US007696342B1

(12) United States Patent
Bentwich

(10) Patent No.: US 7,696,342 B1
(45) Date of Patent: Apr. 13, 2010

(54) BIOINFORMATICALLY DETECTABLE GROUP OF NOVEL VIRAL REGULATORY GENES AND USES THEREOF

(75) Inventor: Itzhak Bentwich, Kfar Daniel (IL)

(73) Assignee: Rosetta Genomics, Ltd., Rehovot (IL)

( * ) Notice: Subject to any disclaimer, the term of this patent is extended or adjusted under 35 U.S.C. 154(b) by 795 days.

(21) Appl. No.: 10/604,945

(22) Filed: Aug. 27, 2003

Related U.S. Application Data

(63) Continuation of application No. 10/303,778, filed on Nov. 26, 2002, now abandoned.

(51) Int. Cl.
*C07H 21/04* (2006.01)
(52) U.S. Cl. .................................... 536/24.5
(58) Field of Classification Search ............... 536/23.1, 536/24.5
See application file for complete search history.

(56) References Cited

U.S. PATENT DOCUMENTS

2001/0053519 A1* 12/2001 Fodor et al. ................... 435/6
2002/0086356 A1   7/2002 Tuschl et al.

FOREIGN PATENT DOCUMENTS

| WO | WO 9312234 A1 * | 6/1993 |
| WO | WO 9623878 A1 * | 8/1996 |
| WO | WO 9850407 A1 * | 11/1998 |
| WO | WO 01/68836 | 9/2001 |
| WO | WO 02/44321 | 6/2002 |

OTHER PUBLICATIONS

Krutzfeldt et al. (2006) Nature Genetics 38:514-519.*
Bentwich et al. (2005) FEBS Lett. 579:5904-5910.*
Martin et al. (2007) J. Biosci. 32:1049-1052.*
Maziere et al. (2007) Drug Discovery Today 12:452-458.*
Smalheiser et al. (2006) Methods Mol. Biol. 342:115-127.*
Lee, R. C., R. L. Feinbaum and V. Ambros. The *C. elegans* heterochronic gene lin-4 encodes small RNAs with antisense complementarity to lin-14 Cell Dec. 3, 1993 843-854 75.
Wightman, B., I. Ha and G. Ruvkun. Posttranscriptional regulation of the heterochronic gene lin-14 by lin-4 mediates temporal pattern formation in *C. elegans* Cell Dec. 3, 1993 855-862 75.
Gallinaro, H., L. Domenjoud and M. Jacob. Structural study of the 5' end of a synthetic premessenger RNA from adenovirus. Evidence for a long-range exon-intron interaction J Mol Biol Jul. 15, 1994 205-225 240.
Lu, C. and R. Bablanian. Characterization of small nontranslated polyadenylylated RNAs in vaccinia virus-infected cells Proc Natl Acad Sci U S A Mar. 5, 1996 2037-2042 93.
Crawford, E. D., E. P. Deantoni, R. Etzioni, V. C. Schaefer, R. M. Olson and C. A. Ross. Serum prostate-specific antigen and digital rectal examination for early detection of prostate cancer in a national community-based program. The Prostate Cancer Education Council Urology Jun. 1996 863-869 47.

Engdahl HM, Hjalt TA, Wagner EG. A two unit antisense RNA cassette test system for silencing of target genes. Nucleic Acids Res. Aug. 15, 1997 3218-27 25.
Smith, D. S., P. A. Humphrey and W. J. Catalona. The early detection of prostate carcinoma with prostate specific antigen: the Washington University experience Cancer Nov. 1, 1997 1852-1856 80.
Dsouza, M., N. Larsen and R. Overbeek. Searching for patterns in genomic data Trends Genet Dec. 1997 497-498 13.
Moss, E. G., R. C. Lee and V. Ambros. The cold shock domain protein LIN-28 controls developmental timing in *C. elegans* and is regulated by the lin-4 RNA Cell 1997 637 88.
Fire, A., S. Xu, M. K. Montgomery, S. A. Kostas, S. E. Driver and C. C. Mello. Potent and specific genetic interference by double-stranded RNA in *Caenorhabditis elegans* Nature Feb. 19, 1998 806-811 391.
Waterhouse, P. M., M. W. Graham and M. B. Wang. Virus resistance and gene silencing in plants can be induced by simultaneous expression of sense and antisense RNA Proc Natl Acad Sci U S A Nov. 10, 1998 13959-13964 95.
Ngo, H., C. Tschudi, K. Gull and E. Ullu. Double-stranded RNA induces mRNA degradation in *Trypanosoma brucei* Proc Natl Acad Sci U S A Dec. 8, 1998 14687-14692 95.
Verma, S. and F. Eckstein. Modified oligonucleotides: synthesis and strategy for users Annu Rev Biochem *No date in Pubmed* 1998 99-134 67.
Wuchty, S., W. Fontana, I. L. Hofacker and P. Schuster. Complete suboptimal folding of RNA and the stability of secondary structures Biopolymers Feb. 1999 145-165 49.
Mathews, D. H., J. Sabina, M. Zuker and D. H. Turner. Expanded sequence dependence of thermodynamic parameters improves prediction of RNA secondary structure J Mol Biol May 21, 1999 911-940 288.
Chang, P. L. Encapsulation for somatic gene therapy Ann N Y Acad Sci Jun. 18, 1999 146-158 875.
Zhang, M. Q. Large-scale gene expression data analysis: a new challenge to computational biologists Genome Res Aug. 1999 681-688 9.
Grisaru, D., M. Sternfeld, A. Eldor, D. Glick and H. Soreq. Structural roles of acetylcholinesterase variants in biology and pathology Eur J Biochem Sep. 1999 672-686 264.
Fire, A. RNA-triggered gene silencing Trends Genet Sep. 1999 358-363 15.

(Continued)

*Primary Examiner*—J. E Angell
(74) *Attorney, Agent, or Firm*—Polsinelli Shughart PC; Teddy C. Scott, Jr.

(57) ABSTRACT

The present invention relates to a group of novel viral RNA regulatory genes, here identified as "viral genomic address messenger genes" or "VGAM genes", and as "genomic record" or "GR" genes. VGAM genes selectively inhibit translation of known host target genes, and are believed to represent a novel pervasive viral attack mechanism. GR genes encode an operon-like cluster of VGAM genes. VGAM and viral GR genes may therefore be useful in diagnosing, preventing and treating viral disease. Several nucleic acid molecules are provided respectively encoding several VGAM genes, as are vectors and probes, both comprising the nucleic acid molecules, and methods and systems for detecting VGAM genes, and for counteracting their activity.

6 Claims, 17 Drawing Sheets

OTHER PUBLICATIONS

Tabara, H., M. Sarkissian, W. G. Kelly, J. Fleenor, A. Grishok, L. Timmons, A. Fire and C. C. Mello. The rde-1 gene, RNA interference, and transposon silencing in *C. elegans* Cell Oct. 15, 1999 123-132 99.

Ryo, A., Y. Suzuki, K. Ichiyama, T. Wakatsuki, N. Kondoh, A. Hada, M. Yamamoto and N. Yamamoto. Serial analysis of gene expression in HIV-1-infected T cell lines FEBS Lett Nov. 26, 1999 182-186 462.

Olsen, P. H. and V. Ambros. The lin-4 regulatory RNA controls developmental timing in *Caenorhabditis elegans* by blocking LIN-14 protein synthesis after the initiation of translation Dev Biol Dec. 15, 1999 671-680 216.

Tuschl, T., P. D. Zamore, R. Lehmann, D. P. Bartel and P. A. Sharp. Targeted mRNA degradation by double-stranded RNA in vitro Genes Dev Dec. 15, 1999 3191-3197 13.

Reinhart, B. J., F. J. Slack, M. Basson, A. E. Pasquinelli, J. C. Bettinger, A. E. Rougvie, H. R. Horvitz and G. Ruvkun. The 21-nucleotide let-7 RNA regulates developmental timing in *Caenorhabditis elegans* Nature Feb. 24, 2000 901-906 403.

Pitt, J. N., J. A. Schisa and J. R. Priess. P granules in the germ cells of *Caenorhabditis elegans* adults are associated with clusters of nuclear pores and contain RNA Dev Biol Mar. 15, 2000 315-333 219.

Hammond, S. M., E. Bernstein, D. Beach and G. J. Hannon. An RNA-directed nuclease mediates post-transcriptional gene silencing in *Drosophila* cells Nature Mar. 16, 2000 293-296 404.

Slack, F. J., M. Basson, Z. Liu, V. Ambros, H. R. Horvitz and G. Ruvkun. The lin-41 RBCC gene acts in the *C. elegans* heterochronic pathway between the let-7 regulatory RNA and the LIN-29 transcription factor Mol Cell Apr. 2000 659-669 5.

Fortier, E. And J. M. Belote. Temperature-dependent gene silencing by an expressed inverted repeat in *Drosophila* Genesis Apr. 2000 240-244 26.

Mourrain, P., C. Beclin, T. Elmayan, F. Feuerbach, C. Codon, J. B. Morel, D. Jouette, A. M. Lacombe, S. Nikic, N. Picault, K. Remoue, M. Sanial, T. A. Vo and H. Vaucheret. *Arabidopsis* SGS2 and SGS3 genes are required for posttranscriptional gene silencing and natural virus resistance Cell May 26, 2000 533-542 101.

Sijen, T. and J. M. Kooter. Post-transcriptional gene-silencing: RNAs on the attack or on the defense? Bioessays Jun. 2000 520-531 22.

Brenner, S., M. Johnson, J. Bridgham, G. Golda, D. H. Lloyd, D. Johnson, S. Luo, S. McCurdy, M. Foy, M. Ewan, R. Roth, D. George, S. Eletr, G. Albrecht, E. Vermaas, S. R. Williams, K. Moon, T. Burcham, M. Pallas, R. B. Dubridge, J. Kirchner, K. Fearon, J. Mao and K. Corcoran. Gene expression analysis by massively parallel signature sequencing (MPSS) on microbead arrays Nat Biotechnol Jun. 2000 630-634 18.

Ryo, A., Y. Suzuki, M. Arai, N. Kondoh, T. Wakatsuki, A. Hada, M. Shuda, K. Tanaka, C. Sato, M. Yamamoto and N. Yamamoto. Identification and characterization of differentially expressed mRNAs in HIV type 1-infected human T cells Aids Res Hum Retroviruses Jul. 1, 2000 995 1005 16.

Nilsson, M., G. Barbany, D. O. Antson, K. Gertow and U. Landegren. Enhanced detection and distinction of RNA by enzymatic probe ligation Nat Biotechnol Jul. 2000 791-793 18.

Kent, W. J. and A. M. Zahler. Conservation, regulation, synteny, and introns in a large-scale *C. briggsae-C. elegans* genomic alignment Genome Res Aug. 2000 1115-1125 10.

Kennerdell, J. R. And R. W. Carthew. Heritable gene silencing in *Drosophila* using double-stranded RNA Nat Biotechnol Aug. 2000 896-898 18.

Smith, N. A., S. P. Singh, M. B. Wang, P. A. Stoutjesdijk, A. G. Green and P. M. Waterhouse. Total silencing by intron-spliced hairpin RNAs Nature Sep. 21, 2000 319-320 407.

Voinnet, O., C. Lederer and D. C. Baulcombe. A viral movement protein prevents spread of the gene silencing signal in *Nicotiana benthamiana* Cell Sep. 29, 2000 157-167 103.

Mette MF, Aufsatz W, van der Winden J, Matzke MA, Matzke AJ. Transcriptional silencing and promoter methylation triggered by double-stranded RNA. EMBO J. Oct. 2, 2000 5194-201 19.

Yang, D., H. Lu and J. W. Erickson. Evidence that processed small dsRNAs may mediate sequence-specific mRNA degradation during RNAI in *Drosophila* embryos Curr Biol Oct. 5, 2000 1191-1200 10.

Anandalakshmi, R., R. Marathe, X. GE, J. M. Herr, Jr., C. Mau, A. Mallory, G. Pruss, L. Bowman and V. B. Vance. A calmodulin-related protein that suppresses posttranscriptional gene silencing in plants Science Oct. 6, 2000 142-144 290.

Fagard, M., S. Boutet, J. B. Morel, C. Bellini and H. Vaucheret. AGO1, QDE-2, and RDE-1 are related proteins required for post-transcriptional gene silencing in plants, quelling in fungi, and RNA interference in animals Proc Natl Acad Sci U S A Oct. 10, 2000 11650-11654 97.

Pasquinelli, A. E., B. J. Reinhart, F. Slack, M. Q. Martindale, M. I. Kuroda, B. Maller, D. C. Hayward, E. E. Ball, B. Degnan, P. Muller, J. Spring, A. Srinivasan, M. Fishman, J. Finnerty, J. Corbo, M. Levine, P. Leahy, E. Davidson and G. Ruvkun. Conservation of the sequence and temporal expression of let-7 heterochronic regulatory RNA Nature Nov. 2, 2000 86-89 408.

Llave, C., K. D. Kasschau and J. C. Carrington. Virus-encoded suppressor of posttranscriptional gene silencing targets a maintenance step in the silencing pathway Proc Natl Acad Sci U S A Nov. 21, 2000 13401-13406 9.

Cogoni, C. and G. Macino. Post-transcriptional gene silencing across kingdoms Curr Opin Genet Dev Dec. 2000 638-643 10.

Elbashir, S. M., W. Lendeckel and T. Tuschl. RNA interference is mediated by 21- and 22-nucleotide RNAs Genes Dev Jan. 15, 2001 188-200 15.

Bernstein, E., A. A. Caudy, S. M. Hammond and G. J. Hannon. Role for a bidentate ribonuclease in the initiation step of RNA interference Nature Jan. 18, 2001 363-366 409.

Vaucheret, H. and M. Fagard. Transcriptional gene silencing in plants: targets, inducers and regulators Trends Genet Jan. 2001 29-35 17.

Thomas, C. L., L. Jones, D. C. Baulcombe and A. J. Maule. Size constraints for targeting post-transcriptional gene silencing and for RNA-directed methylation in *Nicotiana benthamiana* using a potato virus X vector Plant J Feb. 2001 417-425 25.

Galyam, N., D. Grisaru, M. Grifman, N. Melamed-Book, F. Eckstein, S. Seidman, A. Eldor and H. Soreq. Complex host cell responses to antisense suppression of ACHE gene expression Antisense Nucleic Acid Drug Dev Feb. 2001 51-57 11.

Sharp, P. A. RNA interference—2001 Genes Dev Mar. 1, 2001 485-490 15.

Mallory, A. C., L. Ely, T. H. Smith, R. Marathe, R. Anandalakshmi, M. Fagard, H. Vaucheret, G. Pruss, L. Bowman and V. B. Vance. HC-Pro suppression of transgene silencing eliminates the small RNAs but not transgene methylation or the mobile signal Plant Cell Mar. 2001 571-583 13.

Matzke, M. A., A. J. Matzke, G. J. Pruss and V. B. Vance. RNA-based silencing strategies in plants Curr Opin Genet Dev Apr. 2001 221-227 11.

Schisa, J. A., J. N. Pitt and J. R. Priess. Analysis of RNA associated with P granules in germ cells of *C. elegans* adults Development Apr. 2001 1287-1298 128.

Di Serio, F., H. Schob, a. Iglesias, C. Tarina, E. Bouldoires and F. Meins, Jr. Sense- and antisense-mediated gene silencing in tobacco is inhibited by the same viral suppressors and is associated with accumulation of small RNAs Proc Natl Acad Sci U S A May 22, 2001 6506-6510 98.

Elbashir, S. M., J. Harborth, W. Lendeckel, A. Yalcin, K. Weber and T. Tuschl. Duplexes of 21-nucleotide RNAs mediate RNA interference in cultured mammalian cells Nature May 24, 2001 494-498 411.

Piccin, A., A. Salameh, C. Benna, F. Sandrelli, G. Mazzotta, M. Zordan, E. Rosato, C. P. Kyriacou and R. Costa. Efficient and heritable functional knock-out of an adult phenotype in *Drosophila* using a GAL4-driven hairpin RNA incorporating a heterologous spacer Nucleic Acids Res Jun. 15, 2001 E55-55 29.

Vance, V. and H. Vaucheret. RNA silencing in plants—defense and counterdefense Science Jun. 22, 2001 2277-2280 292.

Argaman, L., R. Hershberg, J. Vogel, G. Bejerano, E. G. Wagner, H. Margalit and S. Altuvia. Novel small RNA-encoding genes in the intergenic regions of *Escherichia coli* Curr Biol Jun. 26, 2001 941-950 11.

Grishok, A., A. E. Pasquinelli, D. Conte, N. Li, S. Parrish, I. Ha, D. L. Baillie, A. Fire, G. Ruvkun and C. C. Mello. Genes and mechanisms related to RNA interference regulate expression of the small temporal RNAs that control *C. elegans* developmental timing Cell Jul. 12, 2001 23-34 106.

Hutvagner, G., J. McLachlan, A. E. Pasquinelli, E. Balint, T. Tuschl and P. D. Zamore. A cellular function for the RNA-interference enzyme Dicer in the maturation of the let-7 small temporal RNA Science Aug. 3, 2001 834-838 293.

Hammond, S. M., S. Boettcher, A. A. Caudy, R. Kobayashi and G. J. Hannon. Argonaute2, a link between genetic and biochemical analyses of RNAi Science Aug. 10, 2001 1146-1150 293.

Vaucheret, H., C. Beclin and M. Fagard. Post-transcriptional gene silencing in plants J Cell Sci Sep. 2001 3083-3091 114.

Wesley, S. V., C. A. Helliwell, N. A. Smith, M. B. Wang, D. T. Rouse, Q. Liu, P. S. Gooding, S. P. Singh, D. Abbott, P. A. Stoutjesdijk, S. P. Robinson, A. P. Gleave, A. G. Green and P. M. Waterhouse. Construct design for efficient, effective and high-throughput gene silencing in plants Plant J Sep. 2001 581-590 27.

Mattick, J. S. and M. J. Gagen. The evolution of controlled multitasked gene networks: the role of introns and other noncoding RNAs in the development of complex organisms Mol Biol Evol Sep. 2001 1611-1630 18.

Carter, R. J., I. Dubchak and S. R. Holbrook. A computational approach to identify genes for functional RNAs in genomic sequences Nucleic Acids Res Oct. 1, 2001 3928-3938 29.

Moss, E. G. RNA interference: it's a small RNA world Curr Biol Oct. 2, 2001 R772-775 11.

Ketting, R. F., S. E. Fischer, E. Bernstein, T. Sijen, G. J. Hannon and R. H. Plasterk. Dicer functions in RNA interference and in synthesis of small RNA involved in developmental timing in *C. elegans* Genes Dev Oct. 15, 2001 2654-2659 15.

Ruvkun, G. Molecular biology. Glimpses of a tiny RNA world Science Oct. 26, 2001 797-799 294.

Lee, R. C. And V. Ambros. An extensive class of small RNAs in *Caenorhabditis elegans* Science Oct. 26, 2001 862-864 294.

Lau, N. C., L. P. Lim, E. G. Weinstein and D. P. Bartel. An abundant class of tiny RNAs with probable regulatory roles in *Caenorhabditis elegans* Science Oct. 26, 2001 858-862 294.

Lagos-Quintana, M., R. Rauhut, W. Lendeckel and T. Tuschl. Identification of novel genes coding for small expressed RNAs Science Oct. 26, 2001 853-858 294.

Itaya, A., A. Folimonov, Y. Matsuda, R. S. Nelson and B. Ding. Potato spindle tuber viroid as inducer of RNA silencing in infected tomato Mol Plant Microbe Interact Nov. 2001 1332-1334 14.

Mattick, J. S. Non-coding RNAs: the architects of eukaryotic complexity EMBO Rep Nov. 2001 986-991 2.

Elbashir, S. M., J. Martinez, A. Patkaniowska, W. Lendeckel and T. Tuschl. Functional anatomy of siRNAs for mediating efficient RNAi in *Drosophila melanogaster* embryo lysate Embo J Dec. 3, 2001 6877-6888 20.

Ambros, V. microRNAs: tiny regulators with great potential Cell Dec. 28, 2001 823-826 107.

Blaszczyk, J., J. E. Tropea, M. Bubunenko, K. M. Routzahn, D. S. Waugh, D. L. Court and X. Ji. Crystallographic and modeling studies of RNase III suggest a mechanism for double-stranded RNA cleavage Structure Dec. 2001 1225-1236 9.

Crete, P., S. Leuenberger, V. A. Iglesias, V. Suarez, H. Schob, H. Holtorf, S. Van Eeden and F. Meins. Graft transmission of induced and spontaneous post-transcriptional silencing of chitinase genes Plant J Dec. 2001 493-501 28.

Smallridge, R. A small fortune Nat Rev Mol Cell Biol Dec. 2001 867 2.

Eddy, S. R. Non-coding RNA genes and the modern RNA world Nat Rev Genet Dec. 2001 919-929 2.

Lu, C. M. miRNA bead detection Genaco Biomedical Products PHS 398 2001 1.

Matzke, M., A. J. Matzke and J. M. Kooter. RNA: guiding gene silencing 2001 1080 293.

Grosshans, H. and F. J. Slack. Micro-RNAs: small is plentiful J Cell Biol Jan. 7, 2002 17-21 156.

Meshorer, E., C. Erb, R. Gazit, L. Pavlovsky, D. Kaufer, A. Friedman, D. Glick, N. Ben-Arie and H. Soreq. Alternative splicing and neuritic mRNA translocation under long-term neuronal hypersensitivity Science Jan. 18, 2002 508-512 295.

Paddison, P. J., A. A. Caudy and G. J. Hannon. Stable suppression of gene expression by RNAi in mammalian cells Proc Natl Acad Sci U S A Feb. 5, 2002 1443-1448 99.

Moss, E. G. MicroRNAs: hidden in the genome Curr Biol Feb. 19, 2002 R138-140 12.

Banerjee, D. and F. Slack. Control of developmental timing by small temporal RNAs: a paradigm for RNA-mediated regulation of gene expression Bioessays Feb. 2002 119-129 24.

Elbashir, S. M., J. Harborth, K. Weber and T. Tuschl. Analysis of gene function in somatic mammalian cells using small interfering RNAs Methods Feb. 2002 199-213 26.

Han, Y. and D. Grierson. Relationship between small antisense RNAs and aberrant RNAs associated with sense transgene mediated gene silencing in tomato Plant J Feb. 2002 509-519 29.

Nicholson, R. H. And A. W. Nicholson. Molecular characterization of a mouse cDNA encoding Dicer, a ribonuclease III ortholog involved in RNA interference Mamm Genome Feb. 2002 67-73 13.

Puerta-Fernandez, E., A. Barroso-Deljesus and A. Berzal-Herranz. Anchoring hairpin ribozymes to long target RNAs by loop-loop RNA interactions Antisense Nucleic Acid Drug Dev Feb. 2002 1-9 12.

Giordano, E., R. Rendina, I. Peluso and M. Furia. RNAi triggered by symmetrically transcribed transgenes in *Drosophila melanogaster* Genetics Feb. 2002 637-648 160.

Martens, H., J. Novotny, J. Oberstrass, T. L. Steck, P. Postlethwait and W. Nellen. RNAi in Dictyostelium: the role of RNA-directed RNA polymerases and double-stranded RNase Mol Biol Cell Feb. 2002 445-453 13.

Mourelatos, Z., J. Dostie, S. Paushkin, A. Sharma, B. Charroux, L. Abel, J. Rappsilber, M. Mann and G. Dreyfuss. miRNPs: a novel class of ribonucleoproteins containing numerous microRNAs Genes Dev Mar. 15, 2002 720-728 16.

Seggerson, K., L. Tang and E. G. Moss. Two genetic circuits repress the *Caenorhabditis elegans* heterochronic gene lin-28 after translation initiation Dev Biol Mar. 15, 2002 215-225 243.

Morel, J. B., C. Godon, P. Mourrain, C. Beclin, S. Boutet, F. Feuerbach, F. Proux and H. Vaucheret. Fertile hypomorphic Argonaute (ago1) mutants impaired in post-transcriptional gene silencing and virus resistance Plant Cell Mar. 2002 629-639 14.

Catalanotto, C., G. Azzalin, G. Macino and C. Cogoni. Involvement of small RNAs and role of the qde genes in the gene silencing pathway in Neurospora Genes Dev Apr. 1, 2002 790-795 16.

Boutla, A., K. Kalantidis, N. Tavernarakis, M. Tsagris and M. Tabler. Induction of RNA interference in *Caenorhabditis elegans* by RNAs derived from plants exhibiting post-transcriptional gene silencing Nucleic Acids Res Apr. 1, 2002 1688-1694 30.

Pasquinelli, A. E. And G. Ruvkun. Control of developmental timing by micrornas and their targets Annu Rev Cell Dev Biol Epub Apr. 2, 2002 2002 495-513 18.

Paddison, P. J., A. A. Caudy, E. Bernstein, G. J. Hannon and D. S. Conklin. Short hairpin RNAs (shRNAs) induce sequence-specific silencing in mammalian cells Genes Dev Apr. 15, 2002 948-958 16.

Beclin, C., S. Boutet, P. Waterhouse and H. Vaucheret. A branched pathway for transgene-induced RNA silencing in plants Curr Biol Apr. 16, 2002 684-688 12.

Eddy, S. R. Computational genomics of noncoding RNA genes cell Apr. 19, 2002 137-140 109.

Lagos-Quintana, M., R. Rauhut, A. Yalcin, J. Meyer, W. Lendeckel and T. Tuschl. Identification of tissue-specific microRNAs from mouse Curr Biol Apr. 30, 2002 735-739 12.

Kent, W. J. Blat—the Blast-like alignment tool Genome Res Apr. 2002 656-664 12.

Hutvagner, G. and P. D. Zamore. RNAi: nature abhors a double-strand Curr Opin Genet Dev Apr. 2002 225-232 12.

Nilsson, M., J. Baner, M. Mendel-Hartvig, F. Dahl, D. O. Antson, M. Gullberg and U. Landegren. Making ends meet in genetic analysis using padlock probes Hum Mutat Apr. 2002 410-415 19.

Pasquinelli, A. E. MicroRNAs: deviants no longer Trends Genet Apr. 2002 171-173 18.

Lai, E. C. Micro RNAs are complementary to 3' UTR sequence motifs that mediate negative post-transcriptional regulation Nat Genet Apr. 2002 363-364 30.

Schwarz, D. S. and P. D. Zamore. Why do miRNAs live in the miRNP? Genes Dev May 1, 2002 1025-1031 16.

Brantl, S. Antisense-RNA regulation and RNA interference Biochim Biophys Acta May 3, 2002 15-25 1575.

Li, H., W. X. Li and S. W. Ding. Induction and suppression of RNA silencing by an animal virus Science May 17, 2002 1319-1321 296.

Zamore, P. D. Ancient pathways programmed by small RNAs Science May 17, 2002 1265-1269 296.

Chen, S., E. A. Lesnik, T. A. Hall, R. Sampath, R. H. Griffey, D. J. Ecker and L. B. Blyn. A bioinformatics based approach to discover small RNA genes in the *Escherichia coli* genome Biosystems Mar.-May 2002 157-177 65.

Lee, N. S., T. Dohjima, G. Bauer, H. Li, M. J. Li, A. Ehsani, P. Salvaterra and J. Rossi. Expression of small interfering RNAs targeted against HIV-1 rev transcripts in human cells Nat Biotechnol May 2002 500-505 20.

Draghici, S. Statistical intelligence: effective analysis of high-density microarray data Drug Discov Today Jun. 1, 2002 S55-63 7.

Silhavy, D., A. Molnar, A. Lucioli, G. Szittya, C. Hornyik, M. Tavazza and J. Burgyan. A viral protein suppresses RNA silencing and binds silencing-generated, 21- to 25-nucleotide double-stranded RNAs Embo J Jun. 17, 2002 3070-3080 21.

Ayash-Rashkovsky, M., Z. Weisman, J. Diveley, R. B. Moss, Z. Bentwich and G. Borkow. Generation of Th1 immune responses to inactivated, gp120-depleted HIV-1 in mice with a dominant Th2 biased immune profile via immunostimulatory [correction of imunostimulatory] oligonucleotides—relevance to AIDS vaccines in developing countries Vaccine Jun. 21, 2002 2684-2692 20.

Tabara, H., E. Yigit, H. Siomi and C. C. Mello. The dsRNA binding protein RDE-4 interacts with RDE-1, DCR-1, and a DExH-box helicase to direct RNAi in *C. elegans* Cell Jun. 28, 2002 861-871 109.

Bettencourt, R., O. Terenius and I. Faye. Hemolin gene silencing by ds-RNA injected into *Cecropia pupae* is lethal to next generation embryos Insect Mol Biol Jun. 2002 267-271 11.

Hooper, N. M. and A. J. Turner. The search for alpha-secretase and its potential as a therapeutic approach to Alzheimer s disease Curr Med Chem Jun. 2002 1107-1119 9.

Liu, Q., S. Singh and A. Green. High-oleic and high-stearic cottonseed oils: nutritionally improved cooking oils developed using gene silencing J Am Coll Nutr Jun. 2002 205S-211S 21.

Zeng, Y., E. J. Wagner and B. R. Cullen. Both natural and designed micro RNAs can inhibit the expression of cognate mRNAs when expressed in human cells Mol Cell Jun. 2002 1327-1333 9.

McManus, M. T., C. P. Petersen, B. B. Haines, J. Chen and P. A. Sharp. Gene silencing using micro-RNA designed hairpins Rna Jun. 2002 842-850 8.

Reinhart, B. J., E. G. Weinstein, M. W. Rhoades, B. Bartel and D. P. Bartel. MicroRNAs in plants Genes Dev Jul. 1, 2002 1616-1626 16.

McCaffrey, A. P., L. Meuse, T. T. Pham, D. S. Conklin, G. J. Hannon and M. A. Kay. RNA interference in adult mice Nature Jul. 4, 2002 38-39 418.

Hannon, G. J. RNA interference Nature Jul. 11, 2002 244-251 418.

Dennis, C. The brave new world of RNA Nature Jul. 11, 2002 122-124 418.

Jacque, J. M., K. Triques and M. Stevenson. Modulation of HIV-1 replication by RNA interference Nature Jul. 25, 2002 435-438 418.

Cullen, B. R. RNA interference: antiviral defense and genetic tool Nat Immunol Jul. 2002 597-599 3.

Ma, C. and A. Mitra. Intrinsic direct repeats generate consistent post-transcriptional gene silencing in tobacco Plant J Jul. 2002 37-49 31.

Novina, C. D., M. F. Murray, D. M. Dykxhoorn, P. J. Beresford, J. Riess, S. K. Lee, R. G. Collman, J. Lieberman, P. Shankar and P. A. Sharp. siRNA-directed inhibition of HIV-1 infection Nat Med Jul. 2002 681-686 8.

Pomerantz, R. J. RNA interference meets HIV-1: will silence be golden? Nat Med Jul. 2002 659-660 8.

Zeng, Y. and B. R. Cullen. RNA interference in human cells is restricted to the cytoplasm Rna Jul. 2002 855-860 8.

Xiang, C. C., O. A. Kozhich, M. Chen, J. M. Inman, Q. N. Phan, Y. Chen and M. J. Brownstein. Amine-modified random primers to label probes for DNA microarrays Nat Biotechnol Jul. 2002 738-742 20.

Llave, C., K. D. Kasschau, M. A. Rector and J. C. Carrington. Endogenous and silencing-associated small RNAs in plants Plant Cell Jul. 2002 1605-1619 14.

Rhoades, M. W., B. J. Reinhart, L. P. Lim, C. B. Burge, B. Bartel and D. P. Bartel. Prediction of plant microRNA targets Cell Aug. 23, 2002 513-520 110.

Hipfner, D. R., K. Weigmann and S. M. Cohen. The bantam gene regulates *Drosophila* growth Genetics Aug. 2002 1527-1537 161.

Liu, Q., S. P. Singh and A. G. Green. High-stearic and High-oleic cottonseed oils produced by hairpin RNA-mediated post-transcriptional gene silencing Plant Physiol Aug. 2002 1732-1743 129.

Stoutjesdijk, P. A., S. P. Singh, Q. Liu, C. J. Hurlstone, P. A. Waterhouse and A. G. Green. hpRNA-mediated targeting of the *Arabidopsis FAD2* gene gives highly efficient and stable silencing Plant Physiol Aug. 2002 1723-1731 129.

Suzuma, S., S. Asari, K. Bunai, K. Yoshino, Y. Ando, H. Kakeshita, M. Fujita, K. Nakamura and K. Yaman E. Identification and characterization of novel small RNAs in the aspS-yrvM intergenic region of the *Bacillus subtilis* genome Microbiology Aug. 2002 2591-2598 148.

Milligan, L., T. Forne, E. Antoine, M. Weber, B. Hemonnot, L. Dandolo, C. Brunel and G. Cathala. Turnover of primary transcripts is a major step in the regulation of mouse H19 gene expression EMBO Rep Aug. 2002 774-779 3.

Hamilton, A., O. Voinnet, L. Chappell and D. Baulcombe. Two classes of short interfering RNA in RNA silencing Embo J Sep. 2, 2002 4671-4679 21.

Lee, Y., K. Jeon, J. T. Lee, S. Kim and V. N. Kim. MicroRNA maturation: stepwise processing and subcellular localization Embo J Sep. 2, 2002 4663-4670 21.

Klahre, U., P. Crete, S. A. Leuenberger, V. A. Iglesias and F. Meins, Jr. High molecular weight RNAs and small interfering RNAs induce systemic posttranscriptional gene silencing in plants Proc Natl Acad Sci U S A Sep. 3, 2002 11981-11986 99.

Park, W., J. Li, R. Song, J. Messing and X. Chen. Carpel Factory, a Dicer honlolog, and HEN1, a novel protein, act in microRNA metabolism in *Arabidopsis thaliana* Curr Biol Sep. 3, 2002 1484-1495 12.

Jiang, M. and J. Milner. Selective silencing of viral gene expression in HPV-positive human cervical carcinoma cells treated with siRNA, a primer of RNA interference Oncogene Sep. 5, 2002 6041-6048 21.

Martinez, J., A. Patkaniowska, H. Urlaub, R. Luhrmann and T. Tuschl. Single-stranded antisense siRNAs guide target RNA cleavage in RNAi Cell Sep. 6, 2002 563-574 110.

Allshire, R. Molecular biology. RNAi and heterochromatin—a hushed-up affair Science Sep. 13, 2002 1818-1819 297.

Reinhart, B. J. and D. P. Bartel. Small RNAs correspond to centromere heterochromatic repeats Science Sep. 13, 2002 1831 297.

Volpe, T. A., C. Kidner, I. M. Hall, G. Teng, S. I. Grewal and R. A. Martienssen. Regulation of heterochromatic silencing and histone H3 lysine-9 methylation by RNAi Science Sep. 13, 2002 1833-1837 297.

Baulcombe, D. DNA events. An RNA microcosm Science Sep. 20, 2002 2002-2003 297.

Llave, C., Z. Xie, K. D. Kasschau and J. C. Carrington. Cleavage of Scarecrow-like mRNA targets directed by a class of *Arabidopsis* miRNA Science Sep. 20, 2002 2053-2056 297.

Mochizuki, K., N. A. Fine, T. Fujisawa and M. A. Gorovsky. Analysis of a piwi-related gene implicates small RNAs in genome rearrangement in tetrahymena Cell Sep. 20, 2002 689-699 110.

Hutvagner, G. and P. D. Zamore. A microRNA in a multiple-turnover RNAi enzyme complex Science Sep. 20, 2002 2056-2060 297.

Coburn, G. A. and B. R. Cullen. Potent and specific inhibition of human immunodeficiency virus type 1 replication by RNA interference J Virol Sep. 2002 9225-9231 76.

Caudy, A. A., M. Myers, G. J. Hannon and S. M. Hammond. Fragile X-related protein and VIG associate with the RNA interference machinery Genes Dev Oct. 1, 2002 2491-2496 16.

Ishizuka, A., M. C. Siomi and H. Siomi. A *Drosophila* fragile X protein interacts with components of RNAi and ribosomal proteins Genes Dev Oct. 1, 2002 2497-2508 16.

Voinnet, O. RNA silencing: small RNAs as ubiquitous regulators of gene expression Curr Opin Plant Biol Oct. 2002 444-451 5.

Golden, T. A., S. E. Schauer, J. D. Lang, S. Pien, A. R. Mushegian, U. Grossniklaus, D. W. Meinke and A. Ray. Short Integuments1/

Suspensor1/Carpel Factory, a Dicer homolog, is a maternal effect gene required for embryo development in *Arabidopsis* Plant Physiol Oct. 2002 808-822 130.

Merkle, I., M. J. Van Ooij, F. J. Van Kuppeveld, D. H. Glaudemans, J. M. Galama, A. Henke, R. Zell and W. J. Melchers. Biological significance of a human enterovirus B-specific RNA element in the 3' nontranslated region J Virol Oct. 2002 9900-9909 76.

Froeyen, M. and P. Herdewijn. RNA as a target for drug design, the example of Tat-TAR interaction Curr Top Med Chem Oct. 2002 1123-1145 2.

Carmell, M. A., Z. Xuan, M. Q. Zhang and G. J. Hannon. The Argonaute family: tentacles that reach into RNAi, developmental control, stem cell maintenance, and tumorigenesis Genes Dev Nov. 1, 2002 2733-2742 16.

Provost, P., D. Dishart, J. Doucet, D. Frendewey, B. Samuelsson and O. Radmark. Ribonuclease activity and RNA binding of recombinant human Dicer Embo J Nov. 1, 2002 5864-5874 21.

Zhang, H., F. A. Kolb, V. Brondani, E. Billy and W. Filipowicz. Human Dicer preferentially cleaves dsRNAs at their termini without a requirement for ATP Embo J Nov. 1, 2002 5875-5885 21.

Mallory, A. C., B. J. Reinhart, D. Bartel, V. B. Vance and L. H. Bowman. A viral suppressor of RNA silencing differentially regulates the accumulation of short interfering RNAs and micro-RNAs in tobacco Proc Natl Acad Sci U S A Nov. 12, 2002 15228-15233 99.

Gottesman, S. Stealth regulation: biological circuits with small RNA switches Genes Dev Nov. 15, 2002 2829-2842 16.

Jones, L. Revealing micro-RNAs in plants Trends Plant Sci Nov. 2002 473-475 7.

Schauer, S. E., S. E. Jacobsen, D. W. Meinke and A. Ray. Dicer-Like1: blind men and elephants in *Arabidopsis* development Trends Plant Sci Nov. 2002 487-491 7.

Cohen, O., C. Erb, D. Ginzberg, Y. Pollak, S. Seidman, S. Shoham, R. Yirmiya and H. Soreq. Neuronal overexpression of "readthrough" acetylcholinesterase is associated with antisense-suppressible behavioral impairments Mol Psychiatry *No date in pubmed* 2002 874-885 7.

Mlotshwa, S., O. Voinnet, M. F. Mette, M. Matzke, H. Vaucheret, S. W. Ding, G. Pruss and V. B. Vance. RNA silencing and the mobile silencing signal Plant Cell *No date in pubmed* 2002 S289-301 14 Suppl.

Igarashi T, et al. J Am Soc Nephrol, 2001;12:713-8.

Han et al., Proc Nat Acad Sci USA, 1997;94:4954-9.

Doench JG and Sharp PA. Genes Dev, 2004;18(5):504-11.

Enright AJ, MicroRNA targets in *Drosophila*, Genome Biology 2003;5:R1.

Lewis BP, Prediction of Mammalian MicroRNA Targets, Cell 2003;115:787-98.

Stark A, Identification of *Drosophila* MicroRNA Targets, PLoS Biology 2003;1(3):397-409.

Lai EC, Predicting and validating microRNA targets, Genome Biology 2004;5:115.

Vella MC, Architecture of a validated microRNA::target interaction, Chemistry & Biology 2004;11:1619-23.

Brennecke J, Principles of MicroRNA-target recognition, PLoS Biology 2005;3(3):e85.

MacMillan AM, Dyanamic association of proteins with the pre-mRNA branch region, Genes & Development 1994;8:3008-20.

Das BK, Characterization of a protein complex containing spliceosomal proteins SAPs 49,130, 145, and 155, Mol Cell Biol 1999;19(10):6796-802.

Golas MM, Molecular architecture of the multiprotein splicing factor SF3b, Science 2003;300:980-3.

Lopez AJ, Alternative splicing of pre-mRNA: developmental consequences and mechanisms of regulation. Annu Rev Genet 1998;32:279-305.

Ditella, MC, et al. MAP-1B/TAU functional redundancy during laminin-enhanced axonal growth. Journal of Cell Science, 1996;109:467-77.

* cited by examiner

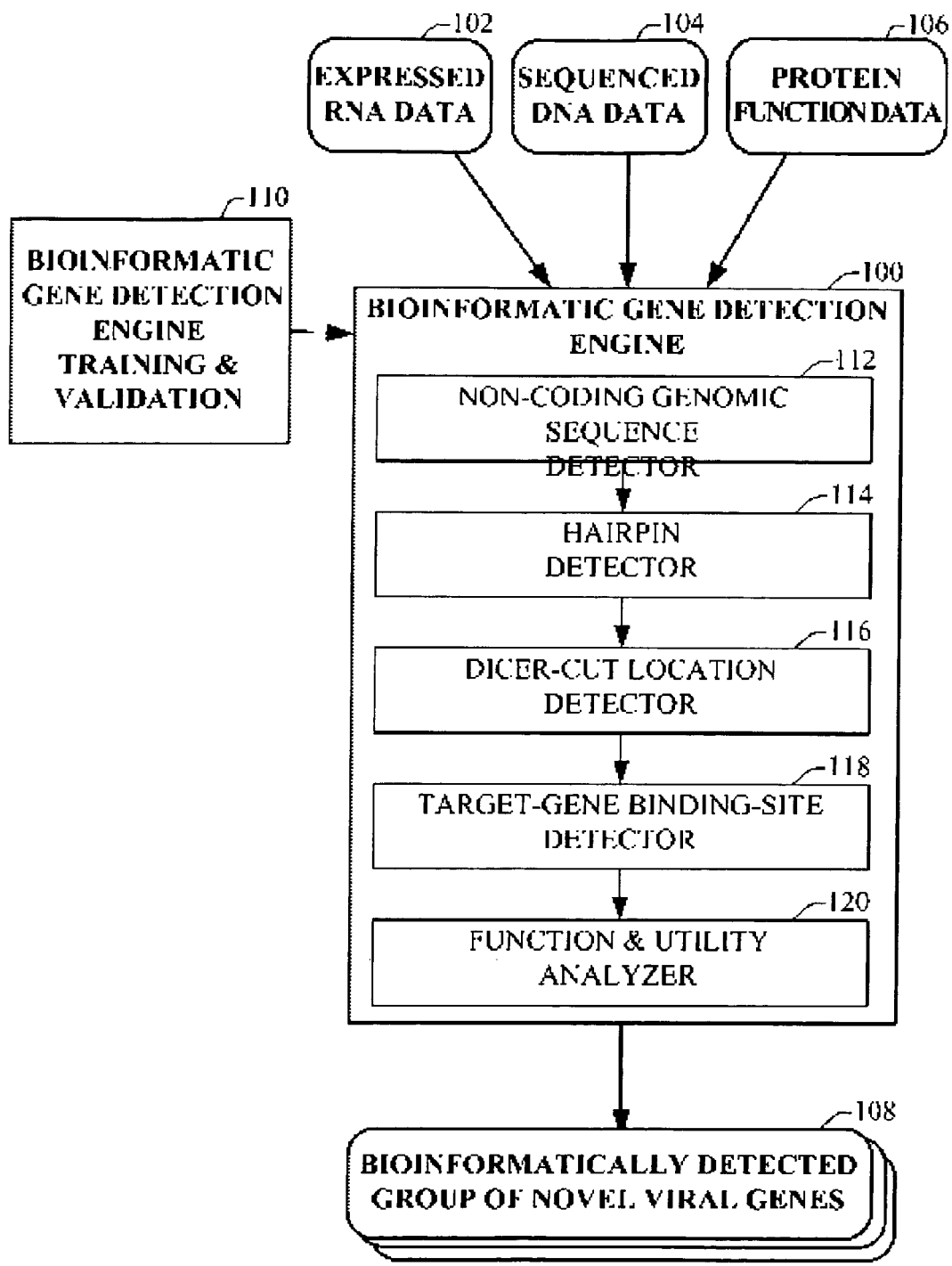

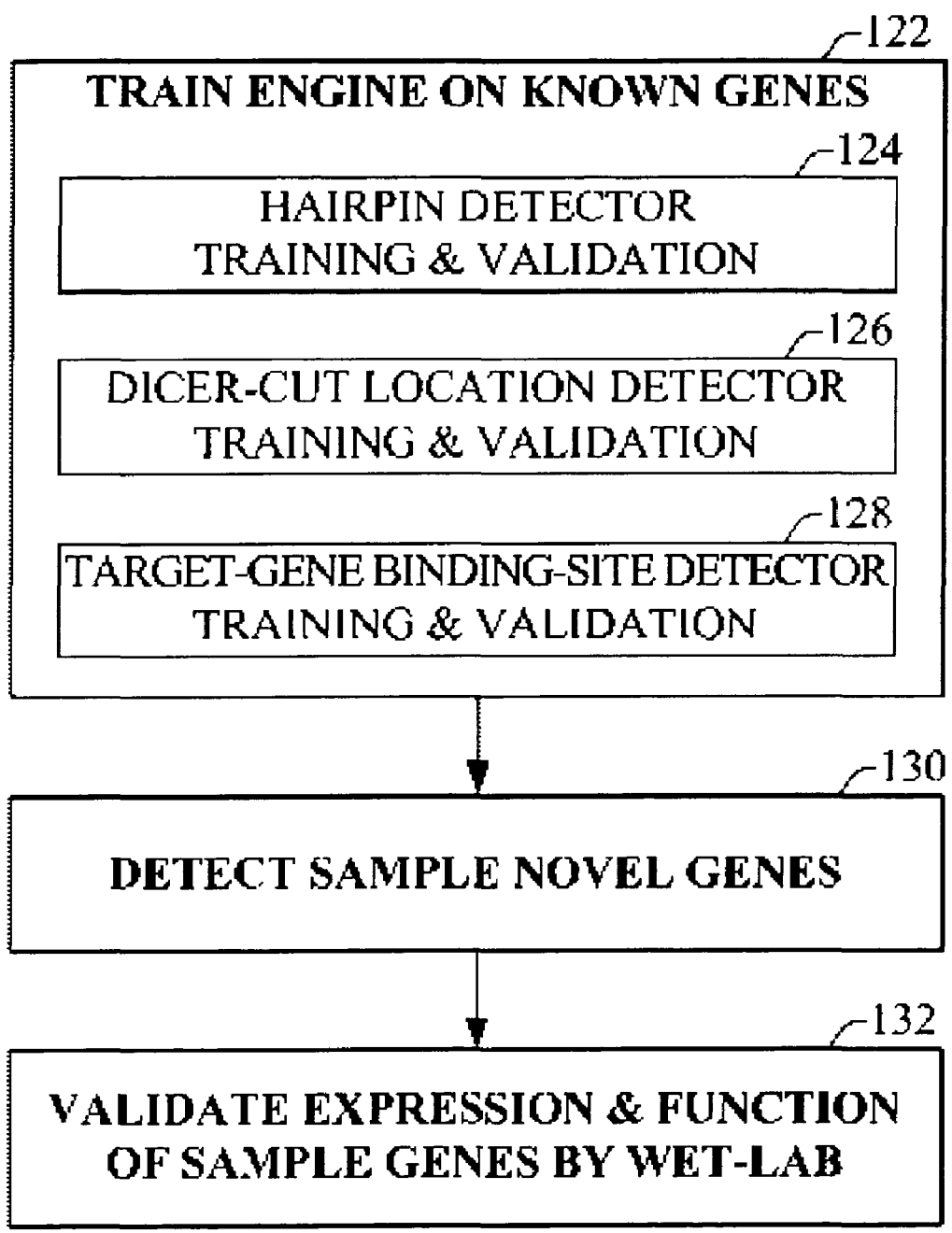

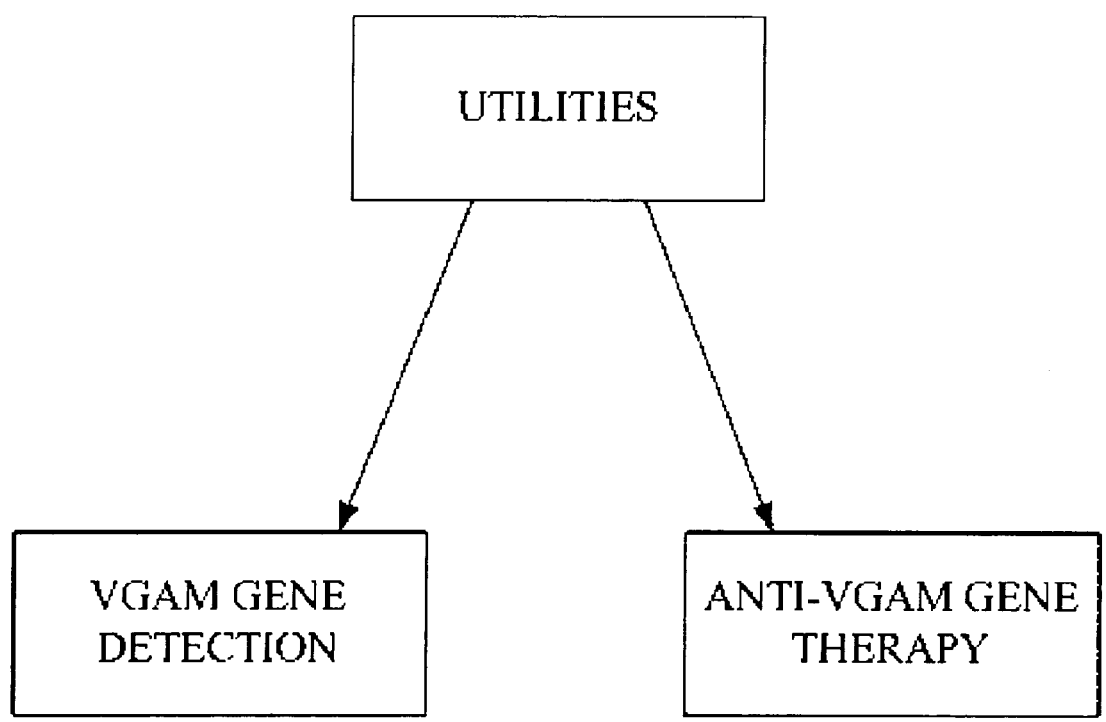

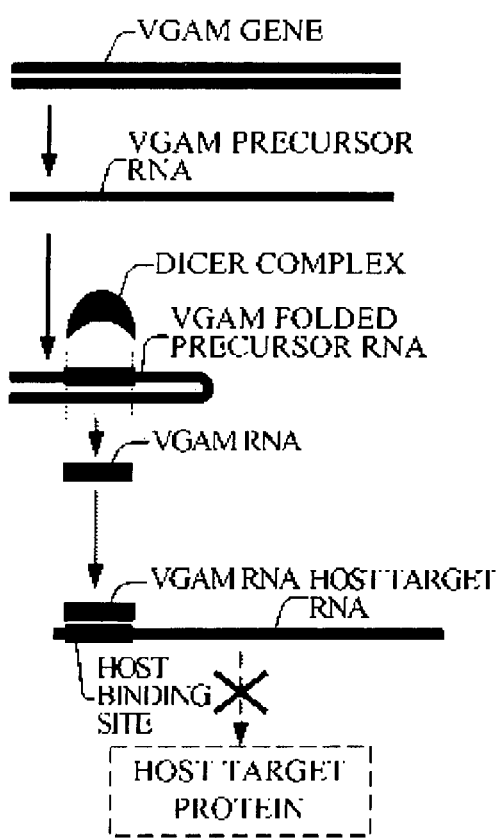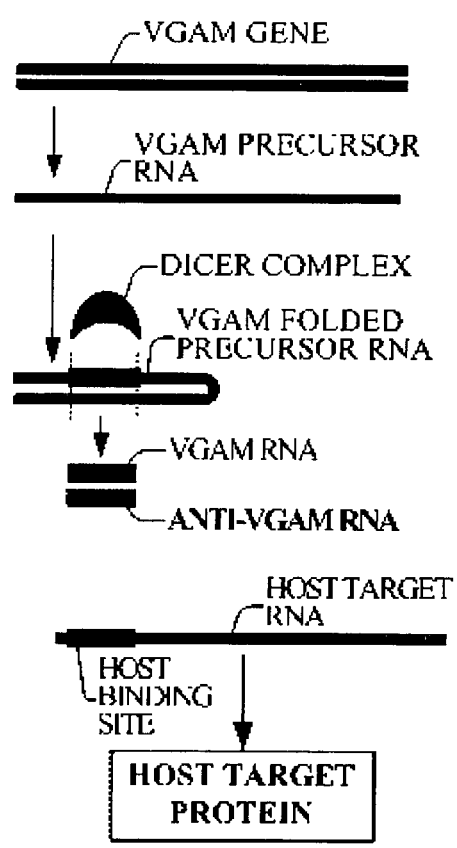
FIG. 11A
FIG. 11B

FIG. 12A

EST72223 sequence:
CCCTTATTAGAGGATTCTGCTCATGCCAGGGTGAGGTAGTAAGTTGT
ATTGTTGTGGGGTAGGGATATTAGGCCCCAATTAGAAGATAACTAT
ACAACTTACTACTTTCCCTGGTGTGTGGCATATTCACACTTAGTCTTA    MIR98
GCAGTGTTGCCTCCATCAGACAAAGTTGTAGATGTTCCTTGGATAATT
TGGACTGGAAGAAAAGAGACATGGAAGGGGACAGATGGTGTTTAGG
GTGAGGCAGATGTCATTATAAAGTGACTTGTCTTTCATTAATTGGAGC
ATATAATTATTTTACCTTTGGGCATGAACTCATTTTGCTATTCTTCAAC
TGTGTAATGATTGCATTTTATTAGTAATAGAACAGGAATGTGTGCAAG
GGAATGGAAAGCATACTTTAAGAATTTTGGGCCAGGCGCGGTGGTTC
ATGCCTGTAATCCCAGCATTTTTGGGAGGCCGAGGCGGGTGGATCA
CCTGAGGTCAGGAGTTCGAGACCAACCTGGCCAACACGGCGAAACC
CCGCCTCTACTCAAATACAAAAATTAGCCAGGCTTGGTGACACTCGC
CTGTGGTCCCAGCTACTCAGGAGGCTGAGGCAGGAGAATTGCTTGA
ACCCAGGAAGTGGAGGCTTCAGTGAGCTGAGAACACGCCACTGCA    GAM24
CTCCAGTCCTGGGCAACAGAGCAAGACTCTGTCTCAGGAAAAAAAA
AG

FIG. 12B

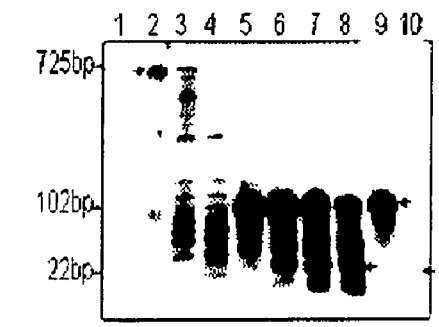

MIR98

FIG. 12C

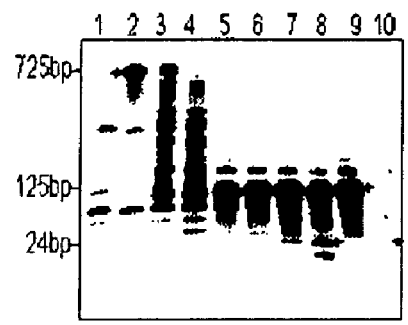

GAM24

FIG. 12D

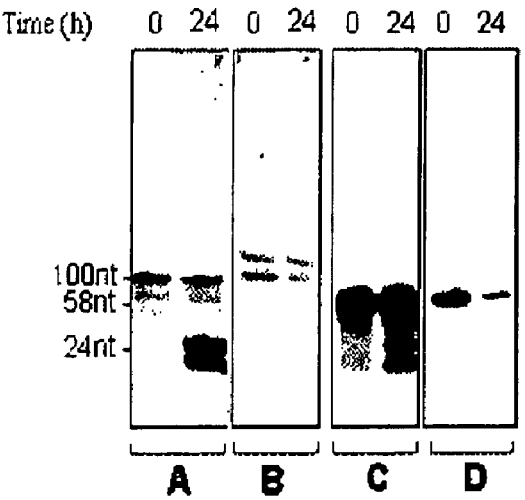

FIG. 13A dbEST Id.7929020(Image4514344) sequence:
```
GCAAAAACTGGAAGCATTCCCTTTGAAAACTGGCACAAGACAGGGATGCCCTCT
CTCACCGCTCCTATTCAACATAGTGTTGCAAGTTCTGCCCACGCCAATTACCCA
GGAGAAGGAAATAAAGGGTATTCAATTAGGAAAAGAGCAAGTCAAATTGTTCCT
GTTTGCAGATGACATGATTGTATATCTAGAAAACCCCATTGTCTCAGCCCAAA
TCTCCTTAAGCTGATAAGCAACTTCAGCAAAGTCTCACCATACAAAATAAATGT
ACAAAAATCACAAGCATTCTTACACACCAACAACAGAAAAACAGAGCCAAATCA
TGAGTGAACTCCCATTCACAATTGCTTCAAGAGAATAAAATACCTAGGAATCC
AACTTACAAGGCATGTGAAGGACCTCTTCAAGGAGAACTACAAACCACTGCTCA
AGGAAATAAAAGAGGATACAAACAAATGGAAGAACATTCCATGCTCATGGGTAG
GAAGAATCAATATTGTGAAAATGGCCATACTGCCCAAGGTAATTTACAGATTCA
ATCCCATCCCCATCAAGCTACCAATCACTTTCTTCACAGAATTGCAAAAAACTA
CTTTAAAGTTCATATGGAACCAAAAAAGAGCCCGCATCGCCAAGTCAATCCTAA
```
<u>GCCAAAAGAACAAAGCTGGAGGCATCACACTACCTGACTTCAAACTTTACTACA</u> GAM23
<u>AGGCTA</u>CAGTAACCAAAACACCATGGTACTGCTACCAAAACACACATATACATC
AATGGAACAGAACAGAGCCCTCAGAAATAACGCCGAATACCTACAACTATCTGA
TCTTTGACAAACCTGAGAAAACAAGCAATGGGGAAGGATTCCCTATTTAATA
AATGCTGCTGGCAAAACTGACTAGCCATATGTACAAAGCTGAAACTGGATCCCT
TCCTTACACCTTATACAAAAATCAATTCAAGATGGATTAAAGATTTAAACGTTA
GACCTAAAACCATAAAAACCCTAGAAGAAAACCTAGGCATTACCATTCAGGACA
TAGGCATGGGCAAGGACTTCATCTCCAAAACACCAAAAGCAATGGCAACAAAAG
ACAAAATTGACAAATGGGATCTAATTAAACTAAAGAGCTTCTGCACAGCAAAAG
AAACTACCATCAGAGTGAACAGGCAACCTACAAAATGGGAGAAAATTTTCGCAA GAM2
CCTACTCATCTGACAAAGGGCTAATATCCACAATCTACAATCAACTCAAACAAA 5
TTTACAAAAAAAAAAAAAAA

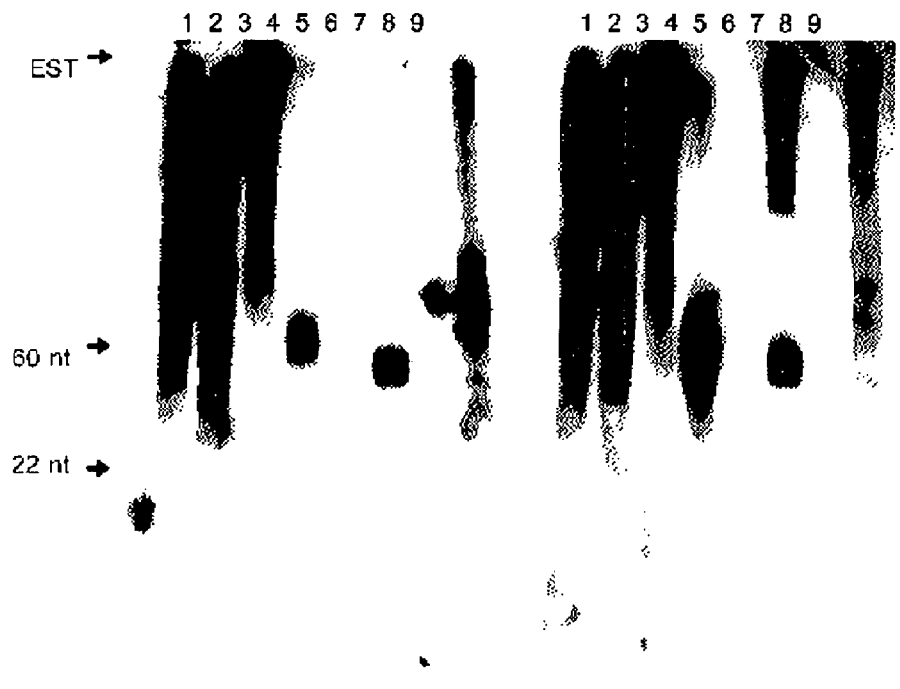

FIG. 13B

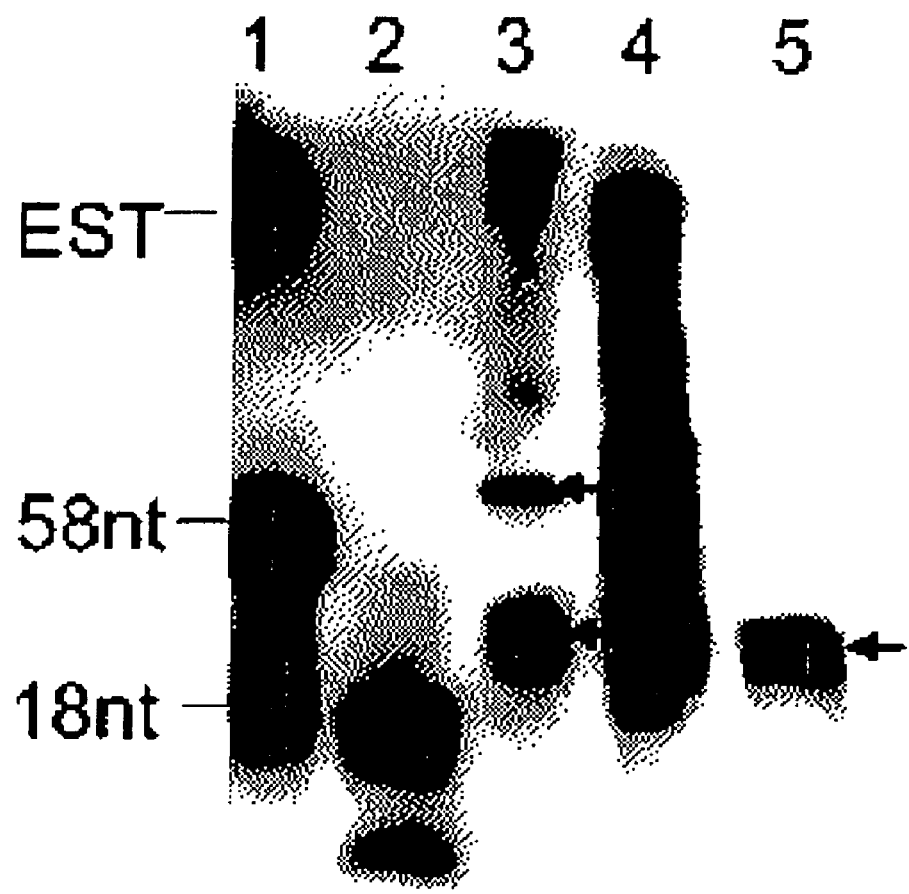

FIG. 14A dbEST Id.1388749 (Imagel020185) Sequence:
ACTCCTATCAACAGTGTAAAAGCATTCCTGTTTCTCCATAATCTTGCCAGCATCTT
TTCATTTTTTTGAATTATAGCCATTCTGACTGTTGTGAGATGGTGTCTCATTGTGG
TTTTGATTTGCATTTCTCAGATGATCAGTGATGTTGAAGTTTTTTTGTTTGTTGGC
TGCATGTATGCCTTCTTTTGAAAAGTGTCTGTTTGTGTCCTTTGACCACTTTCTAA
TGGGGTTGAGTTTTTTTTCTTGTAAATTTGTTTAAGTTCCTTGTAGATGCTGGAT
ATTAGACCTTTGTCAGATGGATAGAGTGCAAAAATTTTCTCCCATTCTGTAGGTTG
TCGGTTTACTCTGTTGATAGGTTCTTAATGCTGTGCAGAAGCTCTTTAGTTTAATT
ACATCCCATTTCTCAATTTTGGCTTTTGTTCCAATTGCTTTTGGCATCTTCGTCAT
GAAATCTTTGCCCTTGCCTGTGTCCTGAATGGCATTGCCTAGGTTTTCTTCCAGGA
TTTTTATAGTTTTGGGTTGTAGATTTAAGTCTTTAATCCATCTTGAGTTAACTTTT
GTATATGGGTTAAGGAAGGGGCCCGTTTCAATTTGCTGCAAATGGCTAGCCAGTTC
TCCAGCACCATTTATTAAATAGGGAATCTTTTCCCATTGCTTCCTTTTGTCAGG
TTTGTCAAAGATCACATGGTTGTAGGTGTGTGGTCTTATTTCTGGGTTCTCTATTC
TGTTCCATTGGGCTATGGGCCGGTTCTGTACCACCACTATGCTGTTTTGGCTACCA
TAGTCTTGTAGAATGTTTGAAGCTGGGTAGCATGATGCCTCTAGCTTTGCTCTTCT
TGCTAAGAAATGTCTTGGCTATTTGGGCTCTTTTTGGTTCCATATGAATTTTAAA
ATAGCTTTTTCTAGGTCTGTAAAGAATCTGAATAGTAGTTTAATGGGCCTACCATT
TAATTTACAGATTGCCTTGGGCAGTGTGGTCATTTTCAGGATATTGATCCTTCCTG
TCTGTGAGCATATGTTTTTCCATTTGTTTGTGTCATCTCTGATTTCTTTGAATAAT GAM
GGTTTATAGTTATCCTTGAAAAGGTCCTTCACTTTTCTTGTTAGCTGTATTCCTAG 26
ATATTATACTCTTCTTGTGGCAATTGTGAATGGGAGTTAATTCATGAGTTTTCTCT
CGGCTTGCCTGTTGTTGGTGTATAGGAATGCTAGTGACTTTTGCACATTGATTTTG
TATCCTGAGACTTTGTTGAAGTTCCTTATCAGCTAAGAAGTTTTTGAGCTGACATG
ATGGAGTTTTCTAGATATAGGATCATATCATCTGCAAACAAAGATAGTTTGACTTC
CTGTCTTCCTATTTGAATAGCTTTTCTTTCTTTCTCTTGCCTGATTGCCTTGGTGA
GAATTTCTAATACTGTGTTGAATAGGAGTGGTGAGCTCGTGCCAA

FIG. 14B

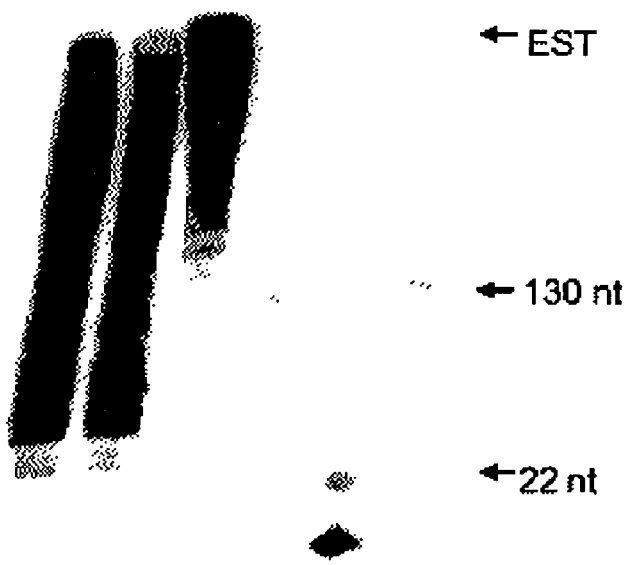

GAM26

BIOINFORMATICALLY DETECTABLE GROUP OF NOVEL VIRAL REGULATORY GENES AND USES THEREOF

BACKGROUND OF INVENTION

1. Field of the Invention

The present invention relates to a group of bioinformatically detectable novel viral RNA regulatory genes, here identified as "viral genomic address messenger" or "VGAM" genes.

2. Description of Prior Art

Small RNAs are known to perform diverse cellular functions, including post-transcriptional gene expression regulation. The first two such RNA genes, Lin-4 and Let-7, were identified by genetic analysis of *Caenorhabditis Elegans* (*Elegans*) developmental timing, and were termed short temporal RNA (stRNA) (Wightman, B., Ha, I., Ruvkun, G., Cell 75, 855 (1993); Erdmann, V. A. et al., Nucleic Acids Res. 29, 189 (2001); Lee, R. C., Feinbaum, R. L., Ambros, V., Cell 75, 843 (1993); Reinhart, B. et al., Nature 403, 901 (2000)).

Lin-4 and Let-7 each transcribe a ~22 nucleotide (nt) RNA, which acts a post transcriptional repressor of target mRNAs, by binding to elements in the 3"-untranslated region (UTR) of these target mRNAs, which are complimentary to the 22 nt sequence of Lin-4 and Let-7 respectively. While Lin-4 and Let-7 are expressed at different developmental stage, first larval stage and fourth larval stage respectively, both specify the temporal progression of cell fates, by triggering post-transcriptional control over other genes (Wightman, B., Ha, I., Ruvkun, G., Cell 75, 855 (1993); Slack et al., Mol. Cell 5,659 (2000)). Let-7 as well as its temporal regulation have been demonstrated to be conserved in all major groups of bilaterally symmetrical animals, from nematodes, through flies to humans (Pasquinelli, A., et al. Nature 408,86 (2000)).

The initial transcription product of Lin-4 and Let-7 is a ~60-80 nt RNA, the nucleotide sequence of the first half of which is partially complimentary to that of its second half, therefore allowing this RNA to fold onto itself, forming a "hairpin structure". The final gene product is a ~22 nt RNA, which is "diced" from the above mentioned "hairpin structure", by an enzyme called Dicer, which also apparently also mediates the complimentary binding of this ~22 nt segment to a binding site in the 3" UTR of its target gene.

Recent studies have uncovered 93 new genes in this class, now referred to as micro RNA or miRNA genes, in genomes of *Elegans, Drosophilea*, and Human (Lagos-Quintana, M., Rauhut, R., Lendeckel, W., Tuschl, T., Science 294,853 (2001); Lau, N. C., Lim, L. P., Weinstein, E. G., Bartel, D. P., Science 294,858 (2001); Lee, R. C., Ambros, V., Science 294,862 (2001). Like the well studied Lin-4 and Let-7, all newly found MIR genes produce a ~60-80 nt RNA having a nucleotide sequence capable of forming a "hairpin structure". Expressions of the precursor ~60-80 nt RNA and of the resulting diced ~22 nt RNA of most of these newly discovered MIR genes have been detected.

Based on the striking homology of the newly discovered MIR genes to their well-studied predecessors Lin-4 and Let-7, the new MIR genes are believed to have a similar basic function as that of Lin-4 and Let-7: modulation of target genes by complimentary binding to the UTR of these target genes, with special emphasis on modulation of developmental control processes. This is despite the fact that the above mentioned recent studies did not find target genes to which the newly discovered MIR genes complementarily bind. While existing evidence suggests that the number of regulatory RNA genes "may turn out to be very large, numbering in the hundreds or even thousands in each genome", detecting such genes is challenging (Ruvkun G., "Perspective: Glimpses of a tiny RNA world", Science 294,779 (2001)).

The ability to detect novel RNA genes is limited by the methodologies used to detect such genes. All RNA genes identified so far either present a visibly discernable whole body phenotype, as do Lin-4 and Let-7 (Wightman et. al., Cell 75, 855 (1993); Reinhart et al., Nature 403, 901 (2000)), or produce significant enough quantities of RNA so as to be detected by the standard biochemical genomic techniques, as do the 93 recently detected miRNA genes. Since a limited number clones were sequenced by the researchers discovering these genes, 300 by Bartel and 100 by Tuschl (Bartel et. al., Science 294,858 (2001); Tuschl et. al., Science 294,853 (2001)), the RNA genes found can not be much rarer than 1% of all RNA genes. The recently detected miRNA genes therefore represent the more prevalent among the miRNA gene family.

Current methodology has therefore been unable to detect RNA genes which either do not present a visually discernable whole body phenotype, or are rare (e.g. rarer than 0.1% of all RNA genes), and therefore do not produce significant enough quantities of RNA so as to be detected by standard biochemical technique. To date, miRNA have not been detected in viruses.

SUMMARY OF INVENTION

The present resent invention relates to a novel group of bioinformatically detectable, viral regulatory RNA genes, which repress expression of host target host genes, by means of complementary hybridization to binding sites in untranslated regions of these host target host genes. It is believed that this novel group of viral genes represent a pervasive viral mechanism of attacking hosts, and that therefore knowledge of this novel group of viral genes may be useful in preventing and treating viral diseases.

In various preferred embodiments, the present invention seeks to provide improved method and system for detection and prevention of viral disease, which is mediated by this group of novel viral genes.

Accordingly, the invention provides several substantially pure nucleic acids (e.g., genomic nucleic acid, cDNA or synthetic nucleic acid) each encoding a novel viral gene of the VGAM group of gene, vectors comprising the nucleic acids, probes comprising the nucleic acids, a method and system for selectively modulating translation of known "target" genes utilizing the vectors, and a method and system for detecting expression of known "target" genes utilizing the probe.

By "substantially pure nucleic acid" is meant nucleic acid that is free of the genes which, in the naturally-occurring genome of the organism from which the nucleic acid of the invention is derived, flank the genes discovered and isolated by the present invention. The term therefore includes, for example, a recombinant nucleic acid which is incorporated into a vector, into an autonomously replicating plasmid or virus, or into the genomic nucleic acid of a prokaryote or eukaryote at a site other than its natural site; or which exists as a separate molecule (e.g., a cDNA or a genomic or cDNA fragment produced by PCR or restriction endonuclease digestion) independent of other sequences. It also includes a recombinant nucleic acid which is part of a hybrid gene encoding additional polypeptide sequence.

"Inhibiting translation" is defined as the ability to prevent synthesis of a specific protein encoded by a respective gene, by means of inhibiting the translation of the mRNA of this gene. "Translation inhibitor site" is defined as the minimal nucleic acid sequence sufficient to inhibit translation.

There is thus provided in accordance with a preferred embodiment of the present invention a bioinformatically detectable novel viral gene encoding substantially pure nucleic acid wherein: RNA encoded by the bioinformatically detectable novel viral gene is about 18 to about 24 nucleotides in length, and originates from an RNA precursor, which RNA precursor is about 50 to about 120 nucleotides in length, a nucleotide sequence of a first half of the RNA precursor is a partial inversed-reversed sequence of a nucleotide sequence of a second half thereof, a nucleotide sequence of the RNA encoded by the novel viral gene is a partial inversed-reversed sequence of a nucleotide sequence of a binding site associated with at least one host target gene, and a function of the novel viral gene is bioinformatically deducible.

There is further provided in accordance with another preferred embodiment of the present invention a method for anti-viral treatment comprising neutralizing said RNA.

Further in accordance with a preferred embodiment of the present invention the neutralizing comprises: synthesizing a complementary nucleic acid molecule, a nucleic sequence of which complementary nucleic acid molecule is a partial inversed-reversed sequence of said RNA, and transfecting host cells with the complementary nucleic acid molecule, thereby complementarily binding said RNA.

Further in accordance with a preferred embodiment of the present invention the neutralizing comprises immunologically neutralizing.

There is still further provided in accordance with another preferred embodiment of the present invention a bioinformatically detectable novel viral gene encoding substantially pure nucleic acid wherein: RNA encoded by the bioinformatically detectable novel viral gene includes a plurality of RNA sections, each of the RNA sections being about 50 to about 120 nucleotides in length, and including an RNA segment, which RNA segment is about 18 to about 24 nucleotides in length, a nucleotide sequence of a first half of each of the RNA sections encoded by the novel viral gene is a partial inversed-reversed sequence of nucleotide sequence of a second half thereof, a nucleotide sequence of each of the RNA segments encoded by the novel viral gene is a partial inversed-reversed sequence of the nucleotide sequence of a binding site associated with at least one target host gene, and a function of the novel viral gene is bioinformatically deducible from the following data elements: the nucleotide sequence of the RNA encoded by the novel viral gene, a nucleotide sequence of the at least one target host gene, and function of the at least one target host gene.

Further in accordance with a preferred embodiment of the present invention the function of the novel viral gene is bioinformatically deducible from the following data elements: the nucleotide sequence of the RNA encoded by the bioinformatically detectable novel viral gene, a nucleotide sequence of the at least one target host gene, and a function of the at least one target host gene.

Still further in accordance with a preferred embodiment of the present invention the RNA encoded by the novel viral gene complementarily binds the binding site associated with the at least one target host gene, thereby modulating expression of the at least one target host gene.

Additionally in accordance with a preferred embodiment of the present invention the binding site associated with at least one target host gene is located in an untranslated region of RNA encoded by the at least one target host gene.

Moreover in accordance with a preferred embodiment of the present invention the function of the novel viral gene is selective inhibition of translation of the at least one target host gene, which selective inhibition includes complementary hybridization of the RNA encoded by the novel viral gene to the binding site.

Further in accordance with a preferred embodiment of the present invention the invention includes a vector including the DNA.

Still further in accordance with a preferred embodiment of the present invention the invention includes a method of selectively inhibiting translation of at least one gene, including introducing the vector.

Moreover in accordance with a preferred embodiment of the present invention the introducing includes utilizing RNAi pathway.

Additionally in accordance with a preferred embodiment of the present invention the invention includes a gene expression inhibition system including: the vector, and a vector inserter, functional to insert the vector into a cell, thereby selectively inhibiting translation of at least one gene.

Further in accordance with a preferred embodiment of the present invention the invention includes a probe including the DNA.

Still further in accordance with a preferred embodiment of the present invention the invention includes a method of selectively detecting expression of at least one gene, including using the probe.

Additionally in accordance with a preferred embodiment of the present invention the invention includes a gene expression detection system including: the probe, and a gene expression detector functional to selectively detect expression of at least one gene.

Further in accordance with a preferred embodiment of the present invention the invention includes an anti-viral substance capable of neutralizing the RNA.

Still further in accordance with a preferred embodiment of the present invention the neutralizing includes complementarily binding the RNA.

Additionally in accordance with a preferred embodiment of the present invention the neutralizing includes immunologically neutralizing.

Moreover in accordance with a preferred embodiment of the present invention the invention includes a method for anti-viral treatment including neutralizing the RNA.

Further in accordance with a preferred embodiment of the present invention the neutralizing includes: synthesizing a complementary nucleic acid molecule, a nucleic sequence of which complementary nucleic acid molecule is a partial inversed-reversed sequence of the RNA, and transfecting host cells with the complementary nucleic acid molecule, thereby complementarily binding the RNA.

Still further in accordance with a preferred embodiment of the present invention the neutralizing includes immunologically neutralizing.

BRIEF DESCRIPTION OF DRAWINGS

Reference is now made to FIG. 1, which is a simplified diagram describing each of a plurality of novel bioinformatically detected viral genes of the present invention, referred to here as Viral Genomic Address Messenger (VGAM) viral genes, which modulates expression of respective host target gene thereof, the function and utility of which host target genes is known in the art. VGAM is a novel bioinformatically detected regulatory, non protein coding, viral micro RNA (miRNA) gene. The method by which VGAM was detected is described hereinabove with reference to FIGS. 2-8. VGAM GENE is a viral gene contained in the genome of a virus.

VGAM HOST TARGET GENE is a human gene contained in the human genome. VGAM GENE encodes a VGAM PRECURSOR RNA. Similar to other miRNA genes, and unlike most ordinary genes, VGAM PRECURSOR RNA does not encode a protein. VGAM PRECURSOR RNA folds onto itself, forming VGAM FOLDED PRECURSOR RNA, which has a two-dimensional 'hairpin structure'. As is well known in the art, this 'hairpin structure', is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By "inversed-reversed" is meant a sequence which is reversed and wherein each nucleotide is replaced by a complementary nucleotide, as is well known in the art (e.g. ATGGC is the inversed-reversed sequence of GCCAT). An enzyme complex designated DICER COMPLEX, 'dices' the VGAM FOLDED PRECURSOR RNA into VGAM RNA, a single stranded ~22 nt long RNA segment. As is known in the art, 'dicing' of a hairpin structured RNA precursor product into a short ~22 nt RNA segment is catalyzed by enzyme complex comprising an enzyme called Dicer together with other necessary proteins. VGAM HOST TARGET GENE encodes a corresponding messenger RNA, VGAM HOST TARGET RNA. VGAM HOST TARGET RNA comprises three regions, as is typical of mRNA of a protein coding gene: a 5' untranslated region, a protein coding region and a 3' untranslated region, designated 5'UTR, PROTEIN CODING and 3'UTR respectively. VGAM RNA binds complementarily to one or more host target binding sites located in untranslated regions of VGAM HOST TARGET RNA. This complementary binding is due to the fact that the nucleotide sequence of VGAM RNA is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting- VGAM RNA may have different number of host target binding sites in untranslated regions of a VGAM HOST TARGET RNA. It is further appreciated that while FIG. 1 depicts host target binding sites in the 3'UTR region, this is meant as an example only—these host target binding sites may be located in the 3'UTR region, the 5'UTR region, or in both 3'UTR and 5'UTR regions. The complementary binding of VGAM RNA to host target binding sites on VGAM HOST TARGET RNA, such as BINDING SITE I, BINDING SITE II and BINDING SITE III, Inhibits translation of VGAM HOST TARGET RNA into VGAM HOST TARGET PROTEIN. VGAM HOST TARGET PROTEIN is therefore outlined by a broken line. It is appreciated that VGAM HOST TARGET GENE in fact represents a plurality of VGAM host target genes. The mRNA of each one of this plurality of VGAM host target genes comprises one or more host target binding sites, each having a nucleotide sequence which is at least partly complementary to VGAM RNA, and which when bound by VGAM RNA causes inhibition of translation of respective one or more VGAM host target proteins. It is further appreciated by one skilled in the art that the mode of translational inhibition illustrated by FIG. 1 with specific reference to translational inhibition exerted by VGAM GENE on one or more VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., 'Perspective: Glimpses of tiny RNA World' Science 294, 779 (2001)). It is yet further appreciated that a function of VGAM is inhibition of expression of host target genes, as part of a novel viral mechanism of attacking a host. Accordingly, utilities of VGAM include diagnosis, prevention and treatment of viral infection by a virus. Specific functions, and accordingly utilities, of VGAM correlate with, and may be deduced from, the identity of the host target genes which VGAM binds and inhibits, and the function of these host target genes, as elaborated hereinbelow. Nucleotide sequences of the VGAM PRECURSOR RNA, and of the 'diced' VGAM RNA and a schematic representation of the secondary folding of VGAM FOLDED PRECURSOR RNA of each of the plurality of VGAM GENEs described by FIG. 1 are further described hereinbelow. For example, nucleotide sequences of host target binding sites, such as BINDING SITE-I, BINDING SITE-II and BINDING SITE III of FIG. 1, found on, and schematic representation of the complementarity of each of these host target binding sites to VGAM RNA (VGAM2191) are described hereinbelow with reference to Table 2.

FIG. 2 is a simplified block diagram illustrating a bioinformatic gene detection system capable of detecting genes of the novel group of genes of the present invention, which system is constructed and operative in accordance with a preferred embodiment of the present invention;

FIG. 3 is a simplified flowchart illustrating operation of a mechanism for training of a computer system to recognize the novel genes of the present invention, which mechanism is constructed and operative in accordance with a preferred embodiment of the present invention;

Figure 8:
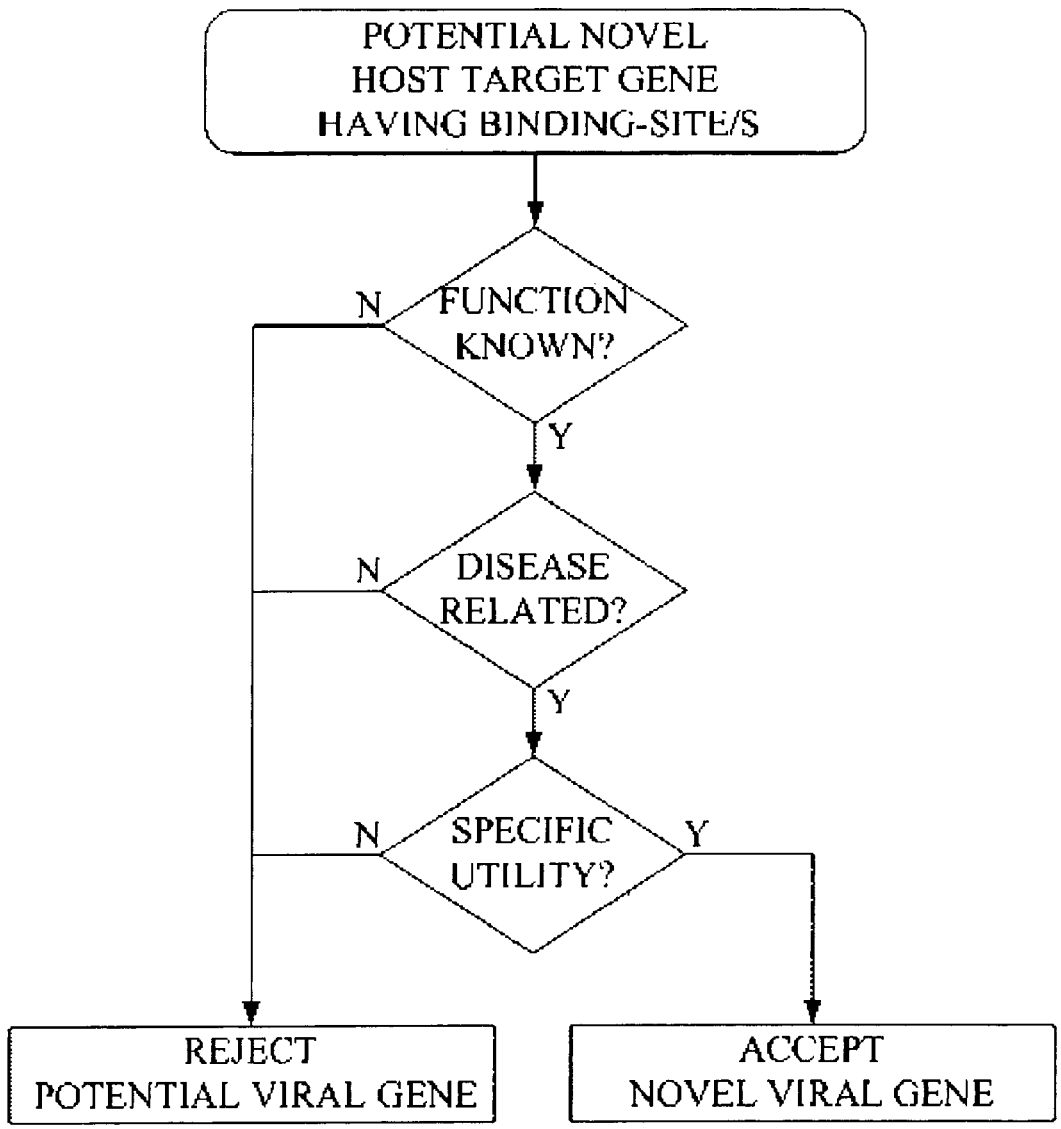
FIG. 8 is a simplified flowchart illustrating operation of a function & utility analyzer constructed and operative in accordance with a preferred embodiment of the present invention.
Figure 9:
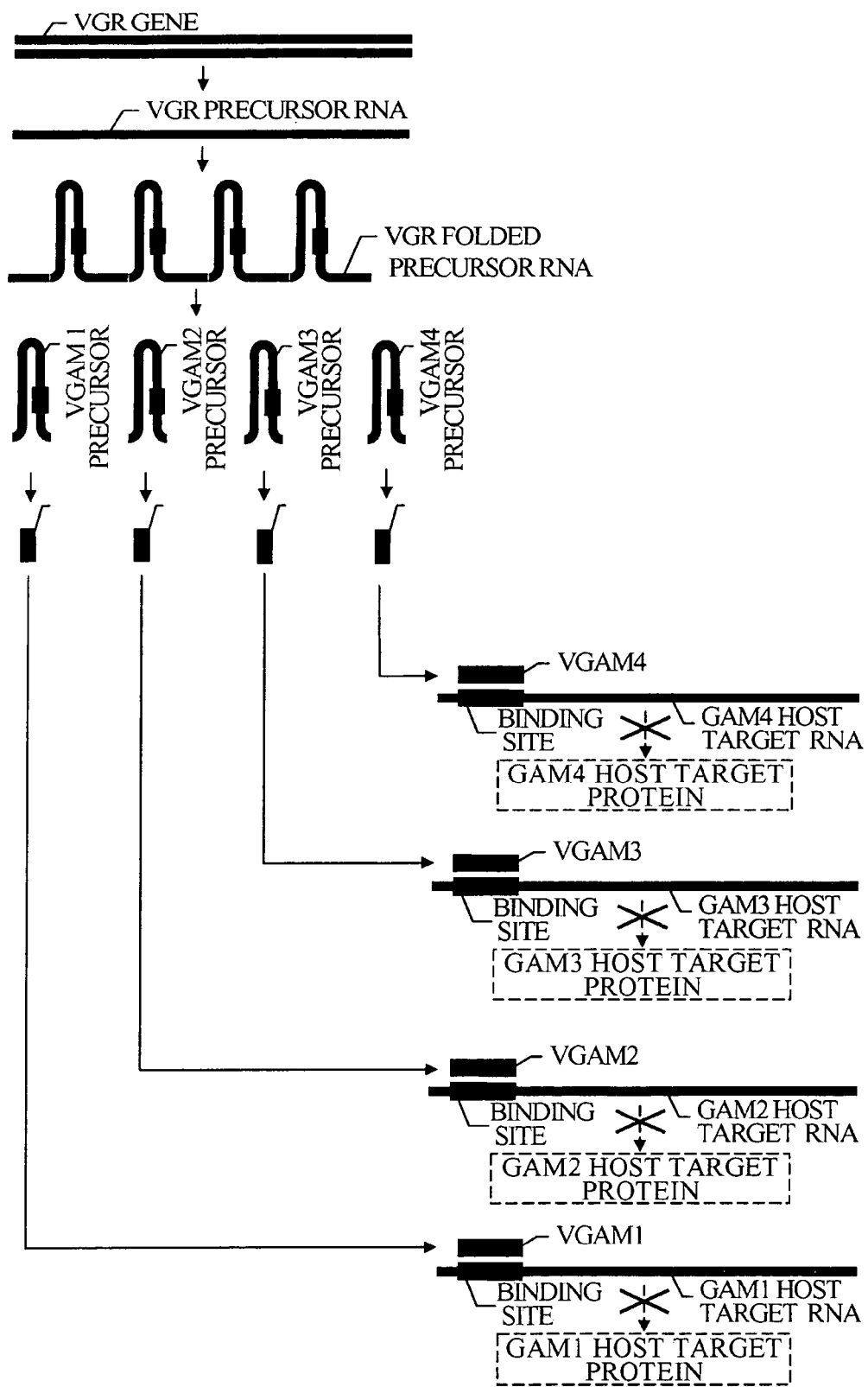

Reference is now made to FIG. 9, which is a simplified diagram describing each of a plurality of novel bioinformatically detected regulatory viral genes, referred hereto as Viral Genomic Record (VGR) viral genes, which encodes an 'operon-like' cluster of novel viral micro RNA-like genes, each of which in turn modulates expression of at least one host target gene, the function and utility of which at least one host target gene is known in the art. VGR GENE is a novel bioinformatically detected regulatory, non protein coding, RNA viral gene. The method by which VGR GENE was detected is described hereinabove with reference to FIGS. 6-14. VGR GENE encodes VGR PRECURSOR RNA, an RNA molecule, typically several hundred nucleotides long. VGR PRECURSOR RNA folds spatially, forming VGR FOLDED PRECURSOR RNA. It is appreciated that VGR FOLDED PRECURSOR RNA comprises a plurality of what is known in the art as 'hairpin' structures. These 'hairpin' structures are due to the fact that the nucleotide sequence of VGR PRECURSOR RNA comprises a plurality of segments, the first half of each such segment having a nucleotide sequence which is at least a partial inversed-reversed sequence of the second half thereof, as is well known in the art. VGR FOLDED PRECURSOR RNA is naturally processed by cellular enzymatic activity into a plurality of separate VGAM precursor RNAs, schematically represented by VGAM1 PRECURSOR, VGAM2 PRECURSOR, VGAM3 PRECURSOR, VGAM4 PRECURSOR, VGAM5 PRECURSOR, VGAM6 PRECURSOR, VGAM7 PRECURSOR, and VGAM8 PRECURSOR, each of which VGAM precursor RNAs being a hairpin shaped RNA segment, corresponding to VGAM PRECURSOR RNA of FIG. 8. The above mentioned VGAM precursor RNA are diced by DICER COMPLEX of FIG. 8, yielding respective short RNA segments of about 22 nucleotides in length, schematically represented as VGAM1 RNA, VGAM2 RNA, VGAM3 RNA, VGAM4 RNA, VGAM5 RNA, VGAM6 RNA, VGAM7 RNA and VGAM8 RNA, respectively, each of which VGAM RNAs corresponding to VGAM RNA to FIG. 8 VGAM1 RNA binds complimentarily to a host target binding site located in an untranslated region of VGAM1 HOST TARGET RNA, which host target binding site corresponds to a host target binding site such as BINDING SITE I, BINDING SITE II or BINDING SITE III of FIG. 10, thereby inhibiting translation of VGAM1 HOST TARGET RNA into VGAM1 HOST TARGET PROTEIN, both of FIG. 10. VGAM2 RNA binds complimentarily to a host target binding site located in an untranslated region of VGAM2 HOST TARGET RNA, which host target binding site corresponds to a host target binding site such as BINDING SITE I, BINDING SITE II, or BINDING SITE III of FIG. 10, thereby inhibiting translation of VGAM2 HOST TARGET RNA into VGAM2 HOST TARGET PROTEIN, both of FIG. 10. VGAM3 RNA binds complimentarily to a host target binding site located in an untranslated region of VGAM3 HOST TARGET RNA, which host target binding site corresponds to a host target binding site such as BINDING SITE I, BINDING SITE II or BINDING SITE III of FIG. 10, thereby inhibiting translation of VGAM3 HOST TARGET RNA into VGAM3 HOST TARGET PROTEIN, both of FIG. 10. VGAM4 RNA binds complimentarily to a host target binding site located in an untranslated region of VGAM4 HOST TARGET RNA, which host target binding site corresponds to a host target binding site such as BINDING SITE I, BINDING SITE II or BINDING SITE III of FIG. 10, thereby inhibiting translation of VGAM4 HOST TARGET RNA into VGAM4 HOST TARGET PROTEIN, both of FIG. 10 VGAM5 RNA binds complimentarily to a host target binding site located in an untranslated region of VGAM5 HOST TARGET RNA, which host target binding site corresponds to a host target binding site such as BINDING SITE I, BINDING SITE II or BINDING SITE III of FIG. 10, thereby inhibiting translation of VGAM5 HOST TARGET RNA into VGAM5 HOST TARGET PROTEIN, both of FIG. 10 VGAM6 RNA binds complimentarily to a host target binding site located in an untranslated region of VGAM6 HOST TARGET RNA, which host target binding site corresponds to a host target binding site such as BINDING SITE I, BINDING SITE II or BINDING SITE III of FIG. 10, thereby inhibiting translation of VGAM6 HOST TARGET RNA into VGAM6 HOST TARGET PROTEIN, both of FIG. 10. VGAM7 RNA binds complimentarily to a host target binding site located in an untranslated region of VGAM7 HOST TARGET RNA, which host target binding site corresponds to a host target binding site such as BINDING SITE I, BINDING SITE. II or BINDING SITE III of FIG. 10, thereby inhibiting translation of VGAM7 HOST TARGET RNA into VGAM7 HOST TARGET PROTEIN, both of FIG. 10. VGAM8 RNA binds complimentarily to a host target binding site located in an untranslated region of VGAM8 HOST TARGET RNA which host target binding site corresponds to a host target binding site such as BINDING SITE I, BINDING SITE II or BINDING SITE III of FIG. 10, thereby inhibiting translation of VGAM8 HOST TARGET RNA into VGAM6 HOST TARGET PROTEIN, both of FIG. 10. It is appreciated that a function of VGR GENE is inhibition of expression of host target genes, as part of a novel viral mechanism of attacking a host. Accordingly, utilities of VGR GENE include diagnosis, prevention and treatment of viral infection by a virus. Specific functions, and accordingly utilities, of VGR GENE correlate with, and may be deduced from, the identity of the host target genes, which are inhibited by VGAM RNA comprised in the 'operon-like' cluster of VGR GENE, schematically represented by VGAM1 HOST TARGET PROTEIN through VGAM8 HOST TARGET PROTEIN.

FIG. 10 is a block diagram illustrating different utilities of genes of a novel group of genes, and operons of a novel group of operons, both of the present invention;

FIGS. 11A and 11B are simplified diagrams, which when taken together illustrate a mode of gene therapy applicable to genes of the novel group of genes of the present invention;

FIG. 12A is an annotated sequence of EST72223 (SEQ ID NO: 45571) comprising novel gene GAM24 detected by the gene detection system of the present invention.

FIGS. 12B and 12C are pictures of laboratory results, which when taken together demonstrate laboratory confirmation of expression of the bioinformatically detected novel gene GAM24 of FIG. 12A;

FIG. 12D provides pictures of laboratory results, which when taken together demonstrate further laboratory confirmation of expression of the bioinformatically detected novel gene GAM24 of FIG. 12A;

FIG. 13A is an annotated sequence of an EST7929020 (SEQ ID NO: 45572) comprising novel genes GAM23 and GAM25 detected by the gene detection system of the present invention;

FIG. 13B is a picture of laboratory results, which confirm expression of bioinformatically detected novel genes GAM23 and GAM25 of FIG. 13A;

FIG. 13C is a picture of laboratory results, which confirm endogenous-expression of bioinformatically detected novel gene GAM25 of FIG. 13A;

FIG. 14A is an annotated sequence of an EST1388749 (SEQ ID NO: 45573) comprising novel gene GAM26 detected by the gene detection system of the present invention;

FIG. 14B is a picture of laboratory results, which confirm expression of the bioinformatically detected novel gene GAM26 of FIG. 14A;

BRIEF DESCRIPTION OF SEQUENCES

A sequence listing of nucleotide sequences of the present invention designated SEQ ID:1 through SEQ ID:45570 is attached to this application, enclosed in computer readable form on CD-ROM, and include nucleotide sequences of 3070 novel genes of the present invention and their respective gene-precursors, and of 39430 target binding sites of these novel genes.

DETAILED DESCRIPTION

Figure 1:
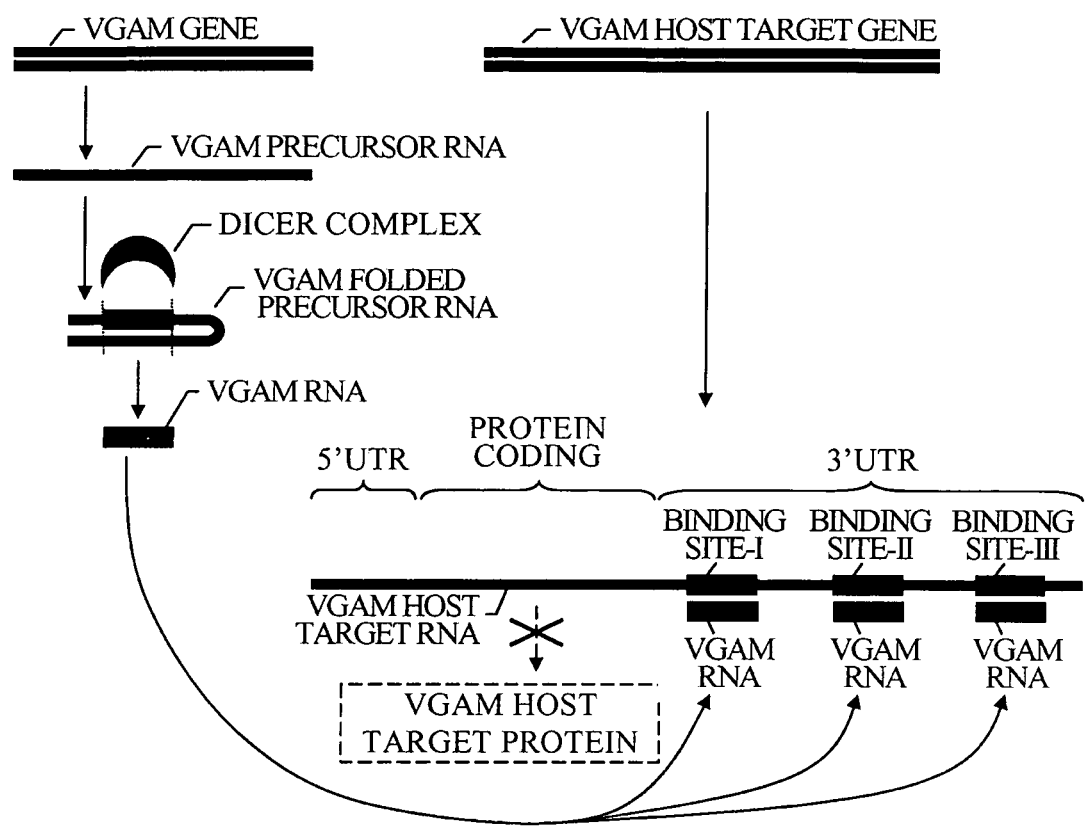

Reference is now made to FIG. 1 which is a simplified diagram illustrating a mode by which genes of a novel group of genes of the present invention, modulate expression of known host target.

The novel genes of the present invention are micro RNA (miRNA)-like, regulatory RNA genes, modulating expression of known host target. This mode of modulation is common to other known miRNA genes, as described hereinabove with reference to the background of the invention section.

VGAM GENE and TARGET GENE are two human genes contained in the DNA of the human genome.

VGAM GENE encodes a VGAM PRECURSOR RNA. However, similar to other miRNA genes, and unlike most ordinary genes, its RNA, VGAM PRECURSOR RNA, does not encode a protein.

VGAM PRECURSOR RNA folds onto itself, forming VGAM FOLDED PRECURSOR RNA. As FIG. 8 illustrates, VGAM FOLDED PRECURSOR RNA forms a "hairpin structure", folding onto itself. As is well known in the art, this "hairpin structure", is typical genes of the miRNA genes, and is due to the fact that nucleotide sequence of the first half of the RNA of a gene in this group is an accurate or partial inversed-reversed sequence of the nucleotide sequence of its second half. By "inversed-reversed" is meant a sequence which is reversed and wherein each nucleotide is replaced by a complimentary nucleotide, as is well known in the art (e.g. ATGGC is the inversed-reversed sequence of GCCAT).

An enzyme complex, designated DICER COMPLEX, "dices" the VGAM FOLDED PRECURSOR RNA into a single stranded RNA segment, about 22 nucleotides long, designated VGAM RNA. As is known in the art, "dicing" of the hairpin structured RNA precursor into shorter RNA segments about 22 nucleotides long by a Dicer type enzyme is catalyzed by an enzyme complex comprising an enzyme called Dicer together with other necessary proteins.

TARGET GENE encodes a corresponding messenger RNA, designated TARGET RNA. This TARGET RNA comprises 3 regions: a 5" untranslated region, a protein coding region and a 3" untranslated region, designated 5"UTR, PROTEIN CODING and 3"UTR respectively.

VGAM RNA binds complementarily a BINDING SITE, located on the 3"UTR segment of TARGET RNA. This complementarily binding is due to the fact that the nucleotide sequence of VGAM RNA is an accurate or partial inversed-reversed sequence of the nucleotide sequence of BINDING SITE.

The complimentary binding of VGAM RNA to BINDING SITE inhibits translation of TARGET RNA into TARGET PROTEIN. TARGET PROTEIN is therefore outlined by a broken line.

It is appreciated by one skilled in the art that the mode of transcriptional inhibition illustrated by FIG. 1 with specific reference to VGAM genes of the present invention, is in fact common to all other miRNA genes. A specific complimentary binding site has been demonstrated only for Lin-4 and Let-7. All the other 93 newly discovered miRNA genes are also believed by those skilled in the art to modulate expression of other genes by complimentary binding, although specific complimentary binding sites for these genes have not yet been found (Ruvkun G., "Perspective: Glimpses of a tiny RNA world", Science 294,779 (2001)). The present invention discloses a novel group of genes, the VGAM genes, belonging to the miRNA genes group, and for which a specific an complimentary binding has been determined.

Reference is now made to FIG. 2 which is a simplified block diagram illustrating a bioinformatic gene detection system capable of detecting genes of the novel group of genes of the present invention, which system is constructed and operative in accordance with a preferred embodiment of the present invention.

A centerpiece of the present invention is a bioinformatic gene detection engine 100, which is a preferred implementation of a mechanism capable of bioinformatically detecting genes of the novel group of genes of the present invention.

The function of the bioinformatic gene detection engine 100 is as follows: it receives three types of input, expressed RNA data 102, sequenced DNA data 104, and protein function data 106, performs a complex process of analysis of this data as elaborated below, and based on this analysis produces output of a bioinformatically detected group of novel genes designated 108.

Expressed RNA data 102 comprises published expressed sequence tags (EST) data, published mRNA data, as well as other sources of published RNA data. Sequenced DNA data 104 comprises alphanumeric data describing sequenced genomic data, which preferably includes annotation data such as location of known protein coding regions relative to the sequenced data. Protein function data 106 comprises scientific publications reporting studies which elucidated physiological function known proteins, and their connection, involvement and possible utility in treatment and diagnosis of various diseases. Expressed RNA data 102, sequenced DNA data 104 may preferably be obtained from data published by the National Center for Bioinformatics (NCBI) at the National Institute of Health (NIH), as well as from various other published data sources. Protein function data 106 may preferably be obtained from any one of numerous relevant published data sources, such as the Online Mendelian Inherited Disease In Man (OMIM) database developed by John Hopkins University, and also published by NCBI.

Prior to actual detection of bioinformatically detected novel genes 108 by the bioinformatic gene detection engine 100, a process of bioinformatic gene detection engine training & validation designated 110 takes place. This process uses the known miRNA genes as a training set (some 200 such genes have been found to date using biological laboratory means), to train the bioinformatic gene detection engine 100 to bioinformatically recognize miRNA-like genes, and their respective potential target binding sites. Bioinformatic gene detection engine training & validation 110 is further describe hereinbelow with reference to FIG. 3.

The bioinformatic gene detection engine 100 comprises several modules which are preferably activated sequentially, and are described as follows:

A non-coding genomic sequence detector 112 operative to bioinformatically detect non-protein coding genomic sequences. The non-coding genomic sequence detector 112 is further described hereinbelow with reference to FIGS. 4A and 4B.

A hairpin detector 114 operative to bioinformatically detect genomic "hairpin-shaped" sequences, similar to VGAM FOLDED PRECURSOR of FIG. 1. The hairpin detector 114 is further described hereinbelow with reference to FIGS. 5A and 5B.

A dicer-cut location detector 116 operative to bioinformatically detect the location on a hairpin shaped sequence which is enzymatically cut by DICER COMPLEX of FIG. 1. The dicer-cut location detector 116 is further described hereinbelow with reference to FIG. 6A.

A target-gene binding-site detector 118 operative to bioinformatically detect host target having binding sites, the nucleotide sequence of which is partially complementary to that of a given genomic sequence, such as a sequence cut by DICER COMPLEX of FIG. 1. The target-gene binding-site detector 118 is further described hereinbelow with reference to FIGS. 7A and 7B.

A function & utility analyzer 120 operative to analyze function and utility of host target, in order to identify host target which have a significant clinical function and utility. The function & utility analyzer 120 is further described hereinbelow with reference to FIG. 8.

Hardware implementation of the bioinformatic gene detection engine 100 is important, since significant computing power is preferably required in order to perform the computation of bioinformatic gene detection engine 100 in reasonable time and cost. As an example, it is estimated that using one powerful 8-processor PC Server, over 30 months of computing time (at 24 hours per day) would be required in order to detect all miRNA genes in human EST data, and their respective binding sites.

For example, in order to address this challenge at reasonable time and cost, a preferred embodiment of the present invention may comprise a cluster of a large number of personal computers (PCs), such as 100 PCs (Pentium IV, 1.7 GHz, with 40 GB storage each), connected by Ethernet to several strong servers, such as 4 servers (2-CPU, Xeon 2.2 GHz, with 200 GB storage each), combined with an 8-processor server (8-CPU, Xeon 550 Mhz w/8 GB RAM) connected via 2 HBA fiber-channels to an EMC Clariion 100-disks, 3.6 Terabyte storage device. Additionally, preferably an efficient database computer program, such as Microsoft™ SQL-Server database computer program is used and is optimized to the specific requirements of bioinformatic gene detection engine 100. Furthermore, the PCs are preferably optimized to operate close to 100% CPU usage continuously, as is known in the art. Using suitable hardware and software may preferably reduce the required calculation time in the abovementioned example from 30 months to 20 days.

It is appreciated that the abovementioned hardware configuration is not meant to be limiting, and is given as an illustration only. The present invention may be implemented in a wide variety of hardware and software configurations.

The present invention discloses 3815 novel viral genes of the VGAM group of genes, which have been detected bioinformatically, as described hereinbelow with reference to Tables 1 and 2 for VGAM2191. Laboratory confirmation of 4 genes of the GAM group of genes is described hereinbelow with reference to FIGS. 12 through 14.

Reference is now made to FIG. 3 which is a simplified flowchart illustrating operation of a mechanism for training of a computer system to recognize the novel genes of the present invention. This mechanism is a preferred implementation of the bioinformatic gene detection engine training & validation 110 described hereinabove with reference to FIG. 2.

Bioinformatic gene detection engine training & validation 110 of FIG. 2 begins by training the bioinformatic gene detection engine to recognize known miRNA genes, as designated by numeral 122. This training step comprises hairpin detector training & validation 124, further described hereinbelow with reference to FIG. 12A, dicer-cut location detector training & validation 126, further described hereinbelow with reference to FIGS. 6A and 6B, and target-gene binding-site detector training & validation 128, further described hereinbelow with reference to FIG. 7A.

Next, the bioinformatic gene detection engine 100 is used to bioinformatically detect sample novel genes, as designated by numeral 130. An example of a sample novel gene thus detected is described hereinbelow with reference to FIG. 12.

Finally, wet lab experiments are preferably conducted in order to validate expression and preferably function the sample novel genes detected by the bioinformatic gene detection engine 100 in the previous step. An example of wet-lab validation of the abovementioned sample novel gene bioinformatically detected by the system is described hereinbelow with reference to FIGS. 13A and 13B.

Figure 4A:
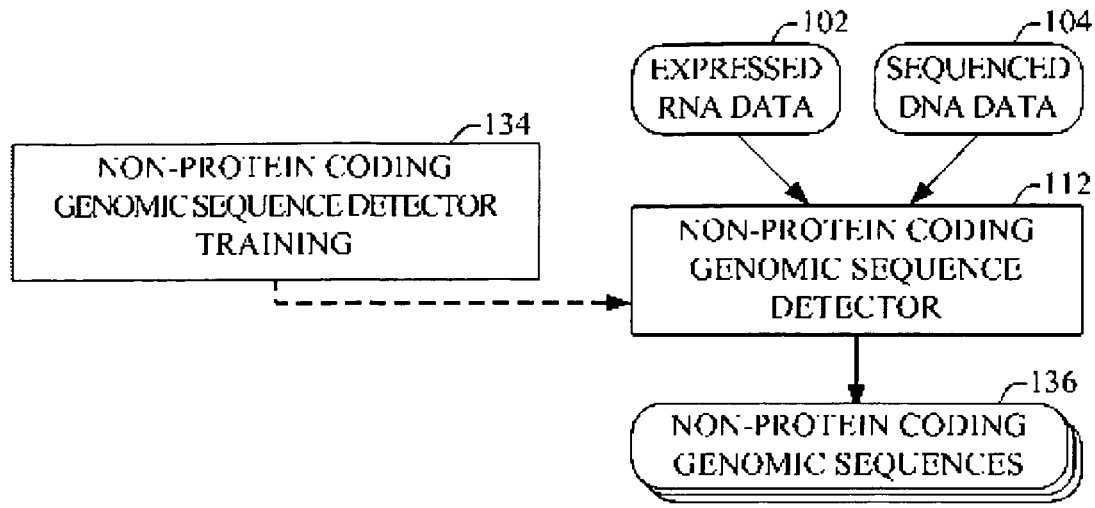
FIG. 4A is a simplified block diagram of a non-coding genomic sequence detector constructed and operative in accordance with a preferred embodiment of the present invention.

Reference is now made to FIG. 4A which is a simplified block diagram of a preferred implementation of the non-coding genomic sequence detector 112 described hereinabove with reference to FIG. 2. Non-protein coding genomic sequence detector 112 of FIG. 2 preferably receives as input at least two types of published genomic data: expressed RNA data 102, including EST data and mRNA data, and sequenced DNA data 104. After its initial training, indicated by numeral 134, and based on the above-mentioned input data, the non-protein coding genomic sequence detector 112 produces as output a plurality of non-protein coding genomic sequences 136. Preferred operation of the non-protein coding genomic sequence detector 112 is described hereinbelow with reference to FIG. 4B.

Figure 4B:
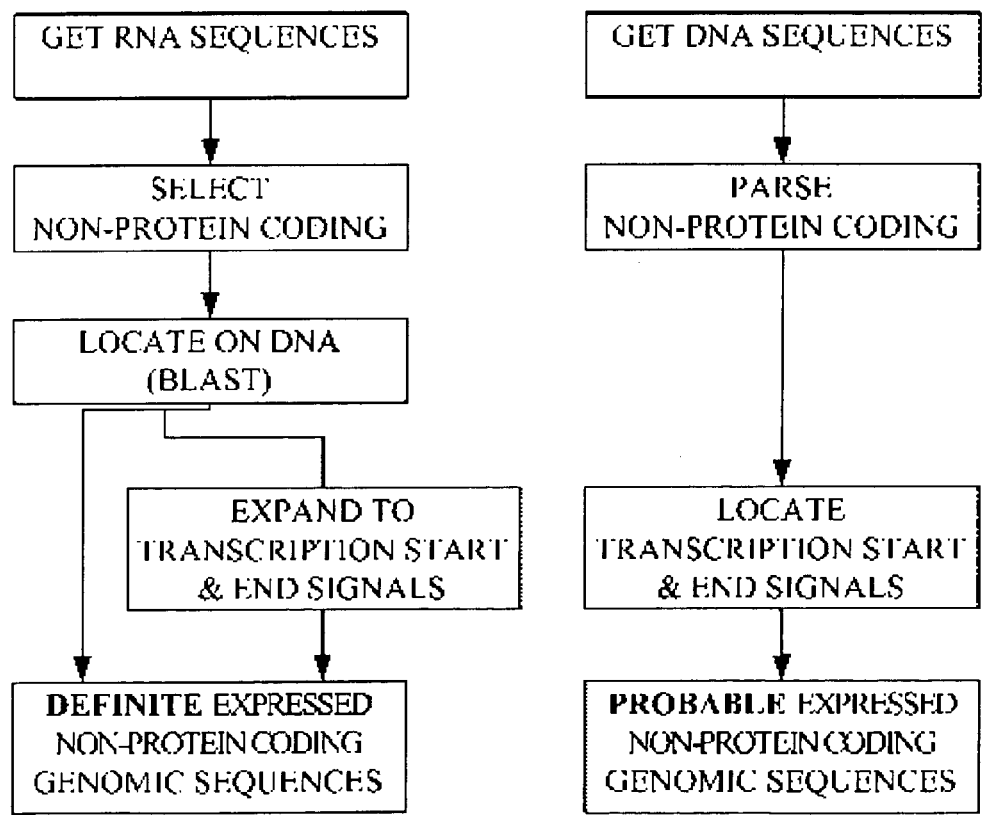
FIG. 4B is a simplified flowchart illustrating operation of a non-coding genomic sequence detector constructed and operative in accordance with a preferred embodiment of the present invention.

Reference is now made to FIG. 4B which is a simplified flowchart illustrating a preferred operation of the non-coding genomic sequence detector 112 of FIG. 2. Detection of non-protein coding genomic sequences to be further analyzed by the system generally preferably progresses in one of the following two paths.

A first path for detecting non-protein coding genomic sequences begins by receiving a plurality of known RNA sequences, such as EST data. Each RNA sequence is first compared to all known protein-coding sequences, in order to select only those RNA sequences which are non-protein coding. This can preferably be performed by BLAST comparison of the RNA sequence to known protein coding sequences. The abovementioned BLAST comparison to the DNA preferably also provides the localization of the RNA on the DNA.

Optionally, an attempt may be made to "expand" the non-protein RNA sequences thus found, by searching for transcription start and end signals, upstream and downstream of location of the RNA on the DNA respectively, as is well known in the art.

A second path for detecting non-protein coding genomic sequences starts by receiving DNA sequences. The DNA sequences are parsed into non protein coding sequences, based on published DNA annotation data: extracting those DNA sequences which are between known protein coding sequences. Next, transcription start and end signals are sought. If such signals are found, and depending on their "strength", probable expressed non-protein coding genomic sequences are yielded.

Figure 5A:
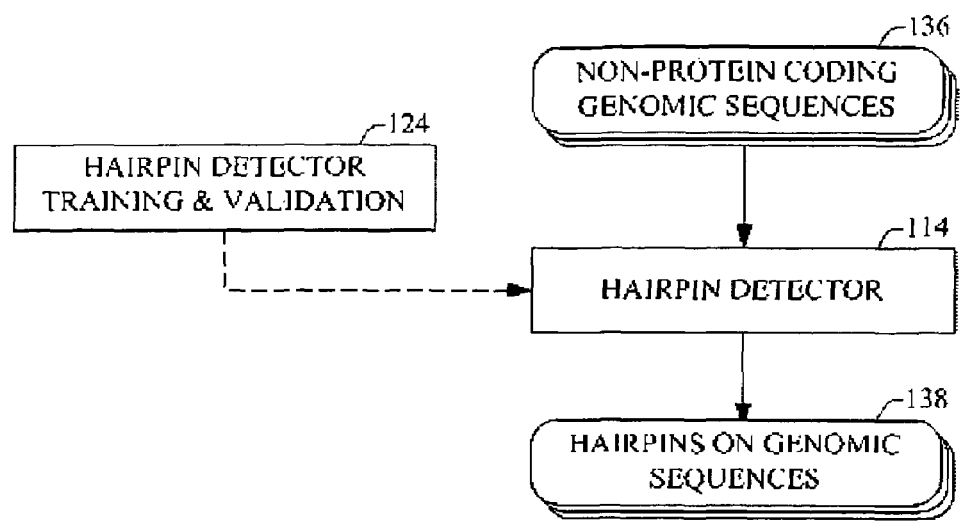
FIG. 5A is a simplified block diagram of a hairpin detector constructed and operative in accordance with a preferred embodiment of the present invention.

Reference is now made to FIG. 5A which is a simplified block diagram of a preferred implementation of the hairpin detector 114 described hereinabove with reference to FIG. 2.

The goal of the hairpin detector 114 is to detect "hairpin" shaped genomic sequences, similar to those of known miRNA genes. As mentioned hereinabove with reference to FIG. 1, a "hairpin" genomic sequence refers to a genomic sequence which "folds onto itself" forming a hairpin like shape, due to the fact that nucleotide sequence of the first half of the nucleotide sequence is an accurate or The hairpin detector 114 of FIG. 2 receives as input a plurality of non-protein coding genomic sequences 136 of FIG. 4A, and after a phase of hairpin detector training & validation 124 of FIG. 3, is operative to detect and output "hairpin shaped" sequences found in the input expressed non-protein coding sequences, designated by numeral 138.

The phase of hairpin detector training & validation 124 is an iterative process of applying the hairpin detector 114 to known hairpin shaped miRNA genes, calibrating the hairpin detector 114 such that it identifies the training set of known hairpins, as well as sequences which are similar thereto. Preferred operation of the hairpin detector 114 is described hereinbelow with reference to FIG. 5B.

Figure 5B:
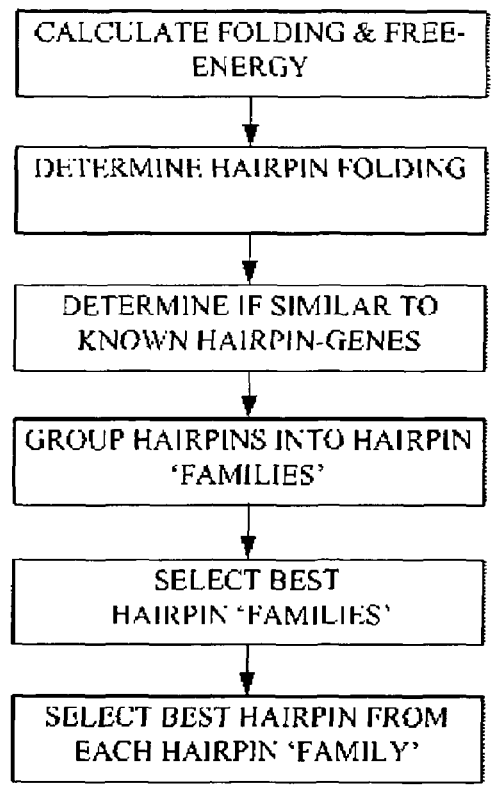
FIG. 5B is a simplified flowchart illustrating operation of a hairpin detector constructed and operative in accordance with a preferred embodiment of the present invention.

Reference is now made to FIG. 5B which is a simplified flowchart illustrating a preferred operation of the hairpin detector 114 of FIG. 2.

A hairpin structure is a two dimensional folding structure, resulting from the nucleotide sequence pattern: the nucleotide sequence of the first half of the hairpin sequence is an inversed-reversed sequence of the second half thereof. Different methodologies are known in the art for detection of various two dimensional and three dimensional hairpin structures.

In a preferred embodiment of the present invention, the hairpin detector 114 initially calculates possible 2-dimensional (2D) folding patterns of a given one of the non-protein coding genomic sequences 136, preferably using a 2D folding algorithm based on free-energy calculation, such as the Zucker algorithm, as is well known in the art.

Next, the hairpin detector 114 analyzes the results of the 2D folding, in order to determine the presence, and location of hairpin structures. A 2D folding algorithm typically provides as output a listing of the base-pairing of the 2D folded shape, i.e. a listing of which all two pairs of nucleotides in the sequence which will bond. The goal of this second step, is to asses this base-pairing listing, in order to determine if it describes a hairpin type bonding pattern.

The hairpin detector 114 then assess those hairpin structures found by the previous step, comparing them to hairpins of known miRNA genes, using various parameters such as length, free-energy, amount and type of mismatches, etc. Only hairpins that bear statistically significant resemblance of the population of hairpins of known miRNAs, according to the abovementioned parameters are accepted.

Lastly, the hairpin detector 114 attempts to select those hairpin structures which are as stable as the hairpins of know miRNA genes. This may be achieved in various manners. A preferred embodiment of the present invention utilizes the following methodology comprising three steps:

First, the hairpin detector 114 attempts to group potential hairpins into "families" of closely related hairpins. As is known in the art, a free-energy calculation algorithm, typically provides multiple "versions" each describing a different possible 2D folding pattern for the given genomic sequence, and the free energy of such possible folding. The hairpin detector 114 therefore preferably assesses all hairpins found on all "versions", grouping hairpins which appear in different versions, but which share near identical locations into a common "family" of hairpins. For example, all hairpins in different versions, the center of which is within 7 nucleotides of each other may preferably be grouped to a single "family".

Next, hairpin "families" are assessed, in order to select only those families which represent hairpins that are as stable as those of known miRNA hairpins. For example, preferably only families which are represented in at least 65% of the free-energy calculation 2D folding versions, are considered stable.

Finally, an attempt is made to select the most suitable hairpin from each selected family. For example, preferably the hairpin which appears in more versions than other hairpins, and in versions the free-energy of which is lower, may be selected.

Figure 6A:
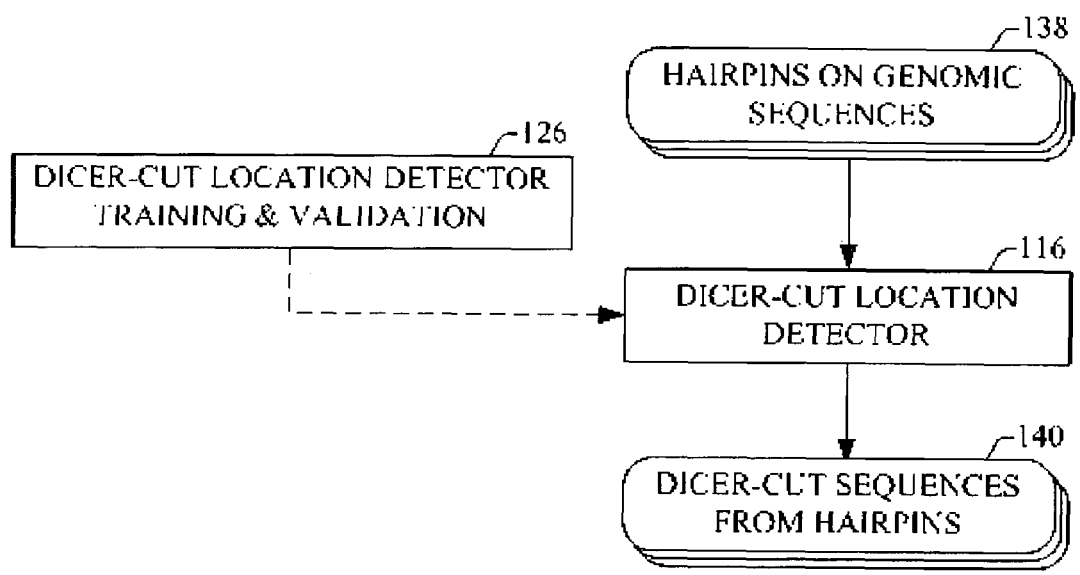
FIG. 6A is a simplified block diagram of a dicer-cut location detector constructed and operative in accordance with a preferred embodiment of the present invention.
Figure 6B:
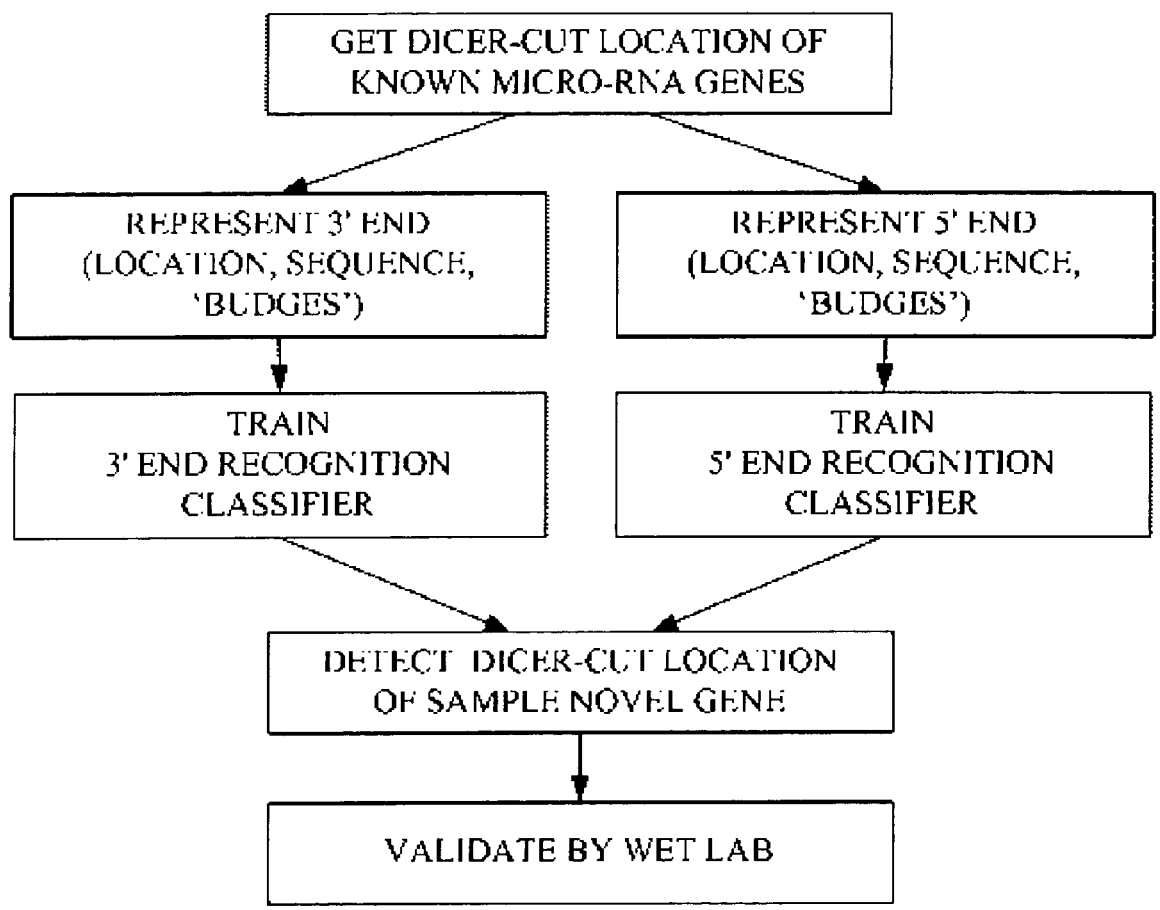
FIG. 6B is a simplified flowchart illustrating training of a dicer-cut location detector constructed and operative in accordance with a preferred embodiment of the present invention.

Reference is now made to FIG. 6A which is a simplified block diagram of a preferred implementation of the dicer-cut location detector 116 described hereinabove with reference to FIG. 2.

The goal of the dicer-cut location detector 116 is to detect the location in which DICER COMPLEX of FIG. 1, comprising the enzyme Dicer, would "dice" the given hairpin sequence, similar to VGAM FOLDED PRECURSOR RNA, yielding VGAM RNA both of FIG. 1.

The dicer-cut location detector 116 of FIG. 2 therefore receives as input a plurality of hairpins on genomic sequences 138 of FIG. 5A, which were calculated by the previous step, and after a phase of dicer-cut location detector training & validation 126 of FIG. 3, is operative to detect a respective plurality of dicer-cut sequences from hairpins 140, one for each hairpin.

In a preferred embodiment of the present invention, the dicer-cut location detector 116 preferably uses a combination of neural networks, Bayesian networks, Markovian modeling, and Support Vector Machines (SVMs) trained on the known dicer-cut locations of known miRNA genes, in order to detect dicer-cut locations. Dicer-cut location detector training & validation 126, which is further described hereinbelow with reference to FIG. 6B.

Figure 6C:
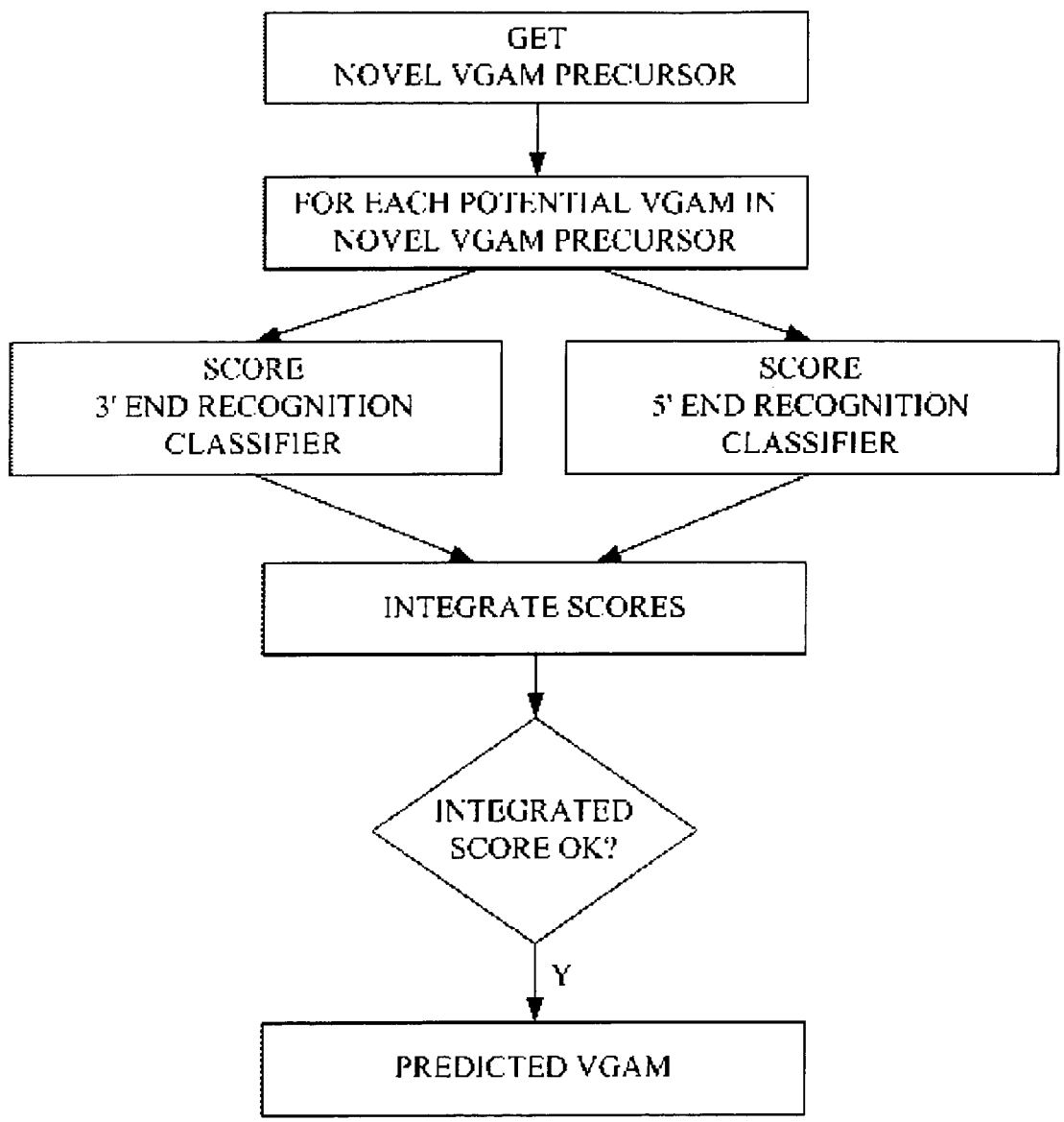
FIG. 6C is a simplified flowchart illustrating prediction of a viral genomic address messenger.

Reference is now made to FIG. 6 B which is a simplified flowchart illustrating a preferred implementation of dicer-cut location detector training & validation 126 of FIG. 3. Dicer-cut location detector 116 first preprocesses known miRNA hairpins and their respective dicer-cut locations, so as to be able to properly analyze them and train the detection system accordingly:

The folding pattern is calculated for each known miRNA, preferably based on free-energy calculation, and the size of the hairpin, the size of the loop at the center of the hairpin, and "bulges" (i.e. mismatched base-pairs) in the folded hairpin are noted.

The dicer-cut location, which is known for known miRNA genes, is noted relative to the above, as well as to the nucleotides in each location along the hairpin. Frequency of identity of nucleotides, and nucleotide-pairing, relative to their location in the hairpin, and relative to the known dicer-cut location in the known miRNA genes is analyzed and modeled.

Different techniques are well known in the art for analysis of existing pattern from a given "training set" of species belonging to a genus, which techniques are then capable, to a certain degree, to detect similar patterns in other species not belonging to the training-set genus. Such techniques include, but are not limited to neural networks, Bayesian networks, Support Vector Machines (SVM), Genetic Algorithms, Markovian modeling, and others, as is well known in the art.

Using such techniques, preferably a combination of several of the above techniques, the known hairpins are represented as a several different networks (such as neural, Bayesian, or SVM) input and output layers. Both nucleotide, and "bulge" (i.e. nucleotide pairing or mismatch) are represented for each position in the hairpin, at the input layer, and a corresponding true/false flag at each position, indicating whether it was diced by dicer at the output layer. Multiple networks are preferably used concurrently, and the results therefrom are integrated and further optimized. Markovian modeling may also be used to validate the results and enhance their accuracy. Finally, the bioinformatic detection of dicer-cut location of a sample novel is confirmed by wet-lab experimentation.

Figure 7A:
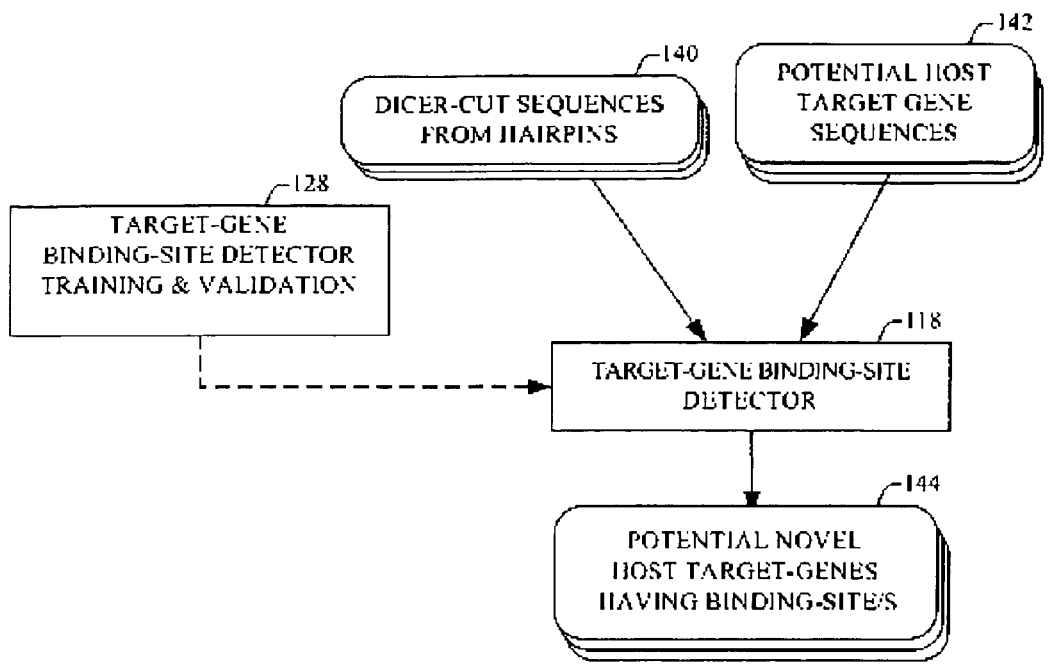
FIG. 7A is a simplified block diagram of a target-gene binding-site detector constructed and operative in accordance with a preferred embodiment of the present invention.

Reference is now made to FIG. 7A which is a simplified block diagram of a preferred implementation of the target-gene binding-site detector 118 described hereinabove with reference to FIG. 2. The goal of the target-gene binding-site detector 118 is to detect a BINDING SITE of FIG. 1, located in an untranslated region of the RNA of a known gene, the nucleotide sequence of which BINDING SITE is at least partially complementary to that of a VGAM RNA of FIG. 1, thereby determining that the abovementioned known gene is a target gene of VGAM of FIG. 1.

The target-gene binding-site detector 118 of FIG. 2 therefore receives as input a plurality of dicer-cut sequences from hairpins 140 of FIG. 6A which were calculated by the previous step, and a plurality of potential target gene sequences 142 which derive sequence DNA data 104 of FIG. 2, and after a phase of target-gene binding-site detector training & validation 128 of FIG. 3, is operative to detect target-genes having binding site/s 144 the nucleotide sequence of which is at least partially complementary to that of each of the plurality of dicer-cut sequences from hairpins 140. Preferred operation of the target-gene binding-site detector is further described hereinbelow with reference to FIG. 7B.

Figure 7B:
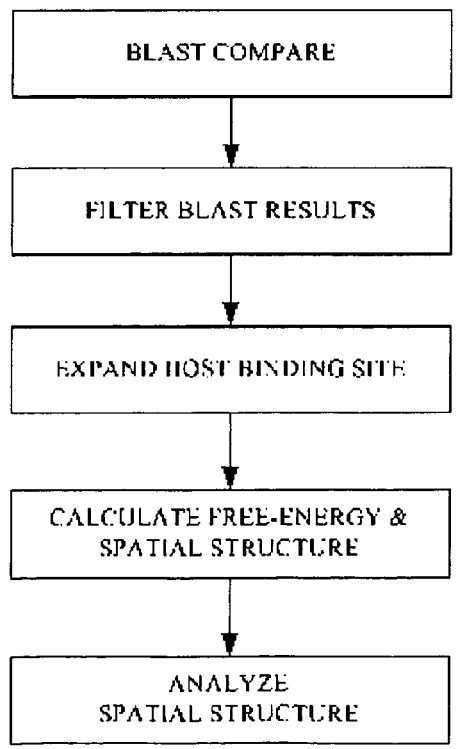
FIG. 7B is a simplified flowchart illustrating operation of a target-gene binding-site detector constructed and operative in accordance with a preferred embodiment of the present invention.

Reference is now made to FIG. 7B which is a simplified flowchart illustrating a preferred operation of the target-gene binding-site detector 118 of FIG. 2. In a preferred embodiment of the present invention, the target-gene binding-site detector 118 first performs a BLAST comparison of the nucleotide sequence of each of the plurality of dicer-cut sequences from hairpins 140, to the potential target gene sequences 142, in order to find crude potential matches. Blast results are then filtered to results which are similar to those of known binding sites (e.g. binding sites of miRNA genes Lin-4 and Let-7 to target genes Lin-14, Lin-41, Lin 28 etc.). Next the binding site is expanded, checking if nucleotide sequenced immediately adjacent to the binding site found by BLAST, may improve the match. Suitable binding sites, then are computed for free-energy and spatial structure. The results are analyzed, selecting only those binding sites, which have free-energy and spatial structure similar to that of known binding sites.

Reference is now made to FIG. 8 which is a simplified flowchart illustrating a preferred operation of the function & utility analyzer 120 described hereinabove with reference to FIG. 2. The goal of the function & utility analyzer 120 is to determine if a potential target gene is in fact a valid clinically useful target gene. Since a potential novel VGAM gene binding a binding site in the UTR of a target gene is understood to inhibit expression of that target gene, and if that target gene is shown to have a valid clinical utility, then in such a case it follows that the potential novel gene itself also has a valid useful function which is the opposite of that of the target gene.

The function & utility analyzer 120 preferably receives as input a plurality of potential novel target genes having binding-site/s 144, generated by the target-gene binding-site detector 118, both of FIG. 7A. Each potential gene, is evaluated as follows:

First the system first checks to see if the function of the potential target gene is scientifically well established.

Preferably, this can be achieved bioinformatically by searching various published data sources presenting information on known function of proteins. Many such data sources exist and are published as is well known in the art.

Next, for those target genes the function of which is scientifically known and is well documented, the system then checks if scientific research data exists which links them to known diseases. For example, a preferred embodiment of the present invention utilizes the OMIM™ database published by NCBI, which summarizes research publications relating to genes which have been shown to be associated with diseases.

Finally, the specific possible utility of the target gene is evaluated. While this process too may be facilitated by bioinformatic means, it might require human evaluation of published scientific research regarding the target gene, in order to determine the utility of the target gene to the diagnosis and or treatment of specific disease. Only potential novel genes, the target-genes of which have passed all three examinations, are accepted as novel genes.

Reference is now made to FIG. 9, which is a simplified diagram describing a novel bioinformatically detected group of regulatory genes, referred to here as Genomic Record (GR) genes, that encode an "operon-like" cluster of novel miRNA-like genes, each modulating expression of a plurality of host target, the function and utility of which target genes is known.

GR GENE (Genomic Record Gene) is gene of a novel, bioinformatically detected group of regulatory, non protein coding, RNA genes. The method by which GR is detected is described hereinabove with reference to FIGS. 6-14.

GR GENE encodes an RNA molecule, typically several hundred nucleotides long, designated GR PRECURSOR RNA.

GR PRECURSOR RNA folds spatially, as illustrated by GR FOLDED PRECURSOR RNA, into a plurality of what is known in the art as "hair-pin" structures. The nucleotide sequence of GR PRECURSOR RNA comprises a plurality of segments, the first half of each such segment having a nucleotide sequence which is at least a partial inversed-reversed sequence of the second half thereof, thereby causing formation of a plurality of "hairpin" structures, as is well known in the art.

GR FOLDED PRECURSOR RNA is naturally processed by cellular enzymatic activity, into 3 separate hairpin shaped RNA segments, each corresponding to VGAM PRECURSOR RNA of FIG. 1, designated VGAM1 PRECURSOR, VGAM2 PRECURSOR and VGAM3 PRECURSOR respectively.

The above mentioned VGAM precursors, are diced by Dicer of FIG. 1, yielding short RNA segments of about 22 nucleotides in length, each corresponding to VGAM RNA of FIG. 1, designated VGAM1, VGAM2 and VGAM3 respectively.

VGAM1, VGAM2 and VGAM3 each bind complementarily to binding sites located in untranslated regions of respective host target, designated VGAM 1-TARGET RNA, VGAM2-TARGET RNA and VGAM3-TARGET RNA respectively. This binding inhibits translation of the respective target proteins designated VGAM1-TARGET PROTEIN, VGAM2-TARGET PROTEIN and VGAM3-TARGET PROTEIN respectively.

The structure of VGAM genes comprised in a GR GENE, and their mode of modulation of expression of their respective target genes is described hereinabove with reference to FIG. 1. The bioinformatic approach to detection of VGAM genes comprised in a GR GENE is described hereinabove with reference to FIGS. 9 through 14.

The present invention discloses 50443 novel viral genes of the GR group of genes, which have been detected bioinformatically, as described hereinbelow with reference to Tables 1 and 2 for VGAM2191. Laboratory confirmation of 3 genes of the GR group of genes is described hereinbelow with reference to FIGS. 9A through 14.

In summary, the current invention discloses a very large number of novel viral GR genes, each of which encodes a plurality of VGAM genes, which in turn may modulate expression of a plurality of host target proteins.

Reference is now made to FIG. 10 which is a block diagram illustrating different utilities of genes of the novel group of genes of the present invention referred to here as VGAM genes and GR genes.

The present invention discloses a first plurality of novel genes referred to here as VGAM genes, and a second plurality of operon-like genes referred to here as GR genes, each of the GR genes encoding a plurality of VGAM genes. The present invention further discloses a very large number of known target genes, which are bound by, and the expression of which is modulated by each of the novel genes of the present invention. Published scientific data referenced by the present invention provides specific, substantial, and credible evidence that the abovementioned target genes modulated by novel genes of the present invention, are associated with various diseases. Specific novel genes of the present invention, target genes thereof and diseases associated therewith, are described hereinbelow with reference to Tables 1 and 2 for VGAM2191. It is therefore appreciated that a function of VGAM genes and GR genes of the present invention is modulation of expression of target genes related to known diseases, and that therefore utilities of novel genes of the present invention include diagnosis and treatment of the above-mentioned diseases. FIG. 10 describes various types of diagnostic and therapeutic utilities of novel genes of the present invention.

A utility of novel genes of the present invention is detection of VGAM genes and of GR genes. It is appreciated that since VGAM genes and GR genes modulate expression of disease related target genes, that detection of expression of VGAM genes in clinical scenarios associated with said diseases is a specific, substantial and credible utility. Diagnosis of novel genes of the present invention may preferably be implemented by RNA expression detection techniques, including but not limited to biochips, as is well known in the art. Diagnosis of expression of genes of the present invention may be useful for research purposes, in order to further understand the connection between the novel genes of the present invention and the abovementioned related diseases, for disease diagnosis and prevention purposes, and for monitoring disease progress.

Another utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. This mode of therapy is particularly useful with respect to target genes which have been shown to be under-expressed in association with a specific disease. Anti-VGAM gene therapy is further discussed hereinbelow with reference to FIGS. 11A and 11B.

A further utility of novel genes of the present invention is VGAM replacement therapy, a mode of therapy which achieves down regulation of a disease related target-gene of a novel VGAM gene of the present invention, by raising levels of the VGAM gene which naturally inhibits expression of that target gene. This mode of therapy is particularly useful with respect to target genes which have been shown to be over-expressed in association with a specific disease. VGAM replacement therapy involves introduction of supplementary VGAM gene products into a cell, or stimulation of a cell to produce excess VGAM gene products. VGAM replacement therapy may preferably be achieved by transfecting cells with an artificial DNA molecule encoding a VGAM gene, which causes the cells to produce the VGAM gene product, as is well known in the art.

Yet a further utility of novel genes of the present invention is modified VGAM therapy. Disease conditions are likely to exist, in which a mutation in a binding site of a VGAM gene prevents natural VGAM gene to effectively bind inhibit a disease related target-gene, causing up regulation of that target gene, and thereby contributing to the disease pathology. In such conditions, a modified VGAM gene is designed which effectively binds the mutated VGAM binding site, i.e. is an effective anti-sense of the mutated VGAM binding site, and is introduced in disease effected cells. Modified VGAM therapy is preferably achieved by transfecting cells with an artificial DNA molecule encoding the modified VGAM gene, which causes the cells to produce the modified VGAM gene product, as is well known in the art.

An additional utility of novel genes of the present invention is induced cellular differentiation therapy. As aspect of the present invention is finding genes which determine cellular differentiation, as described hereinabove with reference to FIG. 11. Induced cellular differentiation therapy comprises transfection of cell with such VGAM genes thereby determining their differentiation as desired. It is appreciated that this approach may be widely applicable, inter alia as a means for auto transplantation harvesting cells of one cell-type from a patient, modifying their differentiation as desired, and then transplanting them back into the patient. It is further appreciated that this approach may also be utilized to modify cell differentiation in vivo, by transfecting cells in a genetically diseased tissue with a cell-differentiation determining VGAM gene, thus stimulating these cells to differentiate appropriately.

Reference is now made to FIGS. 11A and 11B, simplified diagrams which when taken together illustrate anti-VGAM gene therapy mentioned hereinabove with reference to FIG. 10. A utility of novel genes of the present invention is anti-VGAM gene therapy, a mode of therapy which allows up regulation of a disease related target-gene of a novel VGAM gene of the present invention, by lowering levels of the novel VGAM gene which naturally inhibits expression of that target gene. FIG. 11A shows a normal VGAM gene, inhibiting translation of a target gene of VGAM gene, by binding to a BINDING SITE found in an untranslated region of TARGET RNA, as described hereinabove with reference to FIG. 1.

FIG. 11B shows an example of anti-VGAM gene therapy. ANTI-VGAM RNA is short artificial RNA molecule the sequence of which is an anti-sense of VGAM RNA. Anti-VGAM treatment comprises transfecting diseased cells with ANTI-VGAM RNA, or with a DNA encoding thereof. The ANTI-VGAM RNA binds the natural VGAM RNA, thereby preventing binding of natural VGAM RNA to its BINDING SITE. This prevents natural translation inhibition of TARGET RNA by VGAM RNA, thereby up regulating expression of TARGET PROTEIN.

It is appreciated that anti-VGAM gene therapy is particularly useful with respect to target genes which have been shown to be under-expressed in association with a specific disease.

Reference is now made to FIG. 12A which is an annotated sequence of an EST comprising a novel gene detected by the gene detection system of the present invention. FIG. 12A shows the nucleotide sequence of a known human non-protein coding EST (Expressed Sequence Tag), identified as EST72223 (SEQ ID NO: 45571). It is appreciated that the sequence of this EST comprises sequences of one known miRNA gene, identified as MIR98, and of one novel GAM gene, referred to here as GAM24, detected by the bioinformatic gene detection system of the present invention, described hereinabove with reference to FIG. 2.

Reference is now made to FIGS. 12B and 12C that are pictures of laboratory results, which when taken together demonstrate laboratory confirmation of expression of the bioinformatically detected novel gene of FIG. 12A. Reference is now made to FIG. 12B which is a Northern blot analysis of MIR-98 and EST72223 transcripts. MIR-98 and EST72223 were reacted with MIR-98 and GAM24 probes as indicated in the figure. It is appreciated that the probes of both MIR-98 and GAM24 reacted with EST72223, indicating that EST72223 contains the sequences of MIR-98 and of GAM24. It is further appreciated that the probe of GAM24 does not cross-react with MIR-98.

Reference is now made to FIG. 12C. A Northern blot analysis of EST72223 and MIR-98 transfections were performed, subsequently marking RNA by the MIR-98 and GAM24 probes. Left, Northern reacted with MIR-98, Right, Northern reacted with GAM24. The molecular Sizes of EST72223, MIR-98 and GAM24 are indicated by arrows. Hela are control cells that have not been introduced to exogenous RNA. EST and MIR-98 Transfections are RNA obtained from Hela transfected with EST72223 and MIR-98, respectively. MIR-98 and EST are the transcripts used predicted precursor hairpins by using a DIG RNA labeling kit (Roche Molecular Biochemicals) according to the manufacturer's protocol. Briefly, PCR products with T7 promoter at the 5" end or T3 promoter at the 3"end were prepared from each DNA in order to use it as a template to prepare sense and antisense transcripts, respectively. MIR-98 was amplified using EST72223 as a template with T7miR98 forward primer: 5-"TAATACGACTCACTATAGGGTGAGGTAG-TAAGTTGTA TT GTT-3" (SEQ ID NO: 45574) and T3miR98 reverse primer: 5"-AATTAACCCTCAC-TAAAGGGAAAGTAGTA AGTTGTATAGTT-3" (SEQ ID NO: 45575). EST72223 was amplified with T7-EST72223 forward primer: 5"-TAATAC GACTCACTATAGGCCCT-TATTAGAGGATTCTGCT-3" (SEQ ID NO: 45576) and T3-EST72223 reverse primer: 5"-AATTAACCCTCAC-TAAAGGTTTTCCTGAGACAGAGT-3" (SEQ ID NO: 45577). Bet-4 was amplified using EST72223 as a template with Bet-4 forward primer: 5"-GAGGCAGGAGAATGCT-TGA-3" (SEQ ID NO: 45578) and T3-EST72223 reverse primer: 5"-AATTAACCCTCACTAA AGGCCTGAGACA-GAGTCTTGCTC-3" (SEQ ID NO: 45579). The PCR products were cleaned and used for DIG-labeled or unlabeled transcription reactions with the appropriate polymerase. For transfection experiments, for the transfection experiment. The results indicate that EST72223, when transfected into Hela cells, is cut yielding known miRNA gene MIR-98 and novel miRNA gene GAM24.

Reference is now made to FIG. 12D, which is a Northern blot of a lisate experiment with MIR-98 and GAM24. Northern blot analysis of hairpins in EST72223. Left, Northern reacted with predicted Mir-98 hairpin probe, Right, Northern reacted with predicted GAM24 hairpin probe. The molecular size of EST Is indicated by arrow. The molecular sizes of Mir-98 and GAM24 are 80 nt and 100 nt, respectively as indicated by arrows. The 22 nt molecular marker is indicated by arrow. 1-Hela lysate; 2-EST incubated 4 h with Hela lysate; 3-EST without lysate; 4-Mir transcript incubated 4 h with Hela lysate; 5-Mir transcript incubated overnight with Hela lysate; 6-Mir transcript without lysate; 7-RNA extracted from Hela cells following transfection with Mir transcript.

Technical methods used in experiments, the results of which are depicted in FIGS. 12B, 12C and 12D are as follows:

Transcript preparations: Digoxigenin (DIG) labeled transcripts were prepared from EST72223 (TIGER), MIR98 and predicted precursor hairpins by using a DIG RNA labeling kit (Roche Molecular Biochemicals) according to the manufacture's protocol. Briefly, PCR products with T7 promoter at the 5" end or T3 promoter at the 3"end were prepared from each DNA in order to use it as a template to prepare sense and antisense transcripts, respectively. MIR-98 was amplified using EST72223 as a templet with T7miR98 forward primer: 5"-TAATACGACTCACTATAGGGTGAGGTAG-TAAGTTGTATT GTT-3" and T3miR98 revse primer: 5"-AATTAACCCTCACTAAAGGGAAAGTAG-TAAGTTGTATAG TT-3"EST72223 was amplified with T7-EST 72223 forward primer: 5"-TAATACGACTCAC-TATAGGCCCTTATTAGAGGAT TCTGCT-3" and T3-EST72223 reverse primer:5"-AATTAACCCTCAC-TAAAGGTTTTTTTTTCCTGAG ACAGAGT-3" Bet-4 was amplified using EST72223 as a templet with Bet-4 forward primer: 5"-GAGGCAGGAGAATTGCTTGA-3" and T3-EST72223 reverse primer: 5"-AATTAACCCTCAC-TAAAGGCCTGAGACAGAGTCT TGCTC-3" The PCR products were cleaned and used for DIG-labeled or unlabeled transcription reactions with the appropriate polymerase. For transfection experiments, CAP reaction was performed by using a mMassage mMachine kit (Ambion).

Transfection procedure: Transfection of Hela cells was performed by using TransMessenger reagent (Qiagen) according to the manufacture's protocol. Briefly, Hela cells were seeded to 1–2×106 cells per plate a day before transfection. Two Àµg RNA transcripts were mixed with 8Àµl Enhancer in a final volume of 100Àµl, mixed and incubated at room temperature for 5 min. 16Àµl TransMessenger reagent was added to the RNA-Enhancer, mixed and incubated for additional 10 min. Cell plates were washed with sterile PBS twice and then incubated with the transfection mix diluted with 2.5 ml DMEM medium without serum. Cells were incubated with transfection mix for three hours under their normal growth condition (370 C and 5% CO2) before the transfection mix was removed and a fresh DMEM medium containing serum was added to the cells. Cells were left to grow 48 hours before harvesting.

Target RNA cleavage assay: Cap-labeled target RNAs were generated using mMessage mMachine™ (Ambion). Caped RNA transcripts were preincubated at 30° C. for 15 min in supplemented Hela S100 obtained from Computer Cell Culture, Mos, Belgium. After addition of all components, final concentrations were 100 mM target RNA, 1 mM ATP, 0.2 mM GTP, 10 U/ml RNasin, 30¼g/ml creatine kinase, 25 mM creatine phosphate, and 50% S100 extract. Incubation was continued for 4 hours to overnight. Cleavage reaction was stopped by the addition of 8 volumes of proteinase K buffer (200 Mm Tris-Hcl, pH 7.5, 25 mM EDTA, 300 mM NaCl, and 2% SDS). Proteinase K, dissolved in 50 mM Tris-HCl, pH 8, 5 mM CaCl2, and 50% glycerol, was added to a final concentration of 0.6 mg/ml. Sample were subjected to phenol/chloroform extraction and kept frozen until analyzed by urea-TBE PAGE.

Northern analysis: RNAs were extracted from cells by using Tri-reagent according to the manufacture's protocol. The RNAs were dissolved in water and heated to 650 C to disrupt any association of the 25 nt RNA with larger RNA molecules. RNA were placed on ice and incubated for 30 min with PEG (MW=8000) in a final concentration of 5% and NaCl in a final concentration of 0.5M to precipitate high molecular weight nucleic acid. The RNAs were centrifuged at 10,000×g for 10 min to pellet the high molecular weight nucleic acid. The supernatant containing the low molecular weight RNAs was collected and three volumes of ethanol was added. The RNAs were placed at −200 C for at least two hours and then centrifuged at 10,000×g for 10 min. The pellets were dissolved in UreaTBE buffer (1 Xtbe, 7M urea) for further analysis by a Northern blot.

RNA sample were boiled for 5 min before loading on 15%-8% polyacrylamide (19:1) gels containing 7M urea and 1×TBE. Gels were run in 1×TBE at a constant voltage of 300V and then transferred into a nylon membrane. The membrane was exposed to 3 min ultraviolet light to cross link the RNAs to the membrane. Hybridization was performed overnight with DIG-labeled probes at 420 C. Membranes were washed twice with SSC×2 and 0.2% SDS for 10 min. at 420 C and then washed twice with SSC×0.5 for 5 min at room temperature. The membrane was then developed by using a DIG luminescent detection kit (Roche) using anti DIG and CSPD reaction, according to the manufacture's protocol.

It is appreciated that the data presented in FIGS. 12A, 12B, 12C and 12D, when taken together validate the function of the bioinformatic gene detection engine 100 of FIG. 2. FIG. 12A shows a novel GAM gene bioinformatically detected by the bioinformatic gene detection engine 100, and FIGS. 12B, 12C and 12D show laboratory confirmation of the expression of this novel gene. This is in accord with the engine training and validation methodology described hereinabove with reference to FIG. 3.

Reference is now made to FIG. 13A which is an annotated sequence of an EST comprising a novel gene detected by the gene detection system of the present invention. FIG. 13A shows the nucleotide sequence of a known human non-protein coding EST (Expressed Sequence Tag), identified as EST 7929020 (SEQ ID NO: 45572). It is appreciated that the sequence of this EST comprises sequences of two novel GAM genes, referred to here as GAM23 and GAM25, detected by the bioinformatic gene detection system of the present invention, described hereinabove with reference to FIG. 2.

Reference is now made to FIG. 13B which presents pictures of laboratory results, that demonstrate laboratory confirmation of expression of the bioinformatically detected novel gene of FIG. 13A. Northern blot analysis of hairpins in EST7929020. Left, Northern reacted with predicted GAM25 hairpin probe, Right, Northern reacted with predicted GAM23 hairpin probe. The molecular size of EST is indicated by arrow. The molecular sizes of GAM23 and GAM25 are 60 nt, as indicated by arrow. The 22 nt molecular marker is indicated by arrow. 1-Hela lysate; 2-EST incubated 4 h with Hela lysate; 3—EST incubated overnight with Hela lysate; 4-EST without lysate; 5-GAM transcript; 6—GAM 22 nt marker; 7-GAM PCR probe; 8-RNA from control Hela cells; 9-RNA extracted from Hela cells following transfection with EST.

Reference is now made to FIG. 13C which is a picture of a Northern blot confirming Endogenous expression of bioinformatically detected gene GAM25 of FIG. 13A from in Hela cells. Northern was reacted with a predicted GAM25 hairpin probe. The molecular size of EST7929020 is indicated. The molecular sizes of GAM25 is 58 nt, as indicated. A 19 nt DNA oligo molecular marker is indicated. Endogenous expression of GAM25 in Hela total RNA fraction and in S-100 fraction is indicated by arrows. 1-GAM25 transcript; 2-GAM25 DNA oligo marker; 3-RNA from control Hela cells; 4-RNA extracted from Hela cells following transfection with EST; 5-RNA extracted from S-100 Hela lysate.

Reference is now made to FIG. 14A which is an annotated sequence of an EST comprising a novel gene detected by the gene detection system of the present invention. FIG. 14A shows the nucleotide sequence of a known human non-protein coding EST (Expressed Sequence Tag), identified as EST 1388749 (SEQ ID NO: 45573). It is appreciated that the sequence of this EST comprises sequence of a novel GAM gene, referred to here as GAM26, detected by the bioinformatic gene detection system of the present invention, described hereinabove with reference to FIG. 2.

Reference is now made to FIG. 14B which is a picture of Northern blot analysis, confirming expression of novel bioinformatically detected gene GAM26, and natural processing thereof from EST1388749. Northern reacted with predicted GAM26 hairpin probe. The molecular size of EST is indicated by arrow. The molecular sizes of GAM26 is 130 nt, as indicated by arrow. The 22 nt molecular marker is indicated by arrow. 1-Hela lysate; 2-EST incubated 4 h with Hela lysate; 3—EST incubated overnight with Hela lysate; 4-EST without lysate; 5-GAM transcript; 6—GAM 22 nt marker; 7-GAM PCR probe.

Reference is now made to FIG. 1, which is a simplified diagram describing each of a plurality of novel bioinformatically detected viral genes of the present invention, referred to here as Viral Genomic Address Messenger (VGAM) viral genes, which modulates expression of respective host target genes thereof, the function and utility of which host target genes is known in the art.

VGAM is a novel bioinformatically detected regulatory, non protein coding, viral micro RNA (miRNA) gene. The method by which VGAM was detected is described hereinabove with reference to FIGS. 2-8.

VGAM GENE is a viral gene contained in the genome of a virus. VGAM HOST TARGET GENE is a human gene contained in the human genome.

VGAM GENE encodes a VGAM PRECURSOR RNA. Similar to other miRNA genes, and unlike most ordinary genes, VGAM PRECURSOR RNA does not encode a protein.

VGAM PRECURSOR RNA folds onto itself, forming VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof. By inversed-reversed is meant a sequence which is reversed and wherein each nucleotide is replaced by a complementary nucleotide, as is well known in the art (e.g. ATGGC is the inversed-reversed sequence of GCCAT).

An enzyme complex designated DICER COMPLEX, dices the VGAM FOLDED PRECURSOR RNA into VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins.

VGAM HOST TARGET GENE encodes a corresponding messenger RNA, VGAM HOST TARGET RNA. VGAM HOST TARGET RNA comprises three regions, as is typical of mRNA of a protein coding gene: a 5 untranslated region, a protein coding region and a 3 untranslated region, designated 5UTR, PROTEIN CODING and 3UTR respectively.

VGAM RNA binds complementarily to one or more host target binding sites located in untranslated regions of VGAM HOST TARGET RNA. This complementary binding is due to the fact that the nucleotide sequence of VGAM RNA is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM RNA may have a different number of host target binding sites in untranslated regions of a VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM RNA to host target binding sites on VGAM HOST TARGET RNA, such as BINDING SITE I, BINDING SITE II and BINDING SITE III, inhibits translation of VGAM HOST TARGET RNA into VGAM HOST TARGET PROTEIN. VGAM HOST TARGET PROTEIN is therefore outlined by a broken line.

It is appreciated that VGAM HOST TARGET GENE in fact represents a plurality of VGAM host target genes. The mRNA of each one of this plurality of VGAM host target genes comprises one or more host target binding sites, each having a nucleotide sequence which is at least partly complementary to VGAM RNA, and which when bound by VGAM RNA causes inhibition of translation of respective one or more VGAM host target proteins.

It is further appreciated by one skilled in the art that the mode of translational inhibition illustrated by FIG. 1 with specific reference to translational inhibition exerted by VGAM GENE on one or more VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294,779 (2001)).

It is yet further appreciated that a function of VGAM is inhibition of expression of host target genes, as part of a novel viral mechanism of attacking a host. Accordingly, utilities of VGAM include diagnosis, prevention and treatment of viral infection by a virus. Specific functions, and accordingly utilities, of VGAM correlate with, and may be deduced from, the identity of the host target genes which VGAM binds and inhibits, and the function of these host target genes, as elaborated hereinbelow.

FIG. 1 further provides a conceptual description of another novel bioinformatically detected viral gene of the present invention, referred to here as Viral Genomic Address Messenger 2191 (VGAM2191) viral gene, which modulates expression of respective host target genes thereof, the function and utility of which host target genes is known in the art.

VGAM2191 is a novel bioinformatically detected regulatory, non protein coding, viral micro RNA (miRNA) gene. The method by which VGAM2191 was detected is described hereinabove with reference to FIGS. 2-8.

VGAM2191 gene, herein designated VGAM GENE, is a viral gene contained in the genome of Human immunodeficiency virus 1. VGAM2191 host target gene, herein designated VGAM HOST TARGET GENE, is a human gene contained in the human genome.

VGAM2191 gene, herein designated VGAM GENE, encodes a VGAM2191 precursor RNA, herein designated VGAM PRECURSOR RNA. Similar to other miRNA genes, and unlike most ordinary genes, VGAM2191 precursor RNA, herein designated VGAM PRECURSOR RNA, does not encode a protein. A nucleotide sequence identical or highly similar to the nucleotide sequence of VGAM2191 precursor RNA is designated SEQ ID:2194, and is provided hereinbelow with reference to the sequence listing part.

VGAM2191 precursor RNA, herein designated VGAM PRECURSOR RNA, folds onto itself, forming VGAM2191 folded precursor RNA, herein designated VGAM FOLDED PRECURSOR RNA, which has a two-dimensional hairpin structure. As is well known in the art, this hairpin structure, is typical of RNA encoded by miRNA genes, and is due to the fact that the nucleotide sequence of the first half of the RNA encoded by a miRNA gene is an accurate or partial inversed-reversed sequence of the nucleotide sequence of the second half thereof.

An enzyme complex designated DICER COMPLEX, dices the VGAM2191 folded precursor RNA, herein designated VGAM FOLDED PRECURSOR RNA, into VGAM2191 RNA, herein designated VGAM RNA, a single stranded ~22 nt long RNA segment. As is known in the art, dicing of a hairpin structured RNA precursor product into a short ~22 nt RNA segment is catalyzed by an enzyme complex comprising an enzyme called Dicer together with other necessary proteins. A probable (over 55%) nucleotide sequence of VGAM2191 RNA is designated SEQ ID:5264, and is provided hereinbelow with reference to the sequence listing part.

VGAM2191 host target gene, herein designated VGAM HOST TARGET GENE, encodes a corresponding messenger RNA, VGAM2191 host target RNA, herein designated VGAM HOST TARGET RNA. VGAM2191 host target RNA, herein designated VGAM HOST TARGET RNA, comprises three regions, as is typical of mRNA of a protein coding gene: a 5 untranslated region, a protein coding region and a 3 untranslated region, designated 5UTR, PROTEIN CODING and 3UTR respectively.

VGAM2191 RNA, herein designated VGAM RNA, binds complementarily to one or more host target binding sites located in untranslated regions of VGAM2191 host target RNA, herein designated VGAM HOST TARGET RNA. This complementary binding is due to the fact that the nucleotide sequence of VGAM2191 RNA, herein designated VGAM RNA, is an accurate or a partial inversed-reversed sequence of the nucleotide sequence of each of the host target binding sites. As an illustration, FIG. 1 shows 3 such host target binding sites, designated BINDING SITE I, BINDING SITE II and BINDING SITE III respectively. It is appreciated that the number of host target binding sites shown in FIG. 1 is meant as an illustration only, and is not meant to be limiting VGAM2191 RNA, herein designated VGAM RNA, may have a different number of host target binding sites in untranslated regions of a VGAM2191 host target RNA, herein designated VGAM HOST TARGET RNA. It is further appreciated that while FIG. 1 depicts host target binding sites in the 3UTR region, this is meant as an example only these host target binding sites may be located in the 3UTR region, the 5UTR region, or in both 3UTR and 5UTR regions.

The complementary binding of VGAM2191 RNA, herein designated VGAM RNA, to host target binding sites on VGAM2191 host target RNA, herein designated VGAM HOST TARGET RNA, such as BINDING SITE I, BINDING SITE II and BINDING SITE III, inhibits translation of VGAM2191 host target RNA, herein designated VGAM HOST TARGET RNA, into VGAM2191 host target protein, herein designated VGAM HOST TARGET PROTEIN. VGAM host target protein is therefore outlined by a broken line.

It is appreciated that VGAM2191 host target gene, herein designated VGAM HOST TARGET GENE, in fact represents a plurality of VGAM2191 host target genes. The mRNA of each one of this plurality of VGAM2191 host target genes comprises one or more host target binding sites, each having a nucleotide sequence which is at least partly complementary to VGAM2191 RNA, herein designated VGAM RNA, and which when bound by VGAM2191 RNA, herein designated VGAM RNA, causes inhibition of translation of respective one or more VGAM2191 host target proteins.

It is further appreciated by one skilled in the art that the mode of translational inhibition illustrated by FIG. 1 with specific reference to translational inhibition exerted by VGAM2191 gene, herein designated VGAM GENE, on one or more VGAM2191 host target gene, herein designated VGAM HOST TARGET GENE, is in fact common to other known non-viral miRNA genes. As mentioned hereinabove with reference to the background section, although a specific complementary binding site has been demonstrated only for some of the known miRNA genes (primarily Lin-4 and Let-7), all other recently discovered miRNA genes are also believed by those skilled in the art to modulate expression of other genes by complementary binding, although specific complementary binding sites of these other miRNA genes have not yet been found (Ruvkun G., Perspective: Glimpses of a tiny RNA world, Science 294,779 (2001)).

It is yet further appreciated that a function of VGAM2191 is inhibition of expression of host target genes, as part of a novel viral mechanism of attacking a host. Accordingly, utilities of VGAM2191 include diagnosis, prevention and treatment of viral infection by Human immunodeficiency virus 1. Specific functions, and accordingly utilities, of VGAM2191 correlate with, and may be deduced from, the identity of the host target genes which VGAM2191 binds and inhibits, and the function of these host target genes, as elaborated hereinbelow.

Nucleotide sequences of the VGAM2191 precursor RNA, herein designated VGAM PRECURSOR RNA, and of the diced VGAM2191 RNA, herein designated VGAM RNA, and a schematic representation of the secondary folding of VGAM2191 folded precursor RNA, herein designated VGAM FOLDED PRECURSOR RNA, of VGAM2191 are further described hereinbelow with reference to Table 1.

TABLE 1

| GENE | PRECURSOR-SEQUENCE | P-SEQID | GENE-SEQ | G-SEQID | FOLDED PRECURSOR |
|---|---|---|---|---|---|
| GAM 2191 | GTACTGGGTC TCTCTGGTTA GACCAGATCT GAGCCTGGGA GCTCTCTGGC TAACTAGGGA ACCCACTGC | 2194 | TCTCT GGTTA GACCA GATCT GAGC | 5264 | ```
     c    c              a   tct    ct
  gta tgggt tctctggttag ccaga    gagc  g
  ||| ||||| ||||||||||| |||||    ||||
  cgt accca agggatcaatc ggtct    ctcg  g
     c    _              _   ___    ag
``` |

Nucleotide sequences of host target binding sites, such as BINDING SITE-I, BINDING SITE-II and BINDING SITE-III of FIG. 1, found on, and schematic representation of the complementarity of each of these host target binding sites to VGAM2191 RNA, herein designated VGAM RNA, are described hereinbelow with reference to Table 2.

TABLE 2

| GENE | TARGET | UTR | SEQUENCE | SEQID | BINDING-SITE |
|---|---|---|---|---|---|
| GAM2191 | ITGA5 | 3' | CCTCTGTCCCTGGATCTGAG | 41496 | ```
        GTTAGA  A
  TCTCTG      CC  GATCTGAG
  ||||||      ||  ||||||||
  GGAGAC      GG  CTAGACTC
        AG____    AC
``` |
| GAM2191 | SCD | 3' | CTCTTGATCAGATCTGAG | 22825 | ```
            TAGAC
  CTCT GGT       CAGATCTGAG
  |||| |||       ||||||||||
  GAGA CTA       GTCTAGACTC
            A    _____
``` |

TABLE 2-continued

| GENE | TARGET | UTR | SEQUENCE | SEQID | BINDING-SITE |
|---|---|---|---|---|---|
| GAM2191 | SF3B3 | 3' | TCTGGTTAGATTCTAGAGC | 29681 | ```
            CCAGA
TCTGGTTAGA    TCT GAGC
||||||||||    ||| ||||
AGACCAATCT    AGA CTCG
         A____    T
``` |
| GAM2191 | SLC22A11 | 3' | TCTCTGGTTGGCGTGGCTGAG | 32965 | ```
          AGACCAGAT
TCTCTGGTT         CTGAG
|||||||||         |||||
AGAGACCAA         GACTC
          CCGCACC__
``` |
| GAM2191 | SLC4A4 | 3' | TCTGGTTAACAACTCTGAGC | 19065 | ```
          AC  A
TCTGGTTAG   CAG TCTGAGC
|||||||||   ||| |||||||
AGACCAATT   GTT AGACTCG
          __   G
``` |
| GAM2191 | ZNF180 | 3' | TCTCTGATTCACGGTCTGAG | 29936 | ```
          AGAC  A
TCTCTGGTT    CAG TCTGAG
|||||||||    ||| ||||||
AGAGACTAA    GTC AGACTC
          ____   C
``` |
| GAM2191 | AKAP13 | 3' | CAACTAGAGCACTSG | 28470 | ```
          AACC
TAACTAGGG    CACTG
|||||||||    |||||
GTTGATCTC    GTGAC
          ____
``` |
| GAM2191 | DNAH11 | 3' | CTAGAAAATCCTCACTGC | 19096 | ```
     GG  -  -
CTAG   AA CC CACTGC
||||   || || ||||||
GATC   TT GG GTGACG
     TT  A  A
``` |
| GAM2191 | FGFR2 | 3' | TAACTAGGTGAATACTG | 35667 | ```
            -   CCC
TAACTAGG GAA    ACTG
|||||||| |||    ||||
ATTGATCC CTT    TGAC
            A   A__
``` |
| GAM2191 | GTF2E2 | 3' | TAACAGGGAACATCACATTGC | 13318 | ```
         T       C
TAAC AGGGAAC  CAC TGC
|||| |||||||  ||| |||
ATTG TCCCTTG  GTG ACG
  _          TA  TA
``` |
| GAM2191 | ILK | 3' | CAACCAGAGGCCTGCTCC | 21122 | ```
          AA  CA
TAACTAGGG   CC CTGC
|||||||||   || ||||
GTTGGTCTC   GG GACG
          C_  AC
``` |
| GAM2191 | KIF3B | 3' | AACAGGCCCACTGC | 22027 | ```
         T  GAA
AAC AGG    CCCACTGC
||| |||    ||||||||
TTG TCC    GGGTGACG
     _   ___
``` |
| GAM2191 | MAP1B | 3' | ACTAAAGAATGCCTACTGC | 25369 | ```
              C
ACTAGGGAA__CC ACTGC
|||||||||  || |||||
TGATTTCTT  GG TGACG
           AC A
``` |
| GAM2191 | MLH3 | 3' | CAACTACCGGAATCATCTGC | 30778 | ```
          AACC  -
TAACTAGGG    CA CTGC
|||||||||    || ||||
GTTGATCCC    GT GACG
          CTTA  A
``` |
| GAM2191 | MYO1A | 5' | AACTAGGGTATAACTTCACTG | 23919 | ```
          ___     C_
AACTAGGG    AAC   CACTG
||||||||    |||   |||||
TTGATCCC    TTG   GTGAC
          ATA     AA
``` |

TABLE 2-continued

| GENE | TARGET | UTR | SEQUENCE | SEQID | BINDING-SITE |
|------|--------|-----|----------|-------|--------------|
| GAM2191 | POMZP3 | 3' | GAAGGCAAAGCCCACTGC | 29241 | ```
  T   G
C AGG AA  CCCACTGC
| ||| ||  ||||||||
C TCC TT  GGGTGACG
  T   G TC
``` |
| GAM2191 | TRPM2 | 3' | CAACCAGGCCTGCTGC | 17687 | ```
          GAA  CA
TAACTAGG    CC  CTGC
||||||||    ||  ||||
GTTGGTCC    GG  GACG
            AC
``` |
| GAM2191 | UTY | 3' | TAACTAAGCkAAATTCTGC | 20314 | ```
            CCCA
TAACTAGGGAA     CTGC
|||||||||||     ||||
ATTGATTCCTT     GACG
            TTAA
``` |
| GAM2191 | YWHAZ | 3' | CAACTAAGGAGAGATTTGCTGC | 18201 | ```
           ACCCA
TAACTAGGGA      CTGC
||||||||||      ||||
GTTGATTCCT      GACG
           CTCTAAAC
``` |
| GAM2191 | ZP3A | 3' | GAAGGCAAAGCCCACTGC | 28385 | ```
  T   G
C AGG AA  CCCACTGC
| ||| ||  ||||||||
C TCC TT  GGGTGACG
  T   G TC
``` |

FIG. 9 further provides a conceptual description of novel bioinformatically detected regulatory viral gene, referred to here as Viral Genomic Record 3642(VGR3642) viral gene, which encodes an operon-like cluster of novel viral micro RNA-like genes, each of which in turn modulates expression of at least one host target gene, the function and utility of which at least one host target gene is known in the art.

VGR3642 gene, herein designated VGR GENE, is a novel bioinformatically detected regulatory, non protein coding, RNA viral gene. The method by which VGR3642 gene was detected is described hereinabove with reference to FIGS. 6-15.

VGR3642 gene encodes VGR3642 precursor RNA, herein designated VGR PRECURSOR RNA, an RNA molecule, typically several hundred nucleotides long.

VGR3642 precursor RNA folds spatially, forming VGR3642 folded precursor RNA, herein designated VGR FOLDED PRECURSOR RNA. It is appreciated that VGR3642 folded precursor RNA, herein designated VGR FOLDED PRECURSOR RNA, comprises a plurality of what is known in the art as hairpin structures. These hairpin structures are due to the fact that the nucleotide sequence of VGR3642 precursor RNA comprises a plurality of segments, the first half of each such segment having a nucleotide sequence which is at least a partial inversed-reversed sequence of the second half thereof, as is well known in the art.

VGR3642 folded precursor RNA, herein designated VGR FOLDED PRECURSOR RNA, is naturally processed by cellular enzymatic activity into at least 2 separate VGAM precursor RNAs, VGAM2191 precursor RNA and VGAM2192 precursor RNA, herein schematically represented by VGAM1 PRECURSOR and VGAM2 PRECURSOR respectively, each of which VGAM precursor RNAs being a hairpin shaped RNA segment, corresponding to VGAM PRECURSOR RNA of FIG. 8.

The above mentioned VGAM precursor RNAs are diced by DICER COMPLEX of FIG. 8, yielding respective short RNA segments of about 22 nucleotides in length, VGAM2191 RNA and VGAM2192 RNA respectively, herein schematically represented by VGAM1 RNA and VGAM2 RNA respectively, each of which VGAM RNAs corresponding to VGAM RNA of FIG. 8.

VGAM2191 RNA, herein schematically represented by VGAM1 binds complimentarily to a host target binding site located in an untranslated region of VGAM2191 host target RNA, herein schematically represented by VGAM1 HOST TARGET RNA, which host target binding site corresponds to a host target binding site such as BINDING SITE I, BINDING SITE II or BINDING SITE III of FIG. 1, thereby inhibiting translation of VGAM2191 host target RNA, herein schematically represented by VGAM1 HOST TARGET RNA into VGAM2191 host target protein, herein schematically represented by VGAM1 HOST TARGET PROTEIN, both of FIG. 1.

VGAM2192 RNA, herein schematically represented by VGAM2 binds complimentarily to a host target binding site located in an untranslated region of VGAM2192 host target RNA, herein schematically represented by VGAM2 HOST TARGET RNA, which host target binding site corresponds to a host target binding site such as BINDING SITE I, BINDING SITE II or BINDING SITE III of FIG. 1, thereby inhibiting translation of VGAM2192 host target RNA, herein schematically represented by VGAM2 HOST TARGET RNA into VGAM2192 host target protein, herein schematically represented by VGAM2 HOST TARGET PROTEIN, both of FIG. 1.

It is appreciated that a function of VGR3642 gene, herein designated VGR GENE, is inhibition of expression of host target genes, as part of a novel viral mechanism of attacking a host. Accordingly, utilities of VGR3642 gene include diagnosis, prevention and treatment of viral infection by Camelpox virus. Specific functions, and accordingly utilities, of VGR3642 gene, herein designated VGR GENE, correlate with, and may be deduced from, the identity of the host target genes, which are inhibited by VGAM RNAs comprised in the operon-like cluster of VGR3642 gene: VGAM2191 host target protein and VGAM2192 host target protein, herein schematically represented by VGAM1 HOST TARGET PROTEIN and VGAM HOST TARGET PROTEIN respectively. The function of these host target genes is elaborated hereinabove with reference to VGAM2191 and VGAM2192

SEQUENCE LISTING (45579 sequences)

SEQ ID NO: 1 - RNA, 91 nt, Human herpesvirus 7
gaugccugaccgccucacugcuguccuaaacagguacaagauguacuuucucaaggaccaaaaguuuagccugagcgggacaaucaggauc

SEQ ID NO: 2 - RNA, 62 nt, Human herpesvirus 7
gagauucuugcagcggauauuuauacgggauuaguuugaguagaguacacaugcggagcauc

SEQ ID NO: 3 - RNA, 67 nt, Human herpesvirus 7
aggggaacuuaugacuguuauaaaaaauaagaauaagauuccauuuuuauuauuaucugguucuccu

SEQ ID NO: 4 - RNA, 63 nt, Human herpesvirus 7
acauguccucccugcucaccaugaagaaccucaugcacgugguugucgcggaggagggccugu

SEQ ID NO: 5 - RNA, 75 nt, Human herpesvirus 7
caccugcugaacgcgggcuucgccugccacggccccccgggccucagccacggccagcucgccaccugcgaggug

SEQ ID NO: 6 - RNA, 77 nt, Alcelaphine herpesvirus 1
gcgucuaaauuuaaaaaaguuuauauauuaguaccaaauauaaauauacuaaagauuuuuaauuauaguauggacgu

SEQ ID NO: 7 - RNA, 60 nt, Alcelaphine herpesvirus 1
uguuuacaauaguaacuaguaaaaugaagucaucauuagaagauuuauuaucuguauaca

SEQ ID NO: 8 - RNA, 105 nt, Alcelaphine herpesvirus 1
gguuagaaacauuugguuuaugacaauuccggauaccuuuucucaguauaaucaaaucuugggaagaucaauaagaaaguuuucauauaauaauauaacagaacc

SEQ ID NO: 9 - RNA, 64 nt, Alcelaphine herpesvirus 1
ggcugccuaaucuuacagggagcagaaagacacacagacucugcuaucgggagaucaaggugcc

SEQ ID NO: 10 - RNA, 131 nt, Alcelaphine herpesvirus 1
auaaguuuauauauauauuauuggcccgagugcgagcccugggacccgcgccagcucucacgaccgugcccgugagaacgcuggcagaaugccagcguucgcacaaaacucaauaaguauauauauauuau

SEQ ID NO: 11 - RNA, 98 nt, Alcelaphine herpesvirus 1
ggcgaggguccuggcagaaggccggccggucggagcuggcuagccggccgcggcuggaugucugucucucuggcuggccggcuuucugcuccuucguc

SEQ ID NO: 12 - RNA, 80 nt, Alcelaphine herpesvirus 1
ucccugcuugcucacggccgccccucacccuucucccuuucgcgauuggcgggaggaccccggcggugagcaagcaggga

SEQ ID NO: 13 - RNA, 98 nt, Alcelaphine herpesvirus 1
cccgccaagugagcuccgcccacccagcccccacccucaucucgggcccgggggcgggcagacgggggugggggcugggugggcggagcucacucggg

SEQ ID NO: 14 - RNA, 63 nt, Alcelaphine herpesvirus 1
ggcgugucgcgcucgcucgcccgggcgguucauccgcuucggcuuuaggcagccgcggccgcc

SEQ ID NO: 15 - RNA, 64 nt, Alcelaphine herpesvirus 1
ggccacaugugcgguaugggggucgacuaucaaaacguggcccugacgcugacuuacaacggcc

SEQ ID NO: 16 - RNA, 65 nt, Alcelaphine herpesvirus 1
ccuccaguacgucguggucaacgguacagacguguuuuuggaccagccuugccauaugcugcagg

SEQ ID NO: 17 - RNA, 82 nt, Alcelaphine herpesvirus 1
gcuugcuuuggcccgccuugcgcuuuugcauuuggcucgccccugcccgguuuaauuugcauagcccccuggcccgcagugc

SEQ ID NO: 18 - RNA, 80 nt, Vaccinia virus
ucccugcuugcucaccgccgggguccucccgccaaucgcgaaagggagaagggugaggggcggccgugagcaagcaggga

SEQ ID NO: 19 - RNA, 73 nt, Vaccinia virus
gggaaagagaaggaggggaaggggaaggagaaggcgccgcacugccgcccgcucccggcccgccguccguccc

SEQ ID NO: 20 - RNA, 63 nt, Yaba-like disease virus
ccauaaagaccauuaccucggggcuccaguuugguguggaugccuuagagaggggguuagugg

SEQ ID NO: 21 - RNA, 64 nt, Yaba-like disease virus
uggauuauuucucccaacaccccaguauucaacaacaucagugauaagggguguggagucucca

SEQ ID NO: 22 - RNA, 73 nt, Vaccinia virus
cgcauaaggcaccgcggcugggcccuucacacaggcaaaaguagggaggcagggccgcggcgaguaauuugcg

SEQ ID NO: 23 - RNA, 93 nt, Vaccinia virus
ccgagugagcuccgcccacccagcccccacccccgucugcccgcccccgggcccgagaugagggugggggcugggugggcggagcucacuugg

SEQ ID NO: 24 - RNA, 77 nt, Vaccinia virus
gggggaaaggggaaggaggggaggcuagaagcagcgggcgggcccgucguccgccgcccauccgccuagcggcugcc

SEQ ID NO: 25 - RNA, 84 nt, Vaccinia virus
ggacaggcccccccgcuggcgcaaaaauacaauagcucucgauuauccgccauuggauuuuuugcccgcgcgggggcgaugucc

SEQ ID NO: 26 - RNA, 71 nt, Vaccinia virus
gccgcagccccagcugcccccccggcgcgcgcgauagcgagguugcucgggggggcgcuguugccgccggc

SEQ ID NO: 27 - RNA, 61 nt, Yaba-like disease virus
ccacccagagccacaugaggaucccgucgcgggaacggacccacauggcggcggagggugg

SEQ ID NO: 28 - RNA, 85 nt, Yaba-like disease virus
ccaugucagagguccaguacccaugauacuggcaucacuguuaaacagacaguucuugucaauggguuuguggccuuugccaugg

SEQ ID NO: 29 - RNA, 63 nt, Yaba-like disease virus
gagaacagaugaggucgucgcagaaaaucuccuguauaauggaaggggaucaucaucugucuu

SEQ ID NO: 30 - RNA, 110 nt, Yaba-like disease virus
uauccaauauguuguugugaauggcacagauguauuucuggaacagcccugucaguuuuuccaagaggccuauccaacaauuugugccagucacaggagcaugcuggaug

SEQ ID NO: 31 - RNA, 112 nt, Amsacta moorei entomopoxvirus
ggccgccgcgcgcccccgcccggccgccgcgcgcccccgcccggccgccgcgcgcccccgcccggccgccgcgcgcccccgcccggccgccgcgcgcccccgcccggccgcc

SEQ ID NO: 32 - RNA, 62 nt, Amsacta moorei entomopoxvirus
agggacuccggagaaggaaggcugcuccgcgcaccggcgcgcccuucuccucuccccucccu

SEQ ID NO: 33 - RNA, 61 nt, Amsacta moorei entomopoxvirus
ggggcuuggccgccgaggugcgccccggccggaggggcccccgcaccucggcggccgcccc

SEQ ID NO: 34 - RNA, 102 nt, Amsacta moorei entomopoxvirus
agaaacacgaggcgggggucccagaaagggcaggcaggucagccgcaccgcccgcgagccaacccguauccuuuuuuucuagguguuuuuguuuuuguuucu

SEQ ID NO: 35 - RNA, 65 nt, Amsacta moorei entomopoxvirus
gaaaauuugugaguauaucagaucauauuauaaagaugauauaaguuacuuugaaacaggauuuc

SEQ ID NO: 36 - RNA, 80 nt, Yaba-like disease virus
aucacucaauuccagacccugccuacgaguauaggagcacuaucaaucccugggcaucacaggugggguccuugggugau

SEQ ID NO: 37 - RNA, 99 nt, Amsacta moorei entomopoxvirus
ggaaagcggaaaaacggaggauggaagggcagaagauggggagucccgauccuccuccugcauccccucgccuuccauucuccggcccuccgcgagucc

SEQ ID NO: 38 - RNA, 63 nt, Amsacta moorei entomopoxvirus
gggccgcgggccagcagacgggccgcggcgccagcggcccacgccucccgccgcauuaggccc

SEQ ID NO: 39 - RNA, 76 nt, Amsacta moorei entomopoxvirus
gcaauguuaaagugacuccuccagauuacucaccuauaauagcgaguauuaaagguaagaguuaugacgcauuagc

SEQ ID NO: 40 - RNA, 77 nt, Amsacta moorei entomopoxvirus
uaucaagauguguauauuugcgaaaauuguggagacauagcagcacaaaucaaaaguauuaauacaugucuuagaug

SEQ ID NO: 41 - RNA, 62 nt, Southern bean mosaic virus
gccgaggacuuacuugacgaaucuccuguggacuugguucgcagggguuugugugacccggu

SEQ ID NO: 42 - RNA, 96 nt, Southern bean mosaic virus
gggcugauguagagaugagaauuguucuggggggcuuuggccauaaacuggcuaaagccgcccagaauagguuuucguguuucaugaacucagucu

SEQ ID NO: 43 - RNA, 65 nt, Southern bean mosaic virus
gucuggaccgcacaguguguguggcaaaggcaucggcguugcgacgcgcgcuuuguucagcaggc

SEQ ID NO: 44 - RNA, 66 nt, Southern bean mosaic virus
gugucuaugccacguugcucgcacaugcguaucacaguacgcguagccauaaccuuacacucacgc

SEQ ID NO: 45 - RNA, 125 nt, Paramecium bursaria Chlorella virus 1
uucccggggaggagggcaccagguucccggggaggagggcaccagguucccggggaggagggcaccagguucccggggaggagggcaccagguucccggggaggagggcaccagguucccgggga

SEQ ID NO: 46 - RNA, 102 nt, Paramecium bursaria Chlorella virus 1
caccucuccauaguugcaaauacgcuacgaaaugcccaaggacauugacuaaacguguuucuaaaauguuggccgcguguguaggguuuucagagggaggug

SEQ ID NO: 47 - RNA, 84 nt, Paramecium bursaria Chlorella virus 1
uacccagccggguuuacgcagcugcguauacccagcuguguuuacgcagcgggguuuacgcagcuggguagacccagcugggua

SEQ ID NO: 48 - RNA, 73 nt, Southern bean mosaic virus
cggcuguuuguuaagcaggagccccacgccucccgaaaggugagagagggccgcuuccgcuugauaucaucug

SEQ ID NO: 49 - RNA, 71 nt, Southern bean mosaic virus
caaccauuuccggucgcuuauacgagguagaguucugcucucacguuauaagggaagaucgauguugguug

SEQ ID NO: 50 - RNA, 109 nt, Southern bean mosaic virus
ucuccacucucucgguguuccagaggcauguccucaaugcugguauacucaauggcguuaucaaagccgugggccagcguguccugggacaguugcaagggugugauga

SEQ ID NO: 51 - RNA, 67 nt, Southern bean mosaic virus
gucaggaccccuuugguccaugucgcgcggguccuccgguucaggcaggcgucugaaggggcuugac

SEQ ID NO: 52 - RNA, 116 nt, Paramecium bursaria Chlorella virus 1
gaaggaggguugaauacaguuggggguaguccgcugguauucccagcugagguugccuuauuugguaaugcuuccggaaauaccaccugaguaccccauugguuuauaccuuguuu

SEQ ID NO: 53 - RNA, 94 nt, Paramecium bursaria Chlorella virus 1
gugggcgccgcgcgcgugcucucucagucgcgccuagcugcuuccaacagacaaaagcggggcguuagugagggagugcgcgcgcugcgcugac

SEQ ID NO: 54 - RNA, 72 nt, Paramecium bursaria Chlorella virus 1
aaagacucgcucaacagcccgaaaaccaucagcccgaccgccgauggauuaggugcugcuggacaagucuuu

SEQ ID NO: 55 - RNA, 88 nt, Bovine herpesvirus 4
uaauuuguuacuaauuucuuuauccacauauucguuagaauugucaugagugaauucgaauguguaaggagguugcuguaacacguua

SEQ ID NO: 56 - RNA, 67 nt, Bovine herpesvirus 4
auucucaccccaggacuaaaagagaggcugucucacuuacccuagcuguuuuacugggguugggaau

SEQ ID NO: 57 - RNA, 103 nt, Human herpesvirus 7
guuauguuucuuaacuucuucagguagaacgucuuugggacauccguaccguaauacaaacccgaaggaucguuucacacacucguccucuaccucccguaac

SEQ ID NO: 58 - RNA, 131 nt, Equine herpesvirus 2
ucuauuuuuaaacuauuuuuaauuuucuuauuuaauauauuagccaccugugaaaaaucgaaaucguuaagacacgcuuuaaucgguucauuaaauacguauguauauuucuuaaauuuaauaguuauagg

SEQ ID NO: 59 - RNA, 63 nt, Equine herpesvirus 2
aguucguauauuuuuauauauaacaaugauauuuguaaaaaaauaaacuuaacauauugaacu

SEQ ID NO: 60 - RNA, 69 nt, Equine herpesvirus 2
augaaaaucuugcuaaugggaauauaauuauauuuccucuaucguauaaauaauuagcucuuuuuucau

SEQ ID NO: 61 - RNA, 64 nt, Equine herpesvirus 2
guccuucgcggacgccucggccgccugcggguaccagggggugguggagguggucaugagggac

SEQ ID NO: 62 - RNA, 69 nt, Equine herpesvirus 2
auaaaaauauuuuuguaaaacuuuuuuaugagaccaucgaagagagaaagagaauaaaaauauuuuugu

SEQ ID NO: 63 - RNA, 77 nt, Bovine herpesvirus 4
guaguuuccaugggacuauauaauuuuguggccucgaauacaaauuuuacuacauaguuaucuaucuuaaagacuau

SEQ ID NO: 64 - RNA, 76 nt, Bovine herpesvirus 4
caccgccaugcuuccccucucccacucuugaaacuccuuucucuuuucaaacaacggguugggcagcccaaaggug

SEQ ID NO: 65 - RNA, 74 nt, Human herpesvirus 7
auacccgugcauuuuacccucguuaaucaucugaaguugugcgguguuccauagaggaucguguguacgggcgu

SEQ ID NO: 66 - RNA, 72 nt, Human herpesvirus 7
ggccucggcgaaggggcguuccagcaugacggcaugcuggacgaggcgcgcgaugcccuugagcguggggcc

SEQ ID NO: 67 - RNA, 83 nt, Equine herpesvirus 2
auugcccaugcacaaacgauaaguuuuuucucaucucccuuaagauuauuauauaaaaauuuagguauuguauacucggcagu

SEQ ID NO: 68 - RNA, 75 nt, Equine herpesvirus 2
cugcaccccgggcucguguaccgccugcugaaccccaccgccacggaccuacgcgaacaccgggccgaccugcag

SEQ ID NO: 69 - RNA, 91 nt, Equine herpesvirus 2
gagaaagagaauaaaaauauuuuuguaaaacuuuuuuuaugagaccauugaagagagaaagagaauaaaaauauuuuuguaaaacuuuuuu

SEQ ID NO: 70 - RNA, 79 nt, Equine herpesvirus 2
gagaauaaaaauauuuuuguaaaacuuuuuuuaugagaccauugaagagagaaagagaauaaaaauauuuuuguuacuc

SEQ ID NO: 71 - RNA, 93 nt, Equine herpesvirus 2
gagaauaaaauauuuuacgacuccaucagaaagagguuuaauauuuuugugagaccauugaagagagaaagagaauaaaauauuuuacgacuc

SEQ ID NO: 72 - RNA, 91 nt, Equine herpesvirus 2
uuuuucuuaguacaaaagucaauguuuuaaaauauauggacaagaauuugucuguauaaaaacuugugugaaauuuuguaccaaagaaaaa

SEQ ID NO: 73 - RNA, 73 nt, Equine herpesvirus 2
guggggcgaccugcucuucucgccgcccgucgcgacgacgacgacgagcgacgcgcccggcgcgguccccgac

SEQ ID NO: 74 - RNA, 86 nt, Equine herpesvirus 2
gaaagagaauaaaaauauuuuuguaaaacuuuuuuuaugagaccauugaagagagaaagagaauaaaauauuuuuacgacuccauc

SEQ ID NO: 75 - RNA, 66 nt, Equine herpesvirus 2
gcgggcugcacgaccggcucgagcugcugcacggcaaccuggagcagaugcgccggcgcacccagc

SEQ ID NO: 76 - RNA, 105 nt, Equine herpesvirus 2
gagugucuggccgaggccaagaaguucgugcacgcgucggucgcccugacgcggccggagccgcccgggcccgacgccgaucugcgcgaaauccggcagacgcuc

SEQ ID NO: 77 - RNA, 61 nt, Ectromelia virus
cuauacguaucguauagauagggucgaguaucccgucgauguucgucuaacguacguaaag

SEQ ID NO: 78 - RNA, 60 nt, Ectromelia virus
cauucguccuccacgucucguagccccucuaacaaaaacguuacgugucuugacguagug

SEQ ID NO: 79 - RNA, 82 nt, Ectromelia virus
aaggaccgacgccgcgcggaucggcaccgcggcgccguuuauauucgccgcgaacagcccucccaccgccgcgcguuuccuu

SEQ ID NO: 80 - RNA, 80 nt, Ectromelia virus
guauuaggaagagauaauaugagagaauugggaauaggauuaauuauggcaaauuuagaagaaaagaaaauucccaguac

SEQ ID NO: 81 - RNA, 73 nt, Ectromelia virus
ucgucgcgggagaccgcggaaaacgacggauguggccacaauccacgucgauauucgcgaucugccgcgacga

SEQ ID NO: 82 - RNA, 87 nt, Ectromelia virus
gcuuccggguacguaguagguagcuuaccuaguacgguaugcugggguagcauuccguacuuccggguauaccuacuucccggaagc

SEQ ID NO: 83 - RNA, 98 nt, Ectromelia virus
uauaguucaacaaugugaugugugucaagaaaauaaaaugccuaguacauuaagaggcaguaauaaaaggggcauagaccauuggcaaguagacuaua

SEQ ID NO: 84 - RNA, 60 nt, Sheeppox virus
uaauguaucaaaaauaucaauauccaauguccaauuaauguuuuuauaucugauauguua

SEQ ID NO: 85 - RNA, 110 nt, Sheeppox virus
aagaaguuaauauagauaguaaagauauuuuuuuagauuauagauuuuuuauacacauguuaauagaagaucuucuaacaaauagguuuuaugaaaauauauuauuuuuu

SEQ ID NO: 86 - RNA, 76 nt, Sheeppox virus
aggauggaaguugagucccucaguguaucaauuuacaaugcaagaaauauuaagggauuggauagcgaaacauccu

SEQ ID NO: 87 - RNA, 82 nt, Ectromelia virus
gaaacauguaacaauauuagauauaggagaugcauauuuuacaauaccauuauaugagccauauagacaauauacaugcuuu

SEQ ID NO: 88 - RNA, 81 nt, Ectromelia virus
gaaaaccggacccggaagaucgauacguacggacgaaaagugcccuuucgccgggcuaacggggaucaccguccgguuuuc

SEQ ID NO: 89 - RNA, 115 nt, Tupaia herpesvirus
agccguuuucccccaacucucgcugcuggcgaccaacuucaauaaguaccgcaucacugcgcuuacugugaaguacucaccagcguguagcuucgagaccaaugggaggguggcu

SEQ ID NO: 90 - RNA, 74 nt, Tupaia herpesvirus
cuguggugggcgaguuguuuauacaguacacgauugugcugagugacccaaccaagacggccaaaauuucacag

SEQ ID NO: 91 - RNA, 61 nt, Tupaia herpesvirus
ggugcauuauagugcggggcacgguugaagguggcuucaccaaacccacacuuauuggacc

SEQ ID NO: 92 - RNA, 81 nt, Tupaia herpesvirus
gucauaccccaagggagaaaauuugcacaauuaauauuaauggauaaaaagcauggaaaauuggaacccuggggggaaagc

SEQ ID NO: 93 - RNA, 114 nt, Monkeypox virus
gugacgaagcagccuaccccgaaggugguucgugugagugcucccgccgcgguuucauaccgugaggucacgggagcuccacgagucacuacggcugguaaggugcugacacac

SEQ ID NO: 94 - RNA, 83 nt, Monkeypox virus
ggaagugucauggcguccaggggcguucgucuuuaugcauaugagcggcgcgaucacgaaccccguuggcgcgacgcgcuucc

SEQ ID NO: 95 - RNA, 90 nt, Sheeppox virus
auguuuuuauaucuaauguccaauuaauguuuuuauaucuaauguccaauuaauguuuuuauaucuaauguccaauuaauguuuuuauau

SEQ ID NO: 96 - RNA, 86 nt, Sheeppox virus
guaaaaaagguuucuauuucuauaguaauguuaacaagugauaacaaauuuuuagcauguucuagaagacauaguuuuuuauuuac

SEQ ID NO: 97 - RNA, 60 nt, Sheeppox virus
uaauguaucaaaaauaucaauaucuaauacccaauuaauguuuuuauaucugauauguua

SEQ ID NO: 98 - RNA, 129 nt, Sheeppox virus
uaauguaucaaaaauaucaauauccaauguccaauuaauguuuuuauaucugauauguuaaaauaucaauaauguaucaaaaauaucaauaucuaauacccaaucaauguuuuuauaucugauauguua

SEQ ID NO: 99 - RNA, 68 nt, Tupaia herpesvirus
augguucagguccgcauagguucccagcagaggaacuuguuauuugauaccggggcggaccgaacuau

SEQ ID NO: 100 - RNA, 66 nt, Tupaia herpesvirus
ucaaacaaugaauuuaguaacagauaguagauaugcauuugaauuuuuauuaagaaauugggauga

SEQ ID NO: 101 - RNA, 74 nt, Monkeypox virus
guucagccgccuggccacguccuggugccugcugcagaacaaggagcgcgcccugugggccgaggcggcuaagc

SEQ ID NO: 102 - RNA, 85 nt, Sheeppox virus
uaugcauaugaauuuaugagaagaaauugggaugaagaaguuauaaagaacccaauacaggcuagaauuaugaaauuagugcaug

SEQ ID NO: 103 - RNA, 101 nt, Monkeypox virus
gcuucuucgugugcccgccgcccucgggcgccacggugguccggcucgcgcccgcgcggccgugcccugaguacgggcucgggcggaacuacacggagggc

SEQ ID NO: 104 - RNA, 74 nt, Monkeypox virus
caaccgccuagguuccgcccagagaagccaaaucggcucucucgacggcaaguucuugggaccgaggcugguug

SEQ ID NO: 105 - RNA, 115 nt, Monkeypox virus
uuuacaaaaacgugaucgugaccacgaccugggcgggcagcacguacgcggccauuacaaaccaguacacggaccgcgugcccgugggcaugggcgagaucacggaccuggugga

SEQ ID NO: 106 - RNA, 65 nt, Monkeypox virus
gcugcuggcgacccggcugacgcagcucgcgcuucggcggcgagcgccgccggaguaccagcagc

SEQ ID NO: 107 - RNA, 64 nt, Melanoplus sanguinipes entomopoxvirus
uuauugauauuggcaauuuacauucagauauauuugaauauguauuauaugauauaucuaauaa

SEQ ID NO: 108 - RNA, 73 nt, Melanoplus sanguinipes entomopoxvirus
ugucuccuauaguaccccuaaacuuuauagaauccgaggaucuggacaaagaguuggacuaaagcguacgaca

SEQ ID NO: 109 - RNA, 72 nt, Melanoplus sanguinipes entomopoxvirus
cauggguaguuuucugcgagggugggaucggcggccuccauggccacgaccgccucggcagacuugcgcaug

SEQ ID NO: 110 - RNA, 63 nt, Melanoplus sanguinipes entomopoxvirus
gcuucucgacggcagacucuuucuccucugcugugaggggaggagagucugcguugacggggc

SEQ ID NO: 111 - RNA, 61 nt, Melanoplus sanguinipes entomopoxvirus
acuggguauaaagaguauaucuuuggguauagauacaaagaaauagucugaaagauuuagu

SEQ ID NO: 112 - RNA, 102 nt, Melanoplus sanguinipes entomopoxvirus
ucucuugaugucacauuuuggguacucggagaugaguucguaccauauagaauaacuauaaggaaaaaaaugcaauuccgccuaaaauagugcauagugaga

SEQ ID NO: 113 - RNA, 76 nt, Melanoplus sanguinipes entomopoxvirus
caaaguccauaacagaguuuuguguguuugccauaguuuugguugcugcacaaaugcuguggugauuuggauuuug

SEQ ID NO: 114 - RNA, 84 nt, Human herpesvirus 5
cuccuuccaauccuagcucaauugaccuucuuccgacuacagaagauguuggaggucaauuucgaagauaugggaccugaggag

SEQ ID NO: 115 - RNA, 63 nt, Human herpesvirus 1
ugaucuugugacgcaugcggcgcaggcaggccguuaggcccaugagcuucugcagcacagaca

SEQ ID NO: 116 - RNA, 97 nt, Human herpesvirus 1
gacaaagagcugcucgcucaggcuguucugugaauaguacacugggguguaggagagggcccuggugagacacgugucugggaggcggcaguugguc

SEQ ID NO: 117 - RNA, 109 nt, Human herpesvirus 1
cgaggcguuguggcacaaacaaaacaggcggaagcccucgucaggccgcgagaggauggcaucgaggauggccuccgcaaugucaguguuugaggccacaagggccuug

SEQ ID NO: 118 - RNA, 61 nt, Alcelaphine herpesvirus 1
ggugcuccaagauuacuaguauuaccuuggcguagaggugguagguguggaagggcgcgcc

SEQ ID NO: 119 - RNA, 106 nt, Alcelaphine herpesvirus 1
ggguacgcgcgagcgagcgccggggcucugcgcagcgugcuggcguucguucgcgccagugcguagccguucugcgucaguguccggguucgccaccggcguauuc

SEQ ID NO: 120 - RNA, 83 nt, Alcelaphine herpesvirus 1
gcggcgagacgaaguccagcacgcgcgcgugcgggaagcgcaugaccagcgucaggcacgcgcgcgugucuuccagccgcugc

SEQ ID NO: 121 - RNA, 61 nt, Alcelaphine herpesvirus 1
acacaccuacaaauuuacaucuacaggauugccugagagacugcuaaaauuguuugucugu

SEQ ID NO: 122 - RNA, 96 nt, Alcelaphine herpesvirus 1
uuuauccugcaagacuguggccagcuuaccaaaaaauucucuagauauugacaaacuggaagauauuuuggggugcccgguccaguccuggauaga

SEQ ID NO: 123 - RNA, 80 nt, Marburg virus
acagcauuuaauacauauucuaaaucuaaguaauauaauuuauauaauucauuauuuaauuuaguuuuauucggugaugu

SEQ ID NO: 124 - RNA, 70 nt, Marburg virus
aguggacucuccacuucucuucucgaguauucccuauaagugauuuacuugauagaaugucaaguccacu

SEQ ID NO: 125 - RNA, 85 nt, Marburg virus
caaugagaucgauguugagacugaagcaagaagaaggcuagaugucggcagucuaagcaugcagaggcucgacgagaaugaauug

SEQ ID NO: 126 - RNA, 81 nt, Marburg virus
uaauacgaucguuugaacauucguuggguaguaaaucaauuaauuuuugcaauuuagauuguuuuucaagcgguucuauua

SEQ ID NO: 127 - RNA, 91 nt, Marburg virus
aagaaaacaccgauuaaauuagcaucagcuacauuuaaauauucuuuuagauaauuuauaauuugcuuauguaauuuuuuuaauauuucuu

SEQ ID NO: 128 - RNA, 75 nt, Bovine herpesvirus 4
aauguuuacauauagcggaucaacauacaagagaaaaauauaauacguuaguagaucaagcaacuuuuaaauauu

SEQ ID NO: 129 - RNA, 68 nt, Bovine herpesvirus 4
cuaucgaauccaggccccugauugguggauugcugaaagccaaucaggggccuggauuugcccaauag

SEQ ID NO: 130 - RNA, 67 nt, Alcelaphine herpesvirus 1
cuucuggcgggcagcucugcuggcaggcauccuuggcucggcuugccggcguccucuucccgcggag

SEQ ID NO: 131 - RNA, 100 nt, Marburg virus
ugauguuuuauuauauuucucaaaugcuucuuuuaauaauucuucuuuuucauuagaagauaaacuaucaaauaauuuuauauuuuuaauaacuacauua

SEQ ID NO: 132 - RNA, 65 nt, Marburg virus
uccuugugguggugucguuauacagguaauacauaacguauacguauagugacuaacuacuugga

SEQ ID NO: 133 - RNA, 122 nt, Bovine herpesvirus 4
uagcuacuacacaccaucgaaaaaaucuccauuuauguuagaugcgggggaguauguauuuuuaccuauguguuucggaaauguauuuauuuauaagggaaguaugauggaauuggguucug

SEQ ID NO: 134 - RNA, 75 nt, Bovine herpesvirus 4
gagguuguugaccacguacaggugcucgucguaggugagacucuggcccacguccagcauuucgcgguccugccc

SEQ ID NO: 135 - RNA, 81 nt, Bovine herpesvirus 4
gaccuucugcagauaggcgcgcuugcgcacguugaccucgcgcgugacguuguggacgcgcgagcgggcguccaagggguc

SEQ ID NO: 136 - RNA, 87 nt, Bovine herpesvirus 4
gacuauaaccuccgaaguacgggaccaguagguaaaauccgacaaggaauauauucguuccgguauauccguaaacagguuguacuc

SEQ ID NO: 137 - RNA, 69 nt, Tupaia herpesvirus
gcuuagcgacgaugcacccgugagggaggagucgugagcguccuccucaccgguacaucgucgccacgc

SEQ ID NO: 138 - RNA, 98 nt, Marburg virus
gauucugauauauaaauaguauuuuuuucauuauauguuagacucggcaaaauaccgggucuauuaauaaggucuucauauuuagauuuaucaucauc

SEQ ID NO: 139 - RNA, 93 nt, Marburg virus
uauagcaauaugaauuuuuuuauuauuaaauauuaaauuaucuaaauccauuuuauuuuauauuuuaauauuaauuuuucauagacuguuaua

SEQ ID NO: 140 - RNA, 122 nt, Marburg virus
gaucuaaauaaucuccguucaaaauuguuuuacauucuucuuuuaauucuauaauuaacuguuguagaucaacuacauucauuaaaauuuugggguaauguaaaugaaaacuuuguuuaauu

SEQ ID NO: 141 - RNA, 99 nt, Bovine herpesvirus 4
gcuaucgacagcuacgacguauuaauacuggaugagguaaugucagugauuggacaauuauacucccccacaaugagacgucuuuccgcgguugauagc

SEQ ID NO: 142 - RNA, 67 nt, Bovine herpesvirus 4
aauaaaaucagaaucuauauuugaaauaguuagagagugcuuagaauauccuaaaucugacuuuauu

SEQ ID NO: 143 - RNA, 68 nt, Bovine herpesvirus 4
gcugucggugaagcgcaacuccaccgugugauggcggucgcagugauccaaacgcagcaccguacggu

SEQ ID NO: 144 - RNA, 67 nt, Tupaia herpesvirus
uuuccgcggccuccauuggcugggaccuuuaacgacacaggguuauucccagucauguacgcggaga

SEQ ID NO: 145 - RNA, 71 nt, Bovine herpesvirus 4
ucucaaauuaucgcgauggaugcuacaguaaacucgcaguuuauugauuuaaucuccggauugcguggaga

SEQ ID NO: 146 - RNA, 74 nt, Bovine herpesvirus 4
aacuagcacuacgauuacaaugugggcauaacaucuguauauuuucaucaacuuuaucguuuucggagcuaguu

SEQ ID NO: 147 - RNA, 70 nt, Bovine herpesvirus 4
ugggggcguguauacgaauaccugaagcguuggaagcauuugacguauuucaaaaaauauacacgcacua

SEQ ID NO: 148 - RNA, 90 nt, Tupaia herpesvirus
gucuccggucagcccgcuucccucgacggccucgucgucccauccguuucguacgccgaggcuaccgagggcagucagccggccgcagac

SEQ ID NO: 149 - RNA, 110 nt, Tupaia herpesvirus
gcggggggaggagcggggggaggagcggggggaggagcggggggaggagcggggggaggagcggggggaggagcggggggaggagcggggggaggagcggggggaggagc

SEQ ID NO: 150 - RNA, 68 nt, Tupaia herpesvirus
ugccuuacgacccguugaaaggaucugggagaacaguaaugucauccuugacccugggaguaucggca

SEQ ID NO: 151 - RNA, 70 nt, Tupaia herpesvirus
gcuacgaguuccugcgugucgcuggcucgccauucacuggugugggcgguuacguggcgaggucgguggc

SEQ ID NO: 152 - RNA, 78 nt, Primate T-lymphotropic virus 3
gccguggaccagcccuggucgccucgcuuaccugggucgccguuucgugaccgggccaucucccugcuguuugacggc

SEQ ID NO: 153 - RNA, 123 nt, Tupaia herpesvirus
gggcuggggccggggagggcuggggccggggagggcuggggccggggagggcuggggccggggagggcuggggccggggagggcuggggccggggagggcuggggcuggggagggcuggggcu

SEQ ID NO: 154 - RNA, 65 nt, Tupaia herpesvirus
ucggacauugcugauaucauggcccaggcuagcuggaagaaauccaugaguaaugagagugccga

SEQ ID NO: 155 - RNA, 130 nt, Tupaia herpesvirus
gucgaacgugucgggcuagccauggucgggcgugugcccuggagagcgauggcguugacugcuuaugcggcuauggaaccgucgcuguaugggaacccgucuggcggugugcgugcugcguacauaucac

SEQ ID NO: 156 - RNA, 64 nt, Primate T-lymphotropic virus 3
gacgcaccaagaaggcauccugaugguguuuaaaaaaaauauugucccgcacaucuuuaagguc

SEQ ID NO: 157 - RNA, 65 nt, Primate T-lymphotropic virus 3
guacguucaucgcccugaaccugucguuuauagagaacauagauuucagggucaucgagcuguac

SEQ ID NO: 158 - RNA, 71 nt, Bovine herpesvirus 4
aaacacaaaaauguauguucaaccuuuuauuauacaauaaaacuuugugaacuuauacauuugcuuuguuu

SEQ ID NO: 159 - RNA, 130 nt, Tupaia herpesvirus
uguucguggacagagcuucuuugcgguagauuaugaugacuucaauucucaacauacguugcugucacagaagauuguguuugaggaauuguuucagcauaucaacugcaauauguccuggacccgaaca

SEQ ID NO: 160 - RNA, 65 nt, Tupaia herpesvirus
uccuugugguggaguuguuauacaaguaauacauaauguauauguauaaggacgcaccauucgga

SEQ ID NO: 161 - RNA, 104 nt, Primate T-lymphotropic virus 3
aaagaauuagauuguaaauauacaaaaauuaauucuuuaaaaggaauagaaaauauuauuaauuuaaaagaauuagauuguucugauacaaaaauuaauucuuu

SEQ ID NO: 162 - RNA, 105 nt, Primate T-lymphotropic virus 3
uuuuuguagacaaagaagaguacacccucucaugggcccagcaauuuagaaacaucucuuacugcagaugggcucacuggaagagcuuugauaaugcuauaaaaa

SEQ ID NO: 163 - RNA, 91 nt, Primate T-lymphotropic virus 3
ggggggucuguuucuccuguggcagccguuaacgccgcuaagccuagcugacgagaugcgcgaauuaaacggcaccacgccagcacccccc

SEQ ID NO: 164 - RNA, 66 nt, Primate T-lymphotropic virus 3
gcacuggugucccauaauaaaguguaugacucauuguaagagcauguuguacugacuuccuggugu

SEQ ID NO: 165 - RNA, 131 nt, Bovine herpesvirus 4
aaaccuaaucagaaauucagaaaacuaucuugaaauugacauccacagggcuagugauaucuucaauaucugauaucaacuauguuagggauggucuacaagaauagaaaucuucuauuucugaaagaaau

SEQ ID NO: 166 - RNA, 61 nt, Primate T-lymphotropic virus 3
gagccuccgcacguccaccccggggaucugcuacucgcgccccccggucacguucagguuc

SEQ ID NO: 167 - RNA, 93 nt, Meleagrid herpesvirus 1
gcagauguaaaggccuggugaggcgagugucuagauuacaggagacuaauauagucgguaaccugucacuucacuccaacaggaucagucagc

SEQ ID NO: 168 - RNA, 67 nt, Meleagrid herpesvirus 1
cugucgucccccgaugccgaucucgcacacagaggcuguucgugauagaacggacggugacuuccag

SEQ ID NO: 169 - RNA, 112 nt, Meleagrid herpesvirus 1
auguagaugacgcggaacacauaucucagauaacuaaugauguaucuacacaaacgggaaaaagaaaucagaguuagauagauacauggaaauguauccucgucauagauau

SEQ ID NO: 170 - RNA, 129 nt, Meleagrid herpesvirus 1
ggaauguuuggaauauccaaaggcagauuuucuaacauuaguuaauaauaugucauuugauguaaaaaaugguauuguuuuaaauuuuaaguuagaaaauauaaauuguuuagauaauccaaauauauc

SEQ ID NO: 171 - RNA, 63 nt, Meleagrid herpesvirus 1
guuuugccccaucggcuaucugcucccaaaaaguuguaauauaggugccgcugggugcgaaau

SEQ ID NO: 172 - RNA, 76 nt, Meleagrid herpesvirus 1
cgauuuacguaaucuauauacaagauauaugcgagagaaugauaucgcagaguaucauauagagaaugcgaggucg

SEQ ID NO: 173 - RNA, 131 nt, Poliovirus
cuuuguugaacuugccguacccguccagcuugauguuauacaccgacguuaccuuguuaacuauguacgcccagucaaaauuaacgauguuguagccgguggcgaacucgggagaguacugcuugagaaag

SEQ ID NO: 174 - RNA, 76 nt, Equine arteritis virus
cuccgggagggaaaacggcgaggguagaaacgagcggugagcaaaauccccucgcucgucgucguccuccucggag

SEQ ID NO: 175 - RNA, 87 nt, Equine arteritis virus
gucaucggcguacguggggauguaccgcgacugaaagcuguuggcgacguaagaguccgggcccaucagcccagauaugucgaugac

SEQ ID NO: 176 - RNA, 66 nt, Equine arteritis virus
uacagcuacgaagagaauauauguuaugugagaauguuagacauuuuucuuuuaaauuugcuugua

SEQ ID NO: 177 - RNA, 102 nt, Equine arteritis virus
accacagcgcaugcgccgggccguuguggggccccgggccggggccccuuggguccgccggggccccgggccgggccgccacgggggccggccguuggcggu

SEQ ID NO: 178 - RNA, 65 nt, Equine arteritis virus
ccagcggccggccggcgcuuagggggaggaugucgccgacgccccuuggccgccccggcugcagg

SEQ ID NO: 179 - RNA, 131 nt, Equine arteritis virus
ucugccucugccgcuugugagugcgcgcgccggcucugcggugucggcggcggcugcggcggcugcggcggccgccguguucggucucgguagccggccggcggguggacucgcggggggccggagggugg

SEQ ID NO: 180 - RNA, 64 nt, Amsacta moorei entomopoxvirus
cacggucguuguaggcuugugauagaugagaaacauaaacgguuuguucgccacgaucgccgug

SEQ ID NO: 181 - RNA, 106 nt, Equine arteritis virus
ggcaaagcggcggggcgguucggggggggggggggggggcgggaaaccaaguaggcccgcccauccgcggccccucccggcagccacgcccccagcgucggguguc

SEQ ID NO: 182 - RNA, 61 nt, Amsacta moorei entomopoxvirus
guuuuagaaaaccaucuacuauaucauaugaaauacugguauuugauauuucuuuuaaaac

SEQ ID NO: 183 - RNA, 101 nt, Amsacta moorei entomopoxvirus
ucgcgaggagaacuccgccguaaacucgggacguaacggaacggaugcgucuacgaacaacucccguaacgcgagaaaggcgucggaguccuccacgacgg

SEQ ID NO: 184 - RNA, 89 nt, Amsacta moorei entomopoxvirus
guguaugaaaugggcgggauacuaucuacguggaccaauuugcauauuauaugaaaacuaaccgcaugauggcgcuauuuuuuaaacac

SEQ ID NO: 185 - RNA, 117 nt, Amsacta moorei entomopoxvirus
ccuccaccuccucuucgaagaauauuccacuguccccuuuucucuacuuuuuaaugaaaaaggggcaaaugucagugaugaugagcuucgagacggaccacaaccaccaacuggagg

SEQ ID NO: 186 - RNA, 71 nt, Amsacta moorei entomopoxvirus
aggcucugacgucucucccuacccuggcucccggaaaaaaccgaaaaccacccauuuccucauguuugccu

SEQ ID NO: 187 - RNA, 130 nt, Ictalurid herpesvirus 1
caagcuucgcguucagcggcuucuguuugcgcaacaaucacauacggaauucucuccuucacacugggcaguucuucauuccgcauagcgagcuuaaaguaaacagugaggugcgguagccgcuuguuug

SEQ ID NO: 188 - RNA, 96 nt, Amsacta moorei entomopoxvirus
uuacauaauuuauauuaagaauaucaaauauucuaucuaaacagaauucguaagauauaguuuuuguauaauuauuuuuauauauaaauuguguaa

SEQ ID NO: 189 - RNA, 84 nt, Amsacta moorei entomopoxvirus
uuguaugugacguuuccggaauaaaaagguugauccgucgugaacgaagggucgaauacgugucuccagcucgucuucauacga

SEQ ID NO: 190 - RNA, 64 nt, Amsacta moorei entomopoxvirus
guugucgcuuucguuguagacguaucggaacguccauaguccgauaucucgacacgcgcacgac

SEQ ID NO: 191 - RNA, 94 nt, Amsacta moorei entomopoxvirus
guuuuuuuuuauugcuaaugcguaaaccugccccaugcccccaguacaaacaagggggggggggcacuaaaaauuuuugcgcgaaaaaaaaaac

SEQ ID NO: 192 - RNA, 93 nt, Ictalurid herpesvirus 1
cguccgcggcgacggcgccgucgccgccgcgcucggaacguucggaacguucggaacgcucggaguggggucgacggcccgaggaagcggacg

SEQ ID NO: 193 - RNA, 79 nt, Ictalurid herpesvirus 1
acguguuuuuuuuaaguuauuuuacuauugagccaccuauacacucuguuacaaaaaaaacauugaaaaauagauaugu

SEQ ID NO: 194 - RNA, 78 nt, Ictalurid herpesvirus 1
gauaugucaauacaacagucaauguucucaggauugcaagugcguuuuuaagaaaaagaaauaugaugaagauauauc

SEQ ID NO: 195 - RNA, 69 nt, Ictalurid herpesvirus 1
cgugcguguucugugcguuauauaaccagaacaagcugugucuggacuuugcgcgcaacgaucugcacg

SEQ ID NO: 196 - RNA, 61 nt, Amsacta moorei entomopoxvirus
gcuggccacgugccccgaacaucagauuaccugggaccccaucgauggacgcguugucagc

SEQ ID NO: 197 - RNA, 93 nt, Ictalurid herpesvirus 1
acacccacuuccagggcguaacccgaaaguucucaccacacccacuuccagggcguaacccgaaaguucucaccacacccacuuccagggcgu

SEQ ID NO: 198 - RNA, 60 nt, Ictalurid herpesvirus 1
ggcguggcgauacgacgaagccguggagauggcucugaccgugugugaaacgaccgcucc

SEQ ID NO: 199 - RNA, 117 nt, Ictalurid herpesvirus 1
accacauggugguuaucuguauaaacugcaccuguuaacguguaacugcgccaccacaagggcguauauaaaagugcauguaaaucgaguguuuaaaaaauagcgccaucaugcggu

SEQ ID NO: 200 - RNA, 79 nt, Ictalurid herpesvirus 1
cggcuuguggagguaagagcucccgggggacggcuuaccaacuuggcuucauacuuaucugcucucuucuccuucgcug

SEQ ID NO: 201 - RNA, 69 nt, Ictalurid herpesvirus 1
ccucucaaaucuuggguuaaacucaucaccgcgaaaaucuuugccguuccaaacccgaauccugcgagg

SEQ ID NO: 202 - RNA, 74 nt, Human enterovirus B
gcucgggcgcauccgcucgcucgucgacaacgagcucugcguguacuucgacagcagcgccgcgcgccccgagc

SEQ ID NO: 203 - RNA, 97 nt, Human enterovirus B
aucucgucaauuccauuccgacugcuacugccaugaaucaaaugggacaucaugccaucacgaucagcagcagucaagguggcacuuaugaugagau

SEQ ID NO: 204 - RNA, 62 nt, Human enterovirus B
ggcgacuacgauauacuaguguuggacgaaguuauguccacccuggcccaguuguauucgcc

SEQ ID NO: 205 - RNA, 62 nt, Human enterovirus B
gucacguugggugacucugucgauccacgccuggaaaccgacccaccuucccccaacccgac

SEQ ID NO: 206 - RNA, 69 nt, Human enterovirus B
ugccaacuguccgcuuggugcacugaacauuuccgcccaaccaucugcaccaccaaugauuacacugca

SEQ ID NO: 207 - RNA, 70 nt, Human enterovirus B
gaugauucagucauugucggcacuccacccaucuccccgaauuggccugccaucaaagaccuccuucauc

SEQ ID NO: 208 - RNA, 130 nt, Human herpesvirus 4
uggaaauaguauauaaggauaguuucuagauuguacgggagcucuucacuacucgcugcgucgagaguguacgagacucuccagguuugguaagaaauauuuuauauuguuauaauguuacuaugaucca

SEQ ID NO: 209 - RNA, 106 nt, Human herpesvirus 4
ggauuuguauauuagccuugcuaagggagacaucuagugauauaagugugaacuacacuuaucuuaaaugauguaacuccuuaggauaaucaauauacaaaauucc

SEQ ID NO: 210 - RNA, 114 nt, Human herpesvirus 4
gcgagucgcuaugacgcgucgaggguccuucgucuccagagccaggagagucggcauuggcaucaucaacuggcugaaccccagacgcacuauggcgcgucgauggucccucgu

SEQ ID NO: 211 - RNA, 65 nt, Human papillomavirus type 86
ugcaugaaaauaucauuaaauuguuuuacaaauuuuaaaugcaauuuaaaagaauuuuuguagca

SEQ ID NO: 212 - RNA, 84 nt, Human herpesvirus 4
ggaagugaagaaccucgugacccaaauacuccugcuccucauagacguaccugggaugagagacacaagguucuuaaauugucc

SEQ ID NO: 213 - RNA, 122 nt, Human herpesvirus 4
gcagcucuaacuuggcaucucuuuuacagugguucuccugauuugcucuucgugcucuucauguccacugagcaagauccuucuggcacgacuguuccuauaugcucucgcacucuuguugc

SEQ ID NO: 214 - RNA, 63 nt, Human herpesvirus 4
gguuugggcaacaaaacucuuaacccuuugcgcgaaugcaagcaagaguggcuaaugucugcc

SEQ ID NO: 215 - RNA, 64 nt, Human herpesvirus 4
gugauguugcgauaacauccucugggaugccaagcagaucaaagaggucuucaucgcacaucgc

SEQ ID NO: 216 - RNA, 67 nt, Human herpesvirus 4
uacuauaacaggaaacauagaaguugcggauagagccugguuucuaacggcaaugauauuuauagug

SEQ ID NO: 217 - RNA, 91 nt, Human papillomavirus type 86
uguauuuuucuuugcagagauguauggagagcuuauauugggggaaaauaccugacuguucugccuauauucgaauguugaaguauguaca

SEQ ID NO: 218 - RNA, 81 nt, Human papillomavirus type 86
gggugugauguacaggaaaaugacgaagaugaaggaaccaaucgcugcauaacguuaaaccgcaagugcagaaauacaccc

SEQ ID NO: 219 - RNA, 76 nt, Zaire Ebola virus
gcaauguuaaagugacuccuccagauuacucaccuauaaucgcgaguauuaaagguaagaguuaugacgcauuagc

SEQ ID NO: 220 - RNA, 126 nt, Human papillomavirus type 86
uauauauuuuggguucuggcuacuguauauacagguacugugguacauuggauuguuauaaucacacaaccagccaucuacugcugcuacacuaccuuguacagccccuuccccauacaguaugua

SEQ ID NO: 221 - RNA, 61 nt, Zaire Ebola virus
aaguaaagauuucaaagauguuuucugucagaaaauaccauccaagucaauaucuuuacuu

SEQ ID NO: 222 - RNA, 84 nt, Parvovirus H1
uaauauuuguaauuauuuuuuuaauaaaauauaauacuauaucauuuguauuauuauuguuauuuaaaauaauucuaaauuuua

SEQ ID NO: 223 - RNA, 70 nt, Parvovirus H1
aauauugaauguauuauugauuuuauuaauauauuuauuuaaaaaaucauuauauauuacauuuaauauu

SEQ ID NO: 224 - RNA, 76 nt, Parvovirus H1
acuuucauuaauaauauuuuuaaauuuaucagaguuuacauauucuccguuuaaaaaauuuuuuauuaauucuggu

SEQ ID NO: 225 - RNA, 66 nt, Parvovirus H1
ugauauagauuuaauauuuguuuaucauauuuaucauauauagauucaaucauaguaucuauauca

SEQ ID NO: 226 - RNA, 62 nt, Parvovirus H1
gauauaauauuuacuaauuuaucaucugauauauaauuuuuaauauaauuaguuaauuuauc

SEQ ID NO: 227 - RNA, 76 nt, Parvovirus H1
guauugaauucauaaauuauauauucuauuucgcuuaaaauuuuaguuauuaauauaucauuacuauauuuaauau

SEQ ID NO: 228 - RNA, 66 nt, Human papillomavirus type 86
gguuccaccugccuucuuucaaucaaugcgaaagcacacccccuaccgaaauggaugccuggaacc

SEQ ID NO: 229 - RNA, 98 nt, Zaire Ebola virus
gguuuaguaucucaauugucugucuuaaguuccauuacaaauauacuaacgucugaguauuuggauuuggaaaagaaaauuugugaguauaucagauc

SEQ ID NO: 230 - RNA, 67 nt, Parvovirus H1
uuuauuagauauuauauuaauuucaucauauauuccugcuauguuuucauuuuuugauucuaauaaa

SEQ ID NO: 231 - RNA, 85 nt, Parvovirus H1
uaaaacaucuaaagaugauagauguguauuaauuucaucuuguuuaauauuuauaucaucuauuuuuucaucaauagauuuuuua

SEQ ID NO: 232 - RNA, 92 nt, Parvovirus H1
uaauaauaucauguauauaauuuuuuauauuuauauuaaauucuugaucugaucuuaaacuauauaucaaaucuuguacauuuauauuauua

SEQ ID NO: 233 - RNA, 91 nt, Canine adenovirus
acuuugaaaaagcuucuguuuaugcauguagguuauuuaaacaguuuuauaacgaaaaaaaauaugauuuagauaaauguuuuuuaaaagu

SEQ ID NO: 234 - RNA, 64 nt, Hepatitis A virus
gcucuuauaauauuggacuccaccauaggaaacuuccgaaauugagaacaaccacaauaagagc

SEQ ID NO: 235 - RNA, 100 nt, Human herpesvirus 1
cgccacccugcgggcgacccggggggugcucugauagucucgcgugcccaaggcccgugaucgggguacuucgccgccgcgacccgccacccggugugcg

SEQ ID NO: 236 - RNA, 130 nt, Fowl adenovirus D
ccucgucuuugguuggcuccaauccgauuccgagucguccgaauugggcaucggagucuuuucccuggcuccgaauaccugucgaaucuccucgucgucuucguccgagcucacuacccaaagaucgcgg

SEQ ID NO: 237 - RNA, 86 nt, Beet yellows virus
uguuguugcguucgaaaccgaagaggaaucaucggaagcugaacuuccuuugguauaccuccacgauuucgaauuaaacauuaaca

SEQ ID NO: 238 - RNA, 124 nt, Beet yellows virus
cguaaagugacguuuacguucgaaaacggaguccaacuaguguucgggauguauggacucgaacaacggugcguuucuuccgacuacuugugguuugaaaacguuuucguuggcgcgcacugcg

SEQ ID NO: 239 - RNA, 60 nt, Marburg virus
cuuguagaauuaccguggaucacaacuguugcauaucuuccaaaauauaucuuuugcaag

SEQ ID NO: 240 - RNA, 116 nt, Camelpox virus
uagacuuccaaguauuaauucguuacagauccauguaugaaacgagucgcuaauuaguguauaauuuucauuuuuuauaauuuugucauacugcuccagaauuaauaauaucucua

SEQ ID NO: 241 - RNA, 62 nt, Human herpesvirus 1
gcggggggaggagcggggggaggagcggggggaggagcggggggaggagcggggggaggagc

SEQ ID NO: 242 - RNA, 76 nt, Human herpesvirus 1
ggggggaggagcggggggaggagcggggggaggagcggggggaggagcggccagacgccgaaaacgggcccccccc

SEQ ID NO: 243 - RNA, 72 nt, Meleagrid herpesvirus 1
gcuauuaccguaucuaauuccgaggaugaagagcgaaauucgugaucguaaaaauaaaaaauacaagauagu

SEQ ID NO: 244 - RNA, 123 nt, Amsacta moorei entomopoxvirus
uauauuauauaauauuuuauaaaauuaguauuucuuuuauauauuccaauuaauaguaaaauauuuauaaauauagauauaauugaacuaauaaucucuauuguaacaauauuauauaauaua

SEQ ID NO: 245 - RNA, 128 nt, Paramecium bursaria Chlorella virus 1
guuucggggaagggggaggagaagguuucgggggaggagguggacuugugacacucggguuaucauuaacgauacuuacaucggcgcaauuccaaaauucuucggguacagcaccagguucuccacac

SEQ ID NO: 246 - RNA, 81 nt, Human herpesvirus 1
gccccccgcgggcgcgcgcgcgcgcaaaaaaggcgggcggcgguccgggcggcgugcgcgcgcgcggcgggcguggggggc

SEQ ID NO: 247 - RNA, 86 nt, Human herpesvirus 1
gcggggggaggagcggggggaggagcggggggaggagcggggggaggagcggggggaggagcggggggaggagcggggggaggagc

SEQ ID NO: 248 - RNA, 131 nt, Paramecium bursaria Chlorella virus 1
gaauuguccuugagcuuguauacucuguuuacauaccaccugaggguucggggguacuucgugaugcggcagaugacaccgggcggcccuuagugauugccagagaacauauacaaccgaagaccucguuu

SEQ ID NO: 249 - RNA, 81 nt, Amsacta moorei entomopoxvirus
ggauucuauagauuuaauaaauccaacugauucuacuauaaaaucaacagauauuacagauucuauagauuuaauaaaucc

SEQ ID NO: 250 - RNA, 68 nt, Parsnip yellow fleck virus
gaacugagcuuuuuaauuaaagugaaggacccgggccaaggccucgccgucaucuacucggcucaguc

SEQ ID NO: 251 - RNA, 60 nt, Myxoma virus
cgggugcuccgcucuucguaccuguagacuuggaugucuuuuuugauuuagcugcacccg

SEQ ID NO: 252 - RNA, 129 nt, Ectromelia virus
gguauauauuuauaaaaaaguuuuugauuacgaugucauacgcggaaagaggacacauuaacaucauacaucaauuaauuacauucuuauaacaucguaaucaaaagaauugcaauuuugauguauacc

SEQ ID NO: 253 - RNA, 73 nt, Ectromelia virus
uguauucaguauuuuuggaaucauaaaaaaauaaaaaaaguuuuacuaauuuaaaauuuaaaaaguauuuaca

SEQ ID NO: 254 - RNA, 85 nt, Yellow fever virus
gugguucucugcuuuuccuccagaggucugugagcacaguuugcucaagaauaagcagaccuuuggaugacaaacacaaaaccac

SEQ ID NO: 255 - RNA, 107 nt, Macaca mulatta rhadinovirus
gacgccguuaauaauuggcaguaaacugcgaaagggcguacaucgcaguagugauuuuacgaugugcacaccuuuccgcgguucaccgccaacaacaaaagcggguc

SEQ ID NO: 256 - RNA, 111 nt, Paramecium bursaria Chlorella virus 1
gggcgccgccgccacgaaggagacccugcguuuuuucuucguaaaaccauucaaauggcucgccgcgaagaugucuguaccuaccuacaauugugaguguugcaagugucc

SEQ ID NO: 257 - RNA, 61 nt, Human papillomavirus type 20
aacccugcgaaaagaagcugugcuacuauauuuugcuaggcaacaugguaucagcaggguu

SEQ ID NO: 258 - RNA, 79 nt, Human adenovirus A
cuaucuaauaauauaccuuauacuggacuagugccaauauuaaaaugaagugggcguaguguguaauuugauugggugg

SEQ ID NO: 259 - RNA, 131 nt, Ateline herpesvirus 3
uauuugcuugcccgugaugugcuuuguauuuguuuguauguagugcuuucuuuguaaaugucacagaaacuucuaaaagaggcaccuauaauaaaaauauacaucuguaaaaaauuggguuuugugguuag

SEQ ID NO: 260 - RNA, 131 nt, Fowl adenovirus D
gcguacccugcucgggcuggguaccagcagccgacggagaagcggcggucgguccagcagacgccguucccgccccgcuucuaccacuacucgcguaaugcugguacguaccagcccgaagaaggagacgu

SEQ ID NO: 261 - RNA, 65 nt, Paramecium bursaria Chlorella virus 1
cgaauguaucuaguucguugaaguaugcaacucgcauugcaagauacguguuagagaauaguuug

SEQ ID NO: 262 - RNA, 79 nt, Paramecium bursaria Chlorella virus 1
guauuuauacauaucgucaaucgucauuuuuguguaaaaugauaauuacaaaugacaaaugacacuauguguaaauuac

SEQ ID NO: 263 - RNA, 67 nt, Human papillomavirus type 20
gauaucaaccugugccuguauuagcugugucagaagccaaagcuaaacaggcuauaggaaugguauu

SEQ ID NO: 264 - RNA, 82 nt, Human adenovirus A
uguaaguuugggcggaugaggaaguggggcgcggcgugggagccgggcgcgccggaugugacguuuuagacgccauuuuaca

SEQ ID NO: 265 - RNA, 70 nt, Citrus tristeza virus
agcggacgguagugcuuuacuaaaagauaauacuguggucgaucguuuagaaggcaugaauccuuuggcu

SEQ ID NO: 266 - RNA, 61 nt, Citrus tristeza virus
gucggaucgaguuuuauucaaaguuguuauggguacuaacguugacgauucucgaugcggc

SEQ ID NO: 267 - RNA, 114 nt, Melanoplus sanguinipes entomopoxvirus
guaucaaaaauaucaauaucuaauacccaaucaauguuuuuauaucugauaucacaaaauaucaauaauguaucaaaaauaucaauaucuaauacccaauuaauguuuuuauau

SEQ ID NO: 268 - RNA, 63 nt, Sulfolobus virus SIRV-1
gguaaaagaaaguuagaaauuaaagaaauuagugauuuauaugaugaacaaguuuuuuuuacu

SEQ ID NO: 269 - RNA, 72 nt, Human papillomavirus type 36
cgucugaauaugcaucugaaacuuggacauuaguugacaccaguauagaaacuuuuagaagcgcuccagacg

SEQ ID NO: 270 - RNA, 121 nt, Variola virus
uauauauuauaaaaaaguuuuugauuacgauguuauaagaggaaaaaggacacauuaacaucauacaucaauuaacauucuuauaacaucguaaucaaaagaauugcaauuuugauguaua

SEQ ID NO: 271 - RNA, 126 nt, Melanoplus sanguinipes entomopoxvirus
uguuuuuauaucugauauguuaaaauaucaauaauguaucaaaaauaucaauaucuaauacccaaucaauguuuuuauaucugauauguuaaaauaucaauaauguaucaaaaauauaaauaauca

SEQ ID NO: 272 - RNA, 112 nt, Amsacta moorei entomopoxvirus
auauuuaaagaauaaauuuuuauauuauaacaauauaauucuucuaaauuauuaagacuuauuccuuuuagagaaucaaugauuguauaugaacaauuuauuuuuuuaauau

SEQ ID NO: 273 - RNA, 112 nt, Amsacta moorei entomopoxvirus
auauuaaaaaaauaaauuguucauauacaaucauugauucucuaaaaggaauaagucuuaauaauuuagaagaauuauauuguuauaauauaaaaauuuauucuuuaaauau

SEQ ID NO: 274 - RNA, 68 nt, Rat cytomegalovirus
uuguuagccgcuuccuuuuccaugaaauacaaauaauaagaucacggaggaaacgaagaaugcaacaa

SEQ ID NO: 275 - RNA, 64 nt, Shallot virus X
uaagugugcuaaacgccgcagagcaaaacguuauaauagauguuuugacuguggugccuacuua

SEQ ID NO: 276 - RNA, 68 nt, Cryphonectria hypovirus 1
gguugcugcacaaccggggcuuugcccggggauuucaucccguucaaggugaggcccuuguaguaacc

SEQ ID NO: 277 - RNA, 83 nt, Gallid herpesvirus 2
cguuuggaugaagugauuccagaauucgaauuaguaucgaccgauguuaaaauuuuagcugagaaguaucuucaggaugaacg

SEQ ID NO: 278 - RNA, 61 nt, Garlic virus A
cucaaagcucaucucuucuucacuugcgucaacgaauguaaauuaguaagaauagcuagag

SEQ ID NO: 279 - RNA, 70 nt, Rabbit fibroma virus
auuuguuaauggucucgauguaaucgucguagcugcuacgagauaacuuuuuuucugccauuuaagagau

SEQ ID NO: 280 - RNA, 90 nt, Amsacta moorei entomopoxvirus
ucugcaauuaaauucuguuaucgaagugggaagauuuguaaucaaauuaaaaacuuaaaauauuacgauuaacaagauuuuuugaccaga

SEQ ID NO: 281 - RNA, 66 nt, Equine herpesvirus 4
cgucacugaaauacgcgcgcgaggaacgccccgacgaucccggauaucgcgcacaggacagcgacg

SEQ ID NO: 282 - RNA, 65 nt, Louping ill virus
cauggaaugaugcggcacggcgcgacagcgacggggaaauggucgcacccgacgcaccauccaug

SEQ ID NO: 283 - RNA, 73 nt, Gallid herpesvirus 2
caucuguaauuaauagguuccucgauuuacaucaaauuuugaaagacuguuaggacuguugggaaauaaggug

SEQ ID NO: 284 - RNA, 111 nt, Human herpesvirus 2
uuguaggugcggauaggucucucuacagagcuguauaggugugacgguccgggacacccaagcccgccgccccuguguacaguggcugcggcgacgaccccgcuccaacaa

SEQ ID NO: 285 - RNA, 99 nt, Ictalurid herpesvirus 1
cccugcucacguacgaguucgaucuaaucuucggggugcguaugcgaaguuguugcguuacaguguuccauucguacuguacguugagcgcuaauaggg

SEQ ID NO: 286 - RNA, 85 nt, Louping ill virus
gcgguucuuguucucccugagccaccaucacccagacacagauagucugacaaggaggugaugugugacucggaaaaacacccgc

SEQ ID NO: 287 - RNA, 61 nt, Sulfolobus virus SIRV-2
ugaugagaaaguauucuucacuguagacauguuauauuaucagaaacuucaagaauuauca

SEQ ID NO: 288 - RNA, 68 nt, Ictalurid herpesvirus 1
accgcaggagguacccguagucguugaaaaauugaaaguggcggcuccguaugugauccuccuccggu

SEQ ID NO: 289 - RNA, 70 nt, Marburg virus
ucacuuucaguuuuuaguuucaacucuuauugcgagacuugaacacaauucuacuaacuucaauaaguga

SEQ ID NO: 290 - RNA, 68 nt, Fowlpox virus
uagauauaaaacuagguaaucuauacacacuaaaaaguuuuuauacauuacgauagauauuauggaua

SEQ ID NO: 291 - RNA, 89 nt, Reston Ebola virus
ggucugaggaagauuaagaaaaaggccucguguucacuugguugccgucaaguauccugugguuuuuuucuaccuaacuuccucaugcc

SEQ ID NO: 292 - RNA, 66 nt, Bovine herpesvirus 4
ucuguccaaucggaagugaaaccacaucuuugugucauuuuuaaucagccccguuaaagguacaga

SEQ ID NO: 293 - RNA, 65 nt, Human herpesvirus 1
gccgcccugcgacacaaucacccguccgugguuucgaaucuacacgacaggcccgcagacgcggc

SEQ ID NO: 294 - RNA, 63 nt, Sheeppox virus
uuuauuuauuaaauauagacgaucccauaaaauauaaugagguuaguuuauagaauaggaaga

SEQ ID NO: 295 - RNA, 110 nt, Alcelaphine herpesvirus 1
guauuugguggagucguaaagcugacagagucccugggugcgcugggcugcccgcacugaaguaaaguuaaacucacucccuagacagguuuugagcuccaccacguaac

SEQ ID NO: 296 - RNA, 130 nt, Ectromelia virus
guuagagacggaaauaguugucaagauucucuaucguccuaauauaccauuaaaaauuguuagauuuuuccgcaauaacaugguaacuggaauagagauagccgauagaucuguuauuucagucgcugau

SEQ ID NO: 297 - RNA, 67 nt, Infectious spleen and kidney necrosis virus
ggaaaugcgccagagggugaugcugggucgcacggcgccaacugacagguaucuacuggacuuuucc

SEQ ID NO: 298 - RNA, 107 nt, Monkeypox virus
cguacuacugagauauacuaccgauauagaguauaaugauuuaguuacuuuaauaaccguuagacauaaaauugauucuaugaaaacuguguuucagguauuuaacg

SEQ ID NO: 299 - RNA, 66 nt, Fowlpox virus
gauaucucauuauuugauuauguagcgccaggagcuguuauauuaagucaaucuaaucacucuauc

SEQ ID NO: 300 - RNA, 74 nt, Human adenovirus D
ugcccagcagcagcaguagccccucugugcccaguuccaucaucgccgaggagaacugcuggcccugcuggccg

SEQ ID NO: 301 - RNA, 66 nt, Rhopalosiphum padi virus
auuagagaaccacguaauugggucaacccguuaauaccgguccaccaagcccuggaaaucucuagu

SEQ ID NO: 302 - RNA, 131 nt, Vaccinia virus
ugguuugauauuucauauacuauuuauaagauauccauaucaucauuguguaaacuaaauaacgucuucuauguauuuaguaaggacauuggauauguggaaaaguaugauggugcauggaaguuaguaca

SEQ ID NO: 303 - RNA, 62 nt, Hepatitis GB virus C
ggugguggaugggugaugacaggguugguaggucguaaaucccggucauccugguagccacu

SEQ ID NO: 304 - RNA, 88 nt, Infectious spleen and kidney necrosis virus
guauaaucaguuugauguugugcauuuaauacccaucgcaguauccaaggacacuguggcggcaaaugauuacauuacauugcaguac

SEQ ID NO: 305 - RNA, 71 nt, Infectious spleen and kidney necrosis virus
gugcggugcacguugacaucauguucaaaguaggcgaggcuguggacaacgagcugacgcugacaccggau

SEQ ID NO: 306 - RNA, 127 nt, Hepatitis GB virus A
aggguacgucuaucgguccggcuggcccgaaaggcgguggauccuguguguuaggguucguaggugguaaaucccagcacaggugguaaucgcuauagggcaggcuuaucccggugaccgcuucccu

SEQ ID NO: 307 - RNA, 60 nt, Hepatitis GB virus A
ggggccuccggugugaauaagcccucgucuggagcaucagacguuaaacugagacguccc

SEQ ID NO: 308 - RNA, 68 nt, Hepatitis GB virus A
ccccacguauggcaacgccgcuuaaaacccuucggggacagcuaugcggguugacaaugccagugggg

SEQ ID NO: 309 - RNA, 94 nt, Hepatitis GB virus A
gcggcgccgugcuacaggcggcaaggggaaaaauccuucgggugaccccggguggcauucccucccuuagcagcaugaguguggugguagcugc

SEQ ID NO: 310 - RNA, 73 nt, Diatraea saccharalis densovirus
gguccgcugccuagcuacauccuguuuugcacacggcuccagcuucgacgggaguuugcggucaagcgagguc

SEQ ID NO: 311 - RNA, 69 nt, Lymphocystis disease virus 1
cuuucaaccauaaauaaugucguuguuuuaaauuuauaucgaugaacuaauuuuaaaucugguggaaag

SEQ ID NO: 312 - RNA, 108 nt, Bovine herpesvirus 4
uuguauauauuauaguuucauuaugggcauuuuaucauaccucugcaccuuucaacugacuaacugcagaugaaaaauaaaauaucacccaagcuaagauaguaucaa

SEQ ID NO: 313 - RNA, 70 nt, Variola virus
gggacagaccagaccuaggagcuauucuaccauagcagaacuuaggcauggacauacuaauaucugucuu

SEQ ID NO: 314 - RNA, 90 nt, Alcelaphine herpesvirus 1
acaggccggguuuuaaaacuuacucaggggaauuguuuuuuuuaguucugugaggaucuaacucuaaguugacacauaaauuaggccugu

SEQ ID NO: 315 - RNA, 106 nt, Rhopalosiphum padi virus
gauguuaaauauuauuagucucauuaacaaaccacgcaacuaugucaacccgcuaauaccggucuaauaggcccuggaaauuguuaauaaauaauauuguaacauc

SEQ ID NO: 316 - RNA, 101 nt, Rhopalosiphum padi virus
cauauauauguaauagucucaucacuaacccacgcaacugugucaauccguuaauaccgguccaacaggcccuggaaauuaguggcaauaacauauauaug

SEQ ID NO: 317 - RNA, 76 nt, Vaccinia virus
ccgcuucuauuuacucccgcagcacaaugaaccaacacgggcucguuucguugaucacauuuagauaaaaaggcgg

SEQ ID NO: 318 - RNA, 60 nt, Human adenovirus D
cucgucgcuugacagcaccgccgcagccgcggcagccgcagccgccaugacagcgacgag

SEQ ID NO: 319 - RNA, 78 nt, Vaccinia virus
guuaggcaauguauauuuauccaucgucaaauuuaaaacauauuugaacuuaacuucagaugauggugcauccauagc

SEQ ID NO: 320 - RNA, 91 nt, Camelpox virus
auauuuuucuauaaucugucuuuuaaacgauggauuuuccacaaaugcgccucucaagucccucauagaaugauacacguauaaaaaauau

SEQ ID NO: 321 - RNA, 76 nt, Camelpox virus
ccgcuucuauuuacucccgcagcacaaugaaccaacacgggcucguuucguugaucacauuuagauaagaaggcgg

SEQ ID NO: 322 - RNA, 76 nt, Ectromelia virus
ccgcuucuauuuacucccgcagcacaaugaaccaacacaggcucguuuuguugaucacauuuagauaaaaaggcgg

SEQ ID NO: 323 - RNA, 130 nt, Variola virus
acgguagaauugauaauauaaauaugagcauuaguauuucuguggauuaauagauuucuaguaugggaucauuaaucauuucuaaucucuaaauaccucauaaaacaaaaaagcuauuaucaaauacugu

SEQ ID NO: 324 - RNA, 76 nt, Y73 sarcoma virus
gcggguucuuguauuccgugugauagaugguuggauugauaaucgauuggcuggcauacggaauauaggaggucgc

SEQ ID NO: 325 - RNA, 69 nt, Y73 sarcoma virus
cugaggggaccauagcauguauaggcgaaaagcggggcuucgguuguacgcgguuaggaguccccucag

SEQ ID NO: 326 - RNA, 74 nt, Variola virus
cgcuucuauuuacucccgcaacacaaugaaccaacacgggcucguuucguugaucacauuuagauaagaaggcg

SEQ ID NO: 327 - RNA, 63 nt, Variola virus
auuauuagacgaguuacaaacuauuuggauagacacauaugcgaucagauauuugcuaauaau

SEQ ID NO: 328 - RNA, 66 nt, Equine infectious anemia virus
ggguuuuauaaaugauuauaagaguaaaaagaaaguugcugaugcucucauaaccuuguauaaccc

SEQ ID NO: 329 - RNA, 63 nt, Human papillomavirus type 29
uguagcuaaagcuaaagcaugcagugcuauugaaaugcauguagcuuuacaacaauugcaaca

SEQ ID NO: 330 - RNA, 65 nt, Bovine papillomavirus
guuuggggaugaaccauggucuuugcuugacacaagcugggaccgauauaugucagaaccuaaac

SEQ ID NO: 331 - RNA, 63 nt, Soil-borne cereal mosaic virus
acauuaugcauugugguuuuguugugugguuuguuuuugcuuauauugcuauguugcaugugu

SEQ ID NO: 332 - RNA, 79 nt, Soil-borne cereal mosaic virus
gccuauuuguacgggucgaguacaaacguggccaucacgauagaugguucuguuuuucgaacagauguaaaucggaggc

SEQ ID NO: 333 - RNA, 129 nt, Soil-borne cereal mosaic virus
caucacgauagaugguucuguuuuucgaacagauguaaaucggaggcgucgugcaguacgguaaacugcacaucuauccucuaguuucuauugauguaauugaaaaaagaucaauauuuuacgaugaug

SEQ ID NO: 334 - RNA, 65 nt, Equine infectious anemia virus
cucagucccugucucuaguuugucuguucgagauccuacaguuggcgcccgaacagggaccugag

SEQ ID NO: 335 - RNA, 101 nt, Phocoena spinipinnis papillomavirus
uguuacgucccacuggcacauuuaaaaaaaaugguaagaggguucuuguaacauuugauggggaugagagcaaucugauggaauauauguguugggaagca

SEQ ID NO: 336 - RNA, 131 nt, Equine herpesvirus 4
guuugcugcaugcacgcgacaaacacgagauugugcucgaugaagguuagucaacgauuuauuugguuauaagcggggauagacgcgcauugaugcuacauaugaauuaacugcggcguguuggggguuau

SEQ ID NO: 337 - RNA, 82 nt, Variola virus
uaccgauauacaguauaaugauuuaguuacuuuaauaaccguuagacauaaaauugauucuaugaaaacuguguuucaggua

SEQ ID NO: 338 - RNA, 66 nt, Human papillomavirus type 70
auauauuaugugcacgagcagcauaagacauauuaugaaguguuuaagcaggaugcacaaauguau

SEQ ID NO: 339 - RNA, 60 nt, Human herpesvirus 6
cacgccgcuaugggaggcgccguguuuuucaccaacacgcgcgccgcugcgagacgcgug

SEQ ID NO: 340 - RNA, 72 nt, Cowpox virus
uguauucaguauuuuuggaaucauaaaaaauaaaaaaaguuuuaccauuuuaaaauuuaaaaaguauuuaca

SEQ ID NO: 341 - RNA, 76 nt, Meleagrid herpesvirus 1
gugugagcccuucacgucggggguguuuguguguuugugaagcagcauaaacagccccgauuugacagguucgugc

SEQ ID NO: 342 - RNA, 94 nt, Paramecium bursaria Chlorella virus 1
auacacaguacuuguaauuucuugaaacaucuccucgaauauggcauuaacuuucuuuuuguauuuagagauuacaucaguugacaccgugugu

SEQ ID NO: 343 - RNA, 60 nt, Equine herpesvirus 4
gcccaacggugccccuuuaucgccguaugaauaugugaagagcgauaacagcacccacgc

SEQ ID NO: 344 - RNA, 68 nt, Human herpesvirus 2
gggggggugggccucguccccacgcagacccgcgggcaaaugcgagaacgggacccgcgcgccugccu

SEQ ID NO: 345 - RNA, 61 nt, Human papillomavirus type 70
guggcagacaaagccaaaacaauguuuuaaaaaaaaagguguuacaguggaggugugguac

SEQ ID NO: 346 - RNA, 83 nt, Ovine lentivirus
gcgcugcugggggacaggaggaggguucgcagcccugagacuuaaagaaggggacgagcccuccgccugaaccugaggagugc

SEQ ID NO: 347 - RNA, 68 nt, Meleagrid herpesvirus 1
gaaccugucaaaucggggcuguuuaugcugcuucacaaacacacaaacacccccgacgugaagggcuc

SEQ ID NO: 348 - RNA, 125 nt, Friend murine leukemia virus
guugggccaaacaggauaucugcggugagcaguuucggccccggcccggggccaagaacagauggucaccgcgguucggccccggcccggggccaagaacagaugguccccagauauggcccaac

SEQ ID NO: 349 - RNA, 72 nt, Meleagrid herpesvirus 1
acgaaccugucaaaucggggcuauuuaugcugcuccacaaacacacaaacacccccgacaugaaggguucgu

SEQ ID NO: 350 - RNA, 64 nt, Gallid herpesvirus 3
uccguccaucggcguggugcucgaucccgucauucggugaucucaagcaccccgcgaaggagga

SEQ ID NO: 351 - RNA, 131 nt, Rat cytomegalovirus
gaggcggucggcggaggaggcggcaggaggcggcagaggaggccggagggcgugggcugcccuggccccccgucgcgccgcucucucuccccuuuucccgcucucucuccccuuuucccgcccgccugccc

SEQ ID NO: 352 - RNA, 99 nt, Human herpesvirus 1
ggguaccacaggugggugcuuuggaaacuugccggucgccgugcuccugugagcuugcgucccuccccgguuuccuuugcgcucccgccuuccggaccu

SEQ ID NO: 353 - RNA, 100 nt, Chimpanzee cytomegalovirus
gccgaaagccgcgugucggugacacgucgucuugagacggugucuuauauaucuucuuaagacgccggacaugacgcgcccaagacacguggauuuuggc

SEQ ID NO: 354 - RNA, 62 nt, Human herpesvirus 6
guuuuucuugucuacugguuaacauauacaacaacacaauuaacuuccuguaaaagaaaaac

SEQ ID NO: 355 - RNA, 94 nt, Myxoma virus
ccgaggucgucgguuucgaguauuuccacuuugugcauaccccccuucauucggcgggguuuagacuuugucgauuuucuaccggcauuuacgg

SEQ ID NO: 356 - RNA, 63 nt, Human papillomavirus type 55
guaauaaccuuacaaaacauauacaacauuggaaaugcauaagauaugaauguguguuauuac

SEQ ID NO: 357 - RNA, 63 nt, Melanoplus sanguinipes entomopoxvirus
aaucugacuuaguuaaauauguggauuuaguuaaaaauucauauaauuuuaauauuucagauu

SEQ ID NO: 358 - RNA, 75 nt, Rat cytomegalovirus
acauauccgucaccgggagggucguuguucucauaucguggucgaggguccuucuguuagggggugacggugugu

SEQ ID NO: 359 - RNA, 64 nt, Melanoplus sanguinipes entomopoxvirus
uuauuuuuuaaauauuaauuuuucauagacuauuuacuauaugaaauuuuauaaauaaaaauaa

SEQ ID NO: 360 - RNA, 83 nt, Fowlpox virus
uaucuuuuaauaugaauuacuucacuuuaucuuucuuaccugauuauuguuuaaagauuaaaagugaaauauauuggaaggua

SEQ ID NO: 361 - RNA, 68 nt, Amsacta moorei entomopoxvirus
uuuauuauuauccauaauauauaauauauaauauauaauauauaauauauaauauaucuuauaauagg

SEQ ID NO: 362 - RNA, 66 nt, Tupaia herpesvirus
gccguacguggguucacagcuuuuuuuuuaccgagaucagggacacgcaagcacggucacgucggc

SEQ ID NO: 363 - RNA, 61 nt, Chinese wheat mosaic virus
uguccuuacugacaucugcguuuguaucugugugugcgugcuggauucgguaaccaggaua

SEQ ID NO: 364 - RNA, 77 nt, Variola virus
auuuuuaucauaacacuacuuugguuagauguuuuagaaaaaaaauaucgccguaccguucuuguuuuuauaaaaau

SEQ ID NO: 365 - RNA, 85 nt, Variola virus
ugauuuucuuucuaauacuauauauuucucucgaagaaguucuugcacaucaucugggaauaaaauacuacuguugaguaaauca

SEQ ID NO: 366 - RNA, 102 nt, Rat cytomegalovirus
ccucguggcgcgcguccgcgccggggucgcgaggucccggaccgaggucucccgcccgcgaccccggcgcggcgccgcggaaaaacagacgacgacacgagg

SEQ ID NO: 367 - RNA, 121 nt, Peanut clump virus
ccuuaggguguugaaagguguccaacgaccguguaggaaaagaagaguucguucgcgacugggcuuugucccugccucuucuucuguuaccauuucguggauuaccucuaucgccuuaagg

SEQ ID NO: 368 - RNA, 85 nt, Human coronavirus 229E
uauacacuaaugagccucuuuguuguguauuuugcuuuauuuaaagcaagaucacaccguggcagagcugcucuuauaguguuua

SEQ ID NO: 369 - RNA, 130 nt, Paramecium bursaria Chlorella virus 1
ucuuccggaaagacuucagacagaucggaaauaaaagaccgcauaacaguguugaaaucagugaacuucugggacauauugguaauaaugugguauacgaguuucaaaauguuaaguuaauacgguauga

SEQ ID NO: 370 - RNA, 80 nt, Human papillomavirus type 60
gguaaguacauguucauacaaaguuuugacucacucucuuuguuagaaaccauuuccguucuguggauaugcgccagacc

SEQ ID NO: 371 - RNA, 81 nt, Cowpox virus
agaaauuggucuguguuacauaucucuucuauauuauuguugauguauuggcuuagaaaacuauuacuuagaccauuuucu

SEQ ID NO: 372 - RNA, 76 nt, Bovine adenovirus B
aagaccacugcaacagcuucugcguacgcuuguauuuacaguacauaaaaaagcacuuuugccacagagcggucuu

SEQ ID NO: 373 - RNA, 89 nt, Human coronavirus 229E
cgcuuagcaaugcgaaaguuagugcugaaguuucacgacagguuauccaagacgugaaagauggcacuguuaccuucaacuugcuagcg

SEQ ID NO: 374 - RNA, 80 nt, Human papillomavirus type 60
ucacuuggcacacucucggauuuaacaagcauugcuggacacuuaccaaccguaacugguuaaaaaagagcgccaaaggg

SEQ ID NO: 375 - RNA, 87 nt, Camelpox virus
uugauuuucuuucuaauacuauauauuucucucgaagaaguuuuugcacaucaucugggaauaaaauacuacuguugaguaaaucag

SEQ ID NO: 376 - RNA, 130 nt, Peanut clump virus
gcggugucuguguuuaccacucgugacgacguucagaacuucuguacgguucucuucgugagacugagcacggcucugcccgucagucguuuugacauuuucgucuguaguggagcgcgaauaccagggc

SEQ ID NO: 377 - RNA, 90 nt, Human coronavirus 229E
gugccauugcuguauuggucucaagcauauauuuacgcaacuuugauugcuguaauuuugcuuggaagauuuuuccauacagcuuggcac

SEQ ID NO: 378 - RNA, 76 nt, Human papillomavirus type 53
auacaauacuacacacgccauauaugcugcuaggccuguaaacuugcaaccauuguguuguguguuaguuuugugu

SEQ ID NO: 379 - RNA, 71 nt, Human herpesvirus 6B
gacauuuaccagagauacgugauacucggucuacuguguauuguguaccuuguaaucucuagguaaacuuc

SEQ ID NO: 380 - RNA, 124 nt, Human herpesvirus 2
gauugccaucgcggacgcacgcggggacccgccagagacccugccccccggcgcgggcggcgccgcgcccgcgugccgcagaccaccucgcggcggcucccccgcggccuuucccguggcccuc

SEQ ID NO: 381 - RNA, 76 nt, Human herpesvirus 6B
uacugaucucuuuguuuuuuuuuuucuguguauugugauagggaagguuuguaaggacaaaggacaaaguucagua

SEQ ID NO: 382 - RNA, 92 nt, Variola virus
gaucauauaguuauguauauuagugacgaaucaagagaugaaaauaauccugaauauauugauuuucguaacagauacggagacuauagauc

SEQ ID NO: 383 - RNA, 77 nt, Dengue virus type 4
gauccugcugucucugcaacaucaauccaggcacagagcgccgcaagauggauugguguuguugauccaacagguuc

SEQ ID NO: 384 - RNA, 86 nt, Garlic latent virus
agugugugauaaugccggggcuucacgcuacgcucgcgcucguagagcuaagagcauaggucggugcccucguugcuucaggugcu

SEQ ID NO: 385 - RNA, 68 nt, Gallid herpesvirus 2
gcacuuuuuuuuuccgauuuugacuccucguacauauaucgauaauguagcuauuggaggauggaggc

SEQ ID NO: 386 - RNA, 97 nt, Grapevine trichovirus B
gcucaacaguauaggauuuuaagucuccuuuguagaaucaauaaaguuagugugucauucguagugaguugucugguuaggagggagugugucgggc

SEQ ID NO: 387 - RNA, 60 nt, Rat cytomegalovirus
ggagcgggggggaucucgacgcgcgcgacggacagaucgagacggaccaggcccggcuuc

SEQ ID NO: 388 - RNA, 129 nt, Rabbit oral papillomavirus
cagcaauuuuacaguuuugucuugucuggagaccgcugccggucgcgcuaaucccucagguaagcuuaaaggauuagcugcucgaccgaaagcggucccaggugguaggaauuacucaggcgauuguug

SEQ ID NO: 389 - RNA, 66 nt, Equine herpesvirus 1
gguuuucuucgaggccgucgcgaggccgaaaaauuuuuuucacgggcccgcgcccgagagagagcc

SEQ ID NO: 390 - RNA, 60 nt, Paramecium bursaria Chlorella virus 1
gaaaucaagggaugcguugaaucuucucauaaaaagacucaacgucauuucgauuauuuc

SEQ ID NO: 391 - RNA, 110 nt, Tupaia herpesvirus
ugggucucgcgauagcuuuguguucgucgaucgucgacgccgcucccaacgcgaucucgguuaacggugguuuguacgauagaaaagccuguugucagagagcggaccca

SEQ ID NO: 392 - RNA, 89 nt, Apple latent spherical virus
uagagcuugugaguuguuauuacguuuuguuguuugaaucucuguuuuguuacucugauuuccuucacguuugcaccuuacacucucua

SEQ ID NO: 393 - RNA, 71 nt, Grapevine trichovirus B
ugucuaaaucuugaagagguaaucgagcgguugguuaaccgauccuuaccgccugucuucucgauaaggca

SEQ ID NO: 394 - RNA, 62 nt, Pestivirus Giraffe-1
ccccgaugcgaaggccgaaaagggcuaaccaugcccuuaguaggacuagcaaaaaaucgggg

SEQ ID NO: 395 - RNA, 67 nt, Fowlpox virus
aucauaaaaucuuuaauuauuauuuauauuuuauuagcgauauaaaucuaucaaagaaccuuaugau

SEQ ID NO: 396 - RNA, 94 nt, Chimpanzee cytomegalovirus
ccgccgaaagcgguagaaagagccagaagcggcccucgcagacgguacgcaucccccuguuuuuggccccgcucccccgcuuuugacaucacgg

SEQ ID NO: 397 - RNA, 75 nt, Avian sarcoma virus
auucccugacgacuacgaacaccuaaaugaagcggaaggcuucauuuggugaccccgacgugauaguuagggaau

SEQ ID NO: 398 - RNA, 111 nt, Rous sarcoma virus
guugauggccggaccgucgauucccuaacgauugcgaacaccugaaugaagcagaaggcuucauuuggugaccccgacgugauaguuagggaauaguggucggccacagac

SEQ ID NO: 399 - RNA, 61 nt, Alcelaphine herpesvirus 1
accacaaaaugucacaauaauuauuuuuuuuaaaaaauuaguaguuugucccuuugauggu

SEQ ID NO: 400 - RNA, 60 nt, Y73 sarcoma virus
cugagugacgucggagggagcuccacggccgggggccaagauaaccuaccgagaacucag

SEQ ID NO: 401 - RNA, 107 nt, Paramecium bursaria Chlorella virus 1
gcaauuagauuuguaauguuugauaccgccaacgucucugaagaaacaaaaaucucggcugauauagaaguugcgucgaaucuugucacguuuagaucugaauuugc

SEQ ID NO: 402 - RNA, 61 nt, Chimpanzee cytomegalovirus
guggcguaggaguggcgaaccggcgucauuauaaucaaacgccggagucgccgcccgccac

SEQ ID NO: 403 - RNA, 78 nt, Avian sarcoma virus
ggcgaaaagcugaguggcgucggagggagcucuacugcagggagccaacauacccuaccgagcacucagagagucguu

SEQ ID NO: 404 - RNA, 122 nt, Tupaia paramyxovirus
uacaguucaaggauaauuacaucuggguagucuuaaaccaccucauaugaaagucccagucaaagcuuaccuucauuacaguuucacuugcucuuucacuaucccaguacccuaaaccugua

SEQ ID NO: 405 - RNA, 90 nt, Fujinami sarcoma virus
gaccguugagucccuaacgauugcgaacaccugaaugaagcggaaggcuucauuuggugaccccgacgugaucguuagggaauagugguc

SEQ ID NO: 406 - RNA, 86 nt, Alcelaphine herpesvirus 1
ggaacuuuaaaugugacgcaucuuuucagguaguguuggagacauagaucagauuugagaggaaccacagaacaucaaagguauuc

SEQ ID NO: 407 - RNA, 97 nt, Paramecium bursaria Chlorella virus 1
guggcuugaacaucuacuugagaagauacuacguucgaagcgaccagcgagguuacguucaaagugucuacguuagacgauguuaagaucaaguuac

SEQ ID NO: 408 - RNA, 122 nt, Paramecium bursaria Chlorella virus 1
gauguuaagaucaaguuaccaauauuaaaaacauuuguuauaacauucccgaagaacguuguguucgugguuacuguuccuacauuggcauuugauaucguagcaacauugguuguaacauc

SEQ ID NO: 409 - RNA, 80 nt, Fowlpox virus
ugaaacaauuacguauaaagaacuaugcaauauauuaggugauaagaccuauauaacuauauuugugaguaauugcuuua

SEQ ID NO: 410 - RNA, 80 nt, Yaba-like disease virus
gaagaucgagaagagaaaaguacaaugugaaguaauagcuacugcccuggacuauguauugguagcuccugucgauauuc

SEQ ID NO: 411 - RNA, 63 nt, Yaba-like disease virus
gaaguagcgaaccucugcucacugcccgggcccuccgggaggugagcaggaguugcgcuuuuc

SEQ ID NO: 412 - RNA, 67 nt, Yaba-like disease virus
cccuacagaaaagauaauggcuaccauccacaagggauuacugaaggccuuagaucugagcuugggg

SEQ ID NO: 413 - RNA, 66 nt, Yaba-like disease virus
ggggaccaguucugauagugacagauaguaauuauguugcuaagaguuauaaugaagaauugcccu

SEQ ID NO: 414 - RNA, 70 nt, Yaba-like disease virus
gcggcacaccagaaacuugcacaaacuccggauucagcagaaauuugcccaagugcaacaccguguccgc

SEQ ID NO: 415 - RNA, 75 nt, Yaba-like disease virus
ucugaauaaaacaucaaugucgcaauuuguauuguccaauacagaaugucuaugauucguguuaaaaccaucgga

SEQ ID NO: 416 - RNA, 126 nt, Yaba-like disease virus
agagacugugauggggcagccuacuccgaagaccccucgacaacuaagggaguuccuagggacggcaggcuucugucgccucuggaucccuggguuugcagaaauggcagcccccuuguacccucu

SEQ ID NO: 417 - RNA, 81 nt, Yaba-like disease virus
uuuguauuucccugugucguucguggucucguucgugauuuuuuaaagaugagaguugaaaugcuacauaugaaauauaga

SEQ ID NO: 418 - RNA, 63 nt, Yaba-like disease virus
agagggggaguguguggucuguagagagacaugaguugaucggcagacccccucucccccucu

SEQ ID NO: 419 - RNA, 83 nt, Yaba-like disease virus
ucucacccugacagcugucagggguuacaugagagaacuucauguaaccccugacagcugucaaccuaauccugaccgugaga

SEQ ID NO: 420 - RNA, 86 nt, Yaba-like disease virus
gcauuguuuacagcagaugucguagacaucuugaaggacauaccaaauguucagguauauguggaugacgucuaugugagcucagc

SEQ ID NO: 421 - RNA, 63 nt, Yaba-like disease virus
gacacuuugccagcgguuguagauuuaucauauuucuccacuacauauccguuacaauuuguu

SEQ ID NO: 422 - RNA, 72 nt, Yaba-like disease virus
guaaggguacucucaucaccaauguaaauuaauauguagcaaacuuuggugugggaguccuaccccuuuugc

SEQ ID NO: 423 - RNA, 100 nt, Yaba-like disease virus
agggcaaugcucuagcagauaaacaagcuguuucaggaagcuauaaggucuucucaaaugaauugaaacccagccuggaugcagagcuugagcaaguccu

SEQ ID NO: 424 - RNA, 70 nt, Yaba-like disease virus
ggcauauauuccugauccgccaaugauucaauccuuaggaugggauagagaaauuguaccuguauauguu

SEQ ID NO: 425 - RNA, 93 nt, Yaba-like disease virus
uauauacgauaagauauguuuauucauaaacgcgucaaauuuuucaugaaucgcuaaugaguuuaagaaucucaugucaaauuguccuauaua

SEQ ID NO: 426 - RNA, 101 nt, Yaba-like disease virus
gcugucauuaaauauuuaucaucuaaacuguucuaauuguauacuuacuaacuguauuagaggaguagccaaaggagaacaaguuaucauaguaaaacagc

SEQ ID NO: 427 - RNA, 64 nt, Yaba-like disease virus
aaugguagcgcaucuuuaacucgucaguuagcucuuucuuuugaucgaguucgucgcuacuauu

SEQ ID NO: 428 - RNA, 80 nt, Yaba-like disease virus
uaggggaccucggauaucgggccucggccaagaaagcccaaauuugccagaaacaggucaaguaucugggguaucuucua

SEQ ID NO: 429 - RNA, 87 nt, Yaba-like disease virus
cugaggaggggcugcaacaugacugccuugacaucuuggcugaagcccacggaacuagaccagaucuuacggaccagccucucccag

SEQ ID NO: 430 - RNA, 61 nt, Variola virus
guuacuauuauuuauaacugauguaacccacguaacauuagaauuaauuaucgauaguaau

SEQ ID NO: 431 - RNA, 74 nt, Variola virus
cgcgcacaucugccgucugcgcaacaccgcguccgucaaggugcuguuggggcgcaagagcgacagcgagcgcg

SEQ ID NO: 432 - RNA, 126 nt, Variola virus
gagacugugauggggcagccuacuccgaagaccccucgacaacuaagggaguuccuagggacggcaggcuucugucgccucuggaucccuggguuugcagaaauggcagcccccuuguacccucuc

SEQ ID NO: 433 - RNA, 68 nt, Variola virus
ggcggcgaucuuccacgcgcuccucaacgccacgacguaccgggaccuggaggaggacuggcgccgcc

SEQ ID NO: 434 - RNA, 93 nt, Variola virus
uauauacgauaagauauguuuauucauaaacgcgucaaauuuuucaugaaucgcuaaggaguuuaagaaucucaugucaaauuguccuauaua

SEQ ID NO: 435 - RNA, 78 nt, Variola virus
agcgguuguagauuuaucauauuucuccacuacauauccguuacaauuuguuaagaauuuagauacaucuauauugcu

SEQ ID NO: 436 - RNA, 61 nt, Human papillomavirus type 84
guuuaaaaaauccaaaauucuuaauagaaauuuauugugaaauuuaaaagauuuuguaaau

SEQ ID NO: 437 - RNA, 68 nt, Human papillomavirus type 84
ccgcagaguguuccggauugcagguuugggcaaccuguaugaauuuggaguccacaacaacucugcgg

SEQ ID NO: 438 - RNA, 84 nt, Human papillomavirus type 84
ucaacaauggagaugacaacguccugaucuguccggcaguggagguaggcagagucagacaggaacuguacagacauugguuga

SEQ ID NO: 439 - RNA, 60 nt, Human papillomavirus type 84
gaaauauucccaagauucgggaugccacagguauuggguuccgauaaugggccugccuuc

SEQ ID NO: 440 - RNA, 65 nt, Human papillomavirus type 29
gcugaguaccacauguccaauggcaguuuuccaacucgccuccgaggucaucccagguccucagc

SEQ ID NO: 441 - RNA, 81 nt, Variola virus
cuggggccuuggcgucggccgguggccuaccuguccaaaaagcuagacccaguggccgcuggguggcccccuugccuacgg

SEQ ID NO: 442 - RNA, 87 nt, Variola virus
cugaggaggggcugcaacaugacugccuugacaucuuggcugaagcccacggaacuagaccagaucuuacggaucagccucucccag

SEQ ID NO: 443 - RNA, 64 nt, Human papillomavirus type 84
agaguggcuuggggugcagucucggcgcacacgugcgcggcaccccaaacuccguagccacuuu

SEQ ID NO: 444 - RNA, 60 nt, Human papillomavirus type 84
uagugguguuugagcguggugauguaggucuuuuuacuauuauuuugcuuuuaauuguua

SEQ ID NO: 445 - RNA, 73 nt, Human papillomavirus type 84
cgagagacguuucucgcuuacuauacagggccaaagcgcaccauguaugagaaagcggugaauucccucuacg

SEQ ID NO: 446 - RNA, 108 nt, Human papillomavirus type 84
gagaccuagcagacuuccggauccagcacccagacuugauccugcuacaguacguggaugacuuacugcuggccgcuacuuccgaacuagacugccaacaagguacuc

SEQ ID NO: 447 - RNA, 105 nt, Human papillomavirus type 84
ccgacuauuaugaaagguuacucgguugaacagauuggaagacauauugagaacgcguuccgaucguucaccgauccaguggccauuggauuugaugcaagucgg

SEQ ID NO: 448 - RNA, 131 nt, Human papillomavirus type 29
uuuuugguccacuuuuccauacguuuauauucuuuuaauccugcguuauccguuuccguuauauacagggauagaucuugcaaguuaaauagaaugcucuuaaauaaugucauuuuuuuauccgcuaaaaa

SEQ ID NO: 449 - RNA, 65 nt, Human papillomavirus type 29
cgaaguugaaaacuuuggcuugagcaccgaucauuugaccugcuuaagcuaucgucuucacuucg

SEQ ID NO: 450 - RNA, 63 nt, Human papillomavirus type 29
uguuauuuauaguuuauagacauuugggauuauuauaaccuguauauaaccuguauuuguaca

SEQ ID NO: 451 - RNA, 93 nt, Human papillomavirus type 29
uauauacgauaagauauguuuauucauaaacgcgucaaauuuuucaugaauagcuaaggaguuuaagaaucucaugucaaauuguccuauaua

SEQ ID NO: 452 - RNA, 64 nt, Human papillomavirus type 29
aaugguaacgcgucguuaacucgucgguuaacucuuucuuuugaucgaguucgucgcuacuauu

SEQ ID NO: 453 - RNA, 78 nt, Human papillomavirus type 29
agcgguuguagauuuaucauauuucuccaccacauauccguuacaauuuguuaagaauuuagauacaucuauauugcu

SEQ ID NO: 454 - RNA, 65 nt, Human papillomavirus type 29
uauauaugacauaauaaauugguaaauccuaguucugguauuuuacuaauuacuaaaucuguaua

SEQ ID NO: 455 - RNA, 67 nt, Human papillomavirus type 29
ccaaauacaucgacugcuacugcugguggaccuaucguuguccuaaagcaguugccgauuuauuugg

SEQ ID NO: 456 - RNA, 63 nt, Human papillomavirus type 29
cggucggcgccgauuuccggcccggcgcguccccgcggggccgguccagaucgcggucgcccg

SEQ ID NO: 457 - RNA, 64 nt, Human papillomavirus type 29
gauccggauuugaaagaaguuacuguuggugaucaaaccagucagcaauuuccuuauuuggauc

SEQ ID NO: 458 - RNA, 73 nt, Human papillomavirus type 29
gcuugcucuucccugaucaucuccucaaguacuacucggcuugcugggauuuguucugcagaaagugcacugc

SEQ ID NO: 459 - RNA, 65 nt, Human herpesvirus 5
auucauccgggcguucagaagagugggagcuauaauacaucaagcuccaacucccggauccgagu

SEQ ID NO: 460 - RNA, 82 nt, Human herpesvirus 1
gucggggcgggagaguucacucggcacgcaugcacguguaaccgccaguccgugcuugccuagcgaacucacccgucccggc

SEQ ID NO: 461 - RNA, 127 nt, Human herpesvirus 1
cgugacauggagaaacugggggaauuugucuucuggcacagcuguugccagggugcucaugagcgagggccagaugcaggagcugacccaggcgacgagauccaggcccagaugucccucuaucaug

SEQ ID NO: 462 - RNA, 130 nt, Human herpesvirus 1
gggcguggccgcuauuauaaaaaaagugagaacgcgaagcguucgcacuuuguccuaauaauauauauauuauuaggacaaagugcgaacgcuucgcguucucacuuuuuuuauaauagcggccacgccc

SEQ ID NO: 463 - RNA, 83 nt, Human herpesvirus 1
ccgcccgcccgacccccgaauaaaccacacaaggcgguacguuuucgucugucucguucuuuauuucucacacacgcgcgcgg

SEQ ID NO: 464 - RNA, 93 nt, Human herpesvirus 1
ccgcgcaggaaggggaaggccuccuccgccggcaggugcagcgucagaaccaggccgcagcggcucugugaggucagccgcuucuugggcagg

SEQ ID NO: 465 - RNA, 94 nt, Marburg virus
ggcauacuauggugaugcgagggcauuauucagugcuacaaauucuuuuuucaauugcuauaaugauacaacuacgaaccuccauacauuugcc

SEQ ID NO: 466 - RNA, 131 nt, Human herpesvirus 5
uuuuugguccauuuuuccauacguuuauauucuuuuaauccugcguuauccguuuccguuauauccagugauagaucgugcagguuaaauagaaugcucuuaaauaaugucauuuuuuuauccgcuaaaaa

SEQ ID NO: 467 - RNA, 64 nt, Human herpesvirus 5
guggggcagaggaaaauuuguggcuuccuugcgaaaguauuucaaacuaaccacaucuccccac

SEQ ID NO: 468 - RNA, 60 nt, Human herpesvirus 5
uaacuacccuccgggagcucggggccguggccacgcagucuccagcccuggaccgaguug

SEQ ID NO: 469 - RNA, 88 nt, Human herpesvirus 5
caggcacuacuuuuuagccguuuucucggaugacauugaguauuucuggaaaaagacaaucuuccugccacccgagagcuucugccug

SEQ ID NO: 470 - RNA, 62 nt, Human herpesvirus 5
cuucuuuacucgugguuagucgauccggugcuaccacaaaagauaccaggagaguaaagaag

SEQ ID NO: 471 - RNA, 62 nt, Melanoplus sanguinipes entomopoxvirus
ggcccccucccgagcuggggcccggauccccgaccuccccggcccccucccgagcuggggcc

SEQ ID NO: 472 - RNA, 65 nt, Melanoplus sanguinipes entomopoxvirus
gcccgucuucaaccuggugcuggacuuugaccucccccugaaaaagcccggccugagccuggagc

SEQ ID NO: 473 - RNA, 61 nt, Melanoplus sanguinipes entomopoxvirus
ucaaaggucaagccgguagcggcguucccuacgcugcuuucucaggccggaagaccaauga

SEQ ID NO: 474 - RNA, 61 nt, Melanoplus sanguinipes entomopoxvirus
uguggccaggaugcucuuccgagaccaaaaugaagaggagcuccuccaacacauggccaua

SEQ ID NO: 475 - RNA, 72 nt, Fowlpox virus
uauagauauuuacggaguauaugaacuguauaccgauuuacagaauuuguauuugguacguaaguauguaua

SEQ ID NO: 476 - RNA, 67 nt, Fowlpox virus
gugauauuguggggucgugaugauauugacugucuguuggugauucucacccucauuggcuuauuau

SEQ ID NO: 477 - RNA, 68 nt, Infectious hypodermal and hematopoietic necrosis virus
gaggagcugccgguugccauuuuucaagcugcuaaaccacgaguggcagcaggccuaagaagcuccuc

SEQ ID NO: 478 - RNA, 63 nt, Infectious hypodermal and hematopoietic necrosis virus
uguuagccaacaacgacauccguguaccagaaaucuuagcuuggauaaucaucguagcagaca

SEQ ID NO: 479 - RNA, 68 nt, Melanoplus sanguinipes entomopoxvirus
cccggcccccucccgagcuggggcccggauccccgaccuccccggcccccucccgagcuggggcccgg

SEQ ID NO: 480 - RNA, 94 nt, Melanoplus sanguinipes entomopoxvirus
cgaccuucccggcccccucccgagcuggggcccggauccccccgguucccccgaccuucccggcccccucccgagcuggggcccggaucccccg

SEQ ID NO: 481 - RNA, 116 nt, Melanoplus sanguinipes entomopoxvirus
gcgucuguauuaaauauuucuaaauuuuuagguaauaauauauuuuuuaauuguaacuuaucuauaauacuauuuauauguaauucuuuuaaauuuacuaauaucuuuaaagaugu

SEQ ID NO: 482 - RNA, 64 nt, Melanoplus sanguinipes entomopoxvirus
accucuccagguauacagaagagcgggaguuuuaacaccuccucaacgaacucucggaugaggu

SEQ ID NO: 483 - RNA, 69 nt, Melanoplus sanguinipes entomopoxvirus
uggggguugaguacuugggacccuccuuauccaagugaaaauuagauaaggaaaacccaagacccucca

SEQ ID NO: 484 - RNA, 64 nt, Infectious hypodermal and hematopoietic necrosis virus
ucucuucgaagaacccagaaucagucaaauaacaguggacgacuucaaacuccuuuucgaagga

SEQ ID NO: 485 - RNA, 124 nt, Melanoplus sanguinipes entomopoxvirus
cgagcuggggcccggaucccccgaccuccccggcccccucccgagcuggggcccgguucccccgaccuccccggcccccucccgagcuggggcccgguucccccaccuucccggcccucgcccg

SEQ ID NO: 486 - RNA, 61 nt, Melanoplus sanguinipes entomopoxvirus
cccggugauucaggacugccccuauuugacaugaagaugaaugucgucgcaguccaccggg

SEQ ID NO: 487 - RNA, 78 nt, Infectious hypodermal and hematopoietic necrosis virus
cccguggggggucuuaguggaagugacgugcugugaauacagguccauagcaccgcuauccacuaugucucgcccggg

SEQ ID NO: 488 - RNA, 93 nt, Infectious hypodermal and hematopoietic necrosis virus
guguggagucuguugagaaugccaugcuauagucauaggauucaaaauugaacuuguuuguuaguuguguaaaaucuuuauaguuauucauac

SEQ ID NO: 489 - RNA, 78 nt, Infectious hypodermal and hematopoietic necrosis virus
ugugccgcuuggagggaaacaugaccaccugaagucuguuaaccaggucagugguuuuguuuccuugauagagacaca

SEQ ID NO: 490 - RNA, 78 nt, Human papillomavirus type 90
caagccugcugcucaauuguauauauuccucuuguguuguagugugcaauaguaguauguauccuguuguaguacgug

SEQ ID NO: 491 - RNA, 88 nt, Human papillomavirus type 90
gucgugcagucccagcgagcgcagcgguaccagguaacgcggacacgugucacaaaacgucugcaccgccugucgggccagcacguac

SEQ ID NO: 492 - RNA, 61 nt, Human papillomavirus type 90
gguaaguuaacagaguuuuuuauaaaaaucugguaugauucuauaagcuuguuaacuagcu

SEQ ID NO: 493 - RNA, 92 nt, Infectious hypodermal and hematopoietic necrosis virus
uuugaucgguguagauuuuguuguauuugguugaauucuggugucgaauagaauuuaucuguaugguccgcaaagucuauggcggguucagg

SEQ ID NO: 494 - RNA, 60 nt, Human papillomavirus type 90
auuuaguuucacacuccacuagccaagugaguuccggguuguuggggucgaagacuagau

SEQ ID NO: 495 - RNA, 61 nt, Human papillomavirus type 90
gccgcagggcaccuggccggcgugccgccgaagggccgcuaucagggccucgagcugcggc

SEQ ID NO: 496 - RNA, 114 nt, Human papillomavirus type 90
gcugcggcuggugcugcagcugcugcuggaaaaccgacggcgucugcgccgcaagcugcgucggcgccugcgccggauguaccggcacuucguccagcugcagcgcgccgcggc

SEQ ID NO: 497 - RNA, 68 nt, Human papillomavirus type 90
uucuaagugugcaggugugaguaacuuugaaaaaagacccgcaaaacucacacuuuugcauuggggaa

SEQ ID NO: 498 - RNA, 60 nt, Infectious spleen and kidney necrosis virus
ggcggugggucucgggccaaacgccgucguagacgacgcgcuccgaaaaacgacgccgcc

SEQ ID NO: 499 - RNA, 73 nt, Equine rhinovirus 3
gccacacguccaacugcuucccgaacgucucguuauauagugcgacggacaaaaccaguucccggacgugggc

SEQ ID NO: 500 - RNA, 98 nt, Equine rhinovirus 3
guuugagugugguagcgcugugugaguuggcgguggaacccccucguggugacacgagcccccguggccaaaagcccaguguuuacagcaccucucac

SEQ ID NO: 501 - RNA, 64 nt, Infectious hypodermal and hematopoietic necrosis virus
cuuuagugggaacuagugggagugcugugccucggguaccccuauccuauagguccuaccggag

SEQ ID NO: 502 - RNA, 101 nt, Infectious hypodermal and hematopoietic necrosis virus
aggcauuguuaaccuuugguggaaccuaguguuaguguugugcuguaaauaaguguccagcgcaccacuagucaccaggugucaccggaggcuacuugccu

SEQ ID NO: 503 - RNA, 102 nt, Infectious hypodermal and hematopoietic necrosis virus
ggggcucuguaacauuuggugggaccugaugcugcuggugugcuguaaauaagugccuagcacaucacguaggcaccaggugucaccagggcuacuugccuc

SEQ ID NO: 504 - RNA, 61 nt, Infectious hypodermal and hematopoietic necrosis virus
ggcagguggagugggacacaguuagagaacauuaguccucuggucccuaucuccacccgcc

SEQ ID NO: 505 - RNA, 77 nt, Human papillomavirus type 90
guaaauauauguaaacuguguacagugcggaacguuaagggacaucuguuguauacaguguggagaccuuuauuugc

SEQ ID NO: 506 - RNA, 68 nt, Human papillomavirus type 90
gcggccgucgagaugacgcucgcacuugaggcgacacaggcaccagagcggcaggucgaugacgcugc

SEQ ID NO: 507 - RNA, 71 nt, Human papillomavirus type 90
uaccuuacccauuguaccuauauguauuguauacacaguguauguagacacauguaguggguuugugggug

SEQ ID NO: 508 - RNA, 61 nt, Human papillomavirus type 90
ggaguauacguaggcuaggaagacaaaguaaggcuuggucaucaccagccgcuuaaacacc

SEQ ID NO: 509 - RNA, 66 nt, Infectious spleen and kidney necrosis virus
gcacaccaggcucuuggcccaccagagacacugucacguguuugcugaacggccacucuagugugu

SEQ ID NO: 510 - RNA, 101 nt, Infectious spleen and kidney necrosis virus
gcccguaccacugccaucgcccuuuggauacaugcgcacacacauggcauacccauugcgauguguguaaaacaccggagacagaaccauggguagcgggc

SEQ ID NO: 511 - RNA, 60 nt, Infectious spleen and kidney necrosis virus
gguagcgggcaguccgacgacacggccaccagccagacaagggugccauucugcguugcc

SEQ ID NO: 512 - RNA, 75 nt, Infectious spleen and kidney necrosis virus
ugccugucucuccauguuaagguuguugacgcuggcuucaagagccuugauacgaucuguggcccucuucaggca

SEQ ID NO: 513 - RNA, 100 nt, Infectious spleen and kidney necrosis virus
cggcaguuaccuguuguaucgcaaggcucacguggagcugucacucuccagcaacaaggugcaacacguggaagccgugcugcgacagguguacacgccg

SEQ ID NO: 514 - RNA, 112 nt, Equine rhinovirus 3
aagaagauuacucuugaugcuuggcucucagaaagaauggcaccucaaaguuuugagacccgauucuuuugagucgagaaccuuacccccaacccuugagauugcuuuucuu

SEQ ID NO: 515 - RNA, 130 nt, Equine rhinovirus 3
cgggaggaccgccgacgccguguccggaagccucgucggagcagagggccagguguuuauauagcagcagauagagauccuuggaccgaaaccuucgacccgcguaccguagcaggagcggcgccucccg

SEQ ID NO: 516 - RNA, 92 nt, Equine rhinovirus 3
ucgcugaacaaauuguauccucucagggccuccuccgcgucguugauguaggcacaggaccccgcugaggaagacgcgagguucuuuagcga

SEQ ID NO: 517 - RNA, 66 nt, Equine rhinovirus 3
gcgaggcacgucucacgguguuuuucaccccgagcuuuaauauauauagaaacacguuuauuucgc

SEQ ID NO: 518 - RNA, 80 nt, Fowl adenovirus D
aguggaauguucuaccacaaggauggguauguagcccugccauuuaucagacuaccacccagaagauuauagaaaacauu

SEQ ID NO: 519 - RNA, 69 nt, Fowl adenovirus D
cugcagcaguauauuggugugaaggaaggacuaagucaaagguauuuccaggaaccaaucaacaggcgg

SEQ ID NO: 520 - RNA, 63 nt, Cowpox virus
cauucggauagguuaaugguugggucgcgcagaccggauaaagccugcaacguauucugagug

SEQ ID NO: 521 - RNA, 119 nt, Cowpox virus
caacugcguuucaaugcauugaaucuucuuuacguagucgucucguucuuucucaagguuagaaauuguaucgaacugcucguugaucugguucgucaggcauuugaacacgguauuug

SEQ ID NO: 522 - RNA, 67 nt, Cowpox virus
uccucaacaacgucuguuaugccgcucacuguuuuguucuccgcgagcuuuaucagcaaguuuagga

SEQ ID NO: 523 - RNA, 64 nt, Cowpox virus
gcacgugcuaccgaccagcgcuuuuagaggcgcgguauuuaguaacugacauaacuuugcgugc

SEQ ID NO: 524 - RNA, 65 nt, Cowpox virus
gcaccgcaagccacguacauuguaccucaaaagaggaauaugacgaauggccgagaugcuggugc

SEQ ID NO: 525 - RNA, 120 nt, Fowl adenovirus D
ucuaugcauaugcaugagagauucaugcauaugaaugagagucucauccauauucauaaaccucauccauauucaugagccucucaugcauaugcauguuuuuacaugcauaugcaugga

SEQ ID NO: 526 - RNA, 84 nt, Cowpox virus
ggcaaccuugaaguucugacgaacuaucuugcagcuuguuucucaauuuuaaacgagcugagauccgaucaagaacucguugcc

SEQ ID NO: 527 - RNA, 123 nt, African swine fever virus
caggcuaaaacaaaggaggcgauuugggagggauaacgguuguuuuccaccagggggucgaccuuuucuagggugugaaggcaaaggucaucuucuucugcauccauaaagguaauugguuug

SEQ ID NO: 528 - RNA, 60 nt, African swine fever virus
ugccugagaguaaacauugacggauaaaacaaaaaugccccgcauaacucuaucauggca

SEQ ID NO: 529 - RNA, 76 nt, African swine fever virus
ucuuaaccaaauguuggaagaucauuuuuuuaccugcuuuaaaggccugaagggugucgguuggcaaggcuauuga

SEQ ID NO: 530 - RNA, 73 nt, African swine fever virus
gcaagcccauucugccaguuggggauuggcggcuagaaaaccgcgccauagcuggagggcaaaaugggcuugc

SEQ ID NO: 531 - RNA, 69 nt, African swine fever virus
ggcucccauccacguguagguuucgacgucguaggugacaaagaggcguucgacgcgaggaugagagcc

SEQ ID NO: 532 - RNA, 70 nt, African swine fever virus
uugacuugcaggagacggguaagggccgaugccaggcggcgaugaaacuugauuuccauuggugaguugg

SEQ ID NO: 533 - RNA, 99 nt, Human herpesvirus 8
aaauacauuuucucuccgaggugagguauuauguacgugccgggaaugguucaggcaaaacauaguuaccaaugacuucgccaaggguucguuguguuu

SEQ ID NO: 534 - RNA, 68 nt, Paramecium bursaria Chlorella virus 1
cgcaaucgaacauuuguagcauuucauauucucguagaauaaugugucuggcaugcaauguugauucg

SEQ ID NO: 535 - RNA, 65 nt, Human herpesvirus 1
aauacugauguugcuuuucuuggaaauaaacuauugguuuuuaauacuagcauugcaucauuauu

SEQ ID NO: 536 - RNA, 127 nt, Human herpesvirus 1
aauuaaauuuguaaauauauuuaaugguggucuuuguuguugauuauuuucaauugguucuuuaaaauauuuuucaacauuuugauuuaaaauuaaauuuuucuuaucauauauuucauuauuaauu

SEQ ID NO: 537 - RNA, 65 nt, Equine herpesvirus 2
gaaagaaauguaucguuagaccacacuuugaguucggguguggucguccguaggcagagucuuuu

SEQ ID NO: 538 - RNA, 63 nt, Equine herpesvirus 2
ggcuggguggaccccuuggcgaacacgugaggccccgcggcgcacugccacagguccaccgcc

SEQ ID NO: 539 - RNA, 87 nt, Equine herpesvirus 2
gauuucgugcucgauuuaccuaaauugaauauacacgauacaaugguggugguggguaaucaaaucagacaguuagaauacguaguc

SEQ ID NO: 540 - RNA, 115 nt, Equine herpesvirus 2
ucuaucucaacacguugauuuacguuuagcagcggacaaucccgaucuacgcguuggucugcguugggcagggauguuuguguacuacgguguuuaucgguguguuguugauaga

SEQ ID NO: 541 - RNA, 76 nt, Paramecium bursaria Chlorella virus 1
cgcguaucggcgucccggcgcggcgagcgucugacggucugucucuggcggucccgcgucgggucguggauccgug

SEQ ID NO: 542 - RNA, 101 nt, Bovine herpesvirus 1
gguguaauagguuuaagacuucuacuaaaauauuuaaaauuuuuaucauguuuauguauuuguauucuuucuccaucguacuuaaacucuacaauuauacc

SEQ ID NO: 543 - RNA, 69 nt, Human herpesvirus 7
gucgccgcugccgucucuucagccucguccuccuccuccucgcugaccaggggcuuggcacgcgcgcgc

SEQ ID NO: 544 - RNA, 80 nt, Human herpesvirus 2
ggcccggcgcuccacgccgggguucccggcggcggaaaagcgcgaccgccgccgggucuugucgcggccgggcccgggcc

SEQ ID NO: 545 - RNA, 88 nt, Gallid herpesvirus 3
caguuucugaagcaaaagcaaaagaggcuauagggauaaugcugcaauugcaaucucuacagaagucugaguaugcuucggagaacug

SEQ ID NO: 546 - RNA, 63 nt, Gallid herpesvirus 3
aagcgcgauacaaaucgacaucugguuuucgagacccgcguuucguaccgcaugccggcgcuu

SEQ ID NO: 547 - RNA, 61 nt, Gallid herpesvirus 3
ggggagaaaggggcgguagggggaagcgacgagaccgaucauccuccaccucccccacccc

SEQ ID NO: 548 - RNA, 63 nt, Gallid herpesvirus 3
uggcuggagauagcacugagcgucuaggcaggcccagaaugcucauuagcuuuacuucaacua

SEQ ID NO: 549 - RNA, 88 nt, Gallid herpesvirus 2
caccgucgagcaguccgucacccggucgcggcgccgacgacggccgagucgucggagucucucgccgacggggucgucugagacggug

SEQ ID NO: 550 - RNA, 108 nt, Gallid herpesvirus 2
cccggugccuggccucuuucucugugauucacccaacgcccuugacggaccuccauacucguugucucuaccggugaggcuuucaucuauuucgagaccgggcacggg

SEQ ID NO: 551 - RNA, 71 nt, Human papillomavirus type 83
ggaucaacaugucacucaccagagcguccacguccucguggcagaacucucucgguaggaccacgggaucc

SEQ ID NO: 552 - RNA, 66 nt, Human papillomavirus type 83
uaauuguuauuggccgggacgaagugggauuacugcuuauuauuuuaauucucaucguaauuauua

SEQ ID NO: 553 - RNA, 79 nt, Lucerne transient streak virus
ccugugagauuguuuguaaagaaugagccccacccugccaacaaggugcgggaagggcgcuuuagacuaaucucaucgg

SEQ ID NO: 554 - RNA, 85 nt, Lucerne transient streak virus
uauuuagauaucuggaacacccugacgacuuugaggaguuggcaguggaauugcaggguugucaguggccgcggauauacaagua

SEQ ID NO: 555 - RNA, 65 nt, Amsacta moorei entomopoxvirus
aaugauucaggaguuauaaaauuuaugggccaauuuucaaauguuuguaaucuuucagauucauu

SEQ ID NO: 556 - RNA, 111 nt, Bovine papillomavirus
gcaccuaauaaaaaucacuuaauagcaaugugcugugucaguuguuuauuggaaccacacccgguacacauccuguccagcauuugcagugcgugcauugaauuauugugc

SEQ ID NO: 557 - RNA, 76 nt, Equine herpesvirus 2
ucauuguacaagaaacauugcaugaaagacgaugauuauuuuaaucuuaucuuaccuauguuuaauuguuuaauga

SEQ ID NO: 558 - RNA, 61 nt, Bovine papillomavirus
ggcuagacuucauggcgccuggcaccgaauccugccuucucagcgaaaaugaauaauugcu

SEQ ID NO: 559 - RNA, 80 nt, Bovine papillomavirus
guuuccauugcgucugggcuugucuaucauugcgucucuaugguuuuuggaggauuagacggggccaccaguaauggugc

SEQ ID NO: 560 - RNA, 60 nt, Bovine papillomavirus
ccgccuuaaacuacagacaggucccagccaaguaggcggaucaaaaccucaaaaaggcgg

SEQ ID NO: 561 - RNA, 97 nt, Amsacta moorei entomopoxvirus
uuauaucauuacuuacaaauguauauagaauauuuagaaaauaauaaaauuauuaaaggcuauuggauaacuaugaaauuaaaagauaaugauauaa

SEQ ID NO: 562 - RNA, 96 nt, Amsacta moorei entomopoxvirus
gccuuucuccggcagguagccuacacguaccucacuauggccauaaagaugcagccauagagagguacgugaagaagacccgucggaaucagaagc

SEQ ID NO: 563 - RNA, 74 nt, Human herpesvirus 7
auuaucaccuuaaucucuucaggcgaacauaaauaacuccagcuguguacauucugaggaucgggguagauaau

SEQ ID NO: 564 - RNA, 64 nt, Human herpesvirus 7
ggguuaaggccucgggguuagggucucaggcggcguuuggcuuaggggcccgggguuaggaccu

SEQ ID NO: 565 - RNA, 74 nt, Lucerne transient streak virus
guuguaauugguacaacaaacauguaauauuguauuccacauguaaauauuauuguguacuauaguuauacaac

SEQ ID NO: 566 - RNA, 91 nt, Amsacta moorei entomopoxvirus
gacgauuugauaaacguggauugugucauuacuuuuugaauaaaaucuuugccuuuuacaaguuuaacauaaucacauuuaucaaaccauc

SEQ ID NO: 567 - RNA, 66 nt, Melanoplus sanguinipes entomopoxvirus
gaaccagcccugcgcgcuugcgcuauauacgcccugcgcacucaucgcgcaugcgcacagacguuc

SEQ ID NO: 568 - RNA, 69 nt, Melanoplus sanguinipes entomopoxvirus
uccauugaucugcucacgacuguagcacuuagaaucgcacagugcacagccagugagcuggccacagga

SEQ ID NO: 569 - RNA, 84 nt, Gallid herpesvirus 2
ccgagcuuaaaaaauauuuuauuggcggucaaagcaugcuauccuucagcagaucugggaaaucauggauguuuggaggcuugg

SEQ ID NO: 570 - RNA, 82 nt, Fowl adenovirus D
cacguugugcguucuccguugaccuuugaaaaggcgcgugguauuucucgguguguuuuucgggcggauuacgcguuacgug

SEQ ID NO: 571 - RNA, 67 nt, Fowl adenovirus D
gaucgucagagcacggaugagcgagcagccggacucaccgccggagcucuauccgucucuccugguc

SEQ ID NO: 572 - RNA, 68 nt, Bovine papillomavirus
ggagcagcaguggccgggggcccagacgggaguccgcgucgcccuggcgcucgucgccgccuuugccc

SEQ ID NO: 573 - RNA, 100 nt, Human herpesvirus 7
uugcuucugauuccgacgggucuucuucacguaccucucuauggcugcaucuuuauggccauagugagguacguguaggcuaccugccggagaaaggcgg

SEQ ID NO: 574 - RNA, 74 nt, Human herpesvirus 7
uuuuaaagauccgugggcuggagcuuuaaaauucucuauuguucuuucaaguucugcaaaaaugguuuuuaaag

SEQ ID NO: 575 - RNA, 108 nt, Human herpesvirus 7
gccuuuagggguagugucguugucgggguuaggccuguagggguagugucguugucgggguuaggccuuuagggguagugucggggucgggguuaggccuuuaggggc

SEQ ID NO: 576 - RNA, 73 nt, Gallid herpesvirus 2
gagcgcagagcuauuaccgaagaagucuauccccccaaaauggauauuuucgcauggaccagguauugcgcuc

SEQ ID NO: 577 - RNA, 107 nt, Fowl adenovirus D
cccguacuccguucguuuuggacaucagccguuugcccguggugccggagcgcauuuugcugcacgacuuuccgaacggacccuggucggaaacgauuugguacggg

SEQ ID NO: 578 - RNA, 73 nt, Tupaia herpesvirus
uuuugcuaggcaaaauggugugacacgacuuggauaccaaguugugccuacauuagccauuucagaagcaaaa

SEQ ID NO: 579 - RNA, 80 nt, Tupaia herpesvirus
gcggcagaggcggagaucgagguccaaguccaggucgcggucgaggucgcggucucggcuccgaucuagaucccggucgc

SEQ ID NO: 580 - RNA, 100 nt, Variola virus
gcguaccuuuuuuucauccgaucccugccggguaauacgucccaagauuugcuccauguuguuucugcggggcguugccaugaugaucgaugucauaugc

SEQ ID NO: 581 - RNA, 92 nt, Variola virus
gccgauaccuuuucauuaauacacacagggcuaacgaagucaggaugucccugauauucgauuucccucacguacccggaaaagguuguggu

SEQ ID NO: 582 - RNA, 130 nt, Variola virus
agcgacacggggcgcgucguguaaaccauguuaaacauuucaaacugcuuucgcagcaauaugggaaaauaaauguauucccccugcagcgugaaggcaguuuccugucuuauggcuaugugcuuuggcu

SEQ ID NO: 583 - RNA, 67 nt, Variola virus
ggguggcuaucuauccauaggcaggcauccggcgucuuuggugcauuggagauaguagcuuucaccc

SEQ ID NO: 584 - RNA, 125 nt, Variola virus
cgaggaauaauaagaacaaaguaaugccuguaaaaauaaacaucaacauuguaugauggucauuaaaccaauuaguaugacguugaacuaauuucacaguagauuuuauuccgguguuauccucg

SEQ ID NO: 585 - RNA, 96 nt, Variola virus
guggcccaaccucugcuccccucuauucuccucuugcguuaucuccaauagaauuugcuugaggucauacguuuuagggugcucgaccugggccgc

SEQ ID NO: 586 - RNA, 72 nt, Fowl adenovirus D
uuggaucuuguccaucaaaguuucucuggauacaugucuggucagauucuguauguccguucugagguccga

SEQ ID NO: 587 - RNA, 62 nt, Tupaia herpesvirus
ggccguggggggagcagggggagacggucauccuccaccucccccaccuccuccaaacgguc

SEQ ID NO: 588 - RNA, 80 nt, Variola virus
uagggcugcugauagcuagcgcugcacuuaaaaaugggguagcccuuuuucuuguaaauccggugccugucguagaccug

SEQ ID NO: 589 - RNA, 60 nt, Cowpox virus
ugucggagaguaaacauugacggauaaaacaaaaaugcuccgcauaacucuaccauggca

SEQ ID NO: 590 - RNA, 131 nt, Cowpox virus
cgauuucgagaaauaauaagaauaaaguaaugccuguaaagauaaacaucaacauuguuugguaaucauuaaaccaauuaguaugacguugaacuaauuucacaguagauuuuauuccaguguuauccucg

SEQ ID NO: 591 - RNA, 61 nt, Rice yellow mottle virus
uccacaucggcagaugcgacgacauacgauugugugccguuuaaucugccucgggugugga

SEQ ID NO: 592 - RNA, 107 nt, Murid herpesvirus 4
cuggguuugugugccgacuuguuccuuuuacccuuugaugacuuacugcccugaccugacccgucuaccgccuccucaucaccuuuagaacacucccucacgcccag

SEQ ID NO: 593 - RNA, 60 nt, Murid herpesvirus 4
acauagcccaaauggacacuugcgguuaggacaaaaccgcaagcggucgauaggccaugu

SEQ ID NO: 594 - RNA, 96 nt, Simian T-lymphotropic virus 1
ugggcauauguuuuuaugcagguguuugcaauauauuuuguuggcguguagcccuuauuguauaagccaaguaucugucuugcaaauauguaacca

SEQ ID NO: 595 - RNA, 63 nt, Periplaneta fuliginosa densovirus
gcagaagguagcucccucgacugggugacaagaagaaaccauucaggaagugcuuccuucugc

SEQ ID NO: 596 - RNA, 94 nt, Periplaneta fuliginosa densovirus
guucgugcgccaggccugcaagaucuccaacguggagcugaccaaccuggucucguacaugggcaucuugcacgagaaccgccuggggcagaac

SEQ ID NO: 597 - RNA, 74 nt, Rat cytomegalovirus
acaucugggacaguucugccgcuugacccauauacguauuuaauggugcagggguuccauucuguucugaucgu

SEQ ID NO: 598 - RNA, 131 nt, Ectromelia virus
gcuauuaaacaguauggagacauugaucuauuauuuaaugagaaacuuaaaguagacuccgauucgggacuauuugacuuugucaacuuuguaaaggauaugauauguugugauucuagaauaguaguagc

SEQ ID NO: 599 - RNA, 65 nt, Ectromelia virus
uugaaacuccgccccuuacuuuuauuaaaaaucuucaagaugaaauguuuacaauagaaauucga

SEQ ID NO: 600 - RNA, 101 nt, Drosophila C virus
guuguuuucauuguugaugguaaggauucuuauuuugaagugguuuuucagaagauaacucuaaauaugaauuaugccuuauuguuuucaauguugauggc

SEQ ID NO: 601 - RNA, 97 nt, Drosophila C virus
auugacuucgaagaaagaugcgucuuuuggauuuguaaugacugggccuuaaguucauagguguuauuacauggaggaacacauuacuuugguugau

SEQ ID NO: 602 - RNA, 75 nt, Periplaneta fuliginosa densovirus
agaucuauuaugucuguuauuugagauucuucaucacuacuuaauggcauuaucucgucacaauguaaccaaucu

SEQ ID NO: 603 - RNA, 64 nt, Periplaneta fuliginosa densovirus
ggaaggaguguggcuaaugcugguaaggcaccuuucuaucaguacaaucaagcccauuccuccc

SEQ ID NO: 604 - RNA, 62 nt, Periplaneta fuliginosa densovirus
gagguguguggcucagcacguagagugacaaguaaaucuacuguaauaggacacaacaccuc

SEQ ID NO: 605 - RNA, 106 nt, Periplaneta fuliginosa densovirus
ggaauuguauauuagccuugcuaagggagacaucuagugauauaagugugaacuacacuuaucuuaaauguuguaacuccuuaggauaaucaauauacaaaauucc

SEQ ID NO: 606 - RNA, 79 nt, Rat cytomegalovirus
cggcuggacguugguccgcaggcggucgcggaggaaccccgggaagccguuggcgaccuugaggacccgcgcccggucg

SEQ ID NO: 607 - RNA, 96 nt, Rat cytomegalovirus
gcugaggaggccggagucgucggccugcucgugcggcacgccgaagacgaaggugaagcccucgggccaggccaggcgacagcggaacuccucggc

SEQ ID NO: 608 - RNA, 88 nt, Ectromelia virus
gccgguuaguaugacuuacuuguauaauaaguauaguuuuaaacugauuuuagcagaauauauaagacacagaaauacuauauccggc

SEQ ID NO: 609 - RNA, 62 nt, Fowl adenovirus A
ccugccuuucagcagcugguuagcaacgggaucuuugaacguguuacaaugagcugugcagg

SEQ ID NO: 610 - RNA, 121 nt, Drosophila C virus
ggggcaagcaaugaugucuuuucguuggucauuuuuuccacauacgaauuauuuggucagcacauugaauccuucaaauucgauauggcaaaaguguuucgagaaauuauugaaacgccuc

SEQ ID NO: 611 - RNA, 111 nt, Drosophila C virus
gcggaagugacgcaagcggaaggggaggagcaggaaggggaggagcaggacccacuaacccgcccacuaacccgcccacuaacccgcccacuaacccgcccacuaacccgc

SEQ ID NO: 612 - RNA, 65 nt, Human herpesvirus 6B
aauggugcuauuagaauuuacaaaacugguaauccacauaguuguaaaguuaaaauuguuccguu

SEQ ID NO: 613 - RNA, 68 nt, Human herpesvirus 6
gucgcucaugcggacagucaaacauucauuaacacgcaggauguugcauucucucacagcaugaugac

SEQ ID NO: 614 - RNA, 78 nt, Human herpesvirus 6
gcguucauauuagacuacaaaccuaaugauaauaacaaaaaucauuuauauuuuacaaguuuuaacaauauugaacgc

SEQ ID NO: 615 - RNA, 78 nt, Gallid herpesvirus 2
ucgucgagaucgugauuuggagaauauaacguuggaagcacuaacaguucccuggcgucugcaauuccgugucgauga

SEQ ID NO: 616 - RNA, 65 nt, Gallid herpesvirus 2
cgcguuaccaacaauugugugaucucguuacugaaaucggauuuaaagcgcaaauaucaaacgug

SEQ ID NO: 617 - RNA, 94 nt, Gallid herpesvirus 2
ugcauauuuggacgcucauccaugaaucuacgaagcuugauuauaauccccaguagauggcuuccaaauuccuggcuaacuauuacuauaugca

SEQ ID NO: 618 - RNA, 78 nt, Fowl adenovirus A
gccgcucuuagcacaaaaucaaaaacaaaucuagccaccgcagucuguagagacuuuugaguugaaaaaguaagcggc

SEQ ID NO: 619 - RNA, 60 nt, Fowl adenovirus A
uuucaauaacucucacuuuuuugcuagaggcaggcucaacaaugucuggaguuguugggg

SEQ ID NO: 620 - RNA, 72 nt, Human herpesvirus 6
uucgaaucgccccuuuuccaaaacaugugaagaccuucuucucaaaccuugacaaaaccuauuugauucgag

SEQ ID NO: 621 - RNA, 91 nt, Human herpesvirus 6
gcgaaauguauucagauucguuuucagguccgaacgccacaaacucaacaacguaagugucgucucgauuacgccugauuauacauuucgu

SEQ ID NO: 622 - RNA, 130 nt, Paramecium bursaria Chlorella virus 1
cguaaaugcagggguuaaucgggcggauggggaccagcgcagggagcgcggaaggaguccugcucugaaaaaaaugagggggaaccgugagaaagcguuccccgcaguucgcaucgcuucuugccccccg

SEQ ID NO: 623 - RNA, 119 nt, Paramecium bursaria Chlorella virus 1
ugagagauuccucuguguguuuuuuaccauaaaaagaguuauuaguucccauuugagauuuacuuauuuuacucuuaacuucuucuuuuugugguuuaccauacauaugacuuuuuuca

SEQ ID NO: 624 - RNA, 69 nt, Variola virus
augaaguuaaugauacacacuauacugucgaauuugauagggacaaaguaguugacacguuuauuucgu

SEQ ID NO: 625 - RNA, 113 nt, Variola virus
cgcucccgcggccccgccccccacgcccgccgcgcgcgcgcacgccgcccggaccgccgcccgccuuuuuugcgcgcgcgcgcgcccgcggggggcccgggcugccacaggug

SEQ ID NO: 626 - RNA, 79 nt, Paramecium bursaria Chlorella virus 1
gggagagaaauaccgacggccggacagagcgaauuauuaagcacccaacgcucacgccaacacgucccaccucuuuccc

SEQ ID NO: 627 - RNA, 64 nt, Paramecium bursaria Chlorella virus 1
gcauauggaacgguacuggauguagaacacuugugugucuauaugauaacagagcuuccaaugc

SEQ ID NO: 628 - RNA, 117 nt, Melanoplus sanguinipes entomopoxvirus
uagaaauauauuuuuguucagguauaucaacaaauguauaugauggaaaauauauauuuaaaaaaauauuuauaccaucauauaauauaguuaaaugcuuuuuauuaauauuuucua

SEQ ID NO: 629 - RNA, 61 nt, Melanoplus sanguinipes entomopoxvirus
guugggaagugcauguuaaugaggacacuaucuuugcuccuguuacuagcucuucgccggc

SEQ ID NO: 630 - RNA, 112 nt, Melanoplus sanguinipes entomopoxvirus
cauaugguauuuuaucgguauauaaaucuaauaaacuauguguauuuuuuacagcauuugccauaggaaaaucauauauaauuauuucuuccauuguuaaaauaucuauaug

SEQ ID NO: 631 - RNA, 62 nt, Melanoplus sanguinipes entomopoxvirus
uauaaaaucguaauacuaguauaucauaaugagauuuuaauucugguguuaauauuuuuaua

SEQ ID NO: 632 - RNA, 65 nt, Chimpanzee cytomegalovirus
cagucuuuuguccaauagugucgaauaagcguucuauuucuaguagugcuauuggaaaaagacug

SEQ ID NO: 633 - RNA, 96 nt, Fowl adenovirus A
aauucaccacgcccgggagauuucgaaauugcuauuuccgugcaguuccgcauuccgaaguacaauuuaaccgguuuuauggguguucgguguuuu

SEQ ID NO: 634 - RNA, 60 nt, Variola virus
gccccucgcccccucccgccccucgcccccucccgccccucgcccccucccgccccucgc

SEQ ID NO: 635 - RNA, 63 nt, Human papillomavirus type 61
gccgcgccugacuagaguacacacuauaaauuccauuccggugacuuacuacuaggcgcuggc

SEQ ID NO: 636 - RNA, 82 nt, Fowl adenovirus A
gcgguuuucggucucuccucacucggcagaugacuucggaagagaagcugcagaguucgucuccggagaccggccucgccgc

SEQ ID NO: 637 - RNA, 67 nt, Fowl adenovirus A
gcgcugguccccauccgcccgauuaaccccugcauuuacgccccuguaaggagcggaucgccagugc

SEQ ID NO: 638 - RNA, 62 nt, Fowlpox virus
ucuuaaagcggccaucguucaguacuugcuggcauggugacaugagugaugaugcuuuauga

SEQ ID NO: 639 - RNA, 76 nt, Fowlpox virus
gcguguaauacgcuggugucucauuauauacuagcguugcagcgcuaggacuaccuaagacaaccguauuauacgu

SEQ ID NO: 640 - RNA, 67 nt, Rice tungro bacilliform virus
acaguaguuuucacgguauuuuugaaauuaauaaauuuuaaaucggguaaaugguaaagcaugcugu

SEQ ID NO: 641 - RNA, 66 nt, Frog adenovirus 1
augauguguacuuguggcuuaaauuuauuuuacuuaauuaaauuuuaucgcaguuuaauaaaucau

SEQ ID NO: 642 - RNA, 95 nt, Paramecium bursaria Chlorella virus 1
uucggcauuuacuucuaauauaaggacguuaaauacuccaaaugcauuuauuuggaauacgagcguaccgaguagcggacuuuuagaugcgagaa

SEQ ID NO: 643 - RNA, 71 nt, Strawberry vein banding virus
gcgcacaauugccuguaguagcgugaaucccgagagucaggaggacguugguagcgaagaucggcaugcgu

SEQ ID NO: 644 - RNA, 101 nt, Gallid herpesvirus 2
uuguuugcucaucucauauuuggaaaaccggaacgucagcucauccgacccgucacuauauguucaacuucaaaguuuucugaaauaugcauggucgacag

SEQ ID NO: 645 - RNA, 62 nt, Gallid herpesvirus 2
acuugguuacuaaauacccuaauggaacugaguucuauuaguccauucgauaguaaucaugu

SEQ ID NO: 646 - RNA, 104 nt, Chimpanzee cytomegalovirus
uauuauuuuuguaccggauucgcuugucuuguguucuuuucggggucgggagaguucgacaguuuaugagauaggacaggaaaaguaaggauauaaaagaaaua

SEQ ID NO: 647 - RNA, 87 nt, Rat cytomegalovirus
cugauaucauaaugaagacauuuuagagcaccacaucgucuauugacgguugucucaugaaacgucgaauuguucguuugaugucgg

SEQ ID NO: 648 - RNA, 60 nt, Rat cytomegalovirus
uuuuuacguugggaugcucgucgaugucugugacauaacaauugcaguaaaauguaggag

SEQ ID NO: 649 - RNA, 73 nt, Rat cytomegalovirus
cuccuguagcccccaguaaauggauuucagggagggaccguccuugcugucauucucuuggacuaacgaggag

SEQ ID NO: 650 - RNA, 130 nt, Rice tungro bacilliform virus
guuauaauccauaagcuuugaaagaucugcuaguguggauaccaaaaggcugucgugguucgcccagucgacggaugaggucauaaacgaagcacuaguagguaacuaagaggcuuagggaugaagcaac

SEQ ID NO: 651 - RNA, 63 nt, Rat cytomegalovirus
ucaucccggcgcgcccgacaucccugcgcgaucagcuagcgcgcgcucggcgcgccgagauga

SEQ ID NO: 652 - RNA, 95 nt, Pea enation mosaic virus-2
guagaacacgugggauaggggaugaccuugucgaccguuugucgguccccugcuccuuagagcuggcaaggcgcccauugguucuacauuucuac

SEQ ID NO: 653 - RNA, 78 nt, Tomato mosaic virus
cgguacgccugccugauggcuugauaguagggcugcugggcugcuaguagggcugcugggcugcuaguagggcugcug

SEQ ID NO: 654 - RNA, 60 nt, Myxoma virus
guggagauccagugcgggccuuggacgguaaaagccggucaguccuuuguggaucugcac

SEQ ID NO: 655 - RNA, 75 nt, Wheat yellow mosaic virus
aauaccacugacauacucguaaucgucaguguauuucuuuacgacggacguaauaucaguauuuucgguuguauu

SEQ ID NO: 656 - RNA, 64 nt, Rabbit fibroma virus
guugucuaaaaccuacacguggaaugacgauucacaaagagucucugccacgggauuuagcaau

SEQ ID NO: 657 - RNA, 130 nt, Rat cytomegalovirus
guaaugaaucgcacagaauuauggacaucgauaccgucucgaaucuuugcuguguauugugaauucaaaaacacgguugaauucuauuuacguguugauguuuauacuguuaaaacaugcgaagcauuau

SEQ ID NO: 658 - RNA, 84 nt, Chimpanzee cytomegalovirus
uucuucggauacgccguuuuacucgccgucgcuuggcaacgccugaagaaagagcgugccgcgagccuacggcgcuaugaagaa

SEQ ID NO: 659 - RNA, 107 nt, Rat cytomegalovirus
guggguccauucuuaaugguggagagcagcuuggaagaggaaauuaugccauuucgcaauaugucccacaucagguucucagacugcccccuggucauggacuccac

SEQ ID NO: 660 - RNA, 103 nt, Rabbit fibroma virus
uaaauguuagguuugcuggagauaaguuuaaaggcauuauguucgaagcuaauaccugucuugucuugcaugguguuuacuuucuuaacuuuaguaacauuug

SEQ ID NO: 661 - RNA, 62 nt, Rabbit fibroma virus
aaacuguucauauugugagccacaguagacauuguuggccuguaugugaucauaacauguuu

SEQ ID NO: 662 - RNA, 65 nt, African swine fever virus
gucuuuuauggcugguaagugcugacaucaggcccccuguuucagcguggccagccaucgcugac

SEQ ID NO: 663 - RNA, 64 nt, Ectromelia virus
gaauaucgcaguuaucaagguuaguuauaccuguuuauacaguuaacccuaaucuuugcuuuuc

SEQ ID NO: 664 - RNA, 81 nt, Vaccinia virus
gaugaugauuuaugaauugauuccggaagaucgcuaucguauuuugugguuccacaauucauuuccauacauguuauuguc

SEQ ID NO: 665 - RNA, 72 nt, Tomato mosaic virus
aguaggccugcuugcucgcuggccugcuugcugaggggacaguagggcugcuggcuugcuaguagggcugcu

SEQ ID NO: 666 - RNA, 124 nt, Tomato mosaic virus
ggccugcuugcuugcucgcuggccugcuugcuugcucgcuggccugcuugcuugcucgcuggccugcuugcuugcucgcuggccugcuugcuugcucgcuggccugcuugcuugcucgcuggcc

SEQ ID NO: 667 - RNA, 103 nt, Tomato mosaic virus
cuaguagggcugcugggcugcuaguagggcugcugggcugcuaguagggcugccugcuggcuugcuugcuugcuugcuaguggggccgcuugccugcuacuag

SEQ ID NO: 668 - RNA, 70 nt, Macaca mulatta rhadinovirus
ggcagcgucauaccaugucgccugcuuguggcacugagcuacuguuuggcguuuugggggcacgcugacc

SEQ ID NO: 669 - RNA, 92 nt, Rabbit fibroma virus
cauuaugcuggaaccugaaguguuuucuagaguguguuuaaaugggguauuugauuuaucuguggaauuauguaagguuauaagauauaaug

SEQ ID NO: 670 - RNA, 91 nt, Rabbit fibroma virus
gacagugugagugugguagcagucaucuagaacuucgucccauugugcuaaauguaacugaggagcugagaagugaccaccuuacccuguc

SEQ ID NO: 671 - RNA, 122 nt, Vaccinia virus
uugauuuugcaugguuguagcuuuuuugguuuuaauaauauauguguggaagcuugggggcaggucaguguaagaggcuguaguuucuaugcaugcuggauugcaacaucaggcaggaccaa

SEQ ID NO: 672 - RNA, 63 nt, Porcine enterovirus B
uauaaauaaucugaucuuuuuucauguucaaaaaaaugaaacauauaagaaaaguaauuuaua

SEQ ID NO: 673 - RNA, 76 nt, Rabbit fibroma virus
auauuaaauaauuuucuagcgaauagagaaauuaaaucguuaguuuuucuagacgcguuagaaaaaggauuaaugu

SEQ ID NO: 674 - RNA, 60 nt, African swine fever virus
guggcacgucaccaucaaaaacauugcccaacaacacgggcuugauauaaagguggccau

SEQ ID NO: 675 - RNA, 63 nt, Vaccinia virus
agccgcugagugguaaacaacagaacagauaguuuauuaucuuuaccaacacccucagccgcu

SEQ ID NO: 676 - RNA, 70 nt, Porcine enterovirus B
ucacgccuaccaauaagacaagcccuauauuuacuuguugcauuuuacucgucagaagaaaucacagagu

SEQ ID NO: 677 - RNA, 62 nt, Porcine enterovirus B
gcacauacaauuaacuuuuuuucaucaccuuuaagguuaagauauaaaaacuuagguauggu

SEQ ID NO: 678 - RNA, 105 nt, Rat cytomegalovirus
aaauauaugucuuaaaauaucaauauuaugauauaaauaugaaguuuuuucguuuuguauauuauaucuuuuaauauucauaucaguaucuauaaacauauauuu

SEQ ID NO: 679 - RNA, 65 nt, Rat cytomegalovirus
gcggccggucauucgagugaauucauuuuccagggcggagaagaucucgucggcggacgggucgu

SEQ ID NO: 680 - RNA, 87 nt, Rat cytomegalovirus
auuaauuuuaauaucuuuuucugauaaauaaauauauaacauauuuauuaaauauucuuucauuucaaauucagauuuaaaauuaau

SEQ ID NO: 681 - RNA, 75 nt, Meleagrid herpesvirus 1
cuaggacggauucugucgcuucuucgcccguuuugguccugggcugggagaggcgagucaaaccuucccucuugg

SEQ ID NO: 682 - RNA, 69 nt, Rat cytomegalovirus
ucucgcgaucgaaggucggcgcgugggccugcgacgcaggagucggcggcgacgauggagauggcgaga

SEQ ID NO: 683 - RNA, 62 nt, Human spumaretrovirus
gagguguguggcucaacacguagggugacaagaaaaucuacuguaauaggacacaacaccuc

SEQ ID NO: 684 - RNA, 64 nt, Human spumaretrovirus
uguccaccggacgaguggcgcggcgaagacgucgccagcaccagcuucugucggugucaugaca

SEQ ID NO: 685 - RNA, 90 nt, Human spumaretrovirus
guauuaucgucccguucccagaaggaguaugcgucguugggucggagcccaugguggcacucacuggcauucuaaacaggacgauaaagc

SEQ ID NO: 686 - RNA, 94 nt, Human herpesvirus 5
uauuagcuaugcucacuaaacuucauuaaucaagcuuaauuuuuuuauuuguuauaaaauauauacuuguaguaguuugugcaguauguuugug

SEQ ID NO: 687 - RNA, 82 nt, Human herpesvirus 5
aguuuacuauuuagcuacaaguuucuuaaaaacaauauuuuguauauuguuuuuaagaaacuuguagcuaguuuuuugaacu

SEQ ID NO: 688 - RNA, 83 nt, Human herpesvirus 5
cuuuauuacuuaaauuuuguuuaaauagcuacaaauuuauuaagcauagagcauugcuuuauaaacaauuuuuaguuuuagag

SEQ ID NO: 689 - RNA, 92 nt, Human spumaretrovirus
ggucaugucggccgaaucaucuauagcaucauggaucgcaaugagaauuuuuuagaaaacaagaccauuagcuaucugccggccaaaauacc

SEQ ID NO: 690 - RNA, 123 nt, Human spumaretrovirus
ucucuaauuuuugccggguuaaaacauagacacaaaagacaguauaauaaaaauagaacaccauuuuauuuugucuuuuuuccaauguguuuaacaagguaucuucgcccuaucaguuugaga

SEQ ID NO: 691 - RNA, 66 nt, Human herpesvirus 5
aacaaagaaauggaaaucguaauaccaguuauguucaacuuugaaauuguuuuuuauuuucuuguu

SEQ ID NO: 692 - RNA, 107 nt, Human herpesvirus 5
aguugucgcaacaggguagcucguaaacuuuaauguauaacagagacaucuguaaaaagauaaacuuuauauauuguaccaaagauuuaaauccuaauuugauagcu

SEQ ID NO: 693 - RNA, 77 nt, Human herpesvirus 5
ugcaacccccugauuuugcaguucacccagaagggaagacaagccucuugggacggaccuaagauauggggauugcg

SEQ ID NO: 694 - RNA, 130 nt, Human herpesvirus 5
cguguguauauuauuuuuuuuuuuuguguguguuugcgcccccgugugucuaaugugcuguuugaaacacguaaaguagcugguggaagaacagauaaaccuuuaauaaaaaaaaaaguaugugcucccg

SEQ ID NO: 695 - RNA, 100 nt, Human herpesvirus 3
guccaggcuaaacgaccgccuuuucuagaacaaaaaggaggaagaacauccaacugauuuucaucuggggggucggcaucuauaguaaaaaugccaggac

SEQ ID NO: 696 - RNA, 102 nt, Human herpesvirus 3
guugaugcacaugguagacugugugucugugucauucaacagugcuuugcgacgaagugugggaauaauaaauugcgcacgcuuuuuaccguggacgucgau

SEQ ID NO: 697 - RNA, 105 nt, Bovine herpesvirus 4
aagugaucacagccugagaaaggaggccacagcgaaggccgcgugccccgagcugcaaguggagaaggaugcugggccuucaggauuaaauguuguugguuauuu

SEQ ID NO: 698 - RNA, 113 nt, Bovine herpesvirus 4
gucuuguuuguaacauggauaucauuaacuagauuguauauuuuauauuuuauaucuucauaucuuaauauauuauaauaguuuucuuguuugagccuauuuauaucauugac

SEQ ID NO: 699 - RNA, 60 nt, Bovine herpesvirus 4
gugguagcggcacagaaucuuuccagggcuuuaaaguccuacugucccacuauauaccac

SEQ ID NO: 700 - RNA, 80 nt, Bovine herpesvirus 4
uguuaaaagaggaaugaguucuagcaagcucuaaauaaauauuucugagacuugguggaacugguuugucuaugugaaca

SEQ ID NO: 701 - RNA, 64 nt, Human herpesvirus 3
ggcauuaccucuguacucaacgugucaguuucuauaaacgaugaggauuugauguuuaaucgcc

SEQ ID NO: 702 - RNA, 90 nt, Bovine herpesvirus 4
uccaggaggacagcgccucagcgaggaccugcgcagaaagaugcccuccauaguuguccaggacucaucgggguucauugccugccugga

SEQ ID NO: 703 - RNA, 130 nt, Bovine herpesvirus 4
uauagcuuauuaucuguuugugcuaauauaauaucaaauauacucuuguuaucguuaguugggagauuaauauuacauccaauauauacgagauaagacauuauaucaacguugcacgcuauaagcauua

SEQ ID NO: 704 - RNA, 61 nt, Bovine herpesvirus 4
cgcuuauguguacaguuuccuuaguacccugcuauauaaugccauguacucauuuuacgcg

SEQ ID NO: 705 - RNA, 130 nt, Bovine herpesvirus 4
gaauagcgccacauaugauauauaauauauuguagauaucugacgaacuguuuagauaauuaucuucuucuuuuauuauaauaacacuuacguuuuuaucgaauuccuuaaacaugucauucaaugcuuc

SEQ ID NO: 706 - RNA, 60 nt, Bovine herpesvirus 4
gucgaguaaggaaucagucuguucuggucuaucugggucagagucuuguccuuccacggc

SEQ ID NO: 707 - RNA, 78 nt, Bovine herpesvirus 4
gugggaggcguaccuguuguuaaguacgagggaggagcuacuuucuagagugugcagacacacgucaucgucuuccac

SEQ ID NO: 708 - RNA, 94 nt, Bovine herpesvirus 4
agugcguuugauaaaaguuuggcaaugcuucgcaugguuugguucuuuucccugucugccuuuuccuuugcugcgauguucagcugcacguacu

SEQ ID NO: 709 - RNA, 71 nt, Human herpesvirus 7
uccggcgcgccaacgcgaagcgcggcgucuagccccgggcccggcaccgcgcuugcgcuuggcgcgccggg

SEQ ID NO: 710 - RNA, 131 nt, Equine herpesvirus 2
uacauaucuugaaugugauccauuauauauugagucauuagagccauuaaaaaauuuaaaauauuuaauuuuaaauaauauuguaaauaaugacauuaaauugccaaaaucgauuauauauauuaaaugua

SEQ ID NO: 711 - RNA, 98 nt, Equine herpesvirus 2
ccgcgcgcgcaugacuaccugggccagguugagcgccaccaggcgguugaagggcgccugcaggcgcagggcguggugcagguaguugaggguggugg

SEQ ID NO: 712 - RNA, 64 nt, Equine herpesvirus 2
ucaauaauauaccgcacacuuuuauugccccuuuuguggcguggugauuggcggagaggguugg

SEQ ID NO: 713 - RNA, 94 nt, Equine herpesvirus 2
cacucuguuaccccuuuuuaacucucuaacauuuuucuuuguuuuauaagauauaggcccaggaagauauucauuuggaggggugaacugaaug

SEQ ID NO: 714 - RNA, 76 nt, Equine herpesvirus 2
uucugcacaagacagauugagcaaggaucuccguuuuaccacacacagauccuaacccaaucuaucuuacacagaa

SEQ ID NO: 715 - RNA, 96 nt, Equine herpesvirus 2
uguagcauguuuaaaaaaguaacaagucaccgccucaucaccugcuguguuuaagguagguuuugggggcuuacugcuuuuuuaaaaaaauuuaua

SEQ ID NO: 716 - RNA, 73 nt, Equine herpesvirus 2
cggugucgcgcagggcguagagcuugggggcgagcaggaccgucucggagcugugggcgucgcugcggcagcg

SEQ ID NO: 717 - RNA, 62 nt, Equine herpesvirus 2
ccacgggcccggugacucggaaccugaaagagaguuccacggaaucaaugucggcaucgugg

SEQ ID NO: 718 - RNA, 88 nt, Equine herpesvirus 2
uucauaaacccucgcucaccaucuaucaaaaaacaagcaaaaguuucagcucacuuuaacuuguugccucagcuaaagguuuugugga

SEQ ID NO: 719 - RNA, 60 nt, Equine herpesvirus 2
guuaaauaaaaauauaaauguuauauguuaaaaugugaaauuauauaucauuuguuuaau

SEQ ID NO: 720 - RNA, 84 nt, Equine herpesvirus 2
gcagaucuuaugcuugucaguuaaagcccggaauguuuuuuuuuaauuaacaauuccugcuguaacugacacaacaaaaucugc

SEQ ID NO: 721 - RNA, 70 nt, Equine herpesvirus 2
guagcuaggguggugaguggcgcucgcagcagcuagugagcugcugagcaacacucccugccccagcuac

SEQ ID NO: 722 - RNA, 83 nt, Equine herpesvirus 2
gggugugguccggaccgcugcgguaguugcccucgcagaucugggucucccaggcgacuaccuccugcggggggaucaugucc

SEQ ID NO: 723 - RNA, 97 nt, Equine herpesvirus 2
gcgcaaaagaccccuagggagaggagguaagcuagguguguguuuaauaaccaucaccuguuuauagucucuaaccaggauauauucauuuuuaagc

SEQ ID NO: 724 - RNA, 64 nt, Equine herpesvirus 2
ucgugaauuuugauuuuuuaaaaccauuaacuaauuuaaaaaguuuaauuauuccaaauaauga

SEQ ID NO: 725 - RNA, 92 nt, Equine herpesvirus 2
aggugagcuccacguaggauagcuuaagauacaaucucaguuuauacaacacuacagagagcaccuuaagcuaucauaccuaaaacacaccu

SEQ ID NO: 726 - RNA, 65 nt, Equine herpesvirus 2
uugcucaacauuuuaauuuuaucuuuaauguuaacauuuuaaacugcaguuaaaaguuuuaguaa

SEQ ID NO: 727 - RNA, 65 nt, Equine herpesvirus 2
agagggcguuggagagaagcuuggcgaugcugcggagcguuugguuucugucccggucggccuuu

SEQ ID NO: 728 - RNA, 97 nt, Equine herpesvirus 2
ccauuaaauaaauuaaaaaaauuggaaauauuggaauguaaucauuuuaauauagaaaaacauacauuaccaaauucaauuacuaguuuaucauugg

SEQ ID NO: 729 - RNA, 104 nt, Equine herpesvirus 2
ggugagaaaggcuuuucacgcauacuugcacugucagcaguuauuguauuccuaacaccaacacauaacuacugauggugcucaacaugcgugcgccaaacacc

SEQ ID NO: 730 - RNA, 129 nt, Equine herpesvirus 2
gaaacuuuaaaauuuauauucauguaaaguuuuaagcuuacaaaauuaaaucagggcuucaaaaaagauuguuuuucuaguauauguuuuguagauguuuuaagcuuacagauuuuaaauuagggcuuc

SEQ ID NO: 731 - RNA, 130 nt, Equine herpesvirus 2
ugcagcagaugugccacgggcacgucccggucggcguccaggugggugcgaccguagccccgcagggggcgcagcagcgccaggucggccaccacgcgcucggccaggauggccugcugcaugcgcugca

SEQ ID NO: 732 - RNA, 84 nt, Equine herpesvirus 2
cugucacucaugccaguacacucgcacccguaguguuuauacauaaacuacgggggaagcuuguguacuggauaugagugacag

SEQ ID NO: 733 - RNA, 73 nt, Equine herpesvirus 2
cgcgcaugagcaugcccuguaugccucaaguuucauagaguauguaggugauccaugggcagugcgcaugccg

SEQ ID NO: 734 - RNA, 75 nt, Equine herpesvirus 2
gugucuagugacagacagggaguggauugcgcuccuuaaacucccgcacccgcucacugucugucuacagacuac

SEQ ID NO: 735 - RNA, 73 nt, Equine herpesvirus 2
guaauaaguuaaauaaaaauauaaauguuauauguuaaaaugugaaauuauauaucauuuguuuaauaauuac

SEQ ID NO: 736 - RNA, 114 nt, Equine herpesvirus 2
cugagaagucauccagguccaggaaccggugguaggcgcccguguugaugguguaggagcaguugcccagcacggaccaguugaccaccugguaguggggcuggaugaccucgg

SEQ ID NO: 737 - RNA, 83 nt, Equine herpesvirus 2
ugucucuugcuagguagccuguacaaaacaguccuuuuuuaauguaaaacaguguuuuguccagacuagccuaacacgaacca

SEQ ID NO: 738 - RNA, 85 nt, Equine herpesvirus 2
uccugcagcacccccggucccgcgcgcugaccgcgcagcugcugcugaucgcgcagcacugccgggacgagggcauggugaagga

SEQ ID NO: 739 - RNA, 90 nt, Equine herpesvirus 2
uuuugcaagucccuaccagguagccgugcauaagcuuaaaauuaauaaaaagcuuaugcacaagccgucugauuaggaagcacugcaaaa

SEQ ID NO: 740 - RNA, 65 nt, Equine herpesvirus 2
guuggugugugguagcgaucuaucuuucuuugugaucuugguagugaagccugccaggcuccagc

SEQ ID NO: 741 - RNA, 88 nt, Equine herpesvirus 2
gaggccguucugaaagaguuggauuucagcaccuugggacgcaccguagcuaguguggcucuggucugcuucauuuuugagaagcuuc

SEQ ID NO: 742 - RNA, 99 nt, Equine herpesvirus 2
gaguaugugaguuuuguguugaggcaggccacuugcacuugcauugccuuccaaaugcaggugagagauagccugcuuuaacacauaucccacagguuu

SEQ ID NO: 743 - RNA, 65 nt, Equine herpesvirus 2
ggcgggggugagcgcggccucccuggcgcccgagcgggcgacgcggaugcaggcgcugcccuccc

SEQ ID NO: 744 - RNA, 83 nt, Equine herpesvirus 2
ugccagucuccuaccagaguacuuggcaaagaucuuuuuaguacacagagccuucgccaagagcucuuagcacgagaugagca

SEQ ID NO: 745 - RNA, 61 nt, Equine herpesvirus 2
gguaaggccugugaguaagcuaucuccucccacagaagcuuaguaauucagagcaguuauu

SEQ ID NO: 746 - RNA, 64 nt, Equine herpesvirus 2
ucgcggaggagaugaacgucagccggagcuccuacauugggcaccugcugacacucuaccgcga

SEQ ID NO: 747 - RNA, 130 nt, Equine herpesvirus 2
aaguagugcggguaaugaagaaguugcaagucucucaucugauagcauaguaaaaaucaguucaguauacagauuuuuucuaaacuaucgugacacaagacaagccaucaguacuuacucgcacuuacuu

SEQ ID NO: 748 - RNA, 65 nt, Fowlpox virus
uauaucacgcucuauuguauagaucgucuaacguugaaucgcugauauuacacggagcggauaua

SEQ ID NO: 749 - RNA, 70 nt, Fowlpox virus
ccggcugagucaucgcccgaggacgcgcccacgaccaaaaaaggugccuccucgagggcgggacguccgg

SEQ ID NO: 750 - RNA, 127 nt, Fowlpox virus
gugaguuuaccacggcagcgaaagccuugacggucucguaggccuuggucauguccgacaccaugcccccgucggaaaaggcagaggcguacuugguaacgucgguggcgucgaccgccgcggacac

SEQ ID NO: 751 - RNA, 60 nt, Fowlpox virus
uccucacggggugccuuaucuuguuuucgagagauuccagcaucagguccccgucgagga

SEQ ID NO: 752 - RNA, 75 nt, Fowlpox virus
gaguugcaaaugcuccuccgacgagaggcucacucaccagagccucucuggcgggagguucagcgucaccggcuc

SEQ ID NO: 753 - RNA, 128 nt, Fowlpox virus
gggaggagcaguacggaauauccggucaggaggguggaguugaggguaucccauuggcgagcguagcgagccaaugggauauccguaaacggaacucuccugaccggauauuccguacugcuccgacc

SEQ ID NO: 754 - RNA, 62 nt, Fowlpox virus
cgacgcuuuucuuccuucucccgcagccgcucccuucugcgcugcuccuucuccucgcguug

SEQ ID NO: 755 - RNA, 86 nt, Fowlpox virus
ggagcuggucguaggcucccagggacuuuaucugauaccuagcgaauccugaggcgucaaaguuaagcuuggucaugaccagcucc

SEQ ID NO: 756 - RNA, 83 nt, Fowlpox virus
ugcagggggaauaaccggaucccugucccuagcaucaagccgcagccugcuuuuugaaguugacaaagauauuucccaccuca

SEQ ID NO: 757 - RNA, 129 nt, Fowlpox virus
ccgggugggggguggccccgcugggcaccgcugcgccgccgccagguccuggggcagccgggguuccuggcgcuccgggggcagccgggcggccgccgguggguccgcugggccgcugccccgcuccgg

SEQ ID NO: 758 - RNA, 63 nt, Fowlpox virus
gcgccggcaagaccaccuucgagauuaagcccauguuuaagcuucacgucaucugcaacgcgc

SEQ ID NO: 759 - RNA, 98 nt, Fowlpox virus
ggugucgucaugaccacccugugggcuccccccaaaugucuagaaccggccacggccggucuccguucucggagacccgaagugucgucaugaucacc

SEQ ID NO: 760 - RNA, 103 nt, Fowlpox virus
uugugucccgcaugcuagaguauccucgaggaggauucuucuacagcaccgacauggccugcaugauggagggucucgcagaggagcuagcaggaggacacaa

SEQ ID NO: 761 - RNA, 65 nt, Fowlpox virus
gucagggcggcugacggucucaaggguccaaauuccaucgaccccgagacaaaaaugguccugau

SEQ ID NO: 762 - RNA, 92 nt, Amsacta moorei entomopoxvirus
aauucauuagaauugauuuuauuagaaugaguuauuucuucauccgaagauucaacaucaucuuuuuuuuucuuaauuucuauucuagaauu

SEQ ID NO: 763 - RNA, 90 nt, Fowlpox virus
gagacggucgggcuugacguugaggagcuccagcuuggacuuguccaccgaguuuacgacagcgcaaaucuuguacagcucguccuucuu

SEQ ID NO: 764 - RNA, 66 nt, Fowlpox virus
ucccucaguguuugccagcuuauuuccccaguuuucacguacuggggccuguggacaccugaggga

SEQ ID NO: 765 - RNA, 90 nt, Fowlpox virus
gccagagucugaaaaguuuguagccuuuauguccgccgcccggcggaucauggacaagagaaaggccaaaaagacuaugcaagaguuggc

SEQ ID NO: 766 - RNA, 119 nt, Amsacta moorei entomopoxvirus
agaaucuucuucuaauucauuagaauugauuuuauuagaaugaguuauuucuucauccgaagauucaacaucaucuuuuuuuuucuuaauuucuauucuagaauuuuuuuuauuauucu

SEQ ID NO: 767 - RNA, 68 nt, Amsacta moorei entomopoxvirus
auuuuaggaucauuaaaauuauuuuuacacuuaaauuuaauuuuaucaauuuuuucagauuuuaaaau

SEQ ID NO: 768 - RNA, 68 nt, Amsacta moorei entomopoxvirus
gaaguccacgguuccuaaggccuuuuuaccauguuuugaugaaaacgccacggaaaucgaucugcuuu

SEQ ID NO: 769 - RNA, 62 nt, Fowlpox virus
ggaccccagccccgccgaucccucccccagggcguacccggcuugccugguucuggggcucc

SEQ ID NO: 770 - RNA, 62 nt, Amsacta moorei entomopoxvirus
gaaaauaaaugacggauaugaugugaaugauauaucgucaucgauauacgugguuucuuauc

SEQ ID NO: 771 - RNA, 70 nt, Amsacta moorei entomopoxvirus
guuauuggcucuaauuagucauaaaaguacaacaauacaguaugcgaccacugaaauagagcuaaaaaac

SEQ ID NO: 772 - RNA, 60 nt, Amsacta moorei entomopoxvirus
guuuccgcuuuucagcgagcauguacccuaaugggaaugcgauggcuguuagugcgggac

SEQ ID NO: 773 - RNA, 72 nt, Amsacta moorei entomopoxvirus
aguacuugaaauacagccccuagaaaaaucaaaaguauuucuugaaaaacuaaaaccuguagaacaaaaacu

SEQ ID NO: 774 - RNA, 70 nt, Amsacta moorei entomopoxvirus
auagaaaaagauaagaggaucgauuaagcaaaauaaaacuauggugcucuuggucaauuucgguuucuau

SEQ ID NO: 775 - RNA, 73 nt, Fowlpox virus
aguuuugccacaacaagccuacugucaacacgaugggaguggagagcgcagugaccgggcugguggcagagcu

SEQ ID NO: 776 - RNA, 95 nt, Fowlpox virus
ggcucguuaaacccgccgugggcauggacacccuguacggcaccaggaacgccagguucguacccagggacgucggacgguggggaaagggagcu

SEQ ID NO: 777 - RNA, 90 nt, Fowlpox virus
gagauuuaaugcuagucuaaauauuucuauauuaagauacuaucuuaagauaucgguacucugagauauuuuacgcugacauuuuuacuc

SEQ ID NO: 778 - RNA, 97 nt, Fowlpox virus
ggccgccgccucgagguggcucgcgucgccauggagaccgagacccgucaaucagcggucaccauggcgacgcgagcccgccuccgaguccgcggcc

SEQ ID NO: 779 - RNA, 70 nt, Amsacta moorei entomopoxvirus
uugaaaucaauguuuaaaguuuuaaauugaguuuucucucuuaaaaacaagcuaaauaaauugguuuuaa

SEQ ID NO: 780 - RNA, 60 nt, Amsacta moorei entomopoxvirus
ccguaaucgugguguucgucgucacuuguuaacuuuaacguucgagaauagcgagcaugg

SEQ ID NO: 781 - RNA, 75 nt, Amsacta moorei entomopoxvirus
ucugaaauauuuaucuaacaaugguccaauuacaaguuuaauuuuaucacacacaauagauguaauauauucaga

SEQ ID NO: 782 - RNA, 61 nt, Amsacta moorei entomopoxvirus
gaggucguggaguacgguugauuucuuuuucuuaaaagaaguaaacugauucgauuuccuu

SEQ ID NO: 783 - RNA, 74 nt, Amsacta moorei entomopoxvirus
cagugaucaagaaacaauauacaugauaggugacgaaaauauucaugacuggucauauguagacgaugacacug

SEQ ID NO: 784 - RNA, 72 nt, Amsacta moorei entomopoxvirus
aauauugauuuauauuaugcaacaguaacagaaccauuugaaaauacuguccuaagcacaauguuuaauguu

SEQ ID NO: 785 - RNA, 130 nt, Amsacta moorei entomopoxvirus
acccuccacccagccucccauugguccagaauagggaaguccgccauucccgggaucuccugauggucucgggacucuccucccggcuccccauuggccagagaugacgugccaggcauggggcaaucgu

SEQ ID NO: 786 - RNA, 63 nt, Amsacta moorei entomopoxvirus
gcaauccugauauaucgcaauagugggccgggcccgguccaaauaaggucagucgccccuugc

SEQ ID NO: 787 - RNA, 75 nt, Amsacta moorei entomopoxvirus
gggagauaguggacagcccccauugggccaugggcuuuauugcccaaugcccuaaugcauagguaucagucuucc

SEQ ID NO: 788 - RNA, 86 nt, Amsacta moorei entomopoxvirus
aacgggaaugaucgauugacacuauguaaagaguucuuauaaauucaaagcagcucgaaaaggugacaguugaauaaucucucguu

SEQ ID NO: 789 - RNA, 130 nt, Amsacta moorei entomopoxvirus
agcaaccggggucuuuauuggccgagggugcaguggguagcccccauugggccgccgggauaguuacccaauggcucauacauagucaucauggucccccauagucugccuggcaacuuaagaucccauu

SEQ ID NO: 790 - RNA, 61 nt, Amsacta moorei entomopoxvirus
aacccugcccccugacuccccauuggcuaaaugggucagugggagguacccauuaaggguu

SEQ ID NO: 791 - RNA, 102 nt, Ateline herpesvirus 3
cgaucaaguauucucagccugugaugucucaccaagccgccgcaaucuguggcuucaaggagggugaguacaucguggaugacgaguaccagaagaggaucg

SEQ ID NO: 792 - RNA, 65 nt, Ateline herpesvirus 3
aaguacauccuaauuuuaacucuaaaagggguuccuuguaaaauuauuuaaguuaugguguacuu

SEQ ID NO: 793 - RNA, 64 nt, Ateline herpesvirus 3
gcuaaagugaaaguccuggaggauagcuucaaaccucuugauuccggccggaagucacuagagc

SEQ ID NO: 794 - RNA, 65 nt, Ateline herpesvirus 3
cccggggacggggccaccuagccagccagcccggggacggggccaccuagccagccagcccgggg

SEQ ID NO: 795 - RNA, 68 nt, Ateline herpesvirus 3
gcgcuguggauuugucuucuacgcuagauuuuuuuuaagcaguggauugucacaaucuaaagaagcgc

SEQ ID NO: 796 - RNA, 69 nt, Ateline herpesvirus 3
cacaguuuugcuuugaagugcccaauagaagcauuuccauucacacuucuagcaucuuauuugacugug

SEQ ID NO: 797 - RNA, 64 nt, Ateline herpesvirus 3
gcaucugggaugaacuacacgacuuacgucuccgcgaaggaggccaguucaucauagcagaugc

SEQ ID NO: 798 - RNA, 79 nt, Ateline herpesvirus 3
aggcgcguauuuuacaugugguacaggguagaaaaccuuguagguuucaguugagucacccugccacguaaacccgccu

SEQ ID NO: 799 - RNA, 64 nt, Ateline herpesvirus 3
cacuuaagcuaugauuccuguagugcucuuuccuaagcugagccuauuuugcccauuuuaagug

SEQ ID NO: 800 - RNA, 66 nt, Ateline herpesvirus 3
uguggaaaacauuaagaguuguuauugaaaauauuuuuugguaacaaaaccauguuuuagguccca

SEQ ID NO: 801 - RNA, 113 nt, Ateline herpesvirus 3
augcguuguuggcgcacgauccaacaaagucgaggauuacguuggggcugcugguacauuccugacgaauccuaagugguuaaagaauggguugagaauugcuggcagggcgu

SEQ ID NO: 802 - RNA, 98 nt, Encephalomyocarditis virus
ucagaaagagguuuaauauuuuugugagaccaucgaagagagaaagagauaaaacuuuuuuuacgacuccaucagaaagagguuuaauauuuuuguga

SEQ ID NO: 803 - RNA, 126 nt, Equine herpesvirus 1
accucuuucugauggagucguaaaaaaaguuuuaucucuuucucucuucgauggucucacaaaaauauuaaaccucuuucugauggagucguaaaaaaaguuuuaucucuuucucucuucgauggu

SEQ ID NO: 804 - RNA, 125 nt, Equine herpesvirus 1
accucuuucugauggagucguaaaaaaguuuuaucucuuucucucuucgauggucucacaaaaauauuaaaccucuuucugauggagucguaaaaaaaguuuuaucucuuucucucuucgauggu

SEQ ID NO: 805 - RNA, 66 nt, Equine herpesvirus 1
ucucaauaaagaaauaaauauaucuuuguuaaauauguuaacuuuuuguauauuucuauauuguga

SEQ ID NO: 806 - RNA, 109 nt, Human herpesvirus 5
uaugagguucgaccagcggcugcuggaagagggcgacgaggaggaugaagugaccgugaugucgccgucacccgagcccgugcaacagcagccgccggucgagcccgug

SEQ ID NO: 807 - RNA, 64 nt, Human herpesvirus 5
cuauaugaacuuaugugccugucaugccagccagaguuguggacaacaaacauaauuauuauag

SEQ ID NO: 808 - RNA, 96 nt, Human herpesvirus 5
gugguuguaacaguugcuucgaguugugaauuagaaucguuacaaaucuuacgugcgacguucaguccgauaucggagaaaguaccguuugaccac

SEQ ID NO: 809 - RNA, 66 nt, Human herpesvirus 5
gcguuccguugagagugacuguauucacccuuauguccaaguucacugacucuugauaagagcugc

SEQ ID NO: 810 - RNA, 121 nt, Human herpesvirus 5
gauacaucgauguggacaacaacugggcccucuuuauaaauaauaagcgcugucuggauacugaauucucccauaugcuaaaaguuauggaguacggccugccaguuacagacgaaguauu

SEQ ID NO: 811 - RNA, 66 nt, Human herpesvirus 5
uaugcuuccuuuaaacagguguuggauucugauggcuuuuuagaaucucacaccagggacaacaua

SEQ ID NO: 812 - RNA, 65 nt, Human papillomavirus type 89
gggcacaauuucuugcacgugugcauauaccaaaggguauacaggcuaugcaaggucauaugucc

SEQ ID NO: 813 - RNA, 69 nt, Human herpesvirus 5
aguuggcuuucuaccccucuuuacagacaaggaaagguucccuguauaguuugugugggaucuccaacu

SEQ ID NO: 814 - RNA, 62 nt, Human papillomavirus type 89
auguuuguggagugauauacuugugcugcuuauuugcuuuuggcuuucgcauuugccugcau

SEQ ID NO: 815 - RNA, 67 nt, Human papillomavirus type 89
acauggugguauuugacagacaugauguuggguuacuaggcauauuguuguuacuuauugcucuugu

SEQ ID NO: 816 - RNA, 66 nt, Human papillomavirus type 89
gcaagugcuacuacuuuucggagucagaguccaauuggagugaagccgaaaaauuuuguagacagc

SEQ ID NO: 817 - RNA, 91 nt, Southern cowpea mosaic virus
uuucaaauaauauaugcuaaaauuaguucauuaaaauuuauagauaacuaugauauaucuuuaacuaaaguagcauauguuacucaugaaa

SEQ ID NO: 818 - RNA, 103 nt, Southern cowpea mosaic virus
cuccuccacuaauucgcggauacguugccuuauggcugagcuuauugguuccccauggugcaucgccaugggugacgacuccguggaggguuuuguggagggg

SEQ ID NO: 819 - RNA, 97 nt, Human herpesvirus 5
uuuaccuguccaauugucugugaggucuauaaucagacuuuccaaaaauauaaagaaaaaguuaaucuuacagaaauuaccauaauggacugguuga

SEQ ID NO: 820 - RNA, 75 nt, Human herpesvirus 5
gucucggucagcgugccauaaacgaauauuauaugguacgucgaacauucgcuuaucauggcaugcugaccgaac

SEQ ID NO: 821 - RNA, 60 nt, Southern cowpea mosaic virus
ugaccccgccccucggacuuugaccguucccacgccacgucauuuucccacgcgacguca

SEQ ID NO: 822 - RNA, 90 nt, Tupaia herpesvirus
cgcauuaauaauuuacccacagugaagcuugcuaagcaggcucuaccccugcuugcgaauccuaaacuuguaaauaaagcuauagaugug

SEQ ID NO: 823 - RNA, 65 nt, Tupaia herpesvirus
ccgccgucucguagaccgaauccagacgacgcagcccgucuuugaugaggacgucgaaauugugg

SEQ ID NO: 824 - RNA, 68 nt, Tupaia herpesvirus
caaaccgggugcaauaucagcuccugucgcuauuagucggcgaguggcugguaugaagccuagguuug

SEQ ID NO: 825 - RNA, 71 nt, Tupaia herpesvirus
guaacggggaucgcgagcggucgagucgggacccugcaggcgaccgaacggcagcagaucuuccccgcaac

SEQ ID NO: 826 - RNA, 81 nt, Southern cowpea mosaic virus
aauaauauagauagcagauuacuuaaaauauuuauaaaaaauaaaacuuuuauuucugguaguuuuguaucauauaugauu

SEQ ID NO: 827 - RNA, 124 nt, Tupaia herpesvirus
agggugucaauuacauugcugaucgugaugugauaacuacuggggguaauauugguguuaacaucaauauucccgggacuuaucucgucacgauuguucuuaaugcuacaucgauugguccccu

SEQ ID NO: 828 - RNA, 101 nt, Equine herpesvirus 2
gaggugcuugcauggagccaucucuauuggauaaacagcaaaggugaauuggcauuuuccccucuuuuuaucaaaagauggagaggccuguaaaguccuuc

SEQ ID NO: 829 - RNA, 64 nt, Equine herpesvirus 2
uucacaugguugugaaucuuggcacaggccuuaaaguuuuccacguucagagccauacaguggg

SEQ ID NO: 830 - RNA, 77 nt, Cowpox virus
cucaaauuacuucagagcuuucauuuuaaaaaauuacauccucuuccuguguaauguuugagugcugaauuuuugag

SEQ ID NO: 831 - RNA, 78 nt, Cowpox virus
ccagagccuucaaaaauugcugagugcuucugaaacugagaagcuccaacuguaugaaccugaagaguaacucucugg

SEQ ID NO: 832 - RNA, 65 nt, Cowpox virus
acaguaguuuucacgguauuuuuugaaauuaaauuuuaaaucggguacaugauaaagcaugcugu

SEQ ID NO: 833 - RNA, 62 nt, Satellite tobacco mosaic virus
aucucuuucaguaugugaauagauagguauuuuaucucuauucaucaucgaauuuaagagau

SEQ ID NO: 834 - RNA, 62 nt, Southern cowpea mosaic virus
gcgcucaugucgcugggaguacacccggacccgggccuggauguacuccagcaccugaucgc

SEQ ID NO: 835 - RNA, 91 nt, Southern cowpea mosaic virus
auugauaauuauaugagugaauuuaaugauaacacaucacauccugaauuuaauauaguuaaaguugcucaaaaacguguaauauaucaau

SEQ ID NO: 836 - RNA, 74 nt, Tupaia herpesvirus
cgugcugccauuagcucuuaugcucauuccgcugauucagcgccuugggcugagaauguucuaguggucccaug

SEQ ID NO: 837 - RNA, 80 nt, Tupaia herpesvirus
ggugagcggacgaacagauagccgcgcgcacacgcgagucucccggugagcgagcgacugucucgagucgcacgcacacc

SEQ ID NO: 838 - RNA, 131 nt, Tupaia herpesvirus
uuuuguuaauaaaguauguauggagguuucauuugugguugcacccugugacuaagguguugucccuguuuuacauauaauaggagugugauuaccaacauuuccuacauaauuuuaugcccuacccuaag

SEQ ID NO: 839 - RNA, 75 nt, Cowpox virus
ucgucguccaccucagguacaauaguauauuauauauauauuauuuuaauaaacuuauugaggacgggagaacga

SEQ ID NO: 840 - RNA, 65 nt, Cowpox virus
uuacaacuuucauuuuaaaagucgcgucuucuuccgguagcgucuuauuaaaguuuaaguuguag

SEQ ID NO: 841 - RNA, 72 nt, Satellite tobacco mosaic virus
gagcuggaagcuauccuaaggucaauccgacuccaacgugggucagagccauaccuuucgaagugucaguuc

SEQ ID NO: 842 - RNA, 87 nt, Equine herpesvirus 2
gcacguccgcgggcgcguaggccagcaccugagccagcaggucaaagugcucgccggccagcagcgugcgcgccagcgcgggcaugu

SEQ ID NO: 843 - RNA, 82 nt, Cowpox virus
aaaauuauguguaagccuagcgugagugcgcacagucagauucuugcauuguguuuacuuuauuuagcaauaacaucuuuuu

SEQ ID NO: 844 - RNA, 97 nt, Satellite tobacco mosaic virus
auuuuaggaacuacguucaugguauccuggcgaauauuaaaacuaucaaugauaugauuaucguuuucaucuuuuaucaccauauaguuucuaagau

SEQ ID NO: 845 - RNA, 70 nt, Satellite tobacco mosaic virus
ugggcuacacugauaggcugcccguucugaaggggcaccugauuuacaaaacagacuuuauugugggcca

SEQ ID NO: 846 - RNA, 66 nt, Satellite tobacco mosaic virus
ggcgucuaagauauucuuccaucaacuuauuaacauuuuugacuagggaagauacauuaugacguc

SEQ ID NO: 847 - RNA, 78 nt, Satellite tobacco mosaic virus
ggccuggaggacgcgggccagcacgugaaagugaggugccucuuugacguccuucacgagcuggcccuccugcgggcc

SEQ ID NO: 848 - RNA, 64 nt, Satellite tobacco mosaic virus
ggccaccugcuuucaccccuucuacuucaagggcuucaccuccaaccaccugagcucgguggcc

SEQ ID NO: 849 - RNA, 82 nt, Rabbit fibroma virus
auguuuuuuaucucuuucaguaugugaauagauagguauuuuaucucuauucaucaucgaauuuaagagauccgauaaacau

SEQ ID NO: 850 - RNA, 88 nt, Camelpox virus
uuucucgaauauacgggccaaguuagaaucuccaguaacuaccauagugggauaucauccagcagcuagagaccgccaauucgagaaa

SEQ ID NO: 851 - RNA, 61 nt, Junonia coenia densovirus
auuguuuguauucauucaaugucuccuuuucagaaauuaguuuagagucgaauacugcaau

SEQ ID NO: 852 - RNA, 84 nt, Feline leukemia virus
uagaguuaagagaaauuagaguuuguacauuaagcaacaugucucuaaauguggcuacaaacuuuuccuuuuccacaucaucua

SEQ ID NO: 853 - RNA, 66 nt, Fowlpox virus
aacauccuaauacuuuauuuguuuuaaagcuauuaaagaguucuaacaauaucauuuuuggauguu

SEQ ID NO: 854 - RNA, 66 nt, Fowlpox virus
agguuuaccuauuuuaucacgauugauaucugauuauauuguguacaaguaaaauaauuacuaccu

SEQ ID NO: 855 - RNA, 63 nt, Chimpanzee cytomegalovirus
cuuacgaggaucuccuuaaauucgaguccaguaauuccuuugagugacgggaagccuuacgag

SEQ ID NO: 856 - RNA, 67 nt, Vaccinia virus
aaaacuuuuacgguggagaauuauuaaauuacuaaacauauuaguaauuuauacuguucauaguuuu

SEQ ID NO: 857 - RNA, 69 nt, Rous sarcoma virus
cugaggggaccaugauguguauaggcgucaagcggggcuucgguuguacgcggauaggaauccccucag

SEQ ID NO: 858 - RNA, 80 nt, Camelpox virus
uccauauuuccugacuugugucuugacuugcgucgauugggaugggggugugggaugggggugugggauggggguguggg

SEQ ID NO: 859 - RNA, 60 nt, Myxoma virus
ucagagauuauugucuuauauucuuucuuguuauccgauauaaauuuaauaagacuuuga

SEQ ID NO: 860 - RNA, 111 nt, Rous sarcoma virus
gauggcgucuucccuguuuugcccuuagacuauucgaguugccucuguggauuagggcuggaggcagcacggauagucugauggccaaauaaggcaggcaagacagcuauu

SEQ ID NO: 861 - RNA, 77 nt, Rous sarcoma virus
uuguaauuuccaauuuacauaacuaauugaaauaauuuuacaagaugaacaauuaauuggaauuuuggaauuuacaa

SEQ ID NO: 862 - RNA, 64 nt, Rous sarcoma virus
aauuggaauuuuggaauuuacaauuuuauuaacuuuuuguaauaauuuuccaagauguacaauu

SEQ ID NO: 863 - RNA, 80 nt, Sulfolobus virus SIRV-1
aagaaagcuuuaaaguuaaauauccugcagauacgauuuuuccaucugaaguugguauuuguuauagaaaaaguuaucuu

SEQ ID NO: 864 - RNA, 62 nt, Hendra virus
guaugaaacuuuaugaggaacuggugagaaauaacuuacgguuaugauuucgguuucgucgc

SEQ ID NO: 865 - RNA, 61 nt, Rabbit fibroma virus
auuguuuguauucauucaaugucucuuuuucagaaauuaguuuagagucgaauacugcaau

SEQ ID NO: 866 - RNA, 71 nt, Vaccinia virus
ugcguaaauuucgcaacuaaugagauaaauuggaaauuccaauuuuuuucguuuuuuucguuuuuuucgca

SEQ ID NO: 867 - RNA, 66 nt, African swine fever virus
uaucuaucguuggcauuucaaguuccgauacacauuuuauuccauaaauaaugcuauuugaagaua

SEQ ID NO: 868 - RNA, 130 nt, Hendra virus
cacaaaaugauuagaugcuuaacuuacuuaauaacuauacuuaacuauacuuauagacuaaacuuaacuuaucaacuauacuuaauuuuuagguccuuauaaugugaacuaaauaaucaacuguuuugug

SEQ ID NO: 869 - RNA, 86 nt, Human papillomavirus type 54
guaauaauguuguauacaguaaguugguuaacauguugguuuuuauuauccauguuauuauggcaauguauuacaacagcauuuac

SEQ ID NO: 870 - RNA, 75 nt, Human herpesvirus 3
gguucucuguuaaugacucaucccauaagugguggucuggugaccaagaacuuagucugaagggucacagcgacc

SEQ ID NO: 871 - RNA, 89 nt, Foot-and-mouth disease virus SAT 2
uaugggaauauucugguaaaagugcauguaucaauuuuagucguuuuuggauuucuguaauguuacgauuugcuauguguauuuucaug

SEQ ID NO: 872 - RNA, 62 nt, Fowlpox virus
ucagaguauaaauuuuagaaauaacauuagcaaauuguugugcguugaugucguuauucuga

SEQ ID NO: 873 - RNA, 81 nt, Chimpanzee cytomegalovirus
cccuuguuaagauaugaugcaauaaauacacgacaugaaacuuucauuuauugacgaauugcaccauuuaaacuauuuggg

SEQ ID NO: 874 - RNA, 64 nt, African swine fever virus
uagcuuuuauugaauccaaaacaucaguuaacaaacaagcuaccaaaggauuugucauaaguug

SEQ ID NO: 875 - RNA, 66 nt, Human herpesvirus 3
cacuuucuguggugccuuaugaaucagaccuagcuacacuuuucugauucaugugcuaccucugug

SEQ ID NO: 876 - RNA, 100 nt, Foot-and-mouth disease virus SAT 2
gcggggccgaaagccacguucucugaaccuugcgugugugcaaccccagcacgguaauacugucaugaaacacacuuuaagguaacacugagacugguac

SEQ ID NO: 877 - RNA, 105 nt, B19 virus
gaauaugaauucuauaucuacagcauuuucuuuauaguuaauguuguaauuaucgguuauacauugaacaauugauauaaguguuguuuugugcuuuucauauuc

SEQ ID NO: 878 - RNA, 73 nt, Rat cytomegalovirus
ccugugcuucgcccggauggacgagagccucaccuccgugauggcguccucgccguccagcacgaagaacagg

SEQ ID NO: 879 - RNA, 72 nt, Rat cytomegalovirus
uuuccauaucaucauuguguaaacuaaauaacguuuucuauggcauuuaauaaggcauuggauauguggaaa

SEQ ID NO: 880 - RNA, 112 nt, Hendra virus
ucucaguaguaguaagucucacuggugaugggauacaagugcaaguuccuuuucaaauggugcucaaaucuaaggauccucuugcugaauaggcuaucuacuaugcacugga

SEQ ID NO: 881 - RNA, 71 nt, Human papillomavirus type 54
auuguacauacuauauuguaaaacaaccagccaauacugcugcuauguguauauagugagguauguauggu

SEQ ID NO: 882 - RNA, 114 nt, Human papillomavirus type 54
ugcacugcggucaucgucuccacgguccacuccuccucaagcucuuuggcagacggcacauacucaucggccgcggggcguagaguggccaguguagaauugaccgugucugua

SEQ ID NO: 883 - RNA, 86 nt, Fowlpox virus
uguaguuuuaguguauagauauuauacagauuugauuuaucuauuauaucgcuuuccauguguauaagcuauuuacuauuauucca

SEQ ID NO: 884 - RNA, 87 nt, Rat cytomegalovirus
agaucugcggcacgcacugcaucaccggccucucggucacgucgaagaacagguacagggaggugcagaucaugcgcacgcagcucu

SEQ ID NO: 885 - RNA, 76 nt, Hendra virus
uuuuucuuauugucuucagaugagccuuauuacuucaucucaucagauuauaaauuuucuaauaaauuaagaaaaa

SEQ ID NO: 886 - RNA, 81 nt, Tupaia paramyxovirus
cuguuguuuaaaagaaaguagacagugauacggugaaccaguagccaaaacaaaauuuaauauuaucagauuaaacagcag

SEQ ID NO: 887 - RNA, 109 nt, Fowlpox virus
gauuaguuauauucuauguaauaauaacgauuacauguauauaacauauacuauuucuauuuucuuauguuauauaaaaaaguuauuuauuuacauaauaagacuuuuc

SEQ ID NO: 888 - RNA, 86 nt, Simian T-lymphotropic virus 1
guccgccgucuagguaaguuuagagcucaggucgagaccgggccuuuguccggcgcucccuuagagccuaccuagacucagccggc

SEQ ID NO: 889 - RNA, 68 nt, Fowl adenovirus A
auacagcuuugauucuucugaucgucuugacgguguucacgggcgcggugguagcuuugauguuguau

SEQ ID NO: 890 - RNA, 77 nt, Beet yellows virus
cauacgaauauacgauaggaggaaagaaguuccuggucaaggaugcuuggguuuuuccucuaauaaaagaguguaug

SEQ ID NO: 891 - RNA, 68 nt, Meleagrid herpesvirus 1
cgccuuacaggggugugguagugcagggucugccugcucggcaagaccgcuccccggcaaccgaggcg

SEQ ID NO: 892 - RNA, 131 nt, Melanoplus sanguinipes entomopoxvirus
aaaccauccaauccacuaccaauagcuggcauauuaaguguaguuauauuauuuuuuauacaauauucucguaauaauucuauagcaucuucauacuguuuuaauguugguuuuuuauaagaugaugguuu

SEQ ID NO: 893 - RNA, 72 nt, Melanoplus sanguinipes entomopoxvirus
accacuggaaagcuucuaccucuggacauguguuauauacaauccagucauacugagagugagucuuguggu

SEQ ID NO: 894 - RNA, 68 nt, Melanoplus sanguinipes entomopoxvirus
aaccuguuaagcugagauggcugcauuuuuggagaaauaaugugcagcuuagcuugaauuuuaagguu

SEQ ID NO: 895 - RNA, 65 nt, Simian T-lymphotropic virus 1
gccgcccuaccugaggccgccauccacgccgguugagucgcguucugccgccucccgccuguggu

SEQ ID NO: 896 - RNA, 65 nt, Fowl adenovirus A
gcgucugcagcauugucugccuggucaucaccuuccugcagcucaucgacuggugcugcgcgcgc

SEQ ID NO: 897 - RNA, 78 nt, Beet yellows virus
auuaaucacugauuccuuuuucgaugccggacaauagcacaauuguuuagcuuuggacucuauguauucaggauuaau

SEQ ID NO: 898 - RNA, 67 nt, Simian type D virus 1
gcgcaguucccgaggggucauuucuuaucauaaaauaauaaaaagggggaccuguccggagcugcgc

SEQ ID NO: 899 - RNA, 75 nt, Paramecium bursaria Chlorella virus 1
uugguucuuugaacaucuuggucgaaaaguagguauuuucuaucuuuugauuuauccguacacucguguagccag

SEQ ID NO: 900 - RNA, 93 nt, Paramecium bursaria Chlorella virus 1
cgucugaauauccaaaguuaucaggucuaguguaaucuacaaaaucagaacaguaauuggcaucuaaaugaucacuacaaacuuucauguacg

SEQ ID NO: 901 - RNA, 73 nt, Human papillomavirus type 66
aaagguaacguguaaucgccauauauugcaaccauugauuuuuguguaauuuguguguuugcgcuuugcuuuu

SEQ ID NO: 902 - RNA, 102 nt, Cercopithecine herpesvirus 7
gcugcgcccccuaacuauacaagcacgcaggugcaaaccgaaaaccguagcguuuccacgacuuauguaccuccgugguuggaacacgaaagcaacugcagu

SEQ ID NO: 903 - RNA, 90 nt, Tupaia paramyxovirus
uugaagcuuuuauauuaaacaugcgaucuaaucaacccuaggcaaacacacuaaguuuaagacuaaaacugaagagaucgcaggcuuuaa

SEQ ID NO: 904 - RNA, 60 nt, Fowl adenovirus A
uuuugcuuaugcagagucggcaagcuuuggaaaggagcuugcgccgcugcguaagugaag

SEQ ID NO: 905 - RNA, 92 nt, Human herpesvirus 6
ccacgucguuaucagcgugcugugucacgccgucucggccagcagcgucaagaucgacgugacuauuuugcaacgcaagauugacgagaugg

SEQ ID NO: 906 - RNA, 81 nt, Gallid herpesvirus 3
ggguaauacgaauuuugaauuuugggaguaucugucaaguauauucaacucuugaauaaccacgaccaggcguagcuaucc

SEQ ID NO: 907 - RNA, 71 nt, Gallid herpesvirus 3
cgcuauaccguccuuuaaauuagacaaggugcgcgucucuaaaccuauaauucccgguagcgguauaagcg

SEQ ID NO: 908 - RNA, 83 nt, Lymphocystis disease virus 1
gcagaucuguuaacgccuguagaacaauggacuauuauuaaaaagucauuauuuacaagcuuuacaaaaguugauggauuagc

SEQ ID NO: 909 - RNA, 67 nt, Lymphocystis disease virus 1
ucaaauugaagaucauccaacagcguaucauuuuuuaauguaugcaaaagauagaggcuuaauuuga

SEQ ID NO: 910 - RNA, 123 nt, Nipah virus
accucuuucugauggagucguaaaaaguuuuaucucuuucucucuucgauggucucacaaaaaauauuaaaccucuuucugauggagucguaaaaaguuuuaucucuuucucucuucgauggu

SEQ ID NO: 911 - RNA, 65 nt, Sheeppox virus
guauauacuuagaugagucauuuaaaacuugucuauuuaguuuuaguucuuucucuaacuuauac

SEQ ID NO: 912 - RNA, 72 nt, Sheeppox virus
ccgcaucaccgaccaggcgggcgcggggagcgggcucugcugcguguuuucgcgcguguauggggagugcgg

SEQ ID NO: 913 - RNA, 61 nt, Sheeppox virus
cacccgcgcgcgccggccaacacggccugccuuacggccguggcggugggcggcgcggggg

SEQ ID NO: 914 - RNA, 73 nt, Sheeppox virus
acgagauugugaaccugcgccuggagaucgagcgcgcccgcgacgcggacuuuggggcguuuugccgcuucgu

SEQ ID NO: 915 - RNA, 75 nt, Sheeppox virus
gcggcucgcgcggcggguaagcggacgagccugccgcggcggcggcgggccccguggacgccgcccucgagccgc

SEQ ID NO: 916 - RNA, 84 nt, Sheeppox virus
cgaugaauacuuuaaugacguuauaccucuacauaaugcuuauagcgugcaacguugauauaaugucuuaucucguauauauug

SEQ ID NO: 917 - RNA, 66 nt, Sheeppox virus
ugaguuuguccacaaguuugagggcaagaaccuguuugccucuguagacuacuguguaaagacuca

SEQ ID NO: 918 - RNA, 65 nt, Sheeppox virus
gccgaguggcggucaacagccucgcgccgggagagcccggugcgaggcgcccggugccgcuuggc

SEQ ID NO: 919 - RNA, 78 nt, Sheeppox virus
uugcgacuggugcaacaaugguuucgcugaagguuugagacauggcgugagacauggugugaccuaaaccauucgcaa

SEQ ID NO: 920 - RNA, 65 nt, Sheeppox virus
gucccagcgcgcgaauucguggacgccgucuggcagccgcggcggacgucgcuggcgcuggugau

SEQ ID NO: 921 - RNA, 86 nt, Sheeppox virus
gcugcucuugcugcucuugcugcucuugcugcucuugcugcucuugcugcucuugcugcucuugcugcucuugcugcucuugcugc

SEQ ID NO: 922 - RNA, 74 nt, Sheeppox virus
cuggccgaccgcggcggcggcgagcgcuuccgcguggcgagcgcggcgguugcgccgcugcagcggcuggccgg

SEQ ID NO: 923 - RNA, 66 nt, Sheeppox virus
gaucucaaagaccgauauggaaacucaaaccguuaucggguacaauaaaccaugacuguccagauu

SEQ ID NO: 924 - RNA, 83 nt, Sheeppox virus
cagucccguugcccaugagcagguacacuuugguucaggaaacugcccaagacaucauguacacuccgaugggaaaggaacug

SEQ ID NO: 925 - RNA, 97 nt, Sheeppox virus
gcgcagagcuguaccagcgccuggacgcgcuguugcugccgcugcagggcuucgcggggcugcgcgcggcgcccggcgcgcuggagcggcugugcgc

SEQ ID NO: 926 - RNA, 64 nt, Sheeppox virus
gggccauggucaaggcgucuggaaacuggccauccacuuuggccacagccgccgucgccauccc

SEQ ID NO: 927 - RNA, 97 nt, Sheeppox virus
aaguggaccgggaggaccgaggaagagucuuuccugaucucugacaugaugggucagaucaagacagguuggauuagaucugggcccccguccucuu

SEQ ID NO: 928 - RNA, 65 nt, Sheeppox virus
uucacaaguauuauuaaaaaugaguaucgauaguuacauuaccauaucauccaugcucaugugga

SEQ ID NO: 929 - RNA, 74 nt, Sheeppox virus
gagggucuggauggugagcuuggagagagcgucuucgucaaugaccugcucuccuguagccuuguccagcuuuc

SEQ ID NO: 930 - RNA, 63 nt, Sheeppox virus
gaagaucgaugucccgccgccgcuggcgcagcugcgcggcaucgcguggugggacgcguuuuc

SEQ ID NO: 931 - RNA, 117 nt, Human herpesvirus 5
cgcccgcuccggcgccggcgaggggguggugucgcgcggcccgggccgguucggccgacucggcuggcgcgggcggccgugccgcgucccaccgcgccgucgcgcgcucugcggccg

SEQ ID NO: 932 - RNA, 68 nt, Human herpesvirus 5
gugccgcgccgccuggagucgcgguucggccggaccgugcacgcgcucucgcggcccuucaacggcac

SEQ ID NO: 933 - RNA, 92 nt, Human herpesvirus 5
ucgcccuuccggagugacgcacauagcucgccggggcccgccuucuguccaggccgguuccaaagcggcgugucugagucacccggaggcga

SEQ ID NO: 934 - RNA, 104 nt, Human herpesvirus 5
gcagccgcaggaucgacacgaggaacggggucagcacgcggucgaugguguaguuggaguaggcgauguuguccuccgcgcccugguuggucaccuggcggcgc

SEQ ID NO: 935 - RNA, 78 nt, Sheeppox virus
cgcucgugcggcagccgcccagcgaggugcagaccgucaacgcgcuggaccucgucacgugcgcgcugcugcugggcg

SEQ ID NO: 936 - RNA, 70 nt, Sheeppox virus
uugguuccggccccgguuccggcuccggccccgauuccggcuccggccccgacuccggcuccggccccga

SEQ ID NO: 937 - RNA, 70 nt, Human herpesvirus 5
ugcgucugcaacggcaucauguuccuacacgccuugcaccuggguggaacgagcgccguccugcagaccg

SEQ ID NO: 938 - RNA, 60 nt, Human herpesvirus 5
ucugcgacugcaccugcuccuccaggcauuugaucaucugcuugcggaacaggucgcgga

SEQ ID NO: 939 - RNA, 76 nt, Human herpesvirus 5
gauccgggaccgccguagcgggguguuuuuuaauuuauuuuauauauacgcuauguaucuacuguuuuuccggguc

SEQ ID NO: 940 - RNA, 63 nt, Human herpesvirus 5
gcgccuggacguugcacgcggcggguaccgaaagcggcgcuaacgcggcaacggccacggcgc

SEQ ID NO: 941 - RNA, 88 nt, Human herpesvirus 5
gccugcgucgccuaugcuucgcgcgucaccacgacaccuuccuugaagugguagacgucuucggcaugcggcaaaucgucacgcaggc

SEQ ID NO: 942 - RNA, 93 nt, Human herpesvirus 5
gauguucagcaggaagcgcaugauggacuucuuggcgucggucgucuugucgugccgcuccaugagcuccacgauccgcuggcuguugagcuc

SEQ ID NO: 943 - RNA, 108 nt, Sheeppox virus
guacuauccccugaggggaugguguuuucggaagacgccaugagaaagcucuacaaggggaccaucgacauguuugucuccgacccaucuucccuccugaacguagac

SEQ ID NO: 944 - RNA, 76 nt, Sheeppox virus
cgggcgcuggaggcgagcgcgcagcgggcgacggcagccaucgaggccgugcucgcguucaacccgcacgcgcccg

SEQ ID NO: 945 - RNA, 68 nt, Human herpesvirus 5
aggagauugcuauuaguaaguggggccauuuuuauauuaaugguuacaauuucuuuagcacauuuccu

SEQ ID NO: 946 - RNA, 66 nt, Human herpesvirus 5
cagcuggguggccaggccggagaggcucuggcccggguccagcagcuucugcauguugcccagcug

SEQ ID NO: 947 - RNA, 64 nt, Human herpesvirus 5
gucgaagaggcuggcgugcgcguuccacucguccgagaccugccgcaccgucgcacuguuaaac

SEQ ID NO: 948 - RNA, 78 nt, Human herpesvirus 5
gcgcggcacagugccaacgcgaagcgcgcaugcgcacguugaacugcgcaugcgucggcgucgguguuguugccgggc

SEQ ID NO: 949 - RNA, 97 nt, Human herpesvirus 5
ucccguaauacuccgcgaucaguuaccguggcgacguuucagggcgcaugcgccucuggaagcgguaccgcgggcgcgucgugggcacaguacgggg

SEQ ID NO: 950 - RNA, 107 nt, Human herpesvirus 5
aacagccguuauuaguuaauugcuuauggccagucccuagcuuugaagaagcagcuucuacauuuuguuuugagggugcuggcuuugaucaauguaauggugcuguu

SEQ ID NO: 951 - RNA, 62 nt, Human herpesvirus 5
gcucuguucccgcauagcugaucccguauaaauauaauaacggagaaagcguaacggagagc

SEQ ID NO: 952 - RNA, 60 nt, Human herpesvirus 5
gcgcaugcgccugggggcuuucuaugcgcgcauacgcgcgcagcucgcggguguaugcgu

SEQ ID NO: 953 - RNA, 130 nt, Human herpesvirus 5
gggggucggggggugcgcagggcggugccccgggucggaacccccgggugcgguucgggcggcggggcuucccggcuccuuccaccggcucgcccgggggucggggcgaugcccuggccuccccuccccc

SEQ ID NO: 954 - RNA, 117 nt, Human herpesvirus 5
cugacaguagcggguaauaaaaacaauaggauuuuuaucguuuuuuuauguuacaaaacaacguaucacuuucacggugauuuauucuugcuauuccuuuuccccuugggcugucag

SEQ ID NO: 955 - RNA, 107 nt, Human herpesvirus 5
cuacguggaaagcaagcccacuaacgaacugucucaacgacugcaacguuucguaaccaagcgaccgaugcccguuagcgacagcuucgucugccugcgacccguag

SEQ ID NO: 956 - RNA, 61 nt, Human herpesvirus 5
caugcgcaacagguccagcuuaaaggcgcacuugucauuaaacaggcuggacaugcgcgug

SEQ ID NO: 957 - RNA, 61 nt, Human herpesvirus 5
auuugacccccagaacuauguaucagccuagaguugcaacuaguucugacuuuguucaaau

SEQ ID NO: 958 - RNA, 67 nt, Human herpesvirus 5
cuguagaacuugccauucucauugacaacauuaacaauacauuagucaaucuugaauggcucaauag

SEQ ID NO: 959 - RNA, 84 nt, Human herpesvirus 5
gaucgucugcccgcggccgcucacguucacgccguggaggaucuggaagaauucgagcgucagcggcguggggaacagcacguc

SEQ ID NO: 960 - RNA, 129 nt, Human herpesvirus 5
gcugcguggagagacggcggggaaugaucgucuccgaugcggguugugguuucccgagccggaucagagcccucacggaugcgguucggggacccgcggggagcgaucuccgcugucgucucccgcggc

SEQ ID NO: 961 - RNA, 75 nt, Human herpesvirus 5
guaaaauggccuugguauguguggcuacuaauaggcuuaguaguaauauuuugcauaccauuacugcuauuuugc

SEQ ID NO: 962 - RNA, 88 nt, Lumpy skin disease virus
uagacaauggacugucuuugucuugaaaaaguaucuuacgauaguaguaaagauaucuuaagauauuucuuuagucuauaacuguuug

SEQ ID NO: 963 - RNA, 63 nt, Lumpy skin disease virus
gcuaaaagaggguuacgugcccgggacggugucccacaaccacaugaugcccuacuuuuuagc

SEQ ID NO: 964 - RNA, 78 nt, Zaire Ebola virus
gcguaucccaccuuugaaagcaccuccuaacgaaagaccuaauugggaaagguuaaacgaaggacaaagacgauacgc

SEQ ID NO: 965 - RNA, 109 nt, Zaire Ebola virus
uauuucagaacaacaaucugcucccacugcuccuaucgaacauccgguuaauaacgcagacgauagugacgacgaaguaggugggccuauagaaguacaagccgaagua

SEQ ID NO: 966 - RNA, 65 nt, Zaire Ebola virus
auuucacguggcuuagaaucgaauacuuggacugacguauuuaugacuacaccuuuagcugaaau

SEQ ID NO: 967 - RNA, 66 nt, Fowlpox virus
gcugcguuuauggguggaggucuccugucuggauuaggacaggggauuggcgcuuaugcacaaggc

SEQ ID NO: 968 - RNA, 125 nt, Peanut chlorotic streak virus
gagcucucgauaaaaaaguuuuucuauaacucgagcucucgauaaaaaaguuuuucgaaaucucgauaaaaacuuuuucuauaacucgagcucucgauaaaaaacuuuuucuauaacucgagcuc

SEQ ID NO: 969 - RNA, 70 nt, Human herpesvirus 5
guuucggggauugugaaccguggcugaggguguagaugggacaggaaaaagcgugugaucugaccgaggc

SEQ ID NO: 970 - RNA, 130 nt, Human herpesvirus 5
uaguaauaauuuuaaucuuugacgccuacagcaguaguaauaauuuuaauguuuaacgccuacaacaguaguaauaauuuuaauguuuaacgccuacagcaguaguaauaauuuuaauguuuaacgccua

SEQ ID NO: 971 - RNA, 64 nt, Human herpesvirus 5
guaguaauaauuuuaauguuuaacgccuacaacaguaguaauaauuuuaauguuuaacgccuac

SEQ ID NO: 972 - RNA, 129 nt, Peanut chlorotic streak virus
aaaagcuuuucgaaaucucgauaaaaacuuuuucuauaacucgagcucucgauaaaaaaguuuuucuaacauucgagcucucgauaaaaaaguuuuucuauaacucgagcucucgauaaaaaaguuuuu

SEQ ID NO: 973 - RNA, 126 nt, Peanut chlorotic streak virus
gagcucucgauaaaaaaguuuuucuauaacucgagcucucgauaaaaaagcuuuucgaaaucucgauaaaaaaguuuuucuauaacucgagcucucgauaaaaaaguuuuucuauaacucgagcuc

SEQ ID NO: 974 - RNA, 63 nt, Human herpesvirus 5
ggggugauccggaugcguggcaagaggccucgagcuugggcuucucccgcggauggacguucu

SEQ ID NO: 975 - RNA, 80 nt, Human herpesvirus 5
cuacagcaguaguaauaauuuuaauguuuaacgccuacaacaguaguaauaauuuuaauguuuaacgccuacagcaguag

SEQ ID NO: 976 - RNA, 68 nt, Human herpesvirus 8
guugcuauggcugcuguucaacggacccgccucuuuuugucgggccgacuguugccuguacaagcagc

SEQ ID NO: 977 - RNA, 63 nt, Human herpesvirus 8
cugcuuacguuuuacuuuaauaaaguuaaguuuuaaguuuuaacaggaaaugcucuuaggcag

SEQ ID NO: 978 - RNA, 131 nt, Peanut chlorotic streak virus
aguuuuucuauaacucgagcucucgauaaaaaagcuuuucgaaaucucgagcucucgauaaaaaguuuuucuauaacucgagcucucgauaaaaaaguuuuucuauaacucgagcucucgauaaaaaagcu

SEQ ID NO: 979 - RNA, 76 nt, Human herpesvirus 5
aaacauuaaaauuuagcuacgccuacagcaguaauaauguuuaacgccuacagcaguaguaauaauuuuaauguuu

SEQ ID NO: 980 - RNA, 71 nt, Himetobi P virus
cuuuagauaaaguaguuuuuugauaucgaaugguaaaguauuuauaucaucuauacuauaaucaucuagag

SEQ ID NO: 981 - RNA, 61 nt, Himetobi P virus
uguaucguuaaaaucugaauaaaccguagcuaauagguauacguuaacagguuucgaaaca

SEQ ID NO: 982 - RNA, 70 nt, Macaca mulatta rhadinovirus
gacacgcucugggccgcgccgcuccucgucugccgugaucaagcggcgcggcgcggaccuuucaaguguu

SEQ ID NO: 983 - RNA, 104 nt, Macaca mulatta rhadinovirus
guggauccuuuaccgcucauauggcuucuguuuuacgguucccggucguucugucgggaaccagagugccuauaugaacgcaauuuugguaugaagggacccau

SEQ ID NO: 984 - RNA, 129 nt, Macaca mulatta rhadinovirus
gaguucggcgucgcgcgcgcccaggcucauggaguccucgcgccgcgaggcguagcgcgugagcaggucgcgcaguucgcgcacgcgauucucccaggucugguuaagcgugcgcagguccuggaucuc

SEQ ID NO: 985 - RNA, 77 nt, Macaca mulatta rhadinovirus
gcguggugaacagcagcuugucgcgcucauaagccagcgguucggccgccacguacaagcggaugugcuugccgcgc

SEQ ID NO: 986 - RNA, 87 nt, Human herpesvirus 5
ggcgaaaaaauaauuauuccggcccgccaaauucugcaucuugugaaacuacaaaaugcuuuccggcgaaaaaauaauuauuccgcc

SEQ ID NO: 987 - RNA, 108 nt, Himetobi P virus
uuaaaagggcauauaaguuuucaagaagaauaccuuuuauguaguugauagauuuaucugucauacguuuauagguuucuucaagaauaauuuagauaccccuuuugg

SEQ ID NO: 988 - RNA, 103 nt, Himetobi P virus
uuguauuuggcgcgaguaagccuaugaaaaacuuccuucuaugcuauauguguagaaauaggaagcagaaguaguagcagcgagaccgccauccguaauacaa

SEQ ID NO: 989 - RNA, 78 nt, Macaca mulatta rhadinovirus
uuccucgaauucacagggugccuuguuuuaucugccguauggacaggacgaauggaauugggcgcucacguuaaggaa

SEQ ID NO: 990 - RNA, 79 nt, Cocksfoot mottle virus
uccucaacagcagggaccaccaccaaaccgagggccugaucaaggaccucggccaggaggcaaucccagaggaggagga

SEQ ID NO: 991 - RNA, 70 nt, Bovine herpesvirus 4
ggcggccgggggcccgcggcgcgucaggcgccauaggugccgaccgaguccgcgguccaccauacccgcc

SEQ ID NO: 992 - RNA, 97 nt, Bovine herpesvirus 4
cggugcgucccggcggacaugcugggccuaccguggacuccauuuccgagacgacguggggggagcggugguugagcgcgccgccgggugaacgcug

SEQ ID NO: 993 - RNA, 90 nt, Murid herpesvirus 4
auauaagggcacuucuacugaugauaggcaaaauguaucauuugacccuaaacagcuacaaauguuuauuauaggcugugcucccuguau

SEQ ID NO: 994 - RNA, 67 nt, Macaca mulatta rhadinovirus
ugcgccuccagccgcuccgagcgcaccuucuugaagacgcguaccucgggcgcguuggcuacgcgca

SEQ ID NO: 995 - RNA, 88 nt, Cocksfoot mottle virus
gcguguccggugcuccccgauggagauuugaaggaggugagcuuuugcucccaucucaucucuaagggucgagcagagcuggagacgu

SEQ ID NO: 996 - RNA, 61 nt, Bovine herpesvirus 4
ggccuuauagaucuccggaucgaugcggacggggguaaugaucagggcgaucggaacggcc

SEQ ID NO: 997 - RNA, 73 nt, Murid herpesvirus 4
gcgcgcacaaggucauaacaauggcauaugcugguuuaaucagcuauuugucacaguaguagacaacacgcgu

SEQ ID NO: 998 - RNA, 65 nt, Avian infectious bronchitis virus
ggaagaacaaggauuauauggaacacgauuauuauaaaauaacaauaguuccugguuccucuucc

SEQ ID NO: 999 - RNA, 91 nt, Paramecium bursaria Chlorella virus 1
ucuugauugcagacaugaggaaugcugaaauauccgauucaucucuagaugagguagcucggucuuucaacaauuaugucggcgagauuga

SEQ ID NO: 1000 - RNA, 60 nt, Paramecium bursaria Chlorella virus 1
ucuggcacuucaacggcuucugggguggguuucauccuagaaggugauguuuuggccgga

SEQ ID NO: 1001 - RNA, 73 nt, Paramecium bursaria Chlorella virus 1
accgcccuuuacccagucugaucugaugcaacagaccccaaagacguguguguuccagaucaaagaggguggu

SEQ ID NO: 1002 - RNA, 66 nt, Paramecium bursaria Chlorella virus 1
ggucggaacucucccugggggcuuuuugccaccuccacuccccccaaggaugaaguugcguugacc

SEQ ID NO: 1003 - RNA, 80 nt, Macaca mulatta rhadinovirus
cgcucggcuuggucuucacguccagcagcgguaccagucccaccguuacgcaccaauccacguagagaccauagucgucg

SEQ ID NO: 1004 - RNA, 82 nt, Cocksfoot mottle virus
acccgggaugggucugucgaaagcuagccaagucgcgcuguuaugggaggauuuggcgcguacgaaccagacccacccgggu

SEQ ID NO: 1005 - RNA, 65 nt, Cocksfoot mottle virus
cguugauggcgaaggcagcuauaucgcgguuuuacugcuugaugaaugcuaccuuccaauuaacg

SEQ ID NO: 1006 - RNA, 90 nt, Cocksfoot mottle virus
ccuccagcuccaacucccgcauucgcugccuuauggcugagcucaucggcucgccuugguguaucgcaaugggagaugauucuguugagg

SEQ ID NO: 1007 - RNA, 121 nt, Cocksfoot mottle virus
gcccuaguaaccaaugcucagucacaauuugaccuaaugggagaugauauacaacgagcagaaaauuuccccagggucauuaacaaucuauacacuaugcugggucucaauauacaugggc

SEQ ID NO: 1008 - RNA, 116 nt, Bovine herpesvirus 4
ggggcagucggggaaguggcugucgagcacguagcccugcaccaagaucugcuuaaaguucgggugacggggguucgcgaagacgggcucgcggcggaccagauccccggagcucc

SEQ ID NO: 1009 - RNA, 61 nt, Bovine herpesvirus 4
uuuuuaccuuuugaagagcagcgcuuaaagcgggcacuagagcuguuagaagaaguagaaa

SEQ ID NO: 1010 - RNA, 123 nt, Murid herpesvirus 4
acuuguaaauauccagauuucuuaaagaugcaaaaugauguguauggugauuccugcuuuuuuuaugcaaggcgagagcaauguuaugcuagacauuuuuuuguucguggaggcaagacaggu

SEQ ID NO: 1011 - RNA, 60 nt, Avian infectious bronchitis virus
agaccaagaacaagaucgugaacacgaugauauagaaucaucgguuggcgugauugguuu

SEQ ID NO: 1012 - RNA, 72 nt, Paramecium bursaria Chlorella virus 1
gcggcgucggcguagaaccguuaaaggcacgggaaaucccaaucagccuuuugcgguuaccgcuggcgccgc

SEQ ID NO: 1013 - RNA, 74 nt, Paramecium bursaria Chlorella virus 1
ugccuuuucugagagguuucaaacgauuguuuaccuuuuguuuccaaauuuuugcaacuuuucucacuacggca

SEQ ID NO: 1014 - RNA, 109 nt, Paramecium bursaria Chlorella virus 1
uguuuugaacgggugggaugacagguucgcguaugauuucgcguuugguuucgauuuuaggcgugaauaguuucuucacguauaucuuuuuauccccugguuugacaua

SEQ ID NO: 1015 - RNA, 66 nt, Paramecium bursaria Chlorella virus 1
cgggauuuucuuuccaguuggcccgauaacguacuuacccccacgcgguccuguaagaaucucucg

SEQ ID NO: 1016 - RNA, 73 nt, Human herpesvirus 5
uccauuuuuauccucgcacuucuucgcucucaaagccgccuuuaaaguugaaaugaaaggauggaaacaugga

SEQ ID NO: 1017 - RNA, 106 nt, Human herpesvirus 5
gacuucacagaagagggcaaaacaaaaacauuguguguaguguuagauaacagucauauuuuagcuaccauagucuuauuuuuuuuucucuguuuuguuuuaaguc

SEQ ID NO: 1018 - RNA, 87 nt, Human herpesvirus 5
cagauauaucgauauccaauuaggcaagugaaacuucaauauguuuauugcagucuccaaauuuaguuuaguuugauauguugucug

SEQ ID NO: 1019 - RNA, 104 nt, Yaba-like disease virus
ccugccgaggaacgucaccaggugcgguugcagggggcagucgggaaaguggcugucgaggacguaucccugcaccaagaucuguuugaaguucggguggcggg

SEQ ID NO: 1020 - RNA, 62 nt, Monkeypox virus
gucuacuagagccuugcuguuaacgguaucugauacagcacccguagacaacgaggcgggac

SEQ ID NO: 1021 - RNA, 77 nt, Monkeypox virus
gacguaucagauuuuuacacccaaaccaacugcgugcgcagcguuuauuaaggacgcgggacugcuacugaggcguc

SEQ ID NO: 1022 - RNA, 71 nt, Human foamy virus
cuccaccucuggaauucaggaccugcagacucugagugagcuuguuggcccugaaaaugccggagagggag

SEQ ID NO: 1023 - RNA, 62 nt, Human foamy virus
auuucagucuaaaugcuaaaucaacagaaucaaguucuguaaauggaguauuuaucugagau

SEQ ID NO: 1024 - RNA, 76 nt, Human foamy virus
cagccacuuaugaauuaauucuucugauagcucauuucgguuauaauauccaauuaauaauucaaaaaagucucug

SEQ ID NO: 1025 - RNA, 83 nt, Human foamy virus
cauucaguuuuauaagaauuaucagauucuaacuugcugucaggcuguagacccauuugcuaauauuuuucaugguacugaug

SEQ ID NO: 1026 - RNA, 70 nt, Reston Ebola virus
gaugaagauuaauugcggaggaaucaggaauucaacuuuaguuccuuaaggccucguccgaaucuucauc

SEQ ID NO: 1027 - RNA, 100 nt, Reston Ebola virus
uuagcuucuaaggugauuauauuuuaguauuaaauuuugcuaauugcuugcuauaaaguugaaaugucuaaugcuuaaaugaacacuuuuuugaagcuga

SEQ ID NO: 1028 - RNA, 78 nt, Human foamy virus
gugugucuuaucaugcauauaaagaaauugaggacaaacauccucaacauauuaaacugcaggauuggauccccacac

SEQ ID NO: 1029 - RNA, 64 nt, Human foamy virus
aaguuaaaacuguugcuagaucuuuuaaugagauauuauaaucauuucuagguaguuccaauuu

SEQ ID NO: 1030 - RNA, 130 nt, Equine herpesvirus 4
gaggccacacccacauggaggccacacccacauggaggccacacccacauggaggccacacccacauggaggccacacccacauggaggccacacccacauggaggccacacccacauggaggccacacc

SEQ ID NO: 1031 - RNA, 72 nt, Swinepox virus
ggggaacuugggcaugggggcuacggucacguuguugaggaucagcggggcguagucugugcuauugucccu

SEQ ID NO: 1032 - RNA, 60 nt, Human herpesvirus 1
cccauuagaguucugacaaaucaaaccauguauuugggugguucgccugacuuucauggg

SEQ ID NO: 1033 - RNA, 73 nt, Human herpesvirus 1
gccgccucccccgagucuucggaaugucuuggcggccgucaagaacuguuaucccgaggcacggaugagcggc

SEQ ID NO: 1034 - RNA, 62 nt, Equine herpesvirus 4
agugcggguuacacagugcguguuacacaccggguauacacaauuguuccugcucguuaacu

SEQ ID NO: 1035 - RNA, 67 nt, Equine herpesvirus 4
uaagcuuuuccuuuggagcuccucccuaaaugccuuggcuauuuagccuuccgcuccugucugcuua

SEQ ID NO: 1036 - RNA, 75 nt, Equine herpesvirus 4
gcaggaacuucaugauggacuucuuggcgucgcuaccgcggucgugcuucuccaucaucuccaccaucuucuugc

SEQ ID NO: 1037 - RNA, 66 nt, Human herpesvirus 1
cuacaucugccuguguuacuuacccuuaugccauauuauuaggauuaccucaguuaauagauauag

SEQ ID NO: 1038 - RNA, 102 nt, Equine herpesvirus 4
agcuguuggccaccagccgguuguccuccacgggcagcgcgcggaacggcgucgccuccugcgccuugcgcaccgccucggucaccggcaggugguacagcu

SEQ ID NO: 1039 - RNA, 61 nt, Sesbania mosaic virus
agcucgcagcuuguuuggcgacuugagaguuaaacacucucguugcccugcugcugaggcu

SEQ ID NO: 1040 - RNA, 64 nt, Sesbania mosaic virus
auugauugagcaacugcagccgggaauaaugaagucuggaucuuacugcaccuccucaaccaau

SEQ ID NO: 1041 - RNA, 87 nt, Fowlpox virus
gccagguggcuagaaucccgcggacaacguagcugcuaacgacuacaggcagcuacgcucaccggagaaaauacgcccaagccuggc

SEQ ID NO: 1042 - RNA, 73 nt, Fowlpox virus
uacgauuuaaauauuauguaacucuguauuuauucgacacuauuaaucuaguacauacagaauuucuuucgua

SEQ ID NO: 1043 - RNA, 93 nt, Fowlpox virus
cucgcccucuuggucggcgucucauugccggguacucgaauccugcggauuacauagcuguuaaugaauacacacgccuacgcaccccgcgag

SEQ ID NO: 1044 - RNA, 77 nt, Sesbania mosaic virus
gccacgacuccugaaggcgaccuauacgagguagaguucugcucacacguuauuagggcuaacagguguugguuggc

SEQ ID NO: 1045 - RNA, 78 nt, Fowlpox virus
ugggugccuacgaccucauggacggccuagcuguuaacgaauagacacaccucggcgguccauaagaaaguaugccca

SEQ ID NO: 1046 - RNA, 123 nt, Fowlpox virus
gauuagauaucucuuaaccccaauacucaucuccuucaaugaaauuauagcuacgucuaucuacagacgcacgaauuacauaacuuaaacggaaagauagugcgguuacuagauauccccauc

SEQ ID NO: 1047 - RNA, 67 nt, Equine herpesvirus 2
gaacaagagccugcugucccugauguucggaccaaugaccuaccagcaggugacgcaccucagguuc

SEQ ID NO: 1048 - RNA, 78 nt, Equine herpesvirus 2
cgggcauggaucucucgcggggugcguaggcguguguauucauuaacagcuauguaauccgcaggauucgaguacccg

SEQ ID NO: 1049 - RNA, 77 nt, Equine herpesvirus 2
ggggcauacuuucucauggacccccgaguugugucuauucguuaacagcuaggccguccaugaggucguaggcaccc

SEQ ID NO: 1050 - RNA, 60 nt, Sulfolobus virus SIRV-2
uaguggaauuguacucccagugccuuuagcaaaugcuauauucaacuugcugucucacug

SEQ ID NO: 1051 - RNA, 80 nt, Sulfolobus virus SIRV-2
aaugaaucuggaauaguaucuacaacauuagcagcauuuauaaaacugucuuuuccuacuauaucuauuccaaauuuguu

SEQ ID NO: 1052 - RNA, 70 nt, Fowlpox virus
gcccgcccgucguuaccucaaugugauauuuccagacuucuucaagcuaggucacgcgccaagguucggc

SEQ ID NO: 1053 - RNA, 90 nt, Equine herpesvirus 2
gccccaacuccucgcccuaccucaagaucuauguggccacgaccgcuaucucgcccguguucaagccagaugugggagggcgagggcggc

SEQ ID NO: 1054 - RNA, 74 nt, Equine herpesvirus 2
aggauccaggacauuaucucuggcgucacggagacgggggaccgaguggaugucagggacggcaccuggaaccu

SEQ ID NO: 1055 - RNA, 89 nt, Equine herpesvirus 2
caguuugggcauacuuucuuauggaccgccgaggugugucuauucguuaacagcuaggccguccaugaggucguaggcacccaguaaug

SEQ ID NO: 1056 - RNA, 87 nt, Equine herpesvirus 2
gccaggcuugggcguauuuucuccggugagcguagcugccuguagucguuagcagcuacguuguccgcgggauucuagccaccuggc

SEQ ID NO: 1057 - RNA, 70 nt, Sulfolobus virus SIRV-2
auagaacuugauuuauuuguugauuugcaguuccaauaaagcccgcgauauaaauuggaucuuguucugu

SEQ ID NO: 1058 - RNA, 87 nt, Sulfolobus virus SIRV-2
auaauucauauaauaaauauaauguauauaguuuguucucauuuagaucauuuaaaauuaaaauaugucuuauuguuuaugaauuau

SEQ ID NO: 1059 - RNA, 118 nt, Sulfolobus virus SIRV-2
auuguuaccugcugcaagugugacgccagcccuagaaagcuuguuuucaccuacucacuucccuuguaugucugaugaaagcauugcuucuacuucucauguuccgcuagauaacaau

SEQ ID NO: 1060 - RNA, 69 nt, Sulfolobus virus SIRV-2
ugggcuagcuaaaagugaagaaauugaaguauaaguuacacucauauauuuuuaauaaguaacugccca

SEQ ID NO: 1061 - RNA, 68 nt, Sulfolobus virus SIRV-2
caaggcggccaagaggcagaccuaagggcucuaaaacuaaaaagcgcccuacaugcucuccugcuuug

SEQ ID NO: 1062 - RNA, 108 nt, Bovine herpesvirus 4
guguugcuaauagaauuucaucgaaugacugaauguuguguccgaugauguaaaauucuaugaaaauugguuuaacuuucagacucauuaugagguuaguauguucac

SEQ ID NO: 1063 - RNA, 78 nt, Bovine herpesvirus 4
gauaaggaagaguuuuuuuguguuuucauuuucuccuauagguugaaaugguauaguuucccagaauuuucuuguguc

SEQ ID NO: 1064 - RNA, 107 nt, Myxoma virus
gacacaugguggaguuuauggaguggucucaggagcugucgagcaguaaaacccugugucugcuuuuaccgaaaauugcccgagaccucaacgucccuccguugguc

SEQ ID NO: 1065 - RNA, 65 nt, Human herpesvirus 5
gcacggacucucgucguagcacguucaaaucgguuuauuaaagcccucaugcucagacuccgugu

SEQ ID NO: 1066 - RNA, 73 nt, Ateline herpesvirus 3
agguaacccagaacugaaaaaaagauauagugaaggacuagauuuagcaauuucaaugucugaaaauauaccu

SEQ ID NO: 1067 - RNA, 124 nt, Bovine herpesvirus 4
auuucucgguuuucugguguuaaaauuaauuuugugaaguaaucugugagugcaaauaggauguuauuucuuaauuuucugaacuccguacuaaugaaguuuuuaacuuuagaaaaccagaagu

SEQ ID NO: 1068 - RNA, 63 nt, Myxoma virus
guugucacuuaucgauacguucgucaacgugauacccgccacgaacauaucgucccucgcgac

SEQ ID NO: 1069 - RNA, 117 nt, Myxoma virus
uaaaccaauggauguaguucagauaacacgauuguggaaguuucgccuuauacggacgcgugcauagggacaacaccacuaacuuauccguacauacgucaaacacuaauugguuua

SEQ ID NO: 1070 - RNA, 81 nt, Myxoma virus
gaggaguuaauuuuucuacgguggcguguuuaaacugcucaaaguauaacaucuuuccguaagaaaauuguuuauauccuc

SEQ ID NO: 1071 - RNA, 106 nt, Equine herpesvirus 2
cuuuuuuuaccaaacacaauuuuauuuuuaaaauguuuuacggguuuuaaaacagauucccuauuuaacaguauaucuucaauagaauuuccacuuacgaaaaaag

SEQ ID NO: 1072 - RNA, 83 nt, Human herpesvirus 5
cuguaccccaccccccuucuaaauaaauuuccgaucccuggagguuuccggaguauuugucccaggagcgggguccuaugcag

SEQ ID NO: 1073 - RNA, 65 nt, Ictalurid herpesvirus 1
uucgugagcucuuuuuacgacuacggggcuauggagcccgguaguuacuuggacaauaucaugag

SEQ ID NO: 1074 - RNA, 90 nt, Ictalurid herpesvirus 1
auugucaccgucgauguguugcuggugucgacggucgugaacuugacaccgggccguuuuauuaaagauagcacaucguuuauugacagu

SEQ ID NO: 1075 - RNA, 87 nt, Ictalurid herpesvirus 1
ucgaugauucuuuguucgcaccagguccucagcgccgcuuaaauucggccgaggaggcucaauuggagcgugacaucgaaucuuuga

SEQ ID NO: 1076 - RNA, 80 nt, Ictalurid herpesvirus 1
ccccccgauucccacaugcguagccguucuagcuccgucgcuagcgaucuugggcuauugaaccuaucugggacgggggg

SEQ ID NO: 1077 - RNA, 81 nt, Ateline herpesvirus 3
cguaauauagauguuugucuaauuuaguaaaaucaagagaauaaauuaauccuuuucuuuuuaauacccacaucauauucg

SEQ ID NO: 1078 - RNA, 60 nt, Ateline herpesvirus 3
aaagcuagaaaccgugccuccauauuuaguauaugauacagaagaauggaaauuagcuuu

SEQ ID NO: 1079 - RNA, 71 nt, Ateline herpesvirus 3
acagaauaaaagaagcagucgaggaguuaaagcaaauugauuuaccgguugcccaucugucuaauuucugu

SEQ ID NO: 1080 - RNA, 66 nt, Ateline herpesvirus 3
uuucauuucuaaaauaauauucguuuucuaauucuuuuauauggucauuaauuuuagaaaucgaaa

SEQ ID NO: 1081 - RNA, 61 nt, Ictalurid herpesvirus 1
uuguaauauagacauauaaaucucuucauuaagugauuguaacauaguaucuauauuauaa

SEQ ID NO: 1082 - RNA, 63 nt, Ictalurid herpesvirus 1
aaucuauuagaugauauauuucguauaaacacauaauggauaaaauauuaucuaauguagauu

SEQ ID NO: 1083 - RNA, 68 nt, Paramecium bursaria Chlorella virus 1
guaggugcuuuucagacauccggugcagauuaugcagaaaugauggaaugggaagauaagaauccuac

SEQ ID NO: 1084 - RNA, 79 nt, Rat cytomegalovirus
gcgucuccggucccgaucgaccggucgccccgucgcauuguucgacgcgggcgagcgugcgcgggauccccggcgacgc

SEQ ID NO: 1085 - RNA, 81 nt, Rat cytomegalovirus
ucccgggcgcugacgccgccgacgacaucagacgagcggaucuccggucguucuuucgucgggagaagaagcgagccggga

SEQ ID NO: 1086 - RNA, 63 nt, Monkeypox virus
cggaggaggcagacagacggcaggcggccggccgggcaccggcugcaacccucuccucuucug

SEQ ID NO: 1087 - RNA, 79 nt, Monkeypox virus
ucgcgggccgcucgcuaugccgacugacguugacguuaauauauaacgacgucgucgacgacgcggguucugcucccga

SEQ ID NO: 1088 - RNA, 86 nt, Monkeypox virus
cggcuccuccgccucgggcgacgggggcucggagaugaccggcugugucugacacuccuccccuuccucaggcggcccgggcgccg

SEQ ID NO: 1089 - RNA, 104 nt, Ectromelia virus
uuaaaaauaugguuucagauugucuauuucuggcuuuuaaaaauaaaaaccuuucguuuccuuuacuuucgaaccaguuuaugcacuuuauuuccauuuuuuaa

SEQ ID NO: 1090 - RNA, 67 nt, Cowpox virus
guagcgagucuuuuaaaguauacuucguaaaauauucuuucaguagauuuuaauuuaaaacuccuau

SEQ ID NO: 1091 - RNA, 127 nt, Cowpox virus
agacguauuagcggaucuaauggaauccaauugauugacuaucuuuugaaaauauacauuuuuaugauccgauacuuguaagaauauagcaacaaugauaauuccaucaucguguuuuuuugccucu

SEQ ID NO: 1092 - RNA, 128 nt, Monkeypox virus
ggggguggucaacgcccuagagagcgugaccgucuacccggccuacgacugcgugcucuccgaucuggaggccgccaugugccugcuggccgccuacgggcacgcgcucugggacggccgcgaccccc

SEQ ID NO: 1093 - RNA, 63 nt, Monkeypox virus
ggccucgggggcaacgggggcggcgcucugcucaugcagcucagccgcgucaaccccguggcc

SEQ ID NO: 1094 - RNA, 98 nt, Cowpox virus
gaaauauaccguaaaucaaaguuguuuccauuaaaaguuaccacauaaucgaaugucaauuccaaaagcuuuuuugcgacuuuuagcaugguaauuuc

SEQ ID NO: 1095 - RNA, 67 nt, Camelpox virus
gugcgcuuuguacucagcuugucuucgaaacgauucuccgauguuguugguugacugcgcagcucac

SEQ ID NO: 1096 - RNA, 91 nt, Camelpox virus
cuuguaaacuucaucguuuauuguuauauaauuuccuguagauaaaacuuuagaaaauagcaaugauuuucccuuuacguccguuaacgag

SEQ ID NO: 1097 - RNA, 75 nt, Variola virus
cguuguggauugucugaccuuugaaaaaauuuuuguguccguguagcauuucaauaaaagucauuaucugcuccg

SEQ ID NO: 1098 - RNA, 69 nt, Alcelaphine herpesvirus 1
gggcucucugccgugcgaggcuccucacagacacacagcaagaaagaagcgccgcgcagcagauagccc

SEQ ID NO: 1099 - RNA, 114 nt, Ectromelia virus
guggcgagucuuuuaaaguauacuucguaaaauauucguucaguagauuuuaauuuaaaacuccuaucuauaauucuuucauacguuuuuauauuuacuaauuuuuuuugccau

SEQ ID NO: 1100 - RNA, 85 nt, Cowpox virus
ccgcccgcgcggcaucucauuagcgcccggcgcgggcggcuuccgcuuccgcccgcgaugcuaaugagacccucgucgcgggcgg

SEQ ID NO: 1101 - RNA, 66 nt, Cowpox virus
guuucuauauuaauaggagauaguuguugagucauaguaaaaaugaaaugauaacuguuuagaaau

SEQ ID NO: 1102 - RNA, 62 nt, Camelpox virus
acguuaaagcuaaauugcuuauggugggugggucuucuuacuugcccggucugcugucacgu

SEQ ID NO: 1103 - RNA, 73 nt, Alcelaphine herpesvirus 1
gugcagagaccgccugggugugacuguuuuuaggccuaacaaaggcacagaaacacccgugcggucucuguau

SEQ ID NO: 1104 - RNA, 81 nt, Alcelaphine herpesvirus 1
gagacaagcuuucaauaucugaaucuaaaguaaagucauguuuagaaguuucggauaaauuuauuaaugaaugcaugucuu

SEQ ID NO: 1105 - RNA, 101 nt, Alcelaphine herpesvirus 1
uauuuucaaauagccgauuugcaguuuucaguguuucgauuucguccaguugugauugaaucuguuccuccaugcauuuuaugauuuguuuuuugaagaua

SEQ ID NO: 1106 - RNA, 66 nt, Alcelaphine herpesvirus 1
guauucagcaauugacacauuuuacggugccuguguagguuuucguguuuauucaauucugaguau

SEQ ID NO: 1107 - RNA, 88 nt, Ectromelia virus
augauaaaauuucaacacauacuuguacagaugacauauuuccaccugauaacauuugcaaaagccuuguuuuguauauucuuaucau

SEQ ID NO: 1108 - RNA, 61 nt, Ectromelia virus
aaauggauuuauagguuuuguagcuaauaauacuuuuccauuuucuaccuuugauccauuu

SEQ ID NO: 1109 - RNA, 130 nt, Ectromelia virus
auuuucucaucuaauaauaaguuuaauagagguccuuuuauuaauguacuagcucuguauucaaacaccauggauuguggcaauauauaaguaaaagcuccagcaucuauuuuuguuucaauuccguagu

SEQ ID NO: 1110 - RNA, 97 nt, Cowpox virus
uucuuguuuguuuauuucugcuucuaaucuauuauuugcaacaaauacagauacuaauguuucaggggauaaguuuccgaauaaacauacauuaggg

SEQ ID NO: 1111 - RNA, 72 nt, Camelpox virus
uaucuuuguuaauuagcguaaauuuuaacucuuuuccaaauaaguuuauguaacaacaacuaacaugagaua

SEQ ID NO: 1112 - RNA, 129 nt, Variola virus
cacuaugucguggauuaguuuagaugacacuuguuguaggagauuguauaaguucggggccguaugggugguucucaugaacggaacgauuccuacaguacagauccagucuacauaucuguuauagug

SEQ ID NO: 1113 - RNA, 97 nt, Murid herpesvirus 4
gaacgucucucucuccugugucgaucgcagagcguuuucggaacuguccucgguucagcauaaguuuauuuuggucuauuauagagggggugauuuc

SEQ ID NO: 1114 - RNA, 94 nt, Camelpox virus
gcaccgguguuaucuguucagucccugccaacuacaauuguuugcaaaggucuuuuaccgaaaguugugucaaucugaguggcuaccccugugu

SEQ ID NO: 1115 - RNA, 72 nt, Variola virus
ccacgucguugguuucuuuuaucaucuucuuguacuugaggcguuccguuagaaacguuuucaacaacuugg

SEQ ID NO: 1116 - RNA, 68 nt, Variola virus
cgaagaaugucgugccguuguuguuguuuacgugauacgugguguucgauaccccgccgacuccuuug

SEQ ID NO: 1117 - RNA, 95 nt, Murid herpesvirus 4
gaaaggcauguggguuaaugauuaaaucagguacuaugccaucuuuagugaaaggcauguuuucuugggcauaaaucauaccacagguaccuuuu

SEQ ID NO: 1118 - RNA, 128 nt, Murid herpesvirus 4
aguuuagaugacacuuguuguagaagauuguauaaguucggggccguaggggugguucucaugaacggaacgauuccuacgguacagauccagucuacauaucuguuauagugacuguugucuaugcu

SEQ ID NO: 1119 - RNA, 130 nt, Sulfolobus virus SIRV-1
ugcuuauacucuaagaguaucgccaccgacgacgacgacggcagucgcugcccggcgaagccgagccgccgcgaagcggcgagcgacugccgucgucgucgucgguggcgauacucuuagaguauaagca

SEQ ID NO: 1120 - RNA, 70 nt, Sulfolobus virus SIRV-1
auucauaguuuuuaaaauuuuuacauuugagaaaucauauucaaauggaaaauuuguuuuaucuaagaau

SEQ ID NO: 1121 - RNA, 81 nt, Sulfolobus virus SIRV-1
uaccagaguuucgugaugaugauuuguuaugugauccuaaaaaucgcgauuacauacaagcugcaugcgaugacuuuggua

SEQ ID NO: 1122 - RNA, 72 nt, Murid herpesvirus 4
aggacaauuuuugaguucuauuucaaugucaucacauuuucgacaauauucaaaaucaucgcuuauuguuuu

SEQ ID NO: 1123 - RNA, 78 nt, Murid herpesvirus 4
gguuguauuaaaggcuuaauuucagcuuuaucaauaccuaguguaaaucuaacagauaaugcuguauuuaauacaacu

SEQ ID NO: 1124 - RNA, 101 nt, Rat cytomegalovirus
acuuucauccugaucaccuguauccucucucuacucuacgugaucggugacgguaacgagauugaagagacagacaacgggacaggugagacaaugaaggu

SEQ ID NO: 1125 - RNA, 64 nt, Rat cytomegalovirus
gagagguguaaaagauauauggcucgaucagcugauacaccgccaccguaaaaccacgccucuc

SEQ ID NO: 1126 - RNA, 80 nt, Rat cytomegalovirus
ccgccauuuuaaguagcugacgucaaggauugacguaaagguuaaaggucauccucggcggaagcuacacaaaauggugg

SEQ ID NO: 1127 - RNA, 81 nt, Rat cytomegalovirus
gugcguacgucacaagucacguggaggggacccgcuguaacccggaaguaggccccgucacgugacuuaccacguguguac

SEQ ID NO: 1128 - RNA, 85 nt, Sulfolobus virus SIRV-1
uuggaucuuguucuguuaguacugguuguccagauacguaaacuucuuucuggaaaaauccagcuaaugcagauauauuauucgg

SEQ ID NO: 1129 - RNA, 66 nt, Sulfolobus virus SIRV-1
accuucugagcugauggucuacugaccugaugaugaagaggauccgaagaccuuggagcugaaggu

SEQ ID NO: 1130 - RNA, 131 nt, Rat cytomegalovirus
ccggcggacgcaccucgagagggccccgggcccgacggccgcggcgacgaugaggucgcagaucucgaccccggaggcgccguagggcgacucggaccgggccgcccgaucgaagaugccguuccucccgg

SEQ ID NO: 1131 - RNA, 131 nt, Sulfolobus virus SIRV-1
cccgggcuccccguuccccgagggucccgggcuccccguuccccgagggucccgggcuccccguuccccgagggucccgggcuccccguuccccgagggucccgggcuccccguuccccgagggucccggg

SEQ ID NO: 1132 - RNA, 66 nt, Human adenovirus C
ggccuagagaaggagagggagcucuaucuaaagaagauccgcuccauggagucucagcugcaggcc

SEQ ID NO: 1133 - RNA, 87 nt, Sulfolobus virus SIRV-1
gguacuuucuuugccaaaaaaaaaguugauugaagucauuuucacaagaauugaucagaaaguuuuuagcgugugucaaagugugcc

SEQ ID NO: 1134 - RNA, 65 nt, Sulfolobus virus SIRV-1
uugauaacaguugaaagccaaauauuugccaaaaucgguuucaauuugcguuucgcuguugccaa

SEQ ID NO: 1135 - RNA, 65 nt, Rat cytomegalovirus
gcagcauauggauauguagaauuuugugcaaaaaguacaggagaccaaaacauacacaugaaugc

SEQ ID NO: 1136 - RNA, 74 nt, Human adenovirus C
guuggaaacuuacucgccaccccccacccgcugggaaagccggcaucaucgagggugggcacaauaguucuagc

SEQ ID NO: 1137 - RNA, 69 nt, Human adenovirus C
ccgguggaacucgugacagaugucuacgccacccuaggcaucguggagaucaucgacgagcucuaccgg

SEQ ID NO: 1138 - RNA, 74 nt, Human adenovirus C
aguuugccaugcuacaguuugcauacgaucacauccaaucccacgucaaugaaaugcuaaguagaauagcaacu

SEQ ID NO: 1139 - RNA, 101 nt, Human adenovirus C
gcgcaagcugaucgagccgugcgcccucaaucagaagcgcuacuuuaaguuuggcaaagaguacguuuacuacgagaacuacacguucguccgcaaagugc

SEQ ID NO: 1140 - RNA, 118 nt, Equine herpesvirus 2
aaauuauuuauaaaauuugaaaagaauguagaaacuauaacuuagaauuaaauauuacaauauuauauaaauauauagauuuuuaugauccuuuauaguauaauuuuguaaauaauuu

SEQ ID NO: 1141 - RNA, 121 nt, Equine herpesvirus 2
aacacgugcccacacuuggcaagucucuugcggaaaagcuauuuucaaauacauuauuuaauuacaaacguauuugaaacauagcuuuuccaacaagcaacuagcaauuuuugcaccuguu

SEQ ID NO: 1142 - RNA, 125 nt, Equine herpesvirus 2
aaccaugcugaugaauaugaacucaggagcucucggaaggacacuagacccacaggaaaaauauauuacaaccggugaggagugccuuucucgauugagcuacugagucaaaaaaacgcaugguu

SEQ ID NO: 1143 - RNA, 91 nt, Equine herpesvirus 2
gguucucuuguagcccuccaacauuggaagccagcacugagaaguguuuggguuaaagucccugauguagaggaggucgcacucgacggcc

SEQ ID NO: 1144 - RNA, 67 nt, African swine fever virus
uauuuuaauggaacuggaucauuaggaccucucccgcccauuuaaauuuuuaguuucuacaauaaua

SEQ ID NO: 1145 - RNA, 106 nt, Rice yellow stunt virus
uuguguccauauguguacccgagaaaguaauuuaauguuguagaaccuaagagcuauuaauaaaaacccaauaccucaacauucucaacagaaaaccacggcacag

SEQ ID NO: 1146 - RNA, 66 nt, Ryegrass mottle virus
cuucgagaaaagcgcucuucgaguacucccucggcagacuauucuguugcgucucccauagugaag

SEQ ID NO: 1147 - RNA, 67 nt, Fowl adenovirus D
cggguugacaaaaucgaacgguguuuaagcuuugaccggugagcuccgcgaagacucuguaagccug

SEQ ID NO: 1148 - RNA, 131 nt, Human herpesvirus 5
cgugagaggcugacagcuuacgaagcaaaaucacaaagaaaauacacaugcagcaccuagauauccaguuuaaccccguauaucacaagucucugugucaauauuuuuugucuaguuuuuuuuuccuccug

SEQ ID NO: 1149 - RNA, 80 nt, Human herpesvirus 5
cccggacagcgugcaagucucgacuaaggagcgggcgcgagcgagcgaaaguuuuauagagagcacacacgacgaccggg

SEQ ID NO: 1150 - RNA, 60 nt, Cactus virus X
guugucaagggcugugaacacauuggcaaucucgccgacgucauuacggcacuuaauaac

SEQ ID NO: 1151 - RNA, 106 nt, Swinepox virus
aacuaauuaauuauuuaauguguuuuauauuauauuuuuauauauuuuaaugauuaauucauaaaaaauguuauagagauauaagcguaugaauauuuuuuuaguu

SEQ ID NO: 1152 - RNA, 86 nt, Equine herpesvirus 1
gguuguagcgaaauguccccaacagcggccagucaacccccuuaagcgacugaugcguggggcaugccgccgcucaaacuuaaacc

SEQ ID NO: 1153 - RNA, 85 nt, Lymphocystis disease virus 1
uacauuucuaaauauaaauuaaauuuguuaugaucugauaagcgaguaucuugaucaaauugucgugcuaaaauuuuuaaacgua

SEQ ID NO: 1154 - RNA, 69 nt, Human herpesvirus 1
cguguuuauucaagggagugggauaggguucgacgguucgaaacuuaacacaccaaauaaucgagcgcg

SEQ ID NO: 1155 - RNA, 110 nt, Bovine herpesvirus 1
ccccccucaccgguguuaauacgcacgacaauaaaugagcugacacacgcucgcacauacacaguuuguuugccguuuauuuguuuauuggggacagcgacggggcgggg

SEQ ID NO: 1156 - RNA, 90 nt, Paramecium bursaria Chlorella virus 1
uuuuuaaaaauuugaauuuauguucgucauuugacccagguaagauaaaugacaaaguaagguaauauaaauuuaaggucaaucuaaaaa

SEQ ID NO: 1157 - RNA, 60 nt, Rat cytomegalovirus
ccgcucgaucucggcucugucggucgccguccuucgcgaucgcgguccguucgggagcgg

SEQ ID NO: 1158 - RNA, 62 nt, Paramecium bursaria Chlorella virus 1
ucguguugauaugauaaaugacaaaugauacgcuguaucaacaucucaaaagauuaauacga

SEQ ID NO: 1159 - RNA, 117 nt, African swine fever virus
gaaauauccuuagaagcaugucuuucggcagagccauuaccgguagcaaaaaagcaacauugaguauauuauaugccuuagccugcucauaagcguccuuuuuuuucaugguauuuu

SEQ ID NO: 1160 - RNA, 60 nt, Equine herpesvirus 1
uacccguaaauaagcacgcuuuaaaucaaacaacaacagguuguauggcuguaaagggua

SEQ ID NO: 1161 - RNA, 73 nt, Respiratory syncytial virus
cuccauaguucaaauggagccugaaaauuauaguaauuuaaaauuaaggagagacauaagaugaaagaugggg

SEQ ID NO: 1162 - RNA, 87 nt, Vaccinia virus
uugauuuucuuucuaauacuauauauuucucucgaagaaguucuugcacaucaucugggaauaaaauacuacuguugaguaaaucag

SEQ ID NO: 1163 - RNA, 89 nt, Rat cytomegalovirus
ucuccggucuccauaacucgcucucgccuggagcuuuuauauacuaacgugugaugagcaccuccccagggaagaugaugacgccgaga

SEQ ID NO: 1164 - RNA, 71 nt, Tupaia herpesvirus
ggcggcggggcagcggcgcgggcgacgggagcgagagggcgagcgaccgguccgcgcucgggccccccgcc

SEQ ID NO: 1165 - RNA, 90 nt, Equine herpesvirus 4
ggguuguaaguuuuaaucaguagguguacccaaaaaggccaagagugcggaucuccugggugucaggauuuuuauagagacuuacaagcc

SEQ ID NO: 1166 - RNA, 66 nt, Fowl adenovirus D
cuuuuggccccucugggucgcgaggaaguggcggacgccuuaagcucgugccggacgggccgacgg

SEQ ID NO: 1167 - RNA, 74 nt, Zucchini yellow mosaic virus
guguuuacaaacaagcaaucuauaauucgcacagcaucaagaauuucugcaaucacuuuguuuauuuuagacac

SEQ ID NO: 1168 - RNA, 96 nt, Gallid herpesvirus 3
gcgacgggccguuacguuucaccguguugcgucuccgacacugaucaagcuguucacggcaaugacauucuuauacgggaacaguagcgcccacgc

SEQ ID NO: 1169 - RNA, 87 nt, African swine fever virus
uaacaugcaaaaaaaauauguuuaaacuuauuuuaagcuagcacuuauuuaaaagcuuguuuuaaacacguuuuaaauuguauguua

SEQ ID NO: 1170 - RNA, 76 nt, Cowpox virus
cauuaaauuaucauuuuugaauguauuuauaccagaucaaaaacuuguacaauuauuaauaaaaaauaauuuagug

SEQ ID NO: 1171 - RNA, 110 nt, Bovine herpesvirus 1
gcuuaaguacgggccgcggcgaucgcgggcgucgaucgcgugcggcuuggaguccggcugccguuucugccgcaagcgcgaucccgcgacacgacccgacguucuugggc

SEQ ID NO: 1172 - RNA, 70 nt, Bovine herpesvirus 1
ggcgacggccgcgcuuacgcggcgcuggguccgcccacaucagccaccacgcccgcgcgcccgccccgcc

SEQ ID NO: 1173 - RNA, 89 nt, Okra enation virus
uuggucaaucgguacucagaugcuucucuccaauauaucgguacucaauauauagugaguaccaaauggcauuuugguaaaaaucccaa

SEQ ID NO: 1174 - RNA, 85 nt, Myxoma virus
ggaaacgcgccagacuccggaacuaugaaggauuuaucacuguauacagacuccgacguacgaaggauaaucacgacguaacucc

SEQ ID NO: 1175 - RNA, 116 nt, Paramecium bursaria Chlorella virus 1
ucguuuuuuuuaacccaguuuuacguauaauaugauaacauuuguugauauaaugaaaugacguauauacaaacuuauaucaaugcuuauuguauaaaugguuaaauauacaauga

SEQ ID NO: 1176 - RNA, 67 nt, Wheat streak mosaic virus
ucugacaacgaacaaaacgaacucaaagcacccacaagcucuaguucaacaaaguucaucacgcaga

SEQ ID NO: 1177 - RNA, 81 nt, Sendai virus
ggucuguacauaauaagaaaaacuuagggugaaaguuagguugcucaccacuauagcuuucaccucaaguaaguacagauc

SEQ ID NO: 1178 - RNA, 114 nt, Fowl adenovirus D
gagagaaaagaaaaaaaccgcgggugccggugcugucuaaaaggccguuuucaauaaaaauuuuuauagaaccgcugucgccgccgucguuugccguuugucgucgucgucguc

SEQ ID NO: 1179 - RNA, 104 nt, Paramecium bursaria Chlorella virus 1
uuuguuuauuuuuaugauguaacauauauuaauguuuacacagagcgcaauaacguccuguguaauuauaaauucucauugacaucauauuuuucuauuacaaa

SEQ ID NO: 1180 - RNA, 103 nt, Infectious spleen and kidney necrosis virus
ucuagucaagugcuuuuauuuugucauaugcugccacaggugggcuaccucaacccaugaccacagagaccaacaaauaaaugaaucgccggcacuuuaaaga

SEQ ID NO: 1181 - RNA, 86 nt, Rat cytomegalovirus
cgucgccuccuggaacucccggauauaccucgccccguagaucuuauauguuaccugggugggauuuccgcgccucgagcgugacg

SEQ ID NO: 1182 - RNA, 66 nt, Human herpesvirus 4
ggggggcagugauaagucaugacaauuuuagaugagguagaaauuuugcauauuuucagacccacc

SEQ ID NO: 1183 - RNA, 92 nt, Chimpanzee cytomegalovirus
cggauuaucuaugugcauggaguguccuacauaucaaaauaaaugguuuuacugaaggauacaauuguucauguuguuucuugguaaauuug

SEQ ID NO: 1184 - RNA, 95 nt, Molluscum contagiosum virus
aggcaagauucacucugcaagacgugugaaguagcgaacgcucacgcgaagagcuauuuuuucaguuuuuguucuuucucucguggaucgcuccu

SEQ ID NO: 1185 - RNA, 98 nt, Equine herpesvirus 4
acagauuugggguggagacggcgugggcgauacuguauaaaguuguacuacuuaccagcccagucagugugcuguagugccaccaccuguaaagcugu

SEQ ID NO: 1186 - RNA, 62 nt, Amsacta moorei entomopoxvirus
uuauugauaaggauuaaugauuauuuaacaaauuaaauaauuauauuauagcuuaucaauaa

SEQ ID NO: 1187 - RNA, 64 nt, Rat cytomegalovirus
ucggggggaggagaggaaaccggggacucaccggcggccucggaccgagccucgcucccgccgg

SEQ ID NO: 1188 - RNA, 76 nt, African swine fever virus
auuccacguucucauaaaaacaggcacuuaaaaagagcaccagguuuaguguagucuuauuauagaauguaggaau

SEQ ID NO: 1189 - RNA, 70 nt, Theilovirus
uccucucgaucggaucgcaacgcuuuacccuagaagccacuaggguguacgcggccguucugacguugga

SEQ ID NO: 1190 - RNA, 76 nt, Sulfolobus virus SIRV-2
augcauuauauauuuuauaugaauuauaguugcaagaguuacacguaaaacaacucauauacauuauauaauguau

SEQ ID NO: 1191 - RNA, 71 nt, Meleagrid herpesvirus 1
aggcuguccggaaaucuaaguuaaugaauaaaguagaugguuaauacucauugcuuagaauuggacuacuu

SEQ ID NO: 1192 - RNA, 75 nt, Human parainfluenza virus 1 strain Washington/1964
uaaauaguauuuuaggguuaaaguaauacuuuaaagggacaagucacagacauuugaucuuaguauaaauuuuua

SEQ ID NO: 1193 - RNA, 108 nt, Cucumber mosaic virus
aaucuuaccacugugugugugcgugugugugugucgagucguguuguccgcacauuugagucgugcuguccgcacauauuuuaucuuuuggguacaguguguuagauu

SEQ ID NO: 1194 - RNA, 109 nt, Pepper ringspot virus
uaguauugaaaagguguuuguauuuauguauauuugguuucuucaaguagcccuauaggcgcuauuugaugcauauugaauaucacauauuugcacagcauucaaacug

SEQ ID NO: 1195 - RNA, 117 nt, Paramecium bursaria Chlorella virus 1
uuuuguucauacguauagucuucuuaaguuuuuaauauuuguuuaucgauacgcuaacacccgucucgaaacgauguuauuuuuaauuuaagaaacuuuaaaauaaaaauaacaaaa

SEQ ID NO: 1196 - RNA, 73 nt, Chimpanzee cytomegalovirus
cugaugucccguccgguuuuuaacacggucccgggcccgugacgacauuaaauaggaagggacgggguggggg

SEQ ID NO: 1197 - RNA, 89 nt, Rice black streaked dwarf virus
gacuguuugugcauguguuuuggaaggauguuggaaacugucacgugagcucuccccuagccuuuugacauaccguguuguggcggcuc

SEQ ID NO: 1198 - RNA, 114 nt, Human herpesvirus 5
cgauaagucgcguguaggcgacuggcuacaucaaccggauaucugcggggauuuaaaaagacgacccguugucauccggcuuagaccaaaccguccuuuuaucaucuuccgucg

SEQ ID NO: 1199 - RNA, 92 nt, Cercopithecine herpesvirus 7
uauauggugcacuauguaaacgacauuaugggcgugcuuuuaaaugccgugucuguucacacuucauuaaaauauuuggugcguuucaugua

SEQ ID NO: 1200 - RNA, 72 nt, Meleagrid herpesvirus 1
ccccaugggcucucuucuagaaacgaaaauggugcucgaaacaaaaacuaggcacuuggugagagaaagggg

SEQ ID NO: 1201 - RNA, 88 nt, Paramecium bursaria Chlorella virus 1
aguuuguauauuuaagaaugaaaauaaaauauuuucgaagcgauuauaaaguucaauuugucauuugucauuuuuguguauaucaacu

SEQ ID NO: 1202 - RNA, 69 nt, Human parainfluenza virus 3
uacaauaaagauauaucuuaaccuuuaucuuugagcccaaggauagacaaaaaguaagaaaaacaugua

SEQ ID NO: 1203 - RNA, 119 nt, Equine herpesvirus 2
ucuccagacccggguuucaccuugcccucgcucucuccgucuaucuguacuuaagaaagugauccuuuugugugugggccgagagaaggggaaagugugugguuggggggugacagaga

SEQ ID NO: 1204 - RNA, 83 nt, Melanoplus sanguinipes entomopoxvirus
acaucucaauaaaaaaauguaauauaauauuuauaucauuuugugacauuauugaauuaucauuuauauuuuuuuuagcaugu

SEQ ID NO: 1205 - RNA, 116 nt, Rat cytomegalovirus
ccgucccccgccccgccgcccuccccgucgccgccuccccgcccucucuaccuguccgcggguaccgaggaggccggggacgcccccggggaagaccgagccgacggaggagacgg

SEQ ID NO: 1206 - RNA, 91 nt, Molluscum contagiosum virus
gccacagggugucgcucacguagucgccgcgcgccagcagcagcguuccgcggcgcgcgcguggcgccucgucggcgcgcgccugcacggc

SEQ ID NO: 1207 - RNA, 71 nt, Caprine arthritis-encephalitis virus
gauacauggcaauggacaagcaucagaguaccugcggaaauacugcaaagauggcuugcuaugcuuagguc

SEQ ID NO: 1208 - RNA, 67 nt, Equine arteritis virus
caggagcgcgccacccuuucgucgaacguacaacgguucuucaugauugggcaugguucacucacug

SEQ ID NO: 1209 - RNA, 74 nt, Human herpesvirus 6
uugcauacguucaucauuggaucccauguuguuuccagaggguuuugcuggcuccauuguauauuaagaugcaa

SEQ ID NO: 1210 - RNA, 73 nt, Transmissible gastroenteritis virus
ucgaacuaaacgaaauauuugucuuucuaugaaaucauagaggacaagcguugauuauuuccauucaguuugg

SEQ ID NO: 1211 - RNA, 72 nt, Paramecium bursaria Chlorella virus 1
gccgaauauuuuguuucgaacggagcagaaacgccuacaccaagagaccacuccuguuccccguucgucggc

SEQ ID NO: 1212 - RNA, 63 nt, Paramecium bursaria Chlorella virus 1
auagagggguguuuuuuaaaguuacuguaugcgucacauguacuauacgcgaauacccucuau

SEQ ID NO: 1213 - RNA, 69 nt, Human herpesvirus 2
uugggaggcaaaaagaaagaaaacacccagacguaggcccgaggaccggccggcguccucuguccccga

SEQ ID NO: 1214 - RNA, 64 nt, Human papillomavirus type 22
uagguguagaauggucauauggccaguuugaugauuuauaaacugcuuuuuuacuaacacacua

SEQ ID NO: 1215 - RNA, 64 nt, Rat cytomegalovirus
cguuucacguuuuuaauagaugaccuccaugcgcugaggaucuguuacaccgcguucaucaacg

SEQ ID NO: 1216 - RNA, 76 nt, Bovine immunodeficiency virus
gaggcacuggcucgguuggguagccagccuuucggguaauaaaggcuuguuggcauucggcaucuacccgugccuc

SEQ ID NO: 1217 - RNA, 122 nt, Human herpesvirus 5
uguuguacaugugcagaaaaauguguaaauacguguuauuuaucccaugcgucuuguacauagauauauguuuuuauauacgcuauuuauacuuuauauauccuuuugcauaaccauagaca

SEQ ID NO: 1218 - RNA, 82 nt, Camelpox virus
ucuuguuuguucccuggaguaugagacuaggggguguuaaucuugggaauuauuuuucuaaccuuguugguagcauucaaga

SEQ ID NO: 1219 - RNA, 89 nt, Human papillomavirus type 37
aagagaguuguuuuuaaaaacuaugaaauuaccaccaggaguugauuggucacugggucauuuagaugaauugugaaaacagcuuuuuu

SEQ ID NO: 1220 - RNA, 105 nt, Gallid herpesvirus 2
uuuacaguuccauucucucgaacgcaauuaugaaauaaacacaaaaauaaacacuauucuuaaagcgguucuuuauuucuuuaauaaucgagcaugaaaggugaa

SEQ ID NO: 1221 - RNA, 130 nt, African swine fever virus
cuguauuaaguuaguuucugaauaaguaauuaauagauagauuuuaguuuauguaaaaauguuaacauuuguuaauaaguuuuagauaauuacuauuuuagaguuacuauuuuagauuuuaccauuuuag

SEQ ID NO: 1222 - RNA, 130 nt, Tupaia paramyxovirus
aauguaaguguccuuuuauaagauugcucagagugacugacaaaaaucuuuucuauaacuuauagaauauaucaaacuguuaaaaaugucucccuauuguaacucuugaauuacuuauggcuauuauauu

SEQ ID NO: 1223 - RNA, 69 nt, Vaccinia virus
augaaguuaaugauacacacuacacugucgaauuugauagggacaaaguaguugacacguuuauuucau

SEQ ID NO: 1224 - RNA, 68 nt, Hepatitis GB virus C
ggguuaacgccugauggugcuaaugcacugccgcuucggcggcgggucgcuaccuuauagcguaaucc

SEQ ID NO: 1225 - RNA, 81 nt, Human papillomavirus type 24
gggggugcuaacacauuaaaauguuuucgcaacagggcaaagcuuagauauagaggacauuauaaagcauuuagcacaucu

SEQ ID NO: 1226 - RNA, 100 nt, Ictalurid herpesvirus 1
uucguggacucgaccguacaccucgagacgguggacgcacucaugcguuacgagggcguacaaccacccccguucgacccggugaacgauucuucccgaa

SEQ ID NO: 1227 - RNA, 63 nt, Paramecium bursaria Chlorella virus 1
uaaacaucccuauagugaaacugauuaguacaagaguaaacaggagcccuggggucugguuua

SEQ ID NO: 1228 - RNA, 64 nt, Gallid herpesvirus 2
aguaccgcggcuucuauaaucagagaugcucguaucuaucuucguuuagaacgacgcgauuacu

SEQ ID NO: 1229 - RNA, 79 nt, Cycas necrotic stunt virus
gacuuauccaucugaaugaugcgcguuuauugcacacgcggcgaagcucaagugcaugugcauuuucuuuugguuuguu

SEQ ID NO: 1230 - RNA, 75 nt, Hop latent virus
uacucaaguccaggcaaguugaauucccuugagggacacucccgugguuugcgguuucagcccugggcaguggua

SEQ ID NO: 1231 - RNA, 67 nt, Human papillomavirus type 6
ugaaucuaauuguuuaaaguguuuuagauauaggcuaaaugacaaacacagacauuuauuugauuua

SEQ ID NO: 1232 - RNA, 71 nt, Rabbit oral papillomavirus
ccuuggcugcuacacagcacaaugcuaaacaggcuauugaaauuguauuguuuuuggagaguuuacagagg

SEQ ID NO: 1233 - RNA, 118 nt, Paramecium bursaria Chlorella virus 1
aguauuuucaaaaaaaaaaaaaaaaauaaacagggcacccugcccuacaaaacugcuaugccguauuuauuagggcacccugcgcacccugcccuguuuauuuuuuuucuaaaauauu

SEQ ID NO: 1234 - RNA, 65 nt, Giardia lamblia virus
agcagcuggcuucacgcaauuuuuaggucaaggaaauuucuccuuugcguaguagcauagcuguu

SEQ ID NO: 1235 - RNA, 62 nt, Equine herpesvirus 1
acuguuuuuaccagcgcuucaaacuguaguuuugacaaauagguuguuugggggagagcggu

SEQ ID NO: 1236 - RNA, 65 nt, Equine herpesvirus 2
guggcucuuugcguaaaaucuucucacaugauuguagcagaagugaaaauuugggaagaggccac

SEQ ID NO: 1237 - RNA, 98 nt, Foxtail mosaic virus
gcuccaccaauacucgccgcaguacucuuuuuccucacacagccauaucuagcuaccagacgauccaggugcguucggugcuucguuguccacggggc

SEQ ID NO: 1238 - RNA, 65 nt, Macaca mulatta rhadinovirus
cuuuauguccgcucgcccucccagagcgaaagugagaaugguuccuggggcguuuuggcguugag

SEQ ID NO: 1239 - RNA, 78 nt, Cherry virus A
guacuuggucacuagagaaguaguguaugucuucuccaaccuuaagagagguuaguuucucuucccugguuuaaguac

SEQ ID NO: 1240 - RNA, 79 nt, Human herpesvirus 7
auuaaguagagaauaguguaagccuguaguuacugacaagacuucagacagcccuuuacucauaauuuuuucucuuaau

SEQ ID NO: 1241 - RNA, 79 nt, Variola virus
uaucuuggcugcuggaucuaaauauuuuagaacacuguuuacaacaccuaugauaauaagagaucuaguaacuagagua

SEQ ID NO: 1242 - RNA, 78 nt, Triatoma virus
auauaaauauacauucauuuauuguaaauaauuauauauauauaauuuuguuuguuuguaaauaaugugcuuuuauau

SEQ ID NO: 1243 - RNA, 73 nt, Tupaia herpesvirus
gagaugcaguccuugcaucggcgcgcccgagccgccccccgcucgggccgcgccgcgcaaaugacgcgcgcuu

SEQ ID NO: 1244 - RNA, 66 nt, Newcastle disease virus
cggguagaagagggauauucagagaucagggcaagucucccgagucucugcucucuccucuaccug

SEQ ID NO: 1245 - RNA, 89 nt, Human papillomavirus type 21
acgcgcgccagaguuggaucacaucucguuguucuaacacgcuaaggacucaaggaaauguaagucugccaaucgauuuuggcucgugu

SEQ ID NO: 1246 - RNA, 77 nt, Human papillomavirus type 20
cugagguucaaccaguugaccuguuuugugaagaggaguuaccgaacgagcagcaggagagagaggaggagccucag

SEQ ID NO: 1247 - RNA, 90 nt, Human herpesvirus 7
guuucuaauaauauaacccuuagaagaauuaaaaguaaggugugagaaauuuacuuaaaaagcucuucaaagucgucauauuguagaaau

SEQ ID NO: 1248 - RNA, 63 nt, Foxtail mosaic virus
ugccacacgucggugauaacauccacucacuaccccacggaggaaguuacauugacgguacca

SEQ ID NO: 1249 - RNA, 91 nt, Variola virus
augaugcugguuauuacacauguguuuuaauauauauauauauauauauauauauauaugggaguaaagcauauaacguaaccagaauugu

SEQ ID NO: 1250 - RNA, 61 nt, Human papillomavirus type 21
gcaaaauaccaaccgcgcccgacacauaaaggugaguugugagccaaaugaggugaguugu

SEQ ID NO: 1251 - RNA, 75 nt, Tupaia herpesvirus
gggcucuggccaacgguggaccucgucuuuuuccguucccccacguucccgacaccaccaccguccccaccgucc

SEQ ID NO: 1252 - RNA, 82 nt, Tupaia herpesvirus
cgcucgacggcgcggcggugaccccguccgcgggucgcgcgcgggagucaaauagucgagccuccgucgcgccgcaccggcg

SEQ ID NO: 1253 - RNA, 83 nt, Human herpesvirus 1
uggggcacuugcagauuuguaaggccacgcacggcggggagacaggccgacgcgggggcugcucuaaaaauuuaagggcccua

SEQ ID NO: 1254 - RNA, 75 nt, Human herpesvirus 1
gcugcucuaaaaauuuaagggcccuacgguccacagacccgccuucccgggggggcccuuggagcgaccggcagc

SEQ ID NO: 1255 - RNA, 90 nt, Human herpesvirus 2
acgagcggggccuguuuaugggccgggcgucccgaugaguacuguuguuuccgccgcccgaacccccccgcccaucaaccgccuguucgu

SEQ ID NO: 1256 - RNA, 93 nt, African swine fever virus
ggauugauuguucauaaauauuuuuauacucugaccaagaaauuauuuuuuuauuaagccgguuauuuacguuguuauggaacgcgaaggucc

SEQ ID NO: 1257 - RNA, 62 nt, Macaca mulatta rhadinovirus
gugguuucuugugcgacgcuuccuguguaacugcauacaccggggugucgccaggaaaccgc

SEQ ID NO: 1258 - RNA, 67 nt, Human adenovirus A
guaaaaagcguucaauaguugccacgcuuugaccggucaggcgugcgcagucuugaaugcucuggac

SEQ ID NO: 1259 - RNA, 70 nt, Tupaia herpesvirus
cgcaccggcgagucgggacgcgcccguccggccucucguccgggaggaggcggccgacuccgucgaggcg

SEQ ID NO: 1260 - RNA, 65 nt, African swine fever virus
ggaagcggaaccgaucgaccgccaccugcucccagggacccuugcgcucgaugucgucggcuucc

SEQ ID NO: 1261 - RNA, 72 nt, Northern cereal mosaic virus
aguucaagugguauauguugagaaaggugauagccuuaucaaacaaacaggaucauaugccucuucauuacu

SEQ ID NO: 1262 - RNA, 72 nt, Vaccinia virus
gucgugcgauucagaacacacuuuucucaaccuucugguagagaggcugcugaaaauaaugacgcguacgau

SEQ ID NO: 1263 - RNA, 69 nt, Bovine papillomavirus type 2
agguaaagugcuaucgcuuucgugugaaaaagaaccauagacaccgcuacgagaacugcaccaccaccu

SEQ ID NO: 1264 - RNA, 69 nt, Human herpesvirus 3
guacggcccaugggagggaacauuuccacguguuccaauacaggggguguuccuuaauagggacugugc

SEQ ID NO: 1265 - RNA, 131 nt, Casphalia extranea densovirus
accaccacaacccccccagaacccaagcccaauccuauugcgaugaccacgacgcgcgaagcgcgucacuucguguggucacuacguaucgcaauaggauugggcuuggguucuggggggguugugguggu

SEQ ID NO: 1266 - RNA, 79 nt, Human adenovirus C
uggcccucaccugccgccuccguuucccggugccgggauuccgaggaagaaugcaccguaggaggggcauggccggcca

SEQ ID NO: 1267 - RNA, 63 nt, Human adenovirus C
aguugcauguggaaaaaucaaaauaaaaagucuggagucucacgcucgcuugguccuguaacu

SEQ ID NO: 1268 - RNA, 61 nt, Cymbidium ringspot virus
ggaaaggaucucgugcgcuauaagucuaacgaaaguugagcuugcaacaugggucuaugcc

SEQ ID NO: 1269 - RNA, 62 nt, Human herpesvirus 7
guaagcuaccguacaucucuuucacaaacccagggcucacauagagacaagcacaagcucgc

SEQ ID NO: 1270 - RNA, 104 nt, Variola virus
aguuggaugaauaguaugucuuaauaauuguuauuauuucacuaauuaauauuuaguaauuagugcacucuauaaaaacgagaaugacauaacuaaucauaacu

SEQ ID NO: 1271 - RNA, 67 nt, Bovine adenovirus D
aaugaaguuuaaagaauauuaaauuugacguacaggcuuuaauuuuauucuuauuuuaaaccuuauu

SEQ ID NO: 1272 - RNA, 85 nt, Casphalia extranea densovirus
gucacaauggccuacgugacuugguauacgugaccuaaaacaacaaaguggcguacgugagauaauguaaugaggugguggugau

SEQ ID NO: 1273 - RNA, 86 nt, Human adenovirus D
cagacccaccccagucagacccaguggcgagaggcgagcagcuguugaaaaaauugaggacuuguuacaugacauggguggggaug

SEQ ID NO: 1274 - RNA, 61 nt, Oat mosaic virus
aucaaugcuggugccacgguuucacccccuucuuaagggaggcugcugcacccacguuggu

SEQ ID NO: 1275 - RNA, 62 nt, Satellite virus of maize white line mosaic virus
cccucuacgaaauguucagucggaagcugagaaccucccggugcauacugacauugugaggg

SEQ ID NO: 1276 - RNA, 61 nt, Satellite virus of maize white line mosaic virus
gguaggaaguuggccaaagguuuccggauauaagccacccgguuacugucuaacuaucccc

SEQ ID NO: 1277 - RNA, 79 nt, Saimiriine herpesvirus 2
aaguuuaaguaagauacuuauuuucuaguagcuaguacguugcuugcucauuuuucuaauaguguuuauucuaaaacuu

SEQ ID NO: 1278 - RNA, 89 nt, Molluscum contagiosum virus
ggccgucuccucucgcgaucugcgugacccucuucgacuuacggacgcccuccucgaccugcacgacccucuucgacuuacggacgccc

SEQ ID NO: 1279 - RNA, 60 nt, Human erythrovirus V9
cuagauaugaacaacauguaauuagaaugcuaagauuauguaauauguacacaaguuugg

SEQ ID NO: 1280 - RNA, 70 nt, Monkeypox virus
ggauuuuagaauuuccaaauucaccagcgauuuaucgguuuuggugaaauccaaggauuuauuaaugucc

SEQ ID NO: 1281 - RNA, 70 nt, Camelpox virus
ggauuuuagaauuuccaaauucaccagcgauuuaucuguuuuggugaaauccaaggauuuauuaaugucc

SEQ ID NO: 1282 - RNA, 63 nt, Saimiriine herpesvirus 2
aacaaauaaacuuauaaacauauuuuaagcuuuacugguauuguuguuuauaaccuuuuuguu

SEQ ID NO: 1283 - RNA, 75 nt, Saimiriine herpesvirus 2
acaguuuaaaauguuaaacuuuuguuauuuuuaauaugauauauguuaacagcuauaguugcauuuuauauuugu

SEQ ID NO: 1284 - RNA, 94 nt, Molluscum contagiosum virus
gcacgacccucuucgacuuacggacgcccuccucgaccugcacgacccucuucucgagugcacguaaagacggcgauucgugcucguguugugc

SEQ ID NO: 1285 - RNA, 82 nt, Camelpox virus
uauuaacaagaaucaucccagcaaauauauuagagaagcgcucguuuuauuaauaccaguaguaauagugauuccauugaua

SEQ ID NO: 1286 - RNA, 131 nt, Bombyx mori densovirus 1
accaccaccacaaccccccggaacacaggcccaaaauuuucgcuacgaagugaccacacgaagugacgcgcuucgcgcgucguggucagcgaaaauuuugggccuguguuccgggggguuguggugguggu

SEQ ID NO: 1287 - RNA, 67 nt, Cowpox virus
gaugcgcugcaaaguuuccuauuaggguuccgcgcuuuacgucacccaacauacuugaagcaccauc

SEQ ID NO: 1288 - RNA, 62 nt, Human herpesvirus 7
acaggaaacauuagagugauuaaaaccauaagccugguguuaucggauuaaaaaccucuugu

SEQ ID NO: 1289 - RNA, 82 nt, Bovine papillomavirus type 2
agggccacgucgaguguacucugugacugucugcugcggacacugcggaaaggaccuuacauuugcugucaagacuggcucu

SEQ ID NO: 1290 - RNA, 73 nt, Horseradish curly top virus
ccuuauccuuaggguuuaguuuugaagcagagcgagcgcagcgagcguaaacaacccgaauaaacggacuagg

SEQ ID NO: 1291 - RNA, 131 nt, Human herpesvirus 2
uguuucucuuucuuucccccccucucuccgcaauaaacgccuucccggaacuguguuucccccccuacaacaguguuguccguugguugggugguuggggugcgggggugggcgggggaagcaagaaaacg

SEQ ID NO: 1292 - RNA, 75 nt, Bovine herpesvirus 1
ggcccuucccuguugauuuauggcaucgcacacaacgguguuugcggaacacauuuuauuuaaaacgacagcgcc

SEQ ID NO: 1293 - RNA, 63 nt, Equine herpesvirus 1
gacaugugagcaauaaggaacgugggcugcuagauacaacgcccccuucguuccucacauguc

SEQ ID NO: 1294 - RNA, 74 nt, Hepatitis C virus
guacaccggaauugccaggacgaccggguccuuucuuggauaaacccgcucaaugccuggagauuugggcgugc

SEQ ID NO: 1295 - RNA, 71 nt, Fowlpox virus
aggauauugaguacauauaaauuaauuuuuuaaaacugaaaauauaaucaauuuauuaccgagggcguccu

SEQ ID NO: 1296 - RNA, 131 nt, Bombyx mori densovirus 5
accaccaccacaaccccccggaacacaggcccaaaauuuucgcugaccacgacgcgcgaaacgcgucacuucguguggucacuucguagcgaaaauuuugggccuguguuccgggggguuguggugguggu

SEQ ID NO: 1297 - RNA, 92 nt, Rhesus monkey papillomavirus
ccucgaggacauuguccuagauuugcaaccauuuccacaaccgcaaccggucgaccuuauguguuaugagcaauuaucugacagcucagagg

SEQ ID NO: 1298 - RNA, 131 nt, Bombyx mori densovirus 1
accaccaccacaaccccccggaacacaggcccaaaauuuucgcugaccacgacgcgcgaagcgcgucacuucguguggucacuucguagcgaaaauuuugggccuguguuccgggggguuguggugguggu

SEQ ID NO: 1299 - RNA, 115 nt, Equine herpesvirus 4
ccccagccucugcgcguuuguucgauggcccggguagcuuguuucccacccccuaucggagguggggagguggggagguggggagguggggagguggggagguggggaggugggg

SEQ ID NO: 1300 - RNA, 112 nt, Equine herpesvirus 2
gcucuaaucucuauccuccuuccccuuuuuucacuccucccaccggcaacuuccccuacugcuguuuucccgagagagauggugugugggugagugauggcagagagccagc

SEQ ID NO: 1301 - RNA, 89 nt, Amsacta moorei entomopoxvirus
gauacaauuuuagaugcuauuaaugauaauuuagauuuuaaagaauuaauaaaagacgaaauuaguaauuaaguuuuuaaaguugaauc

SEQ ID NO: 1302 - RNA, 65 nt, Amsacta moorei entomopoxvirus
uacuaauaaaguauguucaauguuaauaaaaguauuaacucugacaaauguauuuuaauauagua

SEQ ID NO: 1303 - RNA, 66 nt, Simian-Human immunodeficiency virus
cuuguagagcuauucgccacauaccuagaagaauaagacagggcuuggaaaggauuuugcuauaag

SEQ ID NO: 1304 - RNA, 69 nt, Polyomavirus muris
guguccgggcaaucagccauugcgguauccgggcaaucugcccggucuuggcaaggcgcccgggagcac

SEQ ID NO: 1305 - RNA, 89 nt, Vaccinia virus
uaauaaauuucuuuucacgaugcaucuuauugaaugacguuuucucauaaguggacauauagaugcagaaguaaugaagaaaaguauua

SEQ ID NO: 1306 - RNA, 106 nt, Rana tigrina ranavirus
acuaucguaauauauauuaucacugaaagacuuuuaggccaagaaggagauguaacaucuuaagucuuuuguuagucucuuucagaagacuuuauauuaagauagu

SEQ ID NO: 1307 - RNA, 130 nt, Camelpox virus
gagaauacuaaaauuccuaacgaugauauguuuucagcuaguucuucauaacguccagaauguucaccagcuccaugacuuaugaauacuaaugccuuaggauauguaauagguuucuaauauuuacaau

SEQ ID NO: 1308 - RNA, 131 nt, Human herpesvirus 2
cgggccaaaggaugggguggggugaggguaaaagcacaaagggaguaccagaccgaaaacaaggacggaucggcccgcuccguuuuucgguggggugcugauacggugccagcccuggccccgaacccccg

SEQ ID NO: 1309 - RNA, 100 nt, Cercopithecine herpesvirus 7
aacggcucuugcguauaaugcauguuuccgguuauuuacucgauccgucuuacguaguacaugguaaacacccauacauguaaguauaaaagggacuguu

SEQ ID NO: 1310 - RNA, 113 nt, Duck adenovirus A
acuguauuugauuuuuuuaggaaauuuugcguugcaaucauaucaacugcacacugaaauuaaagaucagauugcagauguguuggagcugauuaggaaggaaucaaaaaagu

SEQ ID NO: 1311 - RNA, 66 nt, Chimpanzee cytomegalovirus
guccuccaccuccgccaccgcgauuuaucaucaucgucgcgggccgccgagccguuccucagggac

SEQ ID NO: 1312 - RNA, 69 nt, Chimpanzee cytomegalovirus
gccaucaccgucgccgaucgaccaggaccgccgcgcggucuucacguacguucuggcccgcugcugcgc

SEQ ID NO: 1313 - RNA, 99 nt, Porcine teschovirus
ucccccucuggacuuguaacugguaagugauaauccuuggaagcuagguacucguuacgcaaguuuuggauuaucuugugcccaacauuaguucucgga

SEQ ID NO: 1314 - RNA, 130 nt, Porcine epidemic diarrhea virus
gucacgaggggaacgcaguaccuuuucaucuaaaccuuugcacgaguaauuaaagauccgcuugacgagccuauauggaagagcgugccagguauuugacuuaaggacuguuaguaacugaagaccugac

SEQ ID NO: 1315 - RNA, 112 nt, Paramecium bursaria Chlorella virus 1
gaacaaucgccuuuguguaaauguugcggagaaugucauuaggcaaauuagcaaacauaaaaccgguugacauauccguuguuucaccauguugacacaaaguuuuuuguuc

SEQ ID NO: 1316 - RNA, 64 nt, Camelpox virus
gugauuuuggcaauaguccguguaauccauaauccaguaacacgagcuggugcuugcuagacac

SEQ ID NO: 1317 - RNA, 77 nt, Camelpox virus
auauguguuauuuuaggaucauauuuacauauuuacgguauaucaaagauguuagauauaguuaauaggacacauau

SEQ ID NO: 1318 - RNA, 69 nt, Avian carcinoma virus
cugaggggaccaugauauguauaggcgaaaggcggggcuucgguuguacgcgguuaggaguccccucag

SEQ ID NO: 1319 - RNA, 95 nt, Bean leafroll virus
auauuguuuccuagauaugcuggcaguuuguaugauuuuaauuguugggaacaacuaagugcaaaaaaauuagcaaaagaauuuagaaaccuuau

SEQ ID NO: 1320 - RNA, 117 nt, Human herpesvirus 6
cgacaacgucgggcgcguucagaguccuguaccgugugcgacugagacacguaguguucaaacucuaccuucuaaaaucacaccucgguggaaagaucgugcggcguaucguugucg

SEQ ID NO: 1321 - RNA, 67 nt, Human herpesvirus 6
ggaaacgggacacaauggacuuugcaacguauaugucuuugauuuacugcauauccgucuuuuaucc

SEQ ID NO: 1322 - RNA, 64 nt, Human herpesvirus 6
agacauacgagccaguguacagcguauugucucuccauuucaaaguacuguuguucguaucucu

SEQ ID NO: 1323 - RNA, 73 nt, Human herpesvirus 6
guugucauguaucguuguguuuggcugauauugugacgggcgaacugucaaaaaaaaacacauauuagacaac

SEQ ID NO: 1324 - RNA, 66 nt, Human adenovirus E
gucgcaaagcgcgcgggcagccacggcccagacugcggucgcgauggcccggagcgcgcucgccac

SEQ ID NO: 1325 - RNA, 62 nt, Alcelaphine herpesvirus 1
gauaacggcacuaauauuaacuuaucuaaagggcuaacaccuuuacauauagcgcccaaauc

SEQ ID NO: 1326 - RNA, 84 nt, Reston Ebola virus
aggacgcggccccgacggccaccccgacgaagaaacggacgacgccggccgcggcccgggaguaggcgucgggauagcgguccu

SEQ ID NO: 1327 - RNA, 126 nt, African swine fever virus
uaauguugguucaugaagauaaagugugccaaagaaacuuuuauaaacaaaugauuaauguaggugcuagucguguguacuuaaacaggguauucuauagccaaguauuuucuauagccaguauua

SEQ ID NO: 1328 - RNA, 61 nt, Alcelaphine herpesvirus 1
uauagagauuaucaguauccaagacacuaauaaacacguagcuuguauaacuauuacuaua

SEQ ID NO: 1329 - RNA, 67 nt, Alcelaphine herpesvirus 1
uacguuuuucauucuucuagaaacauuugaacuauuauuagacaauggagaaaagugaauauacgua

SEQ ID NO: 1330 - RNA, 69 nt, Diatraea saccharalis densovirus
accgcaaacucccgucgaagcuggagccgugugcaaaacaggauguagcuaggcagcggaccguugggu

SEQ ID NO: 1331 - RNA, 71 nt, Diatraea saccharalis densovirus
cuucgaaaucuucaaccccggaggcggcaaaacacacgcgccgucgaaggaggaacaagaagaagucgaag

SEQ ID NO: 1332 - RNA, 131 nt, Melanoplus sanguinipes entomopoxvirus
gauuauaacacuacuuggacuaacugauacuacauauguuccaauuuguuuauaagcauauacuguaucuucugauauuugcuuagcuucauuuaacauuuguucaggauuuucaacuacauauuuuaauu

SEQ ID NO: 1333 - RNA, 110 nt, Diatraea saccharalis densovirus
cucuuagaguaucgccaccgacgacgacgacggcagucgagcgcggcuucgccgcggcagcuucgcugccucgacugccgucgucgucgucgguggcgauacucuaagag

SEQ ID NO: 1334 - RNA, 122 nt, Barley mild mosaic virus
ugccuuuccggcagagcauccccuggcaucgacacucacgcgaucgcaaucaacugacuuaauccucgguuuugcaaucauauagugaguucuaccccuggacguguucccccggaacugca

SEQ ID NO: 1335 - RNA, 108 nt, Barley mild mosaic virus
caaaauaguaaguacuuuuaucguuucguuauacacuaaugcccaggagagcucagauuuugacugaucugcacauuacgaacaccccaggguauuuacaccaguuug

SEQ ID NO: 1336 - RNA, 71 nt, Lumpy skin disease virus
uauuguacuguuuaggaaaaacugauuuuucaaauauaaaaucuauaauagaaguuccggucacuacaaua

SEQ ID NO: 1337 - RNA, 60 nt, Lumpy skin disease virus
cuggagccaaggggauggagauggcaucgugugggcugaauucuuucucuugguuugcag

SEQ ID NO: 1338 - RNA, 73 nt, Human herpesvirus 6
uccggccgggucacuuguucucauaaaagcggucuaucuccacuccgcucagccggaccguacccggaccgga

SEQ ID NO: 1339 - RNA, 63 nt, Human adenovirus E
gggagacggcgcagccaguguuuuuaaagauaaaacaaggcacguggucugugcggcucuccc

SEQ ID NO: 1340 - RNA, 88 nt, Diatraea saccharalis densovirus
gagacagcaacaugagugaaagagauagcaugaaaacaaaccuugaaauaauuuaugcguaauuuuauuaucuuguuauugugaccuc

SEQ ID NO: 1341 - RNA, 130 nt, Vaccinia virus
aaaacucguaccaacggcaaaaauuucgaagauuagaggagaugaaugcgacacaucuggugauuuuauuauuuguaugauucagacucuuuuguccagaaaauauaaugcuuuugaugguaucgggugu

SEQ ID NO: 1342 - RNA, 60 nt, Vaccinia virus
cuuacaaaaaaauuggauucaauauuauuggagacgauaaaaaauccaagaaacaagaag

SEQ ID NO: 1343 - RNA, 111 nt, Barley mild mosaic virus
ccacaauuagcuauucguguacuagcaucaucggauacgccuauccugcacuuaagccugcaggacgcuaucagguccgcugacuguuaccauuuguguagcucguugugg

SEQ ID NO: 1344 - RNA, 100 nt, Gallid herpesvirus 2
uauaaaugauguuugugaauauauauuaucugauacauaauuaaaaauaccaucauagcaugaugauauuguaguauuuuuuuuaaauauauuauuuaua

SEQ ID NO: 1345 - RNA, 63 nt, Gallid herpesvirus 2
uuauuauaaauucuguuguauaauuauaauuauaauuauaauuauuaauacauuuuauaauaa

SEQ ID NO: 1346 - RNA, 71 nt, Alcelaphine herpesvirus 1
gaugagacagguuuacuuuagauagcgguacugauguccacacgcguuagauaaauauaauaaaucucauc

SEQ ID NO: 1347 - RNA, 70 nt, Sheeppox virus
ccuuauuuuauaaaauaucaugacgauugggaagcuguuauuaaucaauugguagauuuauacgaugagg

SEQ ID NO: 1348 - RNA, 120 nt, Sheeppox virus
gguggcaucccuucauaucgccccuaggucuaguucacuggaguuggauggagaaguucgugcaaccggugauaaggcucgaggguuggaaagaacugaaggaggaauugcugacacacc

SEQ ID NO: 1349 - RNA, 93 nt, Sheeppox virus
ccuaugauacauaugcucuuaauguacuuguuuacuguuuauacgcacccaaguaacaacuguauuuaauuauaaccuaugugaaucauaagg

SEQ ID NO: 1350 - RNA, 92 nt, Human herpesvirus 5
guagcgagcgugaggaaacaaaauagcgucacuguggccaccauggcauaaaugacugaacgaugacuaaaguggaagccugacgccgugac

SEQ ID NO: 1351 - RNA, 77 nt, Tupaia herpesvirus
caccagaauggauagaaagacaaacacaguuacaacauagcuuugaggacugucaauuugaacuaucuaaaauggug

SEQ ID NO: 1352 - RNA, 130 nt, Human adenovirus C
uucucaucgcuuuucuuacuuaacagauugcaaaaauaaaacaauauuaccgcuuguugaugaaaauugugaauuaaugcuaguuaaugaugagauauguguaguuguaaaauguuacugugaugaagaa

SEQ ID NO: 1353 - RNA, 106 nt, Gallid herpesvirus 2
ucucauuguuauguaguugugauuuauuaaacauauuuuuuauaacucuaguauucuccgaguuacuuauauauuuauuugucagacaauaaugcaauaguggaga

SEQ ID NO: 1354 - RNA, 72 nt, Human adenovirus C
gcuuguguugcaacagcgcuaaaaaaugagaacaagagagacuuuuuacauaauagcuuuugcaauaaaugc

SEQ ID NO: 1355 - RNA, 69 nt, Human adenovirus C
gaauuaaccaauagagacacguuugacacagaagcuguguugcugacggucuauauucuguuuguauuc

SEQ ID NO: 1356 - RNA, 114 nt, Human T-lymphotropic virus 2
ggagacucaccuuggggauccauccucuccaagcggccucgguugagacgccuuccgugggaccgucucccggccucggcaccuccugaacugcuccucccaagguaagucucc

SEQ ID NO: 1357 - RNA, 80 nt, Human T-lymphotropic virus 2
cccaagguaagucuccucucaggucgagcucggcugccccuuagguagucgcuccccgagggucuuuagagacacccggg

SEQ ID NO: 1358 - RNA, 108 nt, Ectromelia virus
aagaaucuguuauaugguauagggagaguauaaaacauuaaaugcccguacuuauuaaaguauucaguagccaauccuaacucuuucgaauacuuauuaauugcucuu

SEQ ID NO: 1359 - RNA, 97 nt, Cowpox virus
ugagucaauugguagaguuuuauaacgaggucgcuaacuggcuguuaagagaugagaccucgccuauuccugauaacuucuuuauacaguugaaaca

SEQ ID NO: 1360 - RNA, 89 nt, Camelpox virus
uccaguguaagcaagucgauuugaaugacauaggcgacaaagugagguggcauuugucagaaguuucaaagucguguaagaacauugga

SEQ ID NO: 1361 - RNA, 61 nt, Human herpesvirus 5
uccauacguuuuugggaaaguugggcucggcccaacgcaacagaccuaggcacacgaugga

SEQ ID NO: 1362 - RNA, 99 nt, Human herpesvirus 5
ucauuaagcaagacagcgucagacgcacgcuggaaaagagcugcuccaaccggugcggcaacaccagccagcaaaaggcgcagacgcucauaaggauga

SEQ ID NO: 1363 - RNA, 87 nt, Human herpesvirus 5
caucgcgcggggcacgcacuucacgccgcgcgcccacggcagcguccgagggcgggcgcugccgugggcgcgcggcgcccccagaug

SEQ ID NO: 1364 - RNA, 80 nt, Human adenovirus C
uuguuuguguucugaagcuuaucaguuauuauauaagaaaugccuuucuuauugauagauuguuuacgaagcagaagcag

SEQ ID NO: 1365 - RNA, 94 nt, Human T-lymphotropic virus 2
ccuagcgcugaaaaacaaggcucugacgauuacccccugcccauaaaauuugccuagucaaaauaaaagaugccgagucuauaaaagcgcaagg

SEQ ID NO: 1366 - RNA, 88 nt, Ectromelia virus
uuguuuuaaauuguugauuuauuaaagaauauaguuuggcaacuauauaaaugaauuuuugagaauuuaagucauuauuuugaaacaa

SEQ ID NO: 1367 - RNA, 73 nt, Cowpox virus
gauuucuaaguuacuucugcagcauauaacuaaacacguuaguguucuuuauuguuuggguaaaacagauuuc

SEQ ID NO: 1368 - RNA, 73 nt, Human adenovirus C
auaucuguaaguuguauucuuuuuaucgaagcagaguuuccuccgguuuaguuaggaagaaguuaaaugaugu

SEQ ID NO: 1369 - RNA, 93 nt, Camelpox virus
ugcacuaccuaucugcucauucguuguuucgguucuguguuugucugauucuuagauaguguugagguaauucuagaaagcggauugagugua

SEQ ID NO: 1370 - RNA, 70 nt, Camelpox virus
ggguaaaugacaauggggguaaaugacaauggggcgcuuggugacacauuugccccaccgucgccugccc

SEQ ID NO: 1371 - RNA, 88 nt, Variola virus
uuucucgaauauacgggccaaguuagaaucuccaguaacuaccauagugggauaucauccagcagcuagagaccgucaauucgagaaa

SEQ ID NO: 1372 - RNA, 103 nt, Myxoma virus
gauauaaucuaaacgacguagaaggcguguuuccuuggaacuacuaucuaagcugcaaaauaggugaaacaaaaagucacgcguuacacuggaagcguauauc

SEQ ID NO: 1373 - RNA, 62 nt, Myxoma virus
gaaauuagaguuuguacauuaagcaacaugucuuuaaauguggcuacaaacuuuuccuuuuc

SEQ ID NO: 1374 - RNA, 84 nt, Rabbit fibroma virus
uagaguuaagagagauuagaguuuguacauuaagcaacaugucucuaaauguggcuacaaacuuuuccuuuuccacaucaucua

SEQ ID NO: 1375 - RNA, 123 nt, Ovine adenovirus 7
ugggcauuuuugauugcagauuuccagguuuucugcaaaaaucuaaaauucaaacugcuauuauuaauacaggucccagagaacaaggcggaauacacuggauaacauuagcauuagaaccca

SEQ ID NO: 1376 - RNA, 92 nt, Ovine adenovirus 7
uguauuacaguagaaagaaauacucaaaguguucaauguaccugugcgggaucgugcggcuuguuuuguauauuuuucuuauacuguuuuca

SEQ ID NO: 1377 - RNA, 92 nt, Camelpox virus
uaauuaguucuguaguaauaucuuuaauaauuggcuauacaucuguucaauacuaucuauugaugauuucuuuuuacggcuugaacuaauua

SEQ ID NO: 1378 - RNA, 68 nt, Rabbit fibroma virus
gauuauacuauguggcuauaauaaaauuacguucuuuacguauuauacuacacacguuguaacaaauc

SEQ ID NO: 1379 - RNA, 100 nt, Swinepox virus
uaugaaaggaauaguauuuguuaaaaauagaacuguauacguauuaaauacaaaugauccauugauagauuuuauguuuaaagaauauaacccaugcaua

SEQ ID NO: 1380 - RNA, 94 nt, Swinepox virus
augcuuaauaucuuuacuacaacccgaaaauguacauuuauuaaaacaaguauuuaauaauggccaugaucguaucaauaagguauugaaacau

SEQ ID NO: 1381 - RNA, 60 nt, Myxoma virus
gaguuguuacgucugcgucuuuguaaguuuucuaaacagaucaaggccucguauaaacuc

SEQ ID NO: 1382 - RNA, 71 nt, Gibbon ape leukemia virus
ggcccgacagucuggucgcauuugcaccucggcacucggagcgagacgcagcagccaggcagacucgggcc

SEQ ID NO: 1383 - RNA, 91 nt, Camelpox virus
uauauguuaaugucauaaaaacuaauuguuuguuagacgauuuaaucucaaucucuuuuacaaucauuugguggaauaugaucaacauuua

SEQ ID NO: 1384 - RNA, 73 nt, Paramecium bursaria Chlorella virus 1
cccauacgugauucgugaucuuuuuugguuuguaguauaguaaaccuuuccacucuaucauauugcucguggg

SEQ ID NO: 1385 - RNA, 80 nt, Chimpanzee cytomegalovirus
gacaggccccggcuaucgcgacaugucggcgacccacggucggguggacgugucgcgacauggacgugcagggggauguu

SEQ ID NO: 1386 - RNA, 130 nt, Feline immunodeficiency virus
gagagugauugaggaagugaagcuagagcaauagaaagcuguuaagcagaacuccugcugaccuaaauagggaagcaguagcagacgcugcuaacagugaguaucucuagugaagcggacucgagcucau

SEQ ID NO: 1387 - RNA, 129 nt, Paramecium bursaria Chlorella virus 1
auuguuucauauuauugcauguccaacaacaacugacgcaauuaccuucgacguauccuacgguguuauuuagucugucaauaccauuucgaagaguaucagucguuuguuguccacaguaaaagcaau

SEQ ID NO: 1388 - RNA, 90 nt, Sheeppox virus
aaggaaucguauuuauuaaaaauagaaauguguauauuuuacacacaaaugaugaauuaauagauuucuuauuuaaggaguaugauccuu

SEQ ID NO: 1389 - RNA, 70 nt, Yaba-like disease virus
uauaucuauuguaauuuuacaaguuauaggaauaaucgcuauauuuuuuuguauauuacuuuuugaugua

SEQ ID NO: 1390 - RNA, 73 nt, Ovine adenovirus 7
acuggacucgguuucgcuguagcugugguucaaccugaacauggcucccagagcugcuaggaaccgguccagu

SEQ ID NO: 1391 - RNA, 126 nt, Yaba-like disease virus
uuuauauauucauuacaguaagauggugauaaauuaguuauuacaacacacaaaaauauuaauaauaucauguuuuuuguugauaauauaguuuauuauucauuuuacaguuuuguuuuauauaaa

SEQ ID NO: 1392 - RNA, 60 nt, Camelpox virus
gcauuuaucgucucaauuauaauauuacuaaaguauaauaggagaaaaaauauauaaugu

SEQ ID NO: 1393 - RNA, 131 nt, Tobacco necrosis satellite virus
gguucacaauguuagugauggggcgcugaaagaugcguagcuacccuucuggagccacuuccuggugguaagcagaaauccaaggguacggugguacgguggaaagcagucccagcucugcauugggaacc

SEQ ID NO: 1394 - RNA, 60 nt, Duck adenovirus A
aguugaaagcauugaugaaauccuuaggcauagccgguaauuuucucgggacuuucgacu

SEQ ID NO: 1395 - RNA, 130 nt, B19 virus
uuccggaauuaggguuggcucugggccagcuugcuugggguugccuugacacuaagacaagcggcgcgccgcuugucuuaguggcacgucaaccccaagcgcuggcccagagccaacccuaauuccggaa

SEQ ID NO: 1396 - RNA, 98 nt, B19 virus
uucccgccuuaugcaaaugggcagccauuuuaaguguuucacuauaauuuuauuggucaguuuuguaacgguuaaaaugggcggagcguaggcgggga

SEQ ID NO: 1397 - RNA, 63 nt, Yaba-like disease virus
auacacuaugaccaacauaacaaguaauacaaaauuaaauguugugguaacaaaaagguguau

SEQ ID NO: 1398 - RNA, 130 nt, B19 virus
uuccggaauuaggguuggcucugggccagcgcuugggguugacgugccacuaagacaagcggcgcgccgcuugucuuagugucaaggcaaccccaagcaagcuggcccagagccaacccuaauuccggaa

SEQ ID NO: 1399 - RNA, 76 nt, Molluscum contagiosum virus
uguuccgcgugagagccauucuuaauccaguagagacggcuaaagagagggguguggcuacaugcaacgcaggaca

SEQ ID NO: 1400 - RNA, 64 nt, Molluscum contagiosum virus
uguaaucgucacgugaacuccaaggucgagcugacucggacacuggaggugagucacgcuugca

SEQ ID NO: 1401 - RNA, 60 nt, Gallid herpesvirus 3
gcgaccccagccacgcacgaacagaguuuaacggaagcgucguuugcgggauaagguugu

SEQ ID NO: 1402 - RNA, 62 nt, Camelpox virus
ugauacauugauuaaugaaagaacuuauaaugccucaaauguuccaguaguuacguguuucg

SEQ ID NO: 1403 - RNA, 62 nt, Camelpox virus
uuuuuacacuauuaaguuuuauugcuacuaaccguaguaauuuuauuaaugcaguauaaaaa

SEQ ID NO: 1404 - RNA, 67 nt, Petunia vein clearing virus
caugcgugaagaagauaagagggaauccacuuuucaguagugguccuaugugucuaaagcaugcgug

SEQ ID NO: 1405 - RNA, 76 nt, Petunia vein clearing virus
gcuuuuucuauuauggcauuuuguaauaaugcucuguccacuaucgagucuguauuauuaagugugauaagugugc

SEQ ID NO: 1406 - RNA, 93 nt, Petunia vein clearing virus
auuaucaucaauaaaauguuugugugaauaacucucucuuguuuccaaacucucaaaaugguaguucgauccuaauauuaaauugaaggugau

SEQ ID NO: 1407 - RNA, 82 nt, Murray Valley encephalitis virus
gaucuucugcucuauuccaacaucagucacaaggcaccgagcgccgaacacugugacugaugggggagaagaccacaggauc

SEQ ID NO: 1408 - RNA, 74 nt, Amsacta moorei entomopoxvirus
ccuaauuuauuaagaucagauggauuauaacauguuucugaauaucuaaaaucuauuacaauuuuuaaauuagg

SEQ ID NO: 1409 - RNA, 121 nt, Fowl adenovirus D
uuaugugggggauguucuuggggaugcuuugcgggccaggcgauuuggauuucgcggguuacugggacugguauuuccguguuuguaacgcgaggguuccuuaauaaaugucuuuucguaa

SEQ ID NO: 1410 - RNA, 81 nt, Bovine adenovirus D
acaguagaaaaaaauacacaaagcguacaauguacguguucaggagcaugugguuuauuuuguguguucuuuuuauauugu

SEQ ID NO: 1411 - RNA, 82 nt, Japanese encephalitis virus
gaucuucugcucuaucucaacaucagcuacuaggcacagagcgccgaaguauguagcugguggugaggaagaacacaggauc

SEQ ID NO: 1412 - RNA, 82 nt, Murid herpesvirus 4
aauugcaucaaccacccugcgcccuagugugaccucaaaaaagagccuggaaccuacuggguguguuaucugaugugcgauu

SEQ ID NO: 1413 - RNA, 77 nt, Vaccinia virus
uaucaagauguguauguuugugaaaauuguggagacauagcagcacaaaucaaggguauuaauacaugucuuagaug

SEQ ID NO: 1414 - RNA, 82 nt, Amsacta moorei entomopoxvirus
auuuauauauauuucucuuucuauauaauauccucuauuuuuuucgaaaauauuuauagcaacauaagguggaauuuuaaau

SEQ ID NO: 1415 - RNA, 77 nt, Equine herpesvirus 1
gccccgagucgcguggaugagcaacgcuaaacaacaaccguuuuuucgcuaccgcucccccagccggggcucggagc

SEQ ID NO: 1416 - RNA, 72 nt, Equine herpesvirus 1
accacccaaaacgaguaaccaauaaaaacaucguugacggcacucucuguaguuuggcuucguuuauauggu

SEQ ID NO: 1417 - RNA, 69 nt, Sheeppox virus
uacauuauaauauaacuaacuguuuaaacaaugaugguguuaaaacuaaacuuguuacauugugaugua

SEQ ID NO: 1418 - RNA, 71 nt, Tobacco mosaic virus
gaucagaggaaccggaucuuauaaucggagcucuuucgagagcucuucugguuugguuuggaccucugguc

SEQ ID NO: 1419 - RNA, 131 nt, Ovine adenovirus A
ccauugccgaaggcacaacccgccgccgacgcagagcagagcgccgccgcaggcgucgucaagcaacgagcgcaaugcgagccgccagagcucuagucaggucagcuaggcggcguuuagccaggcgaggg

SEQ ID NO: 1420 - RNA, 60 nt, Paramecium bursaria Chlorella virus 1
aagugucauuugacccugaaugacgaauaaaauaaaagugucauuggucaucugucaguu

SEQ ID NO: 1421 - RNA, 91 nt, Acute bee paralysis virus
gaauauuauuauugaaauuaugugagccacguagcaaucaagucauguuuuugucacuacguuuacucaucuaauguagauaauuuuguuu

SEQ ID NO: 1422 - RNA, 118 nt, Paramecium bursaria Chlorella virus 1
gucuucguugaaaacuaugcauuuauauuguuuuuuaaccgccguuaaguggcgaaagauacuuuuugcauauacauaugcgguuuuaacguuuuggacauaguucauaucgauuaac

SEQ ID NO: 1423 - RNA, 105 nt, Maize chlorotic mottle virus
gccacagaaccgcacuguguucagguguauacaggcuggucaguuugcugcauugggcagcgccgcugacaagcaaauguauuccccaggacgauucauuguggc

SEQ ID NO: 1424 - RNA, 71 nt, Melanoplus sanguinipes entomopoxvirus
auuaaaucauuaauuucuuuauuugauaaucguuugacuggcauaucaaauaaauuuuuuaauccuuuagu

SEQ ID NO: 1425 - RNA, 130 nt, Parvovirus H1
agauacauacguucgcuauggaccaagugguaccgguugguugcuaagcucgaacaagacggcuaagccgguccgguugguugagcgcaaccaaccgguaccacuugguccauagcgaacguauguaucu

SEQ ID NO: 1426 - RNA, 60 nt, Rabbit fibroma virus
uauugcuuuauuacuucauuuuuauuauaaauaacugauaaaaaaguacuaccagcgaua

SEQ ID NO: 1427 - RNA, 67 nt, Acute bee paralysis virus
aacaacuuauaacacgauguuacccgaagaaaccauuuuaguguaacauuuaagauuagaaguaguu

SEQ ID NO: 1428 - RNA, 64 nt, Human herpesvirus 4
ggguggugucugcagcaaaagaggaacuugcccaggcagucaguuauuuugcaugccaccuccc

SEQ ID NO: 1429 - RNA, 117 nt, Human herpesvirus 4
ugggggcuucaugaucccaccgccuuucccgaugaugaugacaaccgcggcugucugaagcggcugacgaaaucgguugagauucugaugagaggcuugggggggucuuugcccuca

SEQ ID NO: 1430 - RNA, 77 nt, Leek yellow stripe potyvirus
gaguaagucugaagccuuuaugguguauaagcggcccgaauuuugauaacccaccuuuacccugcgacggagugcuc

SEQ ID NO: 1431 - RNA, 66 nt, Leek yellow stripe potyvirus
ucgagcuguucauuugaagacacugagagugguuaaccauguguguguuccuauguugcaguaaga

SEQ ID NO: 1432 - RNA, 70 nt, Chimpanzee cytomegalovirus
acgggucauccgacaaacaugaugcacuucguggucaggcagcugaugauguacccgcgucugaucccgu

SEQ ID NO: 1433 - RNA, 60 nt, Macaca mulatta rhadinovirus
ucugcugguacaaggaauggccguuaccgguugacguugauuuuauguacuaccuacagg

SEQ ID NO: 1434 - RNA, 71 nt, Human herpesvirus 8
ggccacaggauguagaucgcagacacugaaacgcugaaacacagcauuaagcugcaauaccgccgauggcc

SEQ ID NO: 1435 - RNA, 69 nt, Yaba-like disease virus
accgauucuuccuguuugaacgucuauuuuuuuguuaagaauuaucauguuuuuucucacaguaucggu

SEQ ID NO: 1436 - RNA, 67 nt, Gallid herpesvirus 3
guaauggggaaccgaaaacugaaccaaauacagaaauuagaagaggaacaucggcuuuucccguuau

SEQ ID NO: 1437 - RNA, 90 nt, Human adenovirus C
caugggcggcgauauaaaaugcaaggugcugcucaaaaaaucaggcaaagccucgcgcaaaaaagcaagcacaucguagucaugcucaug

SEQ ID NO: 1438 - RNA, 120 nt, Human herpesvirus 2
ggcccgggcugcgcacgccagccgggacgggugaguucgcuaggcaagcacggacuggcgguuacacgugcaugcgugccgagugaacucucccgccccgacgcgcuccggcuccgggcc

SEQ ID NO: 1439 - RNA, 97 nt, Paramecium bursaria Chlorella virus 1
guguuccccagagcgucuguguauucaguuucuuucuugauuuccaacuuaaucgcaucgagcaucgcggcugauugcccgguaaucuggacaacac

SEQ ID NO: 1440 - RNA, 63 nt, Paramecium bursaria Chlorella virus 1
uucguaauacuugauauacucgucagaaagcaguuucuucagagucuuccugaaaguuacgaa

SEQ ID NO: 1441 - RNA, 72 nt, Paramecium bursaria Chlorella virus 1
gacgcuaaccuccuccuugucaguguacaacugcacacggcuguacauaucagaaggauuuauauuuggcuc

SEQ ID NO: 1442 - RNA, 82 nt, Human herpesvirus 5
ccccccucccccuguggucccccgagacgagagccacccaucguguacucucgcaccacccacgaccacagagggagacggg

SEQ ID NO: 1443 - RNA, 76 nt, Zaire Ebola virus
agcgauuuaucuaaauuaaauuacauuaugcuuuuauaacuuaccuacuagccugcccaacauuuacacgaucguu

SEQ ID NO: 1444 - RNA, 105 nt, Cercopithecine herpesvirus 7
aguucuacauaccagugauuuccacgccuuuuuguuuauuuacgccuuccgcauucuaaauaagugguguuuuauaaauccccugcuucauugguuuuaaucacu

SEQ ID NO: 1445 - RNA, 80 nt, Human herpesvirus 2
gggggagggacggggaagggggcgcgcggggcugcccugccgcccgcccgccgccgccgcccgccuucgcgccccccccc

SEQ ID NO: 1446 - RNA, 115 nt, Monkeypox virus
aucuaguuguaugaguuuaucguuuacauaagcaauuaacggcuuuaacagaugaucugaguaauaauauaccucuguuauacguuuaauguucacggucuuaguauuuuuagau

SEQ ID NO: 1447 - RNA, 89 nt, Monkeypox virus
aaaauaaauuagaagcugugggucauuguuaugaaucucuuucagaggaauacagacaauugacaaaauucacagacucucaagauuuu

SEQ ID NO: 1448 - RNA, 100 nt, Equine herpesvirus 1
gccgucuugcgaaucgugacgcuggagauguugcaacaccugcauugagcaacuguguauguauaacucaucccggauauuguuucaaccguuugacugu

SEQ ID NO: 1449 - RNA, 84 nt, Rat cytomegalovirus
cacccguaguuaacgcaucuacagauccauuacugaaguacacauuaacguugcuuaucugaagaguagaaauaauuacgggug

SEQ ID NO: 1450 - RNA, 60 nt, Monkeypox virus
guuuaauguucacggucuuaguauuuuuagauaucaauugugauuuacaccauauucgac

SEQ ID NO: 1451 - RNA, 66 nt, Monkeypox virus
ccaccgcaauagauccuguuagauacauagauccucgucgugauaucgcauuuucuaacgugaugg

SEQ ID NO: 1452 - RNA, 99 nt, Equine herpesvirus 1
gaggagagacgcgacuucuggcaugcagccugcuccggacacggauucccaauuaccaccccaagcacggcugcuauucuauuuuaugugucucugcuu

SEQ ID NO: 1453 - RNA, 90 nt, Equine herpesvirus 1
gcucucuaccuacaagaaucauuagugcugaagguuccuuucgggguuuacagcgcuaguauuagaguuuuguaagaguuuauuauuagc

SEQ ID NO: 1454 - RNA, 89 nt, Camelpox virus
aaaauaaauuagaagcuguuggucauuguuaugaaucucuuucagaggaauacagacaauugacaaaauucacagacucucaagauuuu

SEQ ID NO: 1455 - RNA, 131 nt, Swinepox virus
uuuauaguuagaaauggauaauugaaauauuuucucuaauaccaauaaucuuaauauaaaaucuuuuauccucaucucaucguggugaauaaaugagucuuucaauauauccgaaauaucuaacucaugaa

SEQ ID NO: 1456 - RNA, 104 nt, Myxoma virus
agucguugaaacaauuguuuaacaaacaacccguguacguugagagcgacucucccauuugcguggauaagggauauuuggcagauuuuguucucgcaacgacu

SEQ ID NO: 1457 - RNA, 73 nt, Canine adenovirus
uugcuguuacaauagugggcccacugugacuagaaagccuucgcacagcccugagauuauaaguagacugcaa

SEQ ID NO: 1458 - RNA, 79 nt, Canine adenovirus
agugguccuucaaaguuauguugcacucauagaaguacacaccuccggcauccauucugaaaaauaacaaaacaccacu

SEQ ID NO: 1459 - RNA, 124 nt, Human papillomavirus type 65
uaagaaugcauuuguucugccaauagaaacuuaaacugagccaauuauuauauaaucuuuggaaacguguauguauuugcuuuuucugugagaaacuugaguaaaauaaacugccacauucuug

SEQ ID NO: 1460 - RNA, 91 nt, Human papillomavirus type 50
ugcauuuuaugcaaaaaaagaaaauaugagcaggcuuggauuacaaccucuuccuccugcuaagguuucugagcaaaaagcaaaagaugca

SEQ ID NO: 1461 - RNA, 82 nt, Human adenovirus D
gcccugagcucgcgccucaaugucagcugcaaaaagucacuuaaguccugggccacuacagcugacaauucagagccagggc

SEQ ID NO: 1462 - RNA, 66 nt, Canine adenovirus
auaaguagacugcaacaacaucgaaaccccgcgacacaaaucugucucgcggucuugcucucuuau

SEQ ID NO: 1463 - RNA, 82 nt, Sheeppox virus
caucuauaucauuucuauauaaaaauuuugcaauuuuaaaaaauguaccauugucaaaucuagccauagaaucauauauaug

SEQ ID NO: 1464 - RNA, 84 nt, Sheeppox virus
aagguuucaucuaauccuuuuuccaauaacaaaaauuuuucguuauaaauuuuuucuauaucuauagggcauauaauauuccuu

SEQ ID NO: 1465 - RNA, 71 nt, Bovine herpesvirus 4
gagagugugccuuagcuugaaaggcacucuaaagcuaaugcucuagagcuucaggucagaggagugcucuc

SEQ ID NO: 1466 - RNA, 85 nt, Walleye dermal sarcoma virus
cccucacaguugcugugguguugugauuccucuucugcagaagauauuaauaaaguguauaacagacaaaugugacuggccuggg

SEQ ID NO: 1467 - RNA, 109 nt, Walleye dermal sarcoma virus
ccuaccuacacuaauaaacuggugaguaccuuuauauuuucucauaacuuugucuaaauaaaacaauaaaaagagauaaauaagguacaagauccagcauguagguggg

SEQ ID NO: 1468 - RNA, 85 nt, Paramecium bursaria Chlorella virus 1
ggacaaaccgugaaaaugcccaaugaacgccucaaggaacaccaacgagaaucauccaagugucauaggcuaaaacacgcucucc

SEQ ID NO: 1469 - RNA, 101 nt, Paramecium bursaria Chlorella virus 1
uucaugcuguagaaaaaauugccauugcucucgaagauucaacagguccaaacggccuuaacauaaccaucgggggugcuggagugaagaagccagaugaa

SEQ ID NO: 1470 - RNA, 84 nt, Variola virus
uauaauguacuagauaauauuauaaagccuuuauuuaaccaaccuaucuucaaaggaccgucugauguuaaaugguucgauaua

SEQ ID NO: 1471 - RNA, 96 nt, Molluscum contagiosum virus
cgcaguucggcgacacgcccgcgucccgacagcagagguaaucccgagcuucuaaaucgcgcgcgggcucaagucgcccuuuuugucucgaacucg

SEQ ID NO: 1472 - RNA, 71 nt, Fowlpox virus
cucuugaagacauaaauacuauuaagaaauauauggacuuuauucuaagcguucuuauacguucuaaagag

SEQ ID NO: 1473 - RNA, 91 nt, Lumpy skin disease virus
aggguacuuaucagauuuuguuacgacauugaugagauuaaaaaaagaacuuuuuuuagaaucaccagagccgauaacauauauagacccu

SEQ ID NO: 1474 - RNA, 129 nt, Molluscum contagiosum virus
cuggccgggcucgggcucgaggugugccuguuugccacggccgcgcgcgacuuuguccugagccuuuuggcggcgcaaggacaccgcgggcgugcccggcguuggcuuucugugcgcgacgccugcuag

SEQ ID NO: 1475 - RNA, 102 nt, Molluscum contagiosum virus
gaccuuucguccggugucggacgccucaagcaugccaggcgcaggcgccgcccugcuagcgcuccgcgugcgagaagauccgacacuacucggagagacguu

SEQ ID NO: 1476 - RNA, 82 nt, Molluscum contagiosum virus
cgcgggcagggauccuucacgcgcgggcccgugguagccgcgggcccuuccuucugcucgggcccgaccuuuccugcgcgcg

SEQ ID NO: 1477 - RNA, 122 nt, Macaca mulatta rhadinovirus
guuaucgcgccaccuuguggcuacauuauauagcacgaucacuuuccacguuauacuuucacguacuaugacucauacgccuuaacgucacguggcgugcgauuguggccggggcugaaaau

SEQ ID NO: 1478 - RNA, 63 nt, Bovine herpesvirus 4
ugguccuggcuacacacccaaaggcacgucagacagugucucuaaaucaguguaccaagacca

SEQ ID NO: 1479 - RNA, 89 nt, European brown hare syndrome virus
gguuugauuuaaguaaaugaauuguuuagugauuuaaauuugaguuuaauuagauuaguuguuuagugauuuauaguuuaaagcaaauu

SEQ ID NO: 1480 - RNA, 63 nt, Human papillomavirus type 24
uccagagaaccauuuuaaaaaaggaccuauaaauguggagguuauauaugauggugauccgga

SEQ ID NO: 1481 - RNA, 91 nt, Equine herpesvirus 4
agaggcgcgacuuuuggcaugcagccugcuccggacacggauuuccaauuaccaccccgagcacugcagcuauucuauuuuaugugucuuu

SEQ ID NO: 1482 - RNA, 131 nt, African swine fever virus
uauggugauauaguaaugagugccugcacaagugcuugcacaggugcuugcacaggugcuugcacaagugcuugcacaagugcuugcacaagugccugcacaagugcuuguacacauuacugcaucgccaa

SEQ ID NO: 1483 - RNA, 70 nt, Ectromelia virus
aagauaguauucaucuucaugcuauuuaauacaucuaauauauguauuggucauuaaaaaauauuauuuu

SEQ ID NO: 1484 - RNA, 63 nt, Molluscum contagiosum virus
gcucgcgcacacgccguacacacugcagcaguuacuguucugcccucuacggaggugcggggc

SEQ ID NO: 1485 - RNA, 62 nt, Beet virus Q
uuguuauuaauacuaguugauuuuucuagcaucuuugucguguugaucuaguaugugugcaa

SEQ ID NO: 1486 - RNA, 64 nt, Beet virus Q
auuucuggucucuagacgcugguaguucaauaaauaaaaaacuaucauuugucguuacagagau

SEQ ID NO: 1487 - RNA, 98 nt, Human papillomavirus type 63
gcuauagaaaugacucuuuaucuuaguggccucagagacucacaauaugguucugaacaguggucuuuacaagauacuagcagagaaaucuuuuuagc

SEQ ID NO: 1488 - RNA, 87 nt, Melanoplus sanguinipes entomopoxvirus
uaauaaacgauuuaauuaaauuacuauauauauauuuacaacuauccuuugaaguauauaauucaauauuuuguauauuauuuauua

SEQ ID NO: 1489 - RNA, 67 nt, Cowpox virus
gugguaucaggaguacaucuugcacaacuauugacggcaggcaccguacauuuuaauccuggaccac

SEQ ID NO: 1490 - RNA, 78 nt, Ectromelia virus
uguugugguaucaggaguacaucuugcacaacuauugacggcaggcagcauacauuucaauccuggaccacauugaca

SEQ ID NO: 1491 - RNA, 63 nt, O'nyong-nyong virus
uuggugcccccuuagaggcacauuauagaaccagguauaggugcccccuuagagguacaccaa

SEQ ID NO: 1492 - RNA, 70 nt, Human herpesvirus 6B
cauuugugcuagaugagcggcaaagaacucaucuuucugagauuuuucugggauuauucugguaaaaaug

SEQ ID NO: 1493 - RNA, 66 nt, Fowlpox virus
aucucaaggaacuuaaaugaagaguuguagacaaacuuaguaaucuuauagaaaguuuaugaagau

SEQ ID NO: 1494 - RNA, 130 nt, Yaba-like disease virus
uuccagcaauaucauuuuuguacuuaaaguauuauccuguaaaucgucauugaugguauuauuguaagauaaauuaaugguuuuuacagguaaaagugguucaagagauucaaaaaaacuauuauuggga

SEQ ID NO: 1495 - RNA, 96 nt, Garlic virus X
gcuaccacacggaggccgauaccgggacggcaacaaauucgucagcuacaacgguccgaacacuggcgccuccucacacagcaucugguggccagc

SEQ ID NO: 1496 - RNA, 72 nt, Garlic virus A
uagccguccucgccgccgcaucugcauacgcugcucugagucucauuaaaggugcgccgcaagggugcguua

SEQ ID NO: 1497 - RNA, 62 nt, Macaca mulatta rhadinovirus
aauauauauauaacguuuuuuacguaaaacauauuguaauuuaaucacgugauguuuauguu

SEQ ID NO: 1498 - RNA, 96 nt, Human herpesvirus 5
cucgggggauagugaggaauucucaagggauacgggacccaaugacuggauaagagaaggguuuuuccccguaagaugauccucguaucacaugag

SEQ ID NO: 1499 - RNA, 101 nt, Sulfolobus virus SIRV-1
ggagguggagcugguagaaauucuagauauuuuauguauuuagaaaaagaagaugacaagaaauauauaguagcaguugccuggcuucaugauaauacucc

SEQ ID NO: 1500 - RNA, 100 nt, Camelpox virus
uaguaaaugugauuguauguuguuacauuuccaugucaauagaguuuauaaaaauuuuuauacauuaucuuccaacaagcaauugacgaacguauuacua

SEQ ID NO: 1501 - RNA, 88 nt, Camelpox virus
gacuauaccuagugcuauuuugacauacucguguucuuguguaauugcgguaucuauauuauuaaaguacguaaaucuagcuauaguu

SEQ ID NO: 1502 - RNA, 97 nt, Fowlpox virus
acauuaguauguuuauuucauaaugucauuauuaguauuuaguaguuagcaagugccauauuacaacuaauaagaucaaaaauaaaacugcugaugu

SEQ ID NO: 1503 - RNA, 91 nt, Human herpesvirus 1
gauggcccuccaggcugucgacgcccccucccuguuugucgccuggcuggccgcucgguggcuccggggggcuuccggccugggggccguc

SEQ ID NO: 1504 - RNA, 66 nt, Taura syndrome virus
guacuaucaguuaaccacucuugaauaugcucaaugacccuauucaacacuggugucucuuaguac

SEQ ID NO: 1505 - RNA, 131 nt, Human herpesvirus 5
gaaaucggauaacggcacgcggaaaggucucagcgaguuggacacguuguuuagccgucucgaagaguaucugcacucgagaaaguagcguugcgauuugcaguccgcuccggugucguucacccaguuac

SEQ ID NO: 1506 - RNA, 84 nt, Reston Ebola virus
ucuuugcuugauuuacaauaugauauuucucuuaauaaugauuaauauauuaagaaaaacuuaugacgaagauuaaaggagagg

SEQ ID NO: 1507 - RNA, 83 nt, Avian leukosis virus
gcuuaacuaaggggacuauggcauguauaggcgcaaagcggggcuucgguuguacgcgguuaggaguccccucaggauauagu

SEQ ID NO: 1508 - RNA, 79 nt, Vaccinia virus
gagauuguaucaguuucguagucuugaguauugguauuacuauauaguauauagaugucgacgcuagauauacagucuc

SEQ ID NO: 1509 - RNA, 102 nt, Sulfolobus virus SIRV-1
ugagaaacugaagaaagaugguuuugaaguucuauggacacuugguuuuccagaccauaguaaugcuuuauauaaaaaagccggguucaaauuaguagguca

SEQ ID NO: 1510 - RNA, 79 nt, Variola virus
gguacgacgagaaucuuuauaccuuuccuggaauaucauuaacuguugccaaugauguuaggaaauauucuguuguguc

SEQ ID NO: 1511 - RNA, 92 nt, Sugarcane striate mosaic associated virus
gucuuagaacuagugcuuugucaaucauuuaauggccaaggcaaggcauugucuugggcacuauuugauugacauuguggucuuucuaagac

SEQ ID NO: 1512 - RNA, 63 nt, Chimpanzee cytomegalovirus
acgucgcuuguacacgucguucguggcccaaagacacggguggcggguacggggacacggcgu

SEQ ID NO: 1513 - RNA, 84 nt, Variola virus
cauuguaaaagaaauauaugugguguuacaguuaggugaacaagagauauauuggagcauugcugcauauguuugagugcaaug

SEQ ID NO: 1514 - RNA, 76 nt, Fowlpox virus
gguaauacuuuucuaaaaacuaaucucaaguauuguuuacaagcgacugaaguaauaguuuuagcaaaauaauacc

SEQ ID NO: 1515 - RNA, 120 nt, Igbo Ora virus
accagguauuagugcccccuuagaggcacauuauauaaccagguauaggugcccccuuagaggcacacuaacaauagguauaagugcccccuuaguggcacacuaaccaccacaauuggu

SEQ ID NO: 1516 - RNA, 82 nt, Paramecium bursaria Chlorella virus 1
caccauugcuaugaccgugccccggguaaucaauaguagcuauauugauaccauugcgugcaaaagguuucagcacaugcug

SEQ ID NO: 1517 - RNA, 78 nt, Amsacta moorei entomopoxvirus
ugacagauaauaauauauuuaccgugauuuuaauuaaacaucacauccaaaguaauauuaaauucgaagauacuguua

SEQ ID NO: 1518 - RNA, 64 nt, Human papillomavirus type 50
ugugaauucuauacugugaaugcuuuagaucugagucuugaacauuucacaaaaugaauaaaca

SEQ ID NO: 1519 - RNA, 62 nt, Ovine adenovirus 7
uucguuuuucagaaaacucaaguguucagucauaucaaguucacuugccucugaaacacgaa

SEQ ID NO: 1520 - RNA, 90 nt, Fowlpox virus
caguaaagguauuauuuugcuaaaacuauuacuucagucgcuuguaaacaauacuugagauuaguuuuuagaaaaguauuaccauuaaug

SEQ ID NO: 1521 - RNA, 128 nt, Beet soil-borne mosaic virus
cggugccauuuuuccaaauggggguugcauuauggauaggaauucguuugcacaguuuggugguugugauaucccaaaauauguggcugauucuaucucucguguggccaucaaggaauuagacgccg

SEQ ID NO: 1522 - RNA, 76 nt, Equine infectious anemia virus
ucucuacucagucccugucucuaguuugucuguucgagauccuacaguuggcgcccgaacagggaccugagagggg

SEQ ID NO: 1523 - RNA, 82 nt, Amsacta moorei entomopoxvirus
aauauguauauuauaugcucaaacuaagguagauauggaauauuuacauuuuaccgaagaagauaauauaaauauacaaauu

SEQ ID NO: 1524 - RNA, 69 nt, Human herpesvirus 5
cgcgguuucuuacgcgggcugagcucgggaguagcggaugccccggggagaggaguguuaguaaccgcg

SEQ ID NO: 1525 - RNA, 70 nt, Equine herpesvirus 2
gauucucauguauguguuuuguaaccugacauuaaaaagucuguuuauaaaauaccugcauguugcaauc

SEQ ID NO: 1526 - RNA, 76 nt, Swinepox virus
uguuuauuuaguaugguaacuguauaugacggaauuaaugcuucuaucucuucauaaacuauauuauuuauaaaua

SEQ ID NO: 1527 - RNA, 104 nt, Swinepox virus
uauaucuaauauacuuggauuauuucuguacaagaauuuagcuauucguaaaauaguuuuauuaucaaaucuaggaaucaauucauauauaugcauacgauaua

SEQ ID NO: 1528 - RNA, 76 nt, Paramecium bursaria Chlorella virus 1
acuggccacucacccauguuguauugcaaccaacguuguuuggcuuucugcaccgcaaucccgugaaugguccggu

SEQ ID NO: 1529 - RNA, 87 nt, Arctic ground squirrel hepatitis B virus
aaauaauuauccugauuucucuauagaacacuuuuuugcagcugcaacuuauuuauggacuuugugggaaucaggaaucuuguauuu

SEQ ID NO: 1530 - RNA, 64 nt, Human papillomavirus type 54
gccuggagugugcauugcaauacaaagcccgggaaaugggauacaaaguguuacagcaccaggc

SEQ ID NO: 1531 - RNA, 127 nt, Indian citrus ringspot virus
ggucgucuuugcuccgcgucaauuucugaacgcuuggcucuacuccgcgagggaccgauuaggucauugaccgaaaaucccaucaacgcuagagcugcgcacuucuuggcgcacgagcuccucgacc

SEQ ID NO: 1532 - RNA, 107 nt, Variola virus
gauuuauuguguauggaagaaguaaccauauuacauaauauauacaggcuauuuacaagaugcgccguaccguucgaugauauaguacguacuaugccaaaugaauc

SEQ ID NO: 1533 - RNA, 71 nt, Fowlpox virus
cguaguggacuuucgcuuugaagaguuaauguuaauauauuuacuccauagauucgauauaauuuauuacg

SEQ ID NO: 1534 - RNA, 62 nt, Fowlpox virus
uaauauauguauaaucuuauagguuaaaauaacacuaacuaucagauuuaucauuaauauua

SEQ ID NO: 1535 - RNA, 98 nt, Gallid herpesvirus 2
gcauuagauaacugcagaaagacgcugcguauaguuauguauucuuagaauacgucuguauauacgcacgaacauauaagucuguaagaauguaaugc

SEQ ID NO: 1536 - RNA, 128 nt, Gallid herpesvirus 2
cuuacccuuccccaacuuucucugucggucgugguauauugaggccgguguauguagagagucuacgaucuucgaucucccuucggaucacauggagcggagauguuguaggguucgagaggggugag

SEQ ID NO: 1537 - RNA, 68 nt, Indian citrus ringspot virus
guagucgguacuuaggcucaagccguuccgccgucaaaaggcgggcugccaggcucaauuacugcuac

SEQ ID NO: 1538 - RNA, 62 nt, Paramecium bursaria Chlorella virus 1
cguaggagaucuuggcaauauucuggcggauaagaacggaaaagccaaguauucguucuaug

SEQ ID NO: 1539 - RNA, 73 nt, Paramecium bursaria Chlorella virus 1
cugauacggaugaucuugguuuagguggcaacgcugaaaguuugaaaaccgggaacgcaggaaaacgaaucgg

SEQ ID NO: 1540 - RNA, 86 nt, Fowlpox virus
cacuaaaaagacauauaguaguagguuaccuauuauccuuaaggcucaucauguaugaccuacguuuauuauaaucucgccgagug

SEQ ID NO: 1541 - RNA, 69 nt, Fowlpox virus
gaagcuaaagaauuaagaaaacaguaucgcgauacgcaagaacuauuaccauuuuaaucggagagcuuu

SEQ ID NO: 1542 - RNA, 70 nt, Amsacta moorei entomopoxvirus
uuuuuuuuaauauagaauauaacauuuuaaauaauauauuauuaauauuuauauauuuuuucaaaaaaaa

SEQ ID NO: 1543 - RNA, 61 nt, Myxoma virus
gggaauguguuuaaccuuaucuaucuuaauaaaagaagugcuaccuaguaaacauuuuucc

SEQ ID NO: 1544 - RNA, 61 nt, Bovine herpesvirus 1
cacccagacgcucggcacuuagcucucgagugauugccuggcugcuugccccguuugcgug

SEQ ID NO: 1545 - RNA, 60 nt, Bovine herpesvirus 1
gccccguuugcguggaaugaggccaaacaagcauuuggccccuguuugucuagacggggc

SEQ ID NO: 1546 - RNA, 82 nt, Bovine herpesvirus 1
ggggcuuuguguuuuucccaccccugcccuugccccuggccgccuggccggccggcuaaaguauaggccagaccaaaccccc

SEQ ID NO: 1547 - RNA, 109 nt, Fowlpox virus
ggugauaagucuuauauagcaauauagaaguaaacauaggcaaaacaaguauucuaauagauauuuugcuaacuauguaguacaauauaaguauauuaauuuuguuacc

SEQ ID NO: 1548 - RNA, 85 nt, Yaba-like disease virus
auuauuugauaaguuuacuaauaaaugguuaaaauuagacucguuaaugucuucuucacucauuuaaaacuuauaaacaaaugau

SEQ ID NO: 1549 - RNA, 87 nt, Saimiriine herpesvirus 2
guucgucguuccguguccagggggagcgucccagccggcgacguuuugacgagcuguugcuuucccugacgaaccuucugcacgaau

SEQ ID NO: 1550 - RNA, 95 nt, Saimiriine herpesvirus 2
ccguguccucgcuuucuucucucuccgcuuccccgcgauccgguccuucguucggucggcuuucacgggguuagaaaaagagagcgugcgcgcgg

SEQ ID NO: 1551 - RNA, 68 nt, Human adenovirus E
uagaauacggggauauagauguuuuacaaacaaaugcuagaacauuuuugauuaauauagccuuucua

SEQ ID NO: 1552 - RNA, 67 nt, Human adenovirus E
ggcgguaacaaauucagaguacgcuauacguaauaaaacgauguacacguacuuuucaaauaccgcc

SEQ ID NO: 1553 - RNA, 60 nt, Human herpesvirus 5
ggcuucguugcguauggccaccaccacguuaaagagagacgguggcaccagcucgaagcc

SEQ ID NO: 1554 - RNA, 71 nt, Human adenovirus E
caauuugcaaaacaguuuuucugcugauuuggaucaguuuccucuuggcaggaaguuuuuaaugcagguug

SEQ ID NO: 1555 - RNA, 71 nt, Human herpesvirus 5
ggcgacaugguugauauuggguuuggugccauggauuuuaaaacauuacaggaaucuaaaucagaugugcc

SEQ ID NO: 1556 - RNA, 65 nt, Human herpesvirus 5
gugcuuaagugcuaucgcuuucgggaacgcaaaaaaaaaagaggcuuaguaaaauauuauaguac

SEQ ID NO: 1557 - RNA, 85 nt, Human herpesvirus 5
gagcacagacaacaauucauuaggacuaugaaauuaccaccuacaguagauuggucuuuaggaaauguugaugaucuguaagcuu

SEQ ID NO: 1558 - RNA, 62 nt, Cryphonectria hypovirus 3
cugggguaaacauuuugggacaaccuccuauggcauuuagagguuuuugcccaauuucccag

SEQ ID NO: 1559 - RNA, 71 nt, Human herpesvirus 5
ccaacagaugcauauguaaagcgcaccaauauauuuuaucaugcaggcagcucacguuugcuugcuguugg

SEQ ID NO: 1560 - RNA, 68 nt, Cryphonectria hypovirus 3
guugacauguggagccacuggcgcguugccgacaacggcgacgacaauaacccgcuccgccacgcagc

SEQ ID NO: 1561 - RNA, 103 nt, Cryphonectria hypovirus 3
caacacacaagccaauaugugcugcuaacacaccuauauaccuguaaucauuauuccuuuuauaguuuauguguuugugcuuugcguguguguguguguguug

SEQ ID NO: 1562 - RNA, 114 nt, Equine herpesvirus 1
gcgggcguggggacccggggagagaccaccaggccucgccgguuuucucucucuccguugggggggggaugguagggauuggugggugaggugguugugguagucauugugagu

SEQ ID NO: 1563 - RNA, 131 nt, Equine herpesvirus 1
uggucucauaaaaaaaguuuuacaaaaauauuuuuauucucuuucucucuucaauggucucacaaaaauauuaaaccucuuucugauggagucguaaaaauauuuuuauucucuuucugaugucucaacua

SEQ ID NO: 1564 - RNA, 123 nt, Equine herpesvirus 1
ccgagcgggggagagcgguaggggaaacgccgccugggaugagugggaccgaguagugugugauaggcacuagagggcgccagcguacaggggaguguacccaccaaaacuccaacaccacgg

SEQ ID NO: 1565 - RNA, 91 nt, Equine herpesvirus 1
uuuuucuuugguacaaaauuucacacaaguuuuuauacagacaaauucuuguccauauauuuuaaaacauugacuuuuguacuaagaaaaa

SEQ ID NO: 1566 - RNA, 82 nt, Equine herpesvirus 1
aaaauauuuuuauucucuuucucucuucaauggucucacaaaaauauuaaaccucuuucugauggagucguaaaaauauuuu

SEQ ID NO: 1567 - RNA, 124 nt, Equine herpesvirus 1
ugggaaguacaauaugggggcaauguaauugauuguaaugacucuaugugcaguaccagugacgacacgguauccgcuacucagauuguuagacagcuacaacacgccuccacgucgaccccca

SEQ ID NO: 1568 - RNA, 124 nt, Equine herpesvirus 1
accucuuucugauggagucguaaaauauuuuauucucuuucucucuucaauggucucacaaaaauauuaaaccucuuucugauggagucguaaaauauuuuauucucuuucucucuucaauggu

SEQ ID NO: 1569 - RNA, 82 nt, Equine herpesvirus 1
auaaaaaaguuuuacaaaaauauuuuuauucucuuucucucuucaauggucucauaaaaaaguuuuacaaaaauauuuuuau

SEQ ID NO: 1570 - RNA, 81 nt, Equine herpesvirus 1
aaaauauuuuuauucucuuucucucuucaauggucucacaaaaauauuaaaccucuuucugauggagucguaaaauauuuu

SEQ ID NO: 1571 - RNA, 109 nt, Equine herpesvirus 1
uacauaugcaugcuuuacacaccauacaauaauuacuauaauguacaguacaguguaacauaccugugaugugcauguuguuguauuuuuguauuuuuguauuuuugua

SEQ ID NO: 1572 - RNA, 82 nt, Equine herpesvirus 1
aaaauauuuuuauucucuuucucgcuucaauggucucacaaaaauauuaaaccucuuucugauggagucguaaaaauauuuu

SEQ ID NO: 1573 - RNA, 123 nt, Equine herpesvirus 1
ccgugguguuggaguuuugguggguacacuccccuguacgcuggcgcccucuagugccuaucacacacuacucggucccacucaucccaggcggcguuuccccuaccgcucucccccgcucgg

SEQ ID NO: 1574 - RNA, 128 nt, Equine herpesvirus 1
gaauuauuauuauucuuauuauucuuauuccacgagaguaugagcucgucuguaagagccugaacgaugauuauucuuauuucacgagaguaugagcucgucuguaagagccugaacgaugauuauuc

SEQ ID NO: 1575 - RNA, 106 nt, Equine herpesvirus 1
gcgggcuggucaucggcauucuggcgcaccggugcgcgcuccuccccuuggucuucccggcaaccccgcgcacggccgcgugcggcgugccgugggacgagcccgc

SEQ ID NO: 1576 - RNA, 73 nt, Fowlpox virus
uauucuuauuucaugagaguaugagcucgucugugagagccugaacgaugauuauucuuauuucaugagagua

SEQ ID NO: 1577 - RNA, 81 nt, Fowlpox virus
ccgugaucgauccccucccgcccgguggccccgaaacgagggucgauuucaacggacgccccgggaggaaaaaaugcacgg

SEQ ID NO: 1578 - RNA, 69 nt, Cowpox virus
augaaguuaaugauacacacuacacugucgaauuugauagggacaaaguaguugacgcguuuauuucau

SEQ ID NO: 1579 - RNA, 88 nt, Cowpox virus
uggccuuccagaugcuaacuuuuaugacccuaacacacagcgccuugugugggccuguuuaggcguggagguggggcguggacagcca

SEQ ID NO: 1580 - RNA, 63 nt, Cowpox virus
ccuccacaguuacuacaccauauaauaaugagaguuuuaaagaguaccugcgacauguggagg

SEQ ID NO: 1581 - RNA, 88 nt, Fowlpox virus
uauucuuauuucaugagaguaugagcuagucugugagagccugaacggugaucauucuuauuaucauuauucuuauuucaugagagua

SEQ ID NO: 1582 - RNA, 109 nt, Cowpox virus
uaagggcagggaggagauacguaugcaaaagcgggggggacugcggucaacaauaaguaaaaacccgcccgccacaucuuucgccacaaucggccuccagaggcuuuua

SEQ ID NO: 1583 - RNA, 63 nt, Cowpox virus
uaacguugcuuauauuuauguuguuguacccagugugcaugauuuauguaugugugcauguug

SEQ ID NO: 1584 - RNA, 66 nt, Cowpox virus
caaaaccacaacacugcuaauccucuggcuuccugccucuccuacugcugcauaccugugguugug

SEQ ID NO: 1585 - RNA, 67 nt, Simian T-lymphotropic virus 1
uggucuguguuaaaucccuucuauauuauuauugauguauuguuguagaaaacuauuacuuagacca

SEQ ID NO: 1586 - RNA, 67 nt, Cowpox virus
cugaaauacccguaaacggggauguauaaacgcaaaaugcccgucccucccgaauggcguauauuag

SEQ ID NO: 1587 - RNA, 95 nt, Cowpox virus
aauccaacccucuuuguacaaaaugcuuuuggcaguacauuucuaagaguuacucaugcuaauugcauaguuggccacaauuucaggguuggauu

SEQ ID NO: 1588 - RNA, 94 nt, Simian T-lymphotropic virus 1
aaguuuggccuuccugauccaucuuucuauaauccugaccaggaacguuugguaugggccuguguagguuuggagguaggccgaggucaaccuu

SEQ ID NO: 1589 - RNA, 76 nt, Periplaneta fuliginosa densovirus
gcugggcucgagcaugacggcgacuaccuccaccugagcgggggggaggacgcgcucaucaagcaucuggcccggc

SEQ ID NO: 1590 - RNA, 93 nt, Paramecium bursaria Chlorella virus 1
gcucugaauuuuucugcgcaugcgcgacuccucaucuacauaauuuaugcacauaaaaggauuagcgcaugcaaauuagucagauagcagggc

SEQ ID NO: 1591 - RNA, 62 nt, Gallid herpesvirus 3
guggcucgcgaccacccaccuggauuuuggaccuggcuuuuggacccguggcucgcgaccac

SEQ ID NO: 1592 - RNA, 103 nt, Gallid herpesvirus 3
ggcugacccaaaauuuuaaaaauugggguuagccauccuguacaaaaauauuacuuuuugagagggccaggcugacccaaaauuuuaaaaauugggguuagcc

SEQ ID NO: 1593 - RNA, 82 nt, Human herpesvirus 7
agcagacagguuagagcacuguugugugaugugagaggaguaagugugucuccaccaucgcauaacaguugauaggugggcu

SEQ ID NO: 1594 - RNA, 114 nt, Human herpesvirus 7
cgauguguuugacaauguacucuuugcuuucaacugcaggguguuuuagaauggcuucaacagauucauuaaaauguucugugguccauagaaagcucugaucaaacuucauug

SEQ ID NO: 1595 - RNA, 67 nt, Human herpesvirus 7
ucuggaucuugguaggcggccgcgagggacuguugcuucuugugcugugaauucuaucuugacugga

SEQ ID NO: 1596 - RNA, 82 nt, Human herpesvirus 6
cccaaugugcaaaugugguuuguauggcuacuuuguguuccuaaaaaaugcaacaauagaaguggaaacccucagucacggg

SEQ ID NO: 1597 - RNA, 89 nt, Human herpesvirus 6
gcgaccucgugaauaugaggaccaacaacccugugcuuggcgcucaggcgcaaguguguguaauuuguccuccagaucgcagcaaucgc

SEQ ID NO: 1598 - RNA, 72 nt, Paramecium bursaria Chlorella virus 1
uugaccggcaaguuccaggcauccuaagugcuugauguagacccuuagggcaccagggacuaccuaggucaa

SEQ ID NO: 1599 - RNA, 106 nt, Paramecium bursaria Chlorella virus 1
cugcuggacggagguaguauaaucagcuaggccucaguauucuauguaacaaaugaaugcccuagaguacugcgguuuagcuaguuauacugcccgguuccaccag

SEQ ID NO: 1600 - RNA, 87 nt, Paramecium bursaria Chlorella virus 1
ccuggaggggugucacauucugugaccgcgacguugacguuagacacacgucgcugccguccucagaaugugauagcccaucacagg

SEQ ID NO: 1601 - RNA, 61 nt, Paramecium bursaria Chlorella virus 1
gcuguugcguugguugggaguuuggggaccaaauuucuauaauuggugucaccgcggcagc

SEQ ID NO: 1602 - RNA, 66 nt, Gallid herpesvirus 3
ccggcaugcuucucgcccgauccccccgaucucacccggccgggcagauccugugagaugcgccgg

SEQ ID NO: 1603 - RNA, 65 nt, Gallid herpesvirus 3
gcgcgcauaauggcggaccuaggccuaaaacccccaggaagcgggucuaugguuggcugcgcugc

SEQ ID NO: 1604 - RNA, 105 nt, Gallid herpesvirus 3
agcccucagaccgcguccgcgccccgggccagccuagcgucgcaaacgucuggaagagucuguggaguuugguuucgagggccgugcggggaaacgcagagggcu

SEQ ID NO: 1605 - RNA, 64 nt, Gallid herpesvirus 3
cguuaagguguacgugcguguacgagaccgcgugcgagcggucucgucguagugcguaugaacg

SEQ ID NO: 1606 - RNA, 62 nt, Gallid herpesvirus 3
gaauauuuuuaaagacuuuuuuccccaaccucuggguuggguuuuuucucuuuaaaauauuc

SEQ ID NO: 1607 - RNA, 131 nt, Gallid herpesvirus 3
cccggggagauaggcgcucgcggagaggggguugggcgaaggacgggggggguggugccuggcgcgcgccccagcccguuccgcacgucuuugccccuugcuccaguuugcagguucccucuuucuccagg

SEQ ID NO: 1608 - RNA, 65 nt, Human herpesvirus 6
acuaacccuaauucgauagcauaugcuucccguuggguaacauaugcuauugaauuaggguuagu

SEQ ID NO: 1609 - RNA, 128 nt, Tupaia herpesvirus
cucccggguacuuacucgcuaacucucgcugcucgggcucgguaaacuugacgcgcuuaguuucgucacagaaggcguccauguugaucaggucaucggccguggguucaaagucaugguucccgggg

SEQ ID NO: 1610 - RNA, 103 nt, Tupaia herpesvirus
uguauuuauguuuauuuuuuuauuauuuauuaauauauuuguguuaaaauuauuuucuacauuaauauuauuuaauaaauuaaaauaagguuuauauuuuaca

SEQ ID NO: 1611 - RNA, 60 nt, Gallid herpesvirus 3
ucccccaaagacacucucggccgaccgcagagggauaacugcgguugggcgcgugggcga

SEQ ID NO: 1612 - RNA, 60 nt, Gallid herpesvirus 3
gagagugaccacacaagaagagaaaaaaagucauuuuaaauuuuuuuauugguuaauuuc

SEQ ID NO: 1613 - RNA, 68 nt, Human herpesvirus 7
aaugcuauggaauuaguagugggacccgggcgugguccaguauccugggucuggccgcuuguagcauu

SEQ ID NO: 1614 - RNA, 123 nt, Human herpesvirus 6
uaucgcagcguugcgacaucgucuccuacauucucguugaauaauaagccuaagaaauuuugcaugcauugcgagauuguaauauucaagcgaagugaagaauuuauguucagccuugcggua

SEQ ID NO: 1615 - RNA, 83 nt, Human herpesvirus 6
agcggggucucggagcuccuaggucagaccacgaaaggucagccugcaagguggauggcguguuuucugagguuauccccgcu

SEQ ID NO: 1616 - RNA, 60 nt, Human herpesvirus 6
gacauuaauucuuacgcucauggguacuucggugacgacccuuaugcguuaaaauguguu

SEQ ID NO: 1617 - RNA, 81 nt, Tupaia herpesvirus
ggaaaacguaaaggugggcccggucagcuggacguccgagucuccgaugccuaaccugauaccuggaucuaccuauguucc

SEQ ID NO: 1618 - RNA, 87 nt, Tupaia herpesvirus
uuguaauaacauuauuuacauuaaauuuaucauuuaauauuuuucuuaaauguauuucaguuucaugugguuuauuuguuauuauaa

SEQ ID NO: 1619 - RNA, 70 nt, Tupaia herpesvirus
cgccgguggcgcguccgcgcggcgggugaggaaaaccgucccuccucggcgcgacggacgcguagcggcg

SEQ ID NO: 1620 - RNA, 96 nt, Tupaia herpesvirus
guagaagucucaggcuagccggcagccccaaaauaaacgugucgucucgaacggaacuaaauaccgggugugugucucugugugugaggucucugc

SEQ ID NO: 1621 - RNA, 60 nt, Simian T-lymphotropic virus 1
guguuuauauaauuguuuaggggcaagucagauuacaguagauuuuaaaaauauuuacac

SEQ ID NO: 1622 - RNA, 73 nt, Fowlpox virus
uauuauguauuuuuauuccgcuagaacuauagaugcuaauguagaaacaaagaaggauuaaaaauagauugua

SEQ ID NO: 1623 - RNA, 63 nt, Fowlpox virus
ggagcuaauaaauacacggguaagcggacggauauacggcgauauaaguguauuggaagcucu

SEQ ID NO: 1624 - RNA, 131 nt, Fowlpox virus
guucugaucuuucuuguacauguucaaguuuucggcgguuaagaugcuuuagagauaguucaagauuuuagauucaaaacaucacuuaucuccacagaucauuuccaagcaauuguacagaaagauagaau

SEQ ID NO: 1625 - RNA, 70 nt, Tupaia herpesvirus
ggcgcgucggcggccgugacucgagcggcgagcgccggccguucgaugagccgcccgaagggacagcgcc

SEQ ID NO: 1626 - RNA, 63 nt, Simian T-lymphotropic virus 1
uuuuuugguuauuggaaaugagauuucugaaaaucuccuugauaagauuuccauuucaaaaga

SEQ ID NO: 1627 - RNA, 69 nt, Fowlpox virus
ggauauccuguaguuuuugaugguuuuuugguugaugacuuacacaagaucaaaaguuacugguaaucc

SEQ ID NO: 1628 - RNA, 65 nt, Equine foamy virus
gucugagggauggcucguccaacaaaccacacaucgaggaauguaauaccuguccucucucagau

SEQ ID NO: 1629 - RNA, 87 nt, Equine foamy virus
uacaguuugcccaauguaaacgauaagcaauaaaggucauaaacagaugaacuuuuaagauuuuauuuuucauacacucgagcugua

SEQ ID NO: 1630 - RNA, 66 nt, Human herpesvirus 5
uggaccgcauggugaccgacgugcgcgaggccguggcccagcgcgagcgguuccaccgcgagucca

SEQ ID NO: 1631 - RNA, 102 nt, Human herpesvirus 5
gccauccugaauccccacuggcucccgccgccgggguucuacacgggcgaguacgacaugcccgaccccaaugacggguuccugugggacgauguggacagc

SEQ ID NO: 1632 - RNA, 101 nt, Fowlpox virus
ucauagauaugauacaacacaacacuacaaauuauaugaguuaaaaaauauagaauaucuaauaaauaauuuauguaauacuagcuaguguuuauuuauga

SEQ ID NO: 1633 - RNA, 66 nt, Equine foamy virus
ggauuauggggcuagcucagcucgcuaaugcauaauagcauucaacugacagcaaccccauagucu

SEQ ID NO: 1634 - RNA, 64 nt, Equine foamy virus
ggagccgggaggauagcucaaccuguuaagaacucagaagguuauguauauucuuccuugcucc

SEQ ID NO: 1635 - RNA, 98 nt, Zaire Ebola virus
ugcuaaacuaaugaugaagauuaaugcggaggucugauaagaauaaaccuuauuauucagauuaggccccaagaggcauucuucaucuccuuuuagca

SEQ ID NO: 1636 - RNA, 69 nt, Zaire Ebola virus
acaaguauaccuucuacuucuauugauaaucaguuuacugauacucaauguuauugggaaguuauuugu

SEQ ID NO: 1637 - RNA, 81 nt, Fowlpox virus
cuauuauucuaaacuaaaauaaccauuuauacuuuuauuccauaacguaguauauagauuuauuuuauucuuuuauaaugg

SEQ ID NO: 1638 - RNA, 102 nt, Equine foamy virus
uaaaauauaaauaagaucagauugugagggccacucacucacauauucggcugcguccggagugagucgagcaggccacagacuggguaagaauauauuuua

SEQ ID NO: 1639 - RNA, 130 nt, Peanut chlorotic streak virus
guuuuucuauaacucgagcucucgauaaaaaaguuuuucuauaacucgagcucucgauaaaaaaguuuuucuauaacucgagcucucgauaaaaaaguuuuucuauaacucgagcucucgauaaaaaagc

SEQ ID NO: 1640 - RNA, 60 nt, Fowl adenovirus D
acuuacauagugacaacgggccgugcuuuacugcacacaggauagaaaaucuauguaagu

SEQ ID NO: 1641 - RNA, 70 nt, Cowpox virus
guucacaugauuccggcaucgaguguugcaaaaucgaaagcaacuuucuuugcucugucggauggugaau

SEQ ID NO: 1642 - RNA, 66 nt, Cowpox virus
cgagaggaaacaaacugucuuggaacaauuuccuugaagauuuuaaaacggcaguuuucucucucg

SEQ ID NO: 1643 - RNA, 63 nt, Cowpox virus
gaguggcagcuacaacaccuccucgucuaacucuagaauucgagugauggccgcuuaccacuc

SEQ ID NO: 1644 - RNA, 106 nt, African swine fever virus
uucuaacucuuaacauuuuuauuuauuuaaaaugauaccuuuguuauuuauuuuauucuauuuugcgaacgguaucgaauagcauaaguuugaaacgagugaagaa

SEQ ID NO: 1645 - RNA, 72 nt, African swine fever virus
gaagaaguuauagacaaauuauucauucuaaaacuauaaaaacagaaugauacgauacuauauguauucuuc

SEQ ID NO: 1646 - RNA, 114 nt, Fowlpox virus
cuaucguauggauaaauauauucuagaauacaaaaauauggucuaaucucgcuacuggauaaaucgaaaaauacuuuuuauuauauacauauagucuauuaaacaaaaugauag

SEQ ID NO: 1647 - RNA, 66 nt, Cowpox virus
ggugagcuccccaaguuuuacuucucuaaacaaaaaggaugcucggauuggggcacgaagcucacc

SEQ ID NO: 1648 - RNA, 61 nt, Human herpesvirus 4
gcccgacccccgggcgcccccaaacuuuguccagauguccagggguccccgagggugaggc

SEQ ID NO: 1649 - RNA, 78 nt, Human herpesvirus 4
auggacauuguuauguuauagcuuuuaauggaaauaaaguuuggccuucacaagauuuaauacaagaucaauguccau

SEQ ID NO: 1650 - RNA, 83 nt, Human herpesvirus 4
uccuuugcucaagcauauauaacaaagguacuuaugaaaaggaaaaagcaaccuacuuuacgagauauagcuuuuccaaagga

SEQ ID NO: 1651 - RNA, 60 nt, Human herpesvirus 4
cgcugucgcagcucuuucccggccuggcucuguuggccgugaccgagagcgugcgcagcg

SEQ ID NO: 1652 - RNA, 69 nt, Human herpesvirus 4
cugagaauacugaggauuggggauggcuggcauauacugacucuuuuccaucccccaucuguauugaag

SEQ ID NO: 1653 - RNA, 96 nt, Human herpesvirus 4
aucuggaagaaaaauuauacucugucaucuguauuagcagaauguguaaaucaagccauggaauaugguauagaugaaguauuauccaaacuagau

SEQ ID NO: 1654 - RNA, 131 nt, Human herpesvirus 4
uuacaaugucaaacaaacuaggaaucuaaauacuuccacugcaugggaaauauauuuauauuaugagaucaucauuccuaccacuauauauacacagaauuggaauauaaagaaucuaggucaccuuguaa

SEQ ID NO: 1655 - RNA, 90 nt, Fowlpox virus
gucacuagagacagcuuggcgaaggggccagccaccauuuacacuuuuggugauaauggauggacucuuucacaagccucgauuaguggc

SEQ ID NO: 1656 - RNA, 78 nt, Fowlpox virus
guuuaacaaugggauauagaugacacuaaagaauacuauugugaacaacaugguaugaauuaucuaacuccguuagac

SEQ ID NO: 1657 - RNA, 75 nt, Fowlpox virus
ggcgccggcggccggcaccggaagcaagcauuucuaacugcgcgagcugguagcggcgccggcggcacgggcgcc

SEQ ID NO: 1658 - RNA, 63 nt, Cherry mottle leaf virus
auacagcaagacaaaugggcauuaaacgucugggccaccagguggugccaaguuuagaugugu

SEQ ID NO: 1659 - RNA, 126 nt, Cherry mottle leaf virus
gugguauucaaugauuugaauuucagaagugaaaguuacccagugagugucaggguugggaauaugugcagguucuuugacaguuuuuuggguucugagauuuucaagaaugaaucaaaugucuac

SEQ ID NO: 1660 - RNA, 75 nt, Macaca mulatta rhadinovirus
uggacaacuacuuuuuagcacaaauccagauauaucuuccuuuaaauuggguaccgaaggcgcugaguauuucca

SEQ ID NO: 1661 - RNA, 131 nt, Macaca mulatta rhadinovirus
ugccaagaggacagauaccagaugccauaaaggggaaagaguuccaccaaauaaauccguuuuugugguuugacggaggggcguuuuggcaacuguuccucucuguggauuuuaugcugcucugucccgca

SEQ ID NO: 1662 - RNA, 70 nt, Macaca mulatta rhadinovirus
ggcuuaaauauuuaaugcaauguaaaagcuuaugcuuuuaagucuuuaagcugcauuaucuuccauugcc

SEQ ID NO: 1663 - RNA, 72 nt, Human herpesvirus 4
acagaugaauacuuggaaauugaaccccuaaagaaugggaguuauuugguuuuaucaaguacuacagacugu

SEQ ID NO: 1664 - RNA, 88 nt, Human herpesvirus 4
agucgcaagggccaaggcagagcuucuacgcuuggaccuucacgaaggagacuauccagaguggcugcagcuccuuggagaagcaacu

SEQ ID NO: 1665 - RNA, 73 nt, Human herpesvirus 4
agguaauuucauaaaggacacugcuggagguauuuuuggaacugccuuuaguuuucugggauauguaaaaccu

SEQ ID NO: 1666 - RNA, 72 nt, Cherry mottle leaf virus
gccucugaucucaugauacauuggaaugaguuugcauucaagaucaugccugaugacauuggggauggaggc

SEQ ID NO: 1667 - RNA, 62 nt, Cherry mottle leaf virus
cugccaauuauguucacuggggggcuuuaucaauaucaauugaugcccuuuucaaaaagcag

SEQ ID NO: 1668 - RNA, 86 nt, Macaca mulatta rhadinovirus
aaacaaggaaugcauaugguugcgacacccggguacguccgcguuuguucggguauacaccgcgaccacugcgcauucugccguuu

SEQ ID NO: 1669 - RNA, 84 nt, Macaca mulatta rhadinovirus
guuuugguacccuuucuaaugcgccgaggagcguuccgauacccgggccguugaacccacauccgcgagaaaccgugcccgggc

SEQ ID NO: 1670 - RNA, 60 nt, Macaca mulatta rhadinovirus
ucccguguaccaguguaccuuucuacuauuuagguuaaggguaaauaaaggcacauguaa

SEQ ID NO: 1671 - RNA, 60 nt, Macaca mulatta rhadinovirus
ccagguuuacaguuucuaagcguguuuugucaucguuuauuuuuuaaacugaccaacugg

SEQ ID NO: 1672 - RNA, 69 nt, Macaca mulatta rhadinovirus
gacaauuacaucuucuucucugcagauaccgacuacucagggggcucgagaaacggagauuuaacgguc

SEQ ID NO: 1673 - RNA, 60 nt, Macaca mulatta rhadinovirus
ccgcuccugacgcgauugaccuggaaccguuuacagaagaugucccagguugauuuccag

SEQ ID NO: 1674 - RNA, 63 nt, Macaca mulatta rhadinovirus
acgcccaaacucauccuggagugcaaaaaucuggaucuuacaacacgaguucauccaauucca

SEQ ID NO: 1675 - RNA, 91 nt, Monkeypox virus
uacauuuuucuauguuacuuuuaguucguaucagauuauauucuagagcuuccugacuacuaacgaaauuaauaugauuuggccaaaugua

SEQ ID NO: 1676 - RNA, 91 nt, Simian immunodeficiency virus
gcugggccuaauuacgcuguccgccuguuccacgcgcgugucggcuacgacacgcuggagcagcuuccacgcgacagauccgucucucagc

SEQ ID NO: 1677 - RNA, 63 nt, Simian immunodeficiency virus
ggcugacaggaucguccccuuggcucgugauccuacaagggcagggggggucucuguucugcc

SEQ ID NO: 1678 - RNA, 69 nt, Simian immunodeficiency virus
cgugccgggaccccgacaaggccuucuugccgacauuacuggcgagaagcgcccgacgcggccuggccg

SEQ ID NO: 1679 - RNA, 80 nt, Simian immunodeficiency virus
cugcaucugggaucgcgcucggagcucucccaccccguguuggagugggagagcacagagcugguccugacggacuggag

SEQ ID NO: 1680 - RNA, 69 nt, Macaca mulatta rhadinovirus
agcccggguuuuguuucaagcacaaaacaaaagagagauagcuuuguggagagcuaucccuucaaagcc

SEQ ID NO: 1681 - RNA, 66 nt, Simian immunodeficiency virus
gcgggggggcgacgcagacguacggcggcagaggccgacaugauuccugcccgucgaucccccugu

SEQ ID NO: 1682 - RNA, 73 nt, Simian immunodeficiency virus
ccucugccaccgaugacgcccgucgacgacgagccguccguccgcccucgguguccgccaggucccgcggagg

SEQ ID NO: 1683 - RNA, 72 nt, Simian immunodeficiency virus
cgacaucugaggcucauacuuaaucuaucagacgguguugucugaaagauuauuaccucugagaggauaucg

SEQ ID NO: 1684 - RNA, 118 nt, Simian immunodeficiency virus
ggauagcaacauuuauagguucucucugaaagagguuuaaggauaguaaaaauauggauaguaaucuuaagauagauauuaucuuaauauauagucuuuacccucucucaugcucucu

SEQ ID NO: 1685 - RNA, 68 nt, Ectromelia virus
ugcgcaugaaaauaucauuaaauuguuuuaaacauucuuaaauucaauuuaaaauaauuuuuguagca

SEQ ID NO: 1686 - RNA, 64 nt, Variola virus
ggcgguaucgguacauauacguaauucaccuucacaaaauacggagucuucgauaauaauagcc

SEQ ID NO: 1687 - RNA, 60 nt, Variola virus
gucgcugaggaaaucacgaagaccauucagucggucuacaaugauuuccugaagcuugac

SEQ ID NO: 1688 - RNA, 84 nt, Variola virus
gggucgcggcccgaaggcggagaugccgagcucggccaguucgaugcccucgguacccaucccccuuccacccgucggcgaccc

SEQ ID NO: 1689 - RNA, 77 nt, Variola virus
guucucccguugcuauugcaacauccccggacacaagugucccuucugggaugucucagcaagacgugaugcagaac

SEQ ID NO: 1690 - RNA, 65 nt, Variola virus
gaucgaucgcaccgugcaagcguacagcaauugcaaaacuaauguaccacggugcacacgagauc

SEQ ID NO: 1691 - RNA, 95 nt, Ectromelia virus
ucucguuagccuggguaggaaagacccaaccgcgauacccacugaucuuuaacuuuaugagaaaaacaggaauugcgguuucccccauuagcaga

SEQ ID NO: 1692 - RNA, 61 nt, Variola virus
ucggauuauccaccgaggaccaagucgaaaguuuuaucaauguccucgcggauaccgcugg

SEQ ID NO: 1693 - RNA, 62 nt, Variola virus
agcccgggguccaaaagagugggucguacaacacgucaucuacgaacucuaggauccggguu

SEQ ID NO: 1694 - RNA, 68 nt, Variola virus
ugcccucgaagcgccagauacagauuugagcaaguauaaagaucugggcuucaaagucgagguuagca

SEQ ID NO: 1695 - RNA, 81 nt, Equine rhinitis B virus
gugguagcgcugugugaguuggcgguggaucccccucgugguaacacgagcccccguggccaaaagcccaguguuuacagc

SEQ ID NO: 1696 - RNA, 94 nt, Meleagrid herpesvirus 1
gguauaucccucuaaaucugauguuuuugcauggacgagguauugugcccccgaccauguaaaaguugugauuguaggucaggauccauaugcc

SEQ ID NO: 1697 - RNA, 80 nt, Meleagrid herpesvirus 1
gucgcuguccccggccgugagcggagccgugcucugggacggggaggcggcggccggggacgaagaagagaaggagcggc

SEQ ID NO: 1698 - RNA, 71 nt, Ateline herpesvirus 3
ucucaggacaucucuaguuacuucguggaucagauuuuccaaaucgaagcgaacaagagaauaaccuggga

SEQ ID NO: 1699 - RNA, 104 nt, Ateline herpesvirus 3
cuaguuuauuaaauaaaaaaaagggaaaaccuguuuaucuaaccuggucuucuauuagguaaucccagguacaguuaauccccuacuauuauauaaucuucuag

SEQ ID NO: 1700 - RNA, 99 nt, Ateline herpesvirus 3
gacuucuugacuuccgccgaaguggauagauucaaacaggcugccucagauuuuggcaucauguuggaaaucggaaccacccggaagauuacagaaguc

SEQ ID NO: 1701 - RNA, 70 nt, Ateline herpesvirus 3
uaauaggccuacgauaaaaugucaacauauauuuuuuaauuuguguuucauuaacagccaugguguauua

SEQ ID NO: 1702 - RNA, 110 nt, Ateline herpesvirus 3
ccaaacucaggaaggugacaaauucaggaauucauggauugccgggugauuuucuccagaauuacccacgcauucccgaucaugauuuuaaacgccuucgugauguuugg

SEQ ID NO: 1703 - RNA, 130 nt, Ateline herpesvirus 3
gccaccuagccagccagcccggggacggggccaccuagccagccagcccggggacggggccaccuagccagccagcccggggacggggccaccuagccagccagcccggggacggggccaccuagccagc

SEQ ID NO: 1704 - RNA, 84 nt, Ateline herpesvirus 3
cgagauuccuguacacagcuugcgaaaggggaaguggucacgcacuggugaccgcauuccaaccugcguuguacaagaaauucg

SEQ ID NO: 1705 - RNA, 62 nt, Ateline herpesvirus 3
caugggauaagucaaagauguaccaagccuuggguuucgcagcaggcgguacuauccccaug

SEQ ID NO: 1706 - RNA, 70 nt, Ateline herpesvirus 3
augcgucgcuacuccccgcaaggauggugguuucaacaucacguugccuugccgggguauugcgucgcgu

SEQ ID NO: 1707 - RNA, 60 nt, Ateline herpesvirus 3
guaagacugccuaaccguuucaaagcaguggcguugcucaacggacguaaggcagauuau

SEQ ID NO: 1708 - RNA, 130 nt, Ateline herpesvirus 3
cgccggccucccccggcucccggcccuccgccccgccggcccgggcccgcggccgccgcccccggccgccccgcgccgcgcgccgggccgcuuucgguucgcggggccgggggucccgcggggggccggg

SEQ ID NO: 1709 - RNA, 72 nt, Ateline herpesvirus 3
gucgaggguguagcggccggucguucaauguauccuccgggauuuuuggucggucguuacgauaccaucgau

SEQ ID NO: 1710 - RNA, 73 nt, Ateline herpesvirus 3
gggugccgcuccgccgggcccggccgacucccgggagcgccccgguccggccgagcccggcggcgccgcgccc

SEQ ID NO: 1711 - RNA, 70 nt, Ateline herpesvirus 3
cugcuaguagggcugcugggcugcuaguagggcuccugggcugcuaguagggcugcugggcugcuaguag

SEQ ID NO: 1712 - RNA, 88 nt, Ateline herpesvirus 3
cuugcaguucacccaccauguucgaauuuacccgcccccccguuuuggcagggaaacagcuuucggcucaugguguaggaauuacaag

SEQ ID NO: 1713 - RNA, 80 nt, Ateline herpesvirus 3
ugggaagacuugcgcgacccugaguauuuaaaggauuuacuauccgacacucaggcaaucgacaaagugcgagucuacca

SEQ ID NO: 1714 - RNA, 74 nt, Ateline herpesvirus 3
auaaacccuauaugaggaaauuuuauuaguacguuuguguaacugcaaaauaaaauuuuaaauaaauacuuuau

SEQ ID NO: 1715 - RNA, 77 nt, Ateline herpesvirus 3
gcauauauccguuuucuccuuuguaugaacccggugggcaagggccacauaaaaacauuagaggggcaacgggcugc

SEQ ID NO: 1716 - RNA, 76 nt, Ateline herpesvirus 3
uugcgccacagcggacguacaucaaucagauucguuacuugacugaugcacacaaagaaaaugccgcaugguacaa

SEQ ID NO: 1717 - RNA, 75 nt, Ateline herpesvirus 3
uguaacuucacgcuacccuaaacguacaauacugggacuagaacccagagguaguuagaauauacgguaguuaca

SEQ ID NO: 1718 - RNA, 60 nt, Ateline herpesvirus 3
ggccaucuuccucaugaugccgcgauuugucaagaaauacgcgauuggggcugcauggcu

SEQ ID NO: 1719 - RNA, 69 nt, Ateline herpesvirus 3
acacccuuacaccgaugauaagaccaacgagcagagaauaaaccgcguuggcagaaucaugaagggugu

SEQ ID NO: 1720 - RNA, 78 nt, Ateline herpesvirus 3
gcugggcugcuaguagggcugcugggcugcuaguagggcugccugcuggcuugcuugcuugcuugcuaguggggccgc

SEQ ID NO: 1721 - RNA, 69 nt, Ateline herpesvirus 3
ucgacaacuaccuccgaaaguguguccuguuggauguuuuguggauuagguaaaacagaaaguugugga

SEQ ID NO: 1722 - RNA, 90 nt, Camelpox virus
ugucuagaaagaaacgauuauuucugaauuauuccaauuauuuaaacaaacaggaaagaaguauacuaucgucauuuuuuucucuagaua

SEQ ID NO: 1723 - RNA, 67 nt, Camelpox virus
ggcagcgccgcccgcccgcagcggcggucccccgcccucggcugccgaggcggcccaucgugcugcc

SEQ ID NO: 1724 - RNA, 118 nt, Human echovirus 1
uuaaucuguguguccuguuccaccccaugaguaaguguuguaguauuguguguuaugucugguguauacaauauacaacauauguacagccauguuguuuuauaaaacacauuuuuaa

SEQ ID NO: 1725 - RNA, 60 nt, Human echovirus 1
uaaagggggcacauguggcuauaguagaaucucuacucaauauaguguccgcccccuuua

SEQ ID NO: 1726 - RNA, 130 nt, Ictalurid herpesvirus 1
ggaggagauaaauaucuuacgcaaagaagcgcuugagcuacagaaacaagugacggagcaaaaggcuguuguggcugagcugagguuacagauuucuaagcaacagggcgcuagcgcaggaacuaccucu

SEQ ID NO: 1727 - RNA, 65 nt, Ictalurid herpesvirus 1
gacuuaaacgcauacggguauagacuaucacgcaaugguccacccuccgugcugguuaccgaguc

SEQ ID NO: 1728 - RNA, 69 nt, Ictalurid herpesvirus 1
cucaagagcuguggucagcgcucaacacucuaaugccucuaagcgcucucaccucacccagccuccgag

SEQ ID NO: 1729 - RNA, 131 nt, Camelpox virus
agaguugcaugaagauauuguugaaauucuccgcagaagggguugcacggcagaucaauccagacacuggauuccgcacugcacuguggcccaauuugacgaagaaagagaaacaaaaggaaugcaauucu

SEQ ID NO: 1730 - RNA, 64 nt, Camelpox virus
gaugacugguuucuauuuggugacagucguucugacuguaccuauguagaaaauaacggucauc

SEQ ID NO: 1731 - RNA, 67 nt, Camelpox virus
gggaccgcuccaaugaguucuccuauggcaagcggucgcugcugggggagucaggagacaccguccc

SEQ ID NO: 1732 - RNA, 61 nt, Camelpox virus
gguggagauggcagaggcugucgccgcgcccgaggugcugcccagccuccccgucuccauc

SEQ ID NO: 1733 - RNA, 62 nt, Human echovirus 1
caggcugaugagucaccguauuccccacgggcgaccgugacgguggcugcguuggcggccug

SEQ ID NO: 1734 - RNA, 68 nt, Human echovirus 1
guuucuauaacaaccucccccagguccaguuaugaacucccaccuuacaccagagauauuauggaugc

SEQ ID NO: 1735 - RNA, 86 nt, Ictalurid herpesvirus 1
cgaggggaacgggggauggaaggacgggaaguggaaguccugauacccauccuacaccccccugccuuccacccuccggccccccg

SEQ ID NO: 1736 - RNA, 64 nt, Ictalurid herpesvirus 1
gcuuuucacgccacgcguauaaacgaguuuucagucauaaauuguaccaggcuggcauggaagc

SEQ ID NO: 1737 - RNA, 117 nt, Human echovirus 1
gaaacuagacauaaaauaaauauuuaccaacuuggaacuuuuacuucaagucaugaagauaguggaagagaaguuagguguuuguugggagccuugaaauaucuuaugucuuuccuc

SEQ ID NO: 1738 - RNA, 73 nt, Ictalurid herpesvirus 1
gacccacguacuccaagaaggcaugugucccaccccgccuguguuuuugugccuggcucucuaugcuuggguc

SEQ ID NO: 1739 - RNA, 67 nt, Ictalurid herpesvirus 1
uagaaacugaugacucaugcgcuggcccaaucuccaccuuccaggaucucuuuccagccaguuacua

SEQ ID NO: 1740 - RNA, 64 nt, Ictalurid herpesvirus 1
gacuucuuuccagagauugucuuccaacucaacaugauaacugccccucugacaaaaagaaguu

SEQ ID NO: 1741 - RNA, 126 nt, Vaccinia virus
auaauuagaacuagaaacauguuuagaaagaaacgauuauuucugaauuauuccaauuauuuguccaaacaggaaagaaguauacuaucgucauuuuuuucucuauauccagcuacugcugauaau

SEQ ID NO: 1742 - RNA, 80 nt, Human echovirus 1
uaauaguacagaauauaaacaauacaugcgacauguugaggaguuugacuuacaguuuauguuucaauuauguaguauua

SEQ ID NO: 1743 - RNA, 80 nt, Human echovirus 1
aaaacguccugcaucugcagccacuucauccuccaguaaacccaaacggucuaggaagaaguaguauguguuauuguuuu

SEQ ID NO: 1744 - RNA, 103 nt, Ictalurid herpesvirus 1
agaaugccugggaaaugauagagaaagagagacugaaacuuagugcagaaaagaaccgcgcugaguacgaagucaauucucuuacuucagccaggaauagucu

SEQ ID NO: 1745 - RNA, 89 nt, Vaccinia virus
gaauguuccagaguguuuauccagggaaauuaaagaagaaguuaauauagacaauucuuuuguauucauagacacucgguuuuuuauuc

SEQ ID NO: 1746 - RNA, 82 nt, Vaccinia virus
uaaagcugauuguauaaauuuacuauuaauaccuaauugaccacuaauaauaaauuuuuuaucauuaauauaauuaguuuua

SEQ ID NO: 1747 - RNA, 78 nt, Monkeypox virus
ggcugcgggacagugauggagaugaugguggcccagagggaccaccugcgcgugucccacgugucccccuuugcgguc

SEQ ID NO: 1748 - RNA, 78 nt, Monkeypox virus
agaaagaaacgauuauuucugaauuauuccaauuauuugaacaaacaggaaagaaguauacuaucgucauuuuuuucu

SEQ ID NO: 1749 - RNA, 62 nt, Ictalurid herpesvirus 1
uccuauccugcugaacuuuagcagaaacucuagcgaguuucagcuaguguuguaugauagga

SEQ ID NO: 1750 - RNA, 72 nt, Ictalurid herpesvirus 1
auacccggcgauuuucccaaccaccccucuaacaacgauauacggcauucccugggaccaggucgagggugu

SEQ ID NO: 1751 - RNA, 70 nt, Monkeypox virus
ggaugacucucaaauuauuacacucacggcauucguuaaccaaugccuauggugucauaaacgaguaucc

SEQ ID NO: 1752 - RNA, 66 nt, Monkeypox virus
gucgcaggcccaguagagcgccggguucuccgggucgaacgugagccgugugugcgggcccuugau

SEQ ID NO: 1753 - RNA, 76 nt, Monkeypox virus
ggcccgcgcacaacaaaucgcggauuacuuaacugcauccaugcaagcacugacugugauagaauacgauagggcc

SEQ ID NO: 1754 - RNA, 86 nt, Monkeypox virus
gcguaaugggcguggucauccucggcuauauaagggggcgcgucgagcgcuuccugcaguuggugaucgacuuccgccagggacgc

SEQ ID NO: 1755 - RNA, 78 nt, Monkeypox virus
auuucuucuccguguugcagaucuaugauauuggugcgauggucacgagccaagacguuuacaagucggaggaggagu

SEQ ID NO: 1756 - RNA, 66 nt, Monkeypox virus
cccucuccuucaugcgccgauaccccgacucggugacgaagaggcugucgguguccccguagaggg

SEQ ID NO: 1757 - RNA, 78 nt, Monkeypox virus
agagcugucgcgaaguauucgcuccgugcggguaacgccgaaauagacuuagcgcccgaggaguuuucguacggcucu

SEQ ID NO: 1758 - RNA, 63 nt, Monkeypox virus
gauguaguagacguuggcgcggaugggaucucccuuggccgccuugaagugggucuuggcauc

SEQ ID NO: 1759 - RNA, 96 nt, Murid herpesvirus 4
gguugugucaugacgggcuucaguccauuaaguggaugcugucaccuacugagugccaccuuccacagugggcguggcagccacaucaagcauacc

SEQ ID NO: 1760 - RNA, 103 nt, Murid herpesvirus 4
acuacuuaggcauggcugcugaccccuauggcgacagcauguuuuuuuuucugcguagggaacaacuguuugccaggcacuucuuuaaucgugcugguguagu

SEQ ID NO: 1761 - RNA, 121 nt, Murid herpesvirus 4
ccuggcagugccauauacagucccacaccuaguggguccaugguaacgucugaggcucaaauauuuaauaagccuuacuggcuacagcaggcccagggacacaacaaugguauaugcuggg

SEQ ID NO: 1762 - RNA, 120 nt, Murid herpesvirus 4
aaacaagguagaaaccaacgggguccucaggugguauuuccggaagcauuaccaaauaaggcaaccucagcugggaauaccagcggacuacccccaacuguauucaacccuccuuuguuu

SEQ ID NO: 1763 - RNA, 69 nt, Poliovirus
aggguguuucgggugcgguugccugacccuaauaaguuuggacugccugacgcccgcauauauaacccu

SEQ ID NO: 1764 - RNA, 127 nt, Monkeypox virus
guacgcggugaagguaaguugcuuccaaaaggcguggguguugcugggaauggugggucgcaggaaaauguuaaagucgccgugcaugccgaguucgucuuugaaguacuugucguaacugucguac

SEQ ID NO: 1765 - RNA, 110 nt, Monkeypox virus
gucgcugggcgcgacgacuccucgcgcccaccugugaagccgcgugggguccuuuuuaucguaguugggguugggcagguggaagaggacgucguuaaagaggaggcggc

SEQ ID NO: 1766 - RNA, 66 nt, Murid herpesvirus 4
acacaacugugcauucugggcuguacgccucccaugggcgaacacugggguaagggcacugugugu

SEQ ID NO: 1767 - RNA, 79 nt, Murid herpesvirus 4
uagguuuguaacauccucugccauaacuugucaaaaagauuuggccccuacagaaaagcaggauccguaugcaaagcua

SEQ ID NO: 1768 - RNA, 131 nt, Murid herpesvirus 4
caccccaggagccccggcagcaccccaggagccccggcagcaccccaggagccccggcagcaccccaggagccccggcagcaccccaggagccccggcagcaccccaggagccccggcagcaccccaggag

SEQ ID NO: 1769 - RNA, 108 nt, Poliovirus
caccuccaaugggagagcauuggggcaagggaaccccgugcaggaacccaccugcacagggcgauugcccuccccuggagcuuauaacuuccccuauucaggauggug

SEQ ID NO: 1770 - RNA, 64 nt, Poliovirus
guguuuuugauuguagcggaaaaauguaauaaauuuuacagacaguuuugccuacugagaacau

SEQ ID NO: 1771 - RNA, 102 nt, Poliovirus
auaacuuuuggucacccaccucgaacgucgaguagucgacggaugguugaagcccggccagauccacuucaucgagcgccaggguggugaaacagagguuau

SEQ ID NO: 1772 - RNA, 77 nt, Poliovirus
uccuggauacaauacucuccuauuacgccccuccggucaggcccucccgcguaauaggaggguauuucuuuauaggg

SEQ ID NO: 1773 - RNA, 82 nt, Poliovirus
cgucgccacagaauacaugucuagagauaucaggccauugauuuucaccuugcucuucuucugaaaaugguucguggcgaug

SEQ ID NO: 1774 - RNA, 111 nt, Poliovirus
gggcgggauagcucagcaaaccuggaugggucaucgugugaggcgcucuccgaagucucuacuaugucguacacgugaaaucucucaaaucugggguugaauccaucgccc

SEQ ID NO: 1775 - RNA, 73 nt, Equine arteritis virus
uugccgccgugggcaaucgguuguuagucccagguaggcccacuaucgauuaugcaguggccuacggcagcaa

SEQ ID NO: 1776 - RNA, 65 nt, Equine arteritis virus
gugccguuuagauggucucagaccgggaucgaggugcaagguugggucuaaggcgggaaggggau

SEQ ID NO: 1777 - RNA, 73 nt, Camelpox virus
auaaucaacauaaccucaucaucuauuaacugauaacgguuaguuauaauagggauaaaggauuaaugauuau

SEQ ID NO: 1778 - RNA, 61 nt, Tupaia herpesvirus
uuaacuucgcaauaauuucugguuagauaacgcacucuaccagucaagucaaugauauuag

SEQ ID NO: 1779 - RNA, 131 nt, Melanoplus sanguinipes entomopoxvirus
ggauuuuauaucugauaucacaaaauaucaauaauguaucaaaaauaucaauauccaauguccaauaaaggauuuuauaucugauaucacaaaauaucaauaauguaucaaaaauaucaauaucuaauacc

SEQ ID NO: 1780 - RNA, 69 nt, Bovine adenovirus B
aucguauugugguuauauggcuacaauuucauaaugaguugaagucaguguccuaugaucaaugacgau

SEQ ID NO: 1781 - RNA, 64 nt, Marburg virus
gcuaugauaagcggaggaaaaccugccugauuccuugggcggggauccuugugcgcugucuugc

SEQ ID NO: 1782 - RNA, 80 nt, Melanoplus sanguinipes entomopoxvirus
cgaguuaaauuacauaagucccgaguucucgggacaagauggcgugucccgaguucuagggaccuacuuguuuguacuug

SEQ ID NO: 1783 - RNA, 60 nt, Murine type C retrovirus
gagggccggguguccgaagccgaccuccagcgguaccgggaggccgucgacaccgcccuc

SEQ ID NO: 1784 - RNA, 111 nt, Murine type C retrovirus
ccgcgcuccugcccccggucuucuacgagcccgugguggacuacgcggccuacaucaaccuggccgagcucuacgucuucgucugguaccgggaccacgaguucuccgcgg

SEQ ID NO: 1785 - RNA, 64 nt, Murine osteosarcoma virus
uuugcgccugcgucuguaucuguacuaguuagcuaacuagaucuguaucuggcgguuccgugaa

SEQ ID NO: 1786 - RNA, 62 nt, Murine osteosarcoma virus
ugggagacgucucagaggcaucgggggccauuuuuguggcccaaucuguaucugagaacccg

SEQ ID NO: 1787 - RNA, 71 nt, Murine osteosarcoma virus
gaaggauacgugguucuauugggcggcgaggggccgaaacgcuccucuccuccaucugaauuuuugcuuuc

SEQ ID NO: 1788 - RNA, 125 nt, Equine herpesvirus 4
auggaaaggggggcgaggcagggcagcgggcgggggaggacgaugagaggauggacgagggggucccggaggagggagccccccgcucgccccacccgcccccguucgcccacuacgaggucuau

SEQ ID NO: 1789 - RNA, 86 nt, Murine type C retrovirus
aacgcgcugcccggcgagcgguccgcggccgccgccgagacccgagccgcguccucggacccgcgcucggaccgggacgacgcguu

SEQ ID NO: 1790 - RNA, 72 nt, Banana mild mosaic virus
gggaagauaauuucaguugaagaagaaguugugaaguacguuucagagcauggucuagaaauucauuacccc

SEQ ID NO: 1791 - RNA, 68 nt, Banana mild mosaic virus
cggggcaguuuguguacaagaacugcgagauggugcacaucgcgccguucuuuguagcggcggcccug

SEQ ID NO: 1792 - RNA, 85 nt, Rana tigrina ranavirus
ucuggcggguuauugguggaaggcuguaacaaugucugugucauaaucgaacugaaaacuugcagauuuuaccgcaaccucaaga

SEQ ID NO: 1793 - RNA, 126 nt, Rana tigrina ranavirus
gggcuuguaguuauacguucgacaccauuaaaaaagaaggcuauauguacagacuuucaucgauuggcaucaaugauguaucucagaucagaauauaggcuuuaugauucggguaugugcaagccc

SEQ ID NO: 1794 - RNA, 66 nt, Rana tigrina ranavirus
cgauuuaaaaaggggcagucugcaaaguuuaucgcggguguaauguagacaccgccuguuagguug

SEQ ID NO: 1795 - RNA, 80 nt, Ribgrass mosaic virus
ugucgcaaucguaucaaacucaggcggcaagagauacuguuagacagcaguucucuaaccuucugagugcgauugugaca

SEQ ID NO: 1796 - RNA, 61 nt, Simian type D virus 1
agcgccggcggcuggcgagcggcggcggccacgcgcgcugcucgccgcguugcgcggcguu

SEQ ID NO: 1797 - RNA, 84 nt, Simian type D virus 1
ugccggagaugcacgccaucuucgaggaguacccggaccuggagcagaaguaccugagccucaugaagaugcccaucaccggca

SEQ ID NO: 1798 - RNA, 97 nt, Simian type D virus 1
uucccacucccuccuccagggccugcuucgacgaucccgcgggccgggauacguggcgcccgaacagggaccuggaaacgagggacuccgugaggaa

SEQ ID NO: 1799 - RNA, 68 nt, Melanoplus sanguinipes entomopoxvirus
agggaagguuugacucgccucucccagcccaggaccaaaacgggcgaagaagcgacagaauccguccu

SEQ ID NO: 1800 - RNA, 103 nt, Melanoplus sanguinipes entomopoxvirus
aacauaccaaugucgaucucauacuuaugguagguucaagucacgacaggccgcguguuacacacaacccccauuucacugugaaaucccgcauucgguuguu

SEQ ID NO: 1801 - RNA, 98 nt, Marburg virus
uagguuaucguugagauuaaaaagacuacguuacguuuucucugaugacaagugacaaaauuucguaguuaaauuucuagaaugucaaugugaaugua

SEQ ID NO: 1802 - RNA, 60 nt, Marburg virus
uaacugucccggcgugccuccaucugcugagucccgugcagacuggcaugaggaugguug

SEQ ID NO: 1803 - RNA, 92 nt, Murine osteosarcoma virus
ugcuaccuuuaaaccuuauguagacugggacaguaaagcacagcuugggucagcuugucacuuuucuuuaaucuuuuuccgguuuaguagca

SEQ ID NO: 1804 - RNA, 79 nt, Ribgrass mosaic virus
ccguuguacgagucucucaugaaguccuuugauacuagaaauaggaucauugaaacugaagaagagucgcguccaucgg

SEQ ID NO: 1805 - RNA, 75 nt, Ribgrass mosaic virus
ucgaaaccuguuauuuccuggaucaccuguuaacguacgcguggcguauauuacagugggaauaacuaaaaguga

SEQ ID NO: 1806 - RNA, 61 nt, Marburg virus
uggugauagauuaauccuugaaguaacuuuuuuauauauuauagaggaacuaauauuacua

SEQ ID NO: 1807 - RNA, 101 nt, Lumpy skin disease virus
uauuacugcaagauuuugauuuuuuauuugguuuugucauacaagcuuuaguuuucacauugccagcuuuuacuucauucucaucuguauuauuaguagua

SEQ ID NO: 1808 - RNA, 62 nt, Crucifer tobamovirus
gaccguggccaucaggagucaaauucagcuuuugcugagugagcuuuccaguggacaugguc

SEQ ID NO: 1809 - RNA, 126 nt, Banana mild mosaic virus
cccuuuucaguacaaaggcaaacccuaucucgcuaauuacaucaagaagaaaagucacagauucaagaaagagcucgugccuauuuugcuugaauuggguguggagguugaaguggaggaggaggg

SEQ ID NO: 1810 - RNA, 91 nt, Turnip vein-clearing virus
ucggcguugucgcaaucguaccaaacacaagcugcgagagacacuguuagacagcaauucucaaacuuguuaagugcgguugugacgccga

SEQ ID NO: 1811 - RNA, 62 nt, Turnip vein-clearing virus
gaccguugccauuagaagucaaauucagcuuuugcugagugagcuuucuaauggacaugguu

SEQ ID NO: 1812 - RNA, 84 nt, Turnip vein-clearing virus
ucgaaaccccuuauuuccuggaucaccuguuaacgcacguuugacguguauuacagugggaauaaguaaaagugagagguucga

SEQ ID NO: 1813 - RNA, 67 nt, Human adenovirus B
ugcgggggcaacauauccuucacccgccgcuaccugcucuuccaccacggggugaacuucccccgca

SEQ ID NO: 1814 - RNA, 61 nt, Gallid herpesvirus 2
guuguacugaaauucgugaguaauauauaaaaccauaaugcaauagaucauucaguaaaac

SEQ ID NO: 1815 - RNA, 84 nt, Ectromelia virus
agggaccucugauucuccugugacgcaugccgauccuaucgauuggaaaucugaggaaccgguaugggucgaucaguggccccu

SEQ ID NO: 1816 - RNA, 66 nt, Meleagrid herpesvirus 1
gccgcagcucacaugccgccuuccgcgcuugccuaggcgcgagugugagaggaggcggguugcggc

SEQ ID NO: 1817 - RNA, 80 nt, Crucifer tobamovirus
ugucacagucguaucagacacaagcugcgagagauacugucagacagcaauucucgaacuuguuaagugcgauugugaca

SEQ ID NO: 1818 - RNA, 64 nt, Crucifer tobamovirus
cccccaggcauauucaauagggacaguguuaauuuacugucgcauacugaauuguuuguugggg

SEQ ID NO: 1819 - RNA, 68 nt, Human adenovirus B
ugucuugcauuacuaccgucaccuccacagccccuauuacagcccgcaagucucggcagaaaaagaca

SEQ ID NO: 1820 - RNA, 66 nt, Ectromelia virus
accacaugacaaugaacaaaccuaagacagauuaugcuuuaugcuuguuguguuguaauauguggu

SEQ ID NO: 1821 - RNA, 71 nt, African swine fever virus
ggcccgagucugccuggcugcugcgucucgcuccgagugccgaggugcaaaugcgaccagacugucgggcc

SEQ ID NO: 1822 - RNA, 75 nt, African swine fever virus
cgucucuccggagagcggcuuggugcggagcucccgggagcuccgcggaagacccaggccgccucggguguaacg

SEQ ID NO: 1823 - RNA, 75 nt, Gibbon ape leukemia virus
cguuacacccgaggcggccugggucuuccgcggagcucccgggagcuccgcaccaagccgcucuccggagagacg

SEQ ID NO: 1824 - RNA, 84 nt, Paramecium bursaria Chlorella virus 1
gacgcgaauaaauauuugacgugcuccgacguaaauuuuauuauucuggagaaguaaugcauauguaaaauaccuauucccguu

SEQ ID NO: 1825 - RNA, 73 nt, Molluscum contagiosum virus
cgcacacgggcaggcagaaggcgcagucgaucucgcacuggggucgcaagcagcccuuucccagcccgcggcg

SEQ ID NO: 1826 - RNA, 70 nt, Vaccinia virus
uaucaaauacuguacggaauggauucauucucuucucuuuuuaugaaacucuguuguauaucuacugaua

SEQ ID NO: 1827 - RNA, 83 nt, Vaccinia virus
uaggaguaucuauuuuaacaaagcaucgauuugcuaauauacaauuaucauuuugauuaauuguuauuuuauucauauucuua

SEQ ID NO: 1828 - RNA, 106 nt, Alcelaphine herpesvirus 1
ugcacagugcugaucaauugacugguauuaacuguugacaguuuuaacuguucauacaaauugugacuauauauacaaguuaguuuccccaaaaaaucacucugca

SEQ ID NO: 1829 - RNA, 107 nt, Human herpesvirus 2
ggggagggggguggcggcuggggaaagggaaggaacgcccgaaaccagagaaaaggaccaaaagggaaacgcguccaaccgauaaaucaagcgccgaccagaacccc

SEQ ID NO: 1830 - RNA, 66 nt, Human papillomavirus type 90
accagcacagcaagcauauagggugguaacaaguuguuguagguguugcuguacaguaaggcuggu

SEQ ID NO: 1831 - RNA, 77 nt, Human papillomavirus type 6
ggacggacaagauucacaaccuuuaaaacaacauuaccaaauagugaccuguugcuguggaugugacagcaacguuc

SEQ ID NO: 1832 - RNA, 76 nt, Fowlpox virus
auauuaucuuuaucuaaccgaacagauguugcuuucuuaguuaacauaaauagaaaaaaaacgauaacuauaauau

SEQ ID NO: 1833 - RNA, 111 nt, Paramecium bursaria Chlorella virus 1
cggugaagacugagacggugaagacugagacggugaagacugagauggugaagccccagccuucugcaaccgccguacuaaugaagcagcccgucgcaacggcucuucccg

SEQ ID NO: 1834 - RNA, 130 nt, Cercopithecine herpesvirus 7
guaaaauauuuccgguaggcguguauguaguguucuguuauuuuaauuugauauauuaguacagcuauauaacaguuguguauguuacacgccauauaacaacacuacauauaucucuaaguugauaaac

SEQ ID NO: 1835 - RNA, 101 nt, Cowpox virus
uagguauaauauaauuaauuauaugguuuauuaucacaauucaaccauggugauugugaauuaguacuacccaauaaucaaaugugcuuguauuguaucua

SEQ ID NO: 1836 - RNA, 95 nt, Sulfolobus virus SIRV-2
uacgacuaacauuuuuauaguuaucauuacaauuuuuuagcaguuaaaugcaaaaaaauaacagauguauaauugaaagaacuuuuaguuuugua

SEQ ID NO: 1837 - RNA, 98 nt, Meleagrid herpesvirus 1
gcaccguggaggucguucuaucgcaugcgauugugcgaaugugccaacugcgaaugccguuauuacaauaaaaaugugacuugaaaaauccgcgaagc

SEQ ID NO: 1838 - RNA, 85 nt, Meleagrid herpesvirus 1
uugugggauguucgucguaucggcaacauuggcauccgcugcggauuauguggacuuugcacguaccaaccagaacguugcacga

SEQ ID NO: 1839 - RNA, 71 nt, Avian paramyxovirus 6
gauaaaaauaugucgagggaugacauugaugagaccccuuauucucucucaaacuaagacaguaauccauc

SEQ ID NO: 1840 - RNA, 63 nt, Lymphocystis disease virus 1
guaaauuaugauauggcacaugcguuagaugcugccagaaacacacggcuauauacauuuuau

SEQ ID NO: 1841 - RNA, 64 nt, Tupaia herpesvirus
ucagcuucagaugagcucuauugaagagucaagaggcucuggagagacgcucaaacugccuuga

SEQ ID NO: 1842 - RNA, 83 nt, Bovine respiratory syncytial virus
cauaaucaucauauuuucucaaccugauuaacccuucaauucaucuuguagauuauaccucaguuagauaaauaaaaauuaug

SEQ ID NO: 1843 - RNA, 67 nt, Avian paramyxovirus 6
ggggggaaggagguugacugcaaccucaauugaucagagguugcagcacuaacucuuuacaaccccc

SEQ ID NO: 1844 - RNA, 61 nt, Peanut clump virus
cauucccuagcuauuauaagguuaauugcaaaaacccuuauaucuggcuaagaugggagug

SEQ ID NO: 1845 - RNA, 63 nt, Paramecium bursaria Chlorella virus 1
ggauguaacgguggagguccggcaggaagugggcaagaauugaccgauuuaucuauugcaucc

SEQ ID NO: 1846 - RNA, 76 nt, Transmissible gastroenteritis virus
uuuagagaaguuuaaagauccgcuacgacgagccaacaauggaagagcuaacgucuggaucuagugauuguuuaaa

SEQ ID NO: 1847 - RNA, 62 nt, Sulfolobus virus SIRV-1
aagcuaauuuuacgugaguuaaaaguuuaaaaagauuucuuggaaauucacguuauuaguuu

SEQ ID NO: 1848 - RNA, 63 nt, Brome mosaic virus
uuguggucuaacucaagacuagcugaaucggugcuauaaccgauagucgugguugacacgcag

SEQ ID NO: 1849 - RNA, 89 nt, Human papillomavirus type 60
aggaggaggagcacuaucccuauacaauagacaccuguugcaaaccuuguggagcagguguuagauuuacuauuauugcuacuccuucu

SEQ ID NO: 1850 - RNA, 65 nt, Pestivirus type 3
uuuauuugaugggauguagauggcaacuaacuaccucauaggaccacacuacacucauuuuuaaa

SEQ ID NO: 1851 - RNA, 60 nt, Paramecium bursaria Chlorella virus 1
uguacguaauggacaucauagguacgauagcaguaucuuucuugguuucuuauuuguaua

SEQ ID NO: 1852 - RNA, 81 nt, Human papillomavirus type 65
cauuagcaguaacugaauauaaugcaaaacaagcaauacaaauacauuugacuuugcagucauuauuaaagucuccuuaug

SEQ ID NO: 1853 - RNA, 82 nt, Human papillomavirus type 55
guuuuagagcuggauccuccugacccuguaggccuacauugcaaugagcaauuagacagcucagaggaugagguggaugaac

SEQ ID NO: 1854 - RNA, 66 nt, Human papillomavirus type 63
gugccuaaaucuguuucuguuauuuuaggggcauuugacgguuccuaaggguggguguugggguau

SEQ ID NO: 1855 - RNA, 82 nt, Human papillomavirus type 44
gugcagugcacaggaacagacauccaucaccuacauacgcuucugcuggguucacuggauauauuguguccugugugugcgc

SEQ ID NO: 1856 - RNA, 81 nt, Human papillomavirus type 25
cgauacauaaaaggugaguuaugugccaaaucagauacagucugugccaaacucaggcagcugcucgccagaugcguaucg

SEQ ID NO: 1857 - RNA, 93 nt, Fowlpox virus
auuacuguuaccgcuguaauaacaaaaguaucuauaauucccauuuauugauaauuaacuuuugacaauauuuauaauaguuuaacuaguaau

SEQ ID NO: 1858 - RNA, 99 nt, Paramecium bursaria Chlorella virus 1
aaaggagaaauaucagauuaugacggguacuauuggauaccgacgaacaaguaauuuguugauacgauauuacaccaucauuauuuuauguacuucuuu

SEQ ID NO: 1859 - RNA, 80 nt, Monkeypox virus
auaugacuagaccgaugaccauuuaaaaaauacucucuagcuuuaacuuaaacuguaucgaucauucuuuuagcacaugu

SEQ ID NO: 1860 - RNA, 68 nt, Human papillomavirus type 63
gucugaaggggggcccuaaucaacuuaagugcuuaagguauaggauuaaagcuucaaauucaucugac

SEQ ID NO: 1861 - RNA, 83 nt, Feline immunodeficiency virus
uauuuguaaauggauauccuauaaaauuuuuauuagacacaggagcagauauaacaauuuuaaauaggagagauuuucaagua

SEQ ID NO: 1862 - RNA, 75 nt, Feline immunodeficiency virus
gaacaaauuauauuaauguacauuuagagauuagagaugaaaauuauaagacacaauguauauuugguaauguuu

SEQ ID NO: 1863 - RNA, 112 nt, Human herpesvirus 1
uggguguuuuugggguguggcggacgcggggcggucauuggacggggugcaguuaaauacaugcccgggacccaugaagcaugcgcgacuuccgggccucagaacccacccg

SEQ ID NO: 1864 - RNA, 74 nt, Equine herpesvirus 2
cucauugugguuuucgcgccucagaguuguuaaccacauucggcaaaaggggaaguaugaaacccacaagggag

SEQ ID NO: 1865 - RNA, 87 nt, Camelpox virus
uuuuuauucuucauucguuacgacuuuuaacacacccgaauguaucgacaaagggcaauauuuugcgucauuuauggaguuagaaaa

SEQ ID NO: 1866 - RNA, 75 nt, Human papillomavirus type 89
acuggcagaacgagcacagcaggccuuuagggugguaacuacguguggugugugcuaucgugcaguuagguuagu

SEQ ID NO: 1867 - RNA, 67 nt, Monkeypox virus
gauuuucaauuauguaucauuauagcaacaguaauucuugcuccuccuugauuuuagcauccucuuc

SEQ ID NO: 1868 - RNA, 127 nt, Human papillomavirus type 15
gaccugcauugcuacgaagaguuaagugaagaagagacagaggaggagccacgauuuauuccuuacaagauuguaguuccguguugcuuuugugauuccaagcuucgacuuauagugguugcaacuc

SEQ ID NO: 1869 - RNA, 64 nt, Human papillomavirus type 9
gcaagacuucguuuauacgugcuugcuacaaauuuaggaauucgagcgcaacaggaacuuuugc

SEQ ID NO: 1870 - RNA, 65 nt, Equine herpesvirus 2
acacuacauuucucagaaccaaaaauuucuaaauaaagauuuuuucuaugaaauucauaaagugu

SEQ ID NO: 1871 - RNA, 78 nt, Paramecium bursaria Chlorella virus 1
gagauaaguuucauaaguuuauuuuauuaucauuucaaauauuuugauuucuuuuucuaaauuugugaaauuuuuuuc

SEQ ID NO: 1872 - RNA, 131 nt, Camelpox virus
auuauuacuauagaagauguuagaaaaaaugaugcugguuauuacacauguguuuauauauauauauauauauaaguaaagcauauaacgacuaaccagaauuguaaaauuauagguacugauagaauaau

SEQ ID NO: 1873 - RNA, 100 nt, Cercopithecine herpesvirus 7
acaaagcauuuccacaacugcuggguuuacaugggaaacaaagcauuuccacaacugcuggguuuacaugggaaacaaagcauuuccacaacugcugggu

SEQ ID NO: 1874 - RNA, 95 nt, Human papillomavirus type 84
ccaaccugcaaaaccagcacagcuggccuauagggugguaacagaguguggguuguguagccguccaguuaggcuggcggugcuuuguggagugg

SEQ ID NO: 1875 - RNA, 62 nt, Human herpesvirus 5
ggcgguggcgaucaaaaggcgcguaugagaaaccguuuauagaguguaauagaaucaccguc

SEQ ID NO: 1876 - RNA, 61 nt, Bovine adenovirus B
ggucgucggaaguuacugauggaacaacaagcgccgcccaacuucaaauuuccagccgacc

SEQ ID NO: 1877 - RNA, 82 nt, Pepper mottle virus
ugauguggucucugggaugaaauauuauuauauguaguaugcaauauauaguauggcuuuucucguuccagucuuuauauua

SEQ ID NO: 1878 - RNA, 92 nt, Fowlpox virus
cuguucuacggaauuaacaacucgugaauauaaagauacaacauucaguauaagaaaauaagaagcacaguuauaucauugcguagcaacag

SEQ ID NO: 1879 - RNA, 131 nt, Rat cytomegalovirus
auauggguggggcgggcgugggagggaccuagucuguggggucauguaugggagggggcugaccuacgagggucagggugagaggaaguugauaugcagauguggucugacacguagguagaguccuauau

SEQ ID NO: 1880 - RNA, 86 nt, Lymphocystis disease virus 1
uguuaaucaucaauccguuacggaaacaaauuaucauuuuuauaaaaaugguuugugguuucuguuuaggguuaccuuuauuaaca

SEQ ID NO: 1881 - RNA, 122 nt, Mouse parvovirus 1
aucauuuuuagaacugaccaaccauguucacguaagugacgugaugacgcgcgcuucgcgcgcugccugcggcagucacacgucacuuacgucucacaugguuggucaguucuaaaaaugau

SEQ ID NO: 1882 - RNA, 90 nt, Y73 sarcoma virus
gaccgucgauucccugacgacuacgagcaccugaaugaagcagaaggcuucauuuggugaccccgacgugaucguuagggaauagugguc

SEQ ID NO: 1883 - RNA, 95 nt, Tupaia herpesvirus
gcccgacgucagucagucaccugaggcggugagccacacagcccggggugaggagcggaggugagcgagggacggcguagguggcgacggugggc

SEQ ID NO: 1884 - RNA, 127 nt, Sheeppox virus
aacuuauuauuguuagaugacgaaauaacugauagaccuacuuucggauauaugugaaucgacauuguaucaguaacuauaaauucuauacccguuauuuuguuauaauuauuaacgaacauuaguu

SEQ ID NO: 1885 - RNA, 71 nt, Equine herpesvirus 1
ggguuuaagcaaucagaggcgugucucauuuugguacgccacacgccguacgucugaaagauaucaagccc

SEQ ID NO: 1886 - RNA, 92 nt, Canine adenovirus
cacauuagcauaagauguacuuguaacaaaccgcguccucaccuaagccuaauugaggcggccuguucuauguauaaccuugacuagaugug

SEQ ID NO: 1887 - RNA, 64 nt, Melanoplus sanguinipes entomopoxvirus
uauuuugaaagauaugaguaaaauauuuaaugaaauaaguaacuuauuuaauaauuucaaaaua

SEQ ID NO: 1888 - RNA, 88 nt, Human herpesvirus 7
uaaaaacgauauacugacucggauuugauaguuuaugcaaauuagcguccaccucacucguaauaguauuuauuuuucaugguuuuua

SEQ ID NO: 1889 - RNA, 96 nt, Ovine adenovirus A
accugaguguucaaaaaaaucaauaaaccaucccucaauaaacuugugcugacaucaauaguaggagugguuuucuguauaaguacuagcucaggu

SEQ ID NO: 1890 - RNA, 76 nt, Tupaia herpesvirus
ggagagggacagagaggacacaacggagucgagguugccaaggaaccgggcguuuuauugucuuuuuugcgucucc

SEQ ID NO: 1891 - RNA, 70 nt, Fowlpox virus
ggauagcucugcgcagcuauaccccacuuaauaaauuauaccgcgcagaguauaaaagauuauauuaucc

SEQ ID NO: 1892 - RNA, 63 nt, Lumpy skin disease virus
auuuguuauuaaaugaauaaaauuagauucaucuauaucuucuucacucauuuaaaaacuuau

SEQ ID NO: 1893 - RNA, 60 nt, Vaccinia virus
aaauaaaauucugauuggucaaugugaauguauucacuuaacaguuccacaaauuuauuu

SEQ ID NO: 1894 - RNA, 115 nt, Equine herpesvirus 1
guggugggagugggcgugguaugcggggguucuuuguuuaaauugggcccaggcggaucagugccaguuuuguuugcauugggggccugugcggcaugcgacacuccucaauugc

SEQ ID NO: 1895 - RNA, 70 nt, Equine herpesvirus 4
cuaccaaucuucaaauaucgcccauuuaacaguacaaaacuaggggguauggcgguuuugaagcucguag

SEQ ID NO: 1896 - RNA, 60 nt, Variola virus
aaauaaaauucugauuggucaaugugaauguauucacuuaacaauuccacaaauuuauuu

SEQ ID NO: 1897 - RNA, 91 nt, Gallid herpesvirus 3
ggcgcgccaauagguagggauggaucuacguaugucaauggaggccguauaaagcuucaauaauacguucccuaaaaugcugugcuccgcc

SEQ ID NO: 1898 - RNA, 64 nt, Simian immunodeficiency virus
gggaauacagacaucauuggcaggugcaauggcaguuuuggaccuacagccaguucauuauccc

SEQ ID NO: 1899 - RNA, 63 nt, Sorghum chlorotic spot virus
ggcgcuacagauguaauugacgaaagaucuguauuugucuaugaugggaugugguggguugcc

SEQ ID NO: 1900 - RNA, 70 nt, Canine adenovirus
acagaaaauccgcaggagauuccagcauuguuccaagcugucuaacaaaaucuuccucauaaugaacugu

SEQ ID NO: 1901 - RNA, 83 nt, Chimpanzee cytomegalovirus
acgucgagcccgcguuggggcauaucacgcuacuguacagcucugcacuaagcacuuuauacucucaccggcacguucgacgu

SEQ ID NO: 1902 - RNA, 69 nt, Monkeypox virus
uagucacgacugaaauaaccgcgugauuauuuuuugguauaauucuacacggcaugguuucugugacua

SEQ ID NO: 1903 - RNA, 106 nt, Rat cytomegalovirus
gagagagaaagagacagagagacgcgagacgaaagagaccacgggacgccacacgaccacguuuuuaucuuuuuuuauucugcguuuuuuauccgcuuucuuuuuu

SEQ ID NO: 1904 - RNA, 61 nt, Human papillomavirus type 4
uuugauaaugauagacagaaugcaaugcuguacacaaauugggacuuuuuauauuaucaag

SEQ ID NO: 1905 - RNA, 108 nt, Canine adenovirus
agaaauugcuugcgccaaagaacguuugaaauauguuacugcaucaacgugcucagaaagaaguugagagugacaaaccacuuuaaagguuaagccaggcuuguuuuu

SEQ ID NO: 1906 - RNA, 76 nt, Variola virus
gauuauuuuuugguauaauucuacacggcauaguuucuguaacuaugaauucuacccccguuacauuuguauaauc

SEQ ID NO: 1907 - RNA, 67 nt, Rat cytomegalovirus
caugggauccgguucguaaucgcgcuaucgucuucguaaagguugucguuacgaacauaucccgaug

SEQ ID NO: 1908 - RNA, 96 nt, Tupaia herpesvirus
gacgauucaccuaccuggcguugcagcguuauuacggauacggaucggauaccgaauggcuagcugccaccuccgcccucgucggucgagucaguc

SEQ ID NO: 1909 - RNA, 101 nt, Macaca mulatta rhadinovirus
cccuucccgagcgagugcgguuucucacaugccgugagcaaacgaaaacgcuacacauaauaagacacgugugagaggaaaacuuuauugcagggacaggg

SEQ ID NO: 1910 - RNA, 130 nt, Cowpox virus
acgaaaaaugaugaaggcaaucauuccucauaagaugauaaaaaguaaggugugugugugugugugugugugauaaaaaguguagugagugagaguauuagugagugagugagugugugagugagugagu

SEQ ID NO: 1911 - RNA, 66 nt, Bovine parvovirus
cuugguauagaaacaugauguaucacuuugccuuggggggugauugugaaaaauguaauuacuggg

SEQ ID NO: 1912 - RNA, 70 nt, Porcine adenovirus A
uguguucuccucccgccgcuugugcagcaccaccucccgcugcucgagcugaggauccgugauggacaca

SEQ ID NO: 1913 - RNA, 78 nt, Cowpox virus
gucguucucguucagaaucuuucgcagcauaaguaguaugucgauauacuuaucguugaagacucuuccagagacgau

SEQ ID NO: 1914 - RNA, 83 nt, Human herpesvirus 4
ccuacgcgaggcugaaccuccugaaucacugcaucuuucuugaggcguuuaaagaagagaauaguggccagggccucgguggg

SEQ ID NO: 1915 - RNA, 83 nt, Turkey adenovirus 3
cuguaccugcuccuacaguuucugcuguaccaguaccugcugcuccuguagcuguagcugcuaagagacguagaguagguuag

SEQ ID NO: 1916 - RNA, 76 nt, Peanut chlorotic streak virus
ggauaaaacgaaucuuuaguaugagcuauuauagaaguagaauaauagaaacaauacaacgagaaauagauugucu

SEQ ID NO: 1917 - RNA, 64 nt, Paramecium bursaria Chlorella virus 1
cuccauauuuuaccauugacaaacucacaucuacuguaaggucaaaagaugguaaaaucacgag

SEQ ID NO: 1918 - RNA, 66 nt, Paramecium bursaria Chlorella virus 1
guauuauacauauaucuguugauaugauugucacuuuaccauaucaacaauauauaguuuuaauau

SEQ ID NO: 1919 - RNA, 67 nt, Trichomonas vaginalis virus 3
gcgccgcgaggguagguggucgauagcccguuugacggaguagcgauauuccugauucugguguagc

SEQ ID NO: 1920 - RNA, 82 nt, Porcine adenovirus A
uccaacaacuguuuauguaaaggaaaauaaagacucagagaaaauccaaguucauaugauuuuucuuuuauugauuggggga

SEQ ID NO: 1921 - RNA, 116 nt, Tupaia paramyxovirus
uuucuuauuauauaucaauuaaugacuaucuuaacuuuauagagcuuucauacuaucgcaauuauauaucaugaaucauuuauaaaggaugugcaugaauaaaccaauuaaagaaa

SEQ ID NO: 1922 - RNA, 74 nt, Myxoma virus
cgauagagggauuuagagaccuuucuuccacguuagaacgacgacguaaggacgaaagggagguuucuuuuucg

SEQ ID NO: 1923 - RNA, 74 nt, Cowpox virus
uuaguguuggaauuauuaguauucuucuugucaucuuguucagaaauauacaacaaugcuauaccuaauacuaa

SEQ ID NO: 1924 - RNA, 70 nt, Human papillomavirus type 48
guagaauguuuacauuauuaauacugugaaucaaacaaacugugaucaauaaacacugugaauauuuuac

SEQ ID NO: 1925 - RNA, 64 nt, Gallid herpesvirus 2
auauguuaauuggaauauacacugcuauaguuuacgggcauucgaaaauaauccuaacacauau

SEQ ID NO: 1926 - RNA, 102 nt, Human herpesvirus 7
gcgcggcacucaaucguuacugguggcugcuucugggacgacacaagcucaguuugguaugcaacuacgucacagcucaucgccaacaguuacugccgcugc

SEQ ID NO: 1927 - RNA, 79 nt, Human herpesvirus 1
uauguucuuuuuuuauugggaggcgcggguaggcggguagcuuuacaaugcaaaagccuucgacguggaggaaggcgug

SEQ ID NO: 1928 - RNA, 101 nt, Human herpesvirus 1
gguccguuuugucacgggaaaggaaagaggaaacaggccgcggacacccgggggaguuuguguucccuuuucuuucuucccacacacacaaaaggcguacc

SEQ ID NO: 1929 - RNA, 72 nt, Paramecium bursaria Chlorella virus 1
gugguuucuacucaaaagcucgaacaacgccucgggaaagacccacguauuuacgcuuugagaaaauaccac

SEQ ID NO: 1930 - RNA, 76 nt, Feline calicivirus
ugagcaaaggguacaaggcccaauccaauccguucgccuugcgcgcgcggcuggauuuaggguugacccuuacuca

SEQ ID NO: 1931 - RNA, 65 nt, Eimeria brunetti RNA virus 1
uaggguucugcuauucagacguacgcacauuaaguguaguaggccgucauguggugguaagccua

SEQ ID NO: 1932 - RNA, 76 nt, Chimpanzee cytomegalovirus
cauggccuguguaacuagccuucuagugaaaguuaccgaaaacgcauuucacuagaacgcugguucagaggcuaug

SEQ ID NO: 1933 - RNA, 66 nt, Pea enation mosaic virus-2
gggaagccggggagucaccaacccacccugaaucgacagggcaaaaagggaagccgggcaccgccc

SEQ ID NO: 1934 - RNA, 103 nt, Gallid herpesvirus 2
gaaacaagcaauauauucuuaaguuauagguacgucaaaccacaucaagguauauccccucucuuuauaaacuguacaaucauacucauauauuguagguauc

SEQ ID NO: 1935 - RNA, 80 nt, Chimpanzee cytomegalovirus
auaguaaaaccucccgaaucucagucucucgaagcgugguucugccagcguccaugccucgggagcucgaagggugcuau

SEQ ID NO: 1936 - RNA, 82 nt, Human papillomavirus type 19
gauacgggcgcgguuagaaguuacucauucggugcuuguuguugccaacaaucagcguuaugaacuuguuucugccuguauc

SEQ ID NO: 1937 - RNA, 91 nt, Human papillomavirus type 23
acauuuguuggcaagaaaagagcaccgauaacgguaagaacuuuuauuuuuugaccguaggcguucauuuacuaaccuuggcaacaauugu

SEQ ID NO: 1938 - RNA, 62 nt, Human papillomavirus type 36
ugcuauauucaaguuuuugccuguaucguuuucguaucaugugaauaauauacuguauagua

SEQ ID NO: 1939 - RNA, 60 nt, Aleutian mink disease virus
uuaaaguaaccuaacaccauaacacuuuacuuuccuuguacuuauguuacuuuacuuuag

SEQ ID NO: 1940 - RNA, 90 nt, Banana mild mosaic virus
gaaguuaauggaaauagggcguuuguuagggguugugaaauaaacgaacaacuggcuucagugauuagagagcucaaaccaguuaaguuc

SEQ ID NO: 1941 - RNA, 70 nt, Human papillomavirus type 25
guguuauacauauauauauauauauauauauauauauauauauauauauuauauauauacacguagacac

SEQ ID NO: 1942 - RNA, 67 nt, Human papillomavirus type 20
gugauuaauauauauauauauauauauauauauauauauauauauauauauauauauauagauacau

SEQ ID NO: 1943 - RNA, 72 nt, Human papillomavirus type 49
gcggucacauuauacuuagucaucucuugugguuguuaacaacaaucuugaaacagauauacauguaaccgc

SEQ ID NO: 1944 - RNA, 79 nt, Human papillomavirus type 9
acguaggugguuauuugaucguugggaugauugugguuaacaacaaucuacauacacauuuucauaugaccgccuucgu

SEQ ID NO: 1945 - RNA, 70 nt, Vaccinia virus
guaauacuaucuauaaacauaaguauauaauaaauacuuuuuauuuacgguacucuuguaguggugauac

SEQ ID NO: 1946 - RNA, 61 nt, Human herpesvirus 4
gcaauuugccuaacauggaggauugaggacccaccuuuuaauucucuucuguuugcauugc

SEQ ID NO: 1947 - RNA, 67 nt, Human herpesvirus 1
uguccuuacuccgucuugguggguggguggcuguguauggcgucccaucugugcggggaggggggca

SEQ ID NO: 1948 - RNA, 81 nt, Meleagrid herpesvirus 1
ugaccagugaacaauuuguuuaauguuaguuuauucaaugcauugguugcaaauauucauuacuucuccaaucccagguca

SEQ ID NO: 1949 - RNA, 122 nt, Porcine adenovirus C
gaucuuucccacguuguaugccaucuuccagcagagccgcggaguagacagcaaccucaagguuaaaaacagaucacuucgcucucucaccaaaagcugcuuguaucacaaccaggaaucuc

SEQ ID NO: 1950 - RNA, 87 nt, Fowl adenovirus A
gucguacacccggcugacgagaaacacgcuucggggguggaccagggcugguucuucccgaacgaggacauagucagcggugaugac

SEQ ID NO: 1951 - RNA, 130 nt, Cowpox virus
auucaacuuguuaaauuaauaauggauaguuuaaaauaguuauuaguaguaauaagauaguuuaaaauaguuauuaguaguaauaagauaguuuaaaauaguuauuaguaguaauaagauaguuuaaaau

SEQ ID NO: 1952 - RNA, 114 nt, Tupaia herpesvirus
gucgaggaacacgcccccggaccccguauaaggccggcgggcgccucggacuucuucuuuuuuggcgaggaacacgcccccggaccccguauaaggccggcgggugccucggac

SEQ ID NO: 1953 - RNA, 63 nt, Chimpanzee cytomegalovirus
gaucgucuuuuuggcugugaagucccucaauaaauacuagugaacucauugccuccggcuguc

SEQ ID NO: 1954 - RNA, 76 nt, Cercopithecine herpesvirus 7
augcaauauuacuaauauuuucacacgcuuauauaccuauuggacaauguuguauaucccaccccuaauauugcau

SEQ ID NO: 1955 - RNA, 65 nt, Fowlpox virus
aguucuauuacauugcuagcuacuuguaggaaugcuaaaguacuuauagaauuuaguauagaacu

SEQ ID NO: 1956 - RNA, 116 nt, Ophiostoma mitovirus 3a
cuuagagacuacuuugucuuucaaauaugacuacucccucucauccauuggucuguuaaaccaauguggugaugauagguaagaugcaaauuuaaaggcuuauguauaucucuaag

SEQ ID NO: 1957 - RNA, 126 nt, Cercopithecine herpesvirus 7
acuggaauguacugggauguacuaagggcgugguuuguuuacauuuuuaacacaaaauaaaagucuuguucaugugacuuuguauaauuuacuaccaaccuuuaaauguuucauauuauaaaaagu

SEQ ID NO: 1958 - RNA, 64 nt, Molluscum contagiosum virus
gcuggcacggccggcgccgcgcaagaugacgacgggagagguugcgcggggcaggcagugccgc

SEQ ID NO: 1959 - RNA, 72 nt, Fowlpox virus
aucgcagaauguauaaagaauauaauacuaaacuuugcucuaguagacauacugauauucauuauacacgau

SEQ ID NO: 1960 - RNA, 91 nt, Lymphocystis disease virus 1
uugacgauaaaccuauagaguugcuuuagcauuaauaaauguaaaacuauauaguauauauuuauuaccguugauuguaauaauacgucaa

SEQ ID NO: 1961 - RNA, 82 nt, Clover yellow vein virus
gcaaguuacacaaacaaagcaaaguaagccaacaguuuucuguaagaucauuucaguuucgucuuucuuuaaucguacuugc

SEQ ID NO: 1962 - RNA, 70 nt, Ovine adenovirus A
uggaagagauuuucuaacgccgcgacuaaagagcugugguaaaagacuuuaacgugcgugccgucuucua

SEQ ID NO: 1963 - RNA, 91 nt, Sugarcane striate mosaic associated virus
cuuuuaucaccggcugcacugaucaaaagugguuggauacugcaaucaaacaccugagaccagacaaucaaagaucagguugguuuagaag

SEQ ID NO: 1964 - RNA, 130 nt, Rat cytomegalovirus
gauauaauuuuauguauguggaguggaagcggagcgugauauauugcgaugugaagcagaggcggaugagccggguuggauauccaaucaauugaguacuguggccuuuuaaauaugggaauguuauguc

SEQ ID NO: 1965 - RNA, 85 nt, Variola virus
uuaguauuaauugcuaccguuacauuguacaaauggagauauucccuguauuuggcauuucuaaaauuagcaauuuuauugcuaa

SEQ ID NO: 1966 - RNA, 76 nt, Apple chlorotic leaf spot virus
agaguauaaagagucaugguauuuaauuggaguguuuagacuuauaauaaauagccuguagacuuuuaaauauuuu

SEQ ID NO: 1967 - RNA, 85 nt, Human respiratory syncytial virus
ugcucuaccaucaugcugugucaaauuauaauccuguauauauaaacaaacaaauccaaucuucucacagagucauggugucgca

SEQ ID NO: 1968 - RNA, 83 nt, Apple latent spherical virus
uucuuucuuucuuuugaacuaguuuguucucgugauccuuggauccguuaagguuucuugcugguucuuccuuaagaugagaa

SEQ ID NO: 1969 - RNA, 67 nt, Cercopithecine herpesvirus 7
caauuuaauacuaguuguacauuccauguaauacuuauuuauauagacguuuuaaauuaguuuauug

SEQ ID NO: 1970 - RNA, 80 nt, Cherry necrotic rusty mottle virus
acuugaaaccucauucacauagcuuagguuuuuaggcacuccaauuugaauauuauuugagugugugugagcuuucaagu

SEQ ID NO: 1971 - RNA, 69 nt, Human herpesvirus 5
gccaaaaguugcgugucugaguggacguggguuuuuauagagucguccuaagcgcgugcggcggguggc

SEQ ID NO: 1972 - RNA, 96 nt, Tobacco etch virus
cuuuuaagcuuauuguaauauauaugaauagcuauucacagugggacuuggucuuguguugaauaguaucuuauauauuuuaauaugucuuauuag

SEQ ID NO: 1973 - RNA, 60 nt, Sulfolobus virus SIRV-1
aauaguuuuguguauuacauuauauaguauaauauauaguauauaauuuccgggauuauu

SEQ ID NO: 1974 - RNA, 80 nt, Human papillomavirus type 15
gugacuaaaccgcauaggucauugccaacaaccgcacccgguuaaucagauauaaaaugcaccuggugcgauuuuaucac

SEQ ID NO: 1975 - RNA, 86 nt, Common chimpanzee papillomavirus 1
uaacguguaguuuugaugauggugacacaugguuguuguuauggcuuuuagcaucacuuauuguugcuauuuuaggguuacuguua

SEQ ID NO: 1976 - RNA, 85 nt, Human herpesvirus 3
uguucagucuaaaaauaauguuggguauuuauaauuaccgcccccguguuacuuggaaacacccauacauauguuccacucuaca

SEQ ID NO: 1977 - RNA, 74 nt, Acute bee paralysis virus
ucgcaacacaacaugguuacccauagauugaggaaauuuccaauaaacucaguauuaaggcuuguuguguugga

SEQ ID NO: 1978 - RNA, 80 nt, Gallid herpesvirus 2
guagcacucgaaauuucaaacggcauguaaauacgaauguccuuagaaagcgacguuuagcggcugguguucgaugucac

SEQ ID NO: 1979 - RNA, 60 nt, Fowlpox virus
aucacucaagauuacuuacuucuauuuuaauguauagauuaaaagguuauuucguaugau

SEQ ID NO: 1980 - RNA, 124 nt, Equine herpesvirus 2
ugaagacccgagagaagagcuuuacaaaaaacacaaaaaaacaaaaauuucaauaaaaacaauuuaaauuuuauuuaucuuuguaugugugucucuugcaacccccaccccuuauagaucuuca

SEQ ID NO: 1981 - RNA, 91 nt, Paramecium bursaria Chlorella virus 1
uuggauuauucauuuuuaugaacuauguuauuuacaaagcuucgaaagugaguauauugugcagacgugguucuuggguuguuguaaacga

SEQ ID NO: 1982 - RNA, 67 nt, Amsacta moorei entomopoxvirus
augauauuaucgauaguugugauaaugugcucuuuuauuuuauuaauugcgaugauuauaauauuau

SEQ ID NO: 1983 - RNA, 91 nt, Camelpox virus
uaggaaauugguuuauaauguauaauuuuuuuaguuuuuauagauucuuuauucuauacuuaaaaaaugaaaauaaauacaaagguuccug

SEQ ID NO: 1984 - RNA, 75 nt, Potato virus Y
ugcuaaguuucaguuuaaaucauuuccuugcaauucucuagaacaauauuggaaaccauuucaacucaacaagca

SEQ ID NO: 1985 - RNA, 67 nt, African swine fever virus
uuaagucuauuguucauggcuuaagucuauuacucauagcuuaacuccauuacugaucaugacuuaa

SEQ ID NO: 1986 - RNA, 81 nt, Human herpesvirus 6
uuguuuaccgacgcguucaauaaaacgaaugguuaaaaguuguuuuuuguuuuuuuuauuuucguauaaaaugguauuuag

SEQ ID NO: 1987 - RNA, 63 nt, Variola virus
aagcguuaucacacugcgacgugcugacaaaacccacguugguuuugccgugugcauucgcuu

SEQ ID NO: 1988 - RNA, 99 nt, Equine rhinitis B virus
uagcgaccaaaugcaacauaaacuuagacaaucuauuuaucuccaugacuaucggaacagacaaaauuguaaccacuucguuuugcuccuucaucgcua

SEQ ID NO: 1989 - RNA, 96 nt, Meleagrid herpesvirus 1
gcuucgccgcggcccgcgaccgcgcgcugcgcgcggugccguggcggccggcgaugguggacacgguggcgggcgcgguggcggacgcgguggagc

SEQ ID NO: 1990 - RNA, 131 nt, Monkeypox virus
acauuauauacauuauauacauuauauacauuauauacauuauauacauuauauacauuauauacauuauauacauuauauacauuauauacauuauauacauuauauacauuauauacauuauauacauu

SEQ ID NO: 1991 - RNA, 103 nt, Vaccinia virus
cugugaccaagauagagagcuccuuuggugaauccaucucuauguuucaguuuaaccaagaaacagucagcuggucuaaaauuuccaucucuaucuaauacag

SEQ ID NO: 1992 - RNA, 63 nt, Vaccinia virus
agaaaaccaggcagcguuuguaacgcuuugguauaccagcgauacacagcguacugaauuucu

SEQ ID NO: 1993 - RNA, 77 nt, Ictalurid herpesvirus 1
uguaguccuacaaucaagcgagguuguagacguuaccuacaaugaacuacaccucuaagcauaaccugucgggcaca

SEQ ID NO: 1994 - RNA, 80 nt, Ictalurid herpesvirus 1
uuacuauuggacuguuuauacuuaucuucaaauguucacucacagcagcgaaggggacacuagaaaacacucccaaguag

SEQ ID NO: 1995 - RNA, 70 nt, Equine rhinitis B virus
ggcgacacauuucuagacaggcuguugaaaauggacuacuguuuuacauauuacccuucuucaaaucgcc

SEQ ID NO: 1996 - RNA, 68 nt, Ictalurid herpesvirus 1
uaaccuuagcucuaacucugacccuaggccuaacccuaagccuaacccuaaccguagcucuaaguuua

SEQ ID NO: 1997 - RNA, 60 nt, Rat cytomegalovirus
gcgcgccucgucgaccgggcgaccggaccccgcgggcccgggucucggucguucacgcgc

SEQ ID NO: 1998 - RNA, 85 nt, Rat cytomegalovirus
guccgagguccuggucgcauuaucguggguguguucuucguccagcauccaggccgcucgagacccgcuggcgagggccucggau

SEQ ID NO: 1999 - RNA, 80 nt, Rat cytomegalovirus
uucaguacguaguagcuucucgaacagauucguucguuuacaaugagccaguuuuuucagauggauuuuacuguggugaa

SEQ ID NO: 2000 - RNA, 60 nt, Rat cytomegalovirus
guccuucucugcuucuuuucuguguucucuugccuuuuuucacgggggcugaagaaggac

SEQ ID NO: 2001 - RNA, 131 nt, Melanoplus sanguinipes entomopoxvirus
auauacccccaauuagcccccaauuggcacaugguaauauaccgccauggcgccgugcuugguauugguggugauguucacauaaacagccagcuggggguguuuuguuuaggugggcuuuugugguauau

SEQ ID NO: 2002 - RNA, 126 nt, Meleagrid herpesvirus 1
uucguggcgggcggccugauccugcugggcgcgugcgggcugacgguguggcugugccgccgcgcgcggcgggcgcucgacccgucggcgcucgggcccggcgcggagaaggcggcccugcucgag

SEQ ID NO: 2003 - RNA, 70 nt, Monkeypox virus
accccgcuccugggacaaauacuccggaaaccuccagggaucggaaauuuauuuagaagggggguggggu

SEQ ID NO: 2004 - RNA, 60 nt, Ictalurid herpesvirus 1
gcagcgcggcgcacagagcgaaggcagcggcuuucagacuguuugccaagcgcagucugc

SEQ ID NO: 2005 - RNA, 68 nt, Melanoplus sanguinipes entomopoxvirus
agaucucccccaugcaaauguuuuaggguaggcuguacauggaauagguaaacgcuugggggucuucu

SEQ ID NO: 2006 - RNA, 83 nt, Melanoplus sanguinipes entomopoxvirus
guuugggaaaaggagauuucugcaggugcagugguucccccgggccuuauaucuugcagcuuuagaaaucugcuuucucaaac

SEQ ID NO: 2007 - RNA, 63 nt, Rat cytomegalovirus
guccaacaacauauacucauagagcuuaucaaacauccccugugcccaucuagguugccagac

SEQ ID NO: 2008 - RNA, 112 nt, Melanoplus sanguinipes entomopoxvirus
gguuuaauauuuucuuaguacaaaagucaauguuuuaaaauauauggaugagagaauauuugucuguauaaaaacugugugaaauuuuguaccaaagaaaaaaacgugagcc

SEQ ID NO: 2009 - RNA, 65 nt, Rat cytomegalovirus
gggagguucuuauauuccagggcucugacagguaucucacuguuaucuccccuggguuuucuccu

SEQ ID NO: 2010 - RNA, 131 nt, Melanoplus sanguinipes entomopoxvirus
ccaucagaaagagaauaaaaauauuuuuguaaaacuuuuuuaugagaccaucgaagagagaaagagauaaaacuuuuuuacgacuccaucagaaagagaauaaaaauauuuuuguaaaacuuuuuuaugag

SEQ ID NO: 2011 - RNA, 129 nt, Bovine syncytial virus
caucguuaaaauuuuuagcauauccaucauuuuuuaaauuuucaaaugauucucuagauuuccauaaauauccuggaucuaaauuagaaucagaaacuuuaaauuuauauucuauaguuuuuaaugaug

SEQ ID NO: 2012 - RNA, 61 nt, Rat cytomegalovirus
gacgguggaggggcgggcgccacgggcucgggggaggauggcgcuuggccugcagaccguc

SEQ ID NO: 2013 - RNA, 83 nt, Paramecium bursaria Chlorella virus 1
ccaugaugaagguccucaaugccaucaaggagucugguaaggacuacuucauccagcucgaugaggcagacucugucaucagg

SEQ ID NO: 2014 - RNA, 68 nt, Melanoplus sanguinipes entomopoxvirus
uauuaaauguuguauuuuuacuagguucagguauauucucaaacccauaaaaauuuuuaauuucaaua

SEQ ID NO: 2015 - RNA, 73 nt, Lettuce infectious yellows virus
cguaauuguaucagcgaauguacaugaaucauuuauccuaacugcaaucugugcacacgcuguagugauugcg

SEQ ID NO: 2016 - RNA, 60 nt, Lettuce infectious yellows virus
guaacgguaaaauaauauaaacuuaguuuaacuccuaaaguagaucugauuaauuguuac

SEQ ID NO: 2017 - RNA, 63 nt, Equine rhinitis A virus
gcgacaaacuugaggaccaaauaaugcauuggcaauugaugcgguuagagcaagcuuuguugu

SEQ ID NO: 2018 - RNA, 92 nt, Rat cytomegalovirus
guugccggcgcgggcccagacgcucggggcgaagcucuggagguccagcgggccguagagcgucucgacggaggugggucccggcggguaau

SEQ ID NO: 2019 - RNA, 63 nt, Fowlpox virus
guaugggaaaacaaauagguggacuguuauuguggguucacacguuauauguucuccuaguac

SEQ ID NO: 2020 - RNA, 65 nt, Paramecium bursaria Chlorella virus 1
guagacguaaucgacuuagaagcggauuauaaaaccguauuugacgugauuuauuacauguauac

SEQ ID NO: 2021 - RNA, 60 nt, Fowlpox virus
uucaucaauuaaugccuauuaugauguagucucugcgcauagguaugauuugaaguugag

SEQ ID NO: 2022 - RNA, 78 nt, Fowlpox virus
cucgccggggcucuagaauacaaaaugcgcacggacgcucguauaaacucgcgcauuuuuauuugaaguuaaaucgag

SEQ ID NO: 2023 - RNA, 76 nt, Fowlpox virus
aaucgcgccguagagacacguacgcguuguauuaacacauacuggaaagaacaucgcgcacagcuacggcgggauu

SEQ ID NO: 2024 - RNA, 94 nt, Fowlpox virus
aggcccuguuuuauuaacaacauuaaagcauucucagaggaaagguuuaaccacagcugagugccuuuuauguuguuugcuuaauauaggcccu

SEQ ID NO: 2025 - RNA, 113 nt, Marburg virus
aacuaccucuuaagcuuuuguggaugguuucaauaugugcguagagguuaauuuaaagagauuucuuguugcacaguuuuuuguauuacuuacuugggcuugaagacauaguu

SEQ ID NO: 2026 - RNA, 76 nt, Equine rhinitis A virus
uauguauccucugguacucacagacaacaauggcgaccaucuugucuuguuuguugagccuggagacguguacaua

SEQ ID NO: 2027 - RNA, 75 nt, Fowlpox virus
uccuuuuugugcuaugucggaguuacaaacaaauccacaaauuuuauuugcccauccuacauuuacaaacaagga

SEQ ID NO: 2028 - RNA, 61 nt, Camelpox virus
gccgcagacacuguggcggacgugaacccgacugggaguaucacguccaccgacucugggc

SEQ ID NO: 2029 - RNA, 68 nt, Fowlpox virus
cucauauggugcucauuacguucaaguguugaaggauccaauagccuugaacuguggugccaugugag

SEQ ID NO: 2030 - RNA, 62 nt, Fowlpox virus
auccacguuaucucugauugucaaaauagacuagucuaggagacgauaaauccuaugugggu

SEQ ID NO: 2031 - RNA, 64 nt, Fowlpox virus
gcguugagggauaagaguagcauguuccuacuuaaggaaggaauaugucguguuuuccacacgu

SEQ ID NO: 2032 - RNA, 71 nt, Myxoma virus
ggauacuccuauuacgucgaagucagagguauagaacuuuccccuccuuuuucuacaugauaucccguucc

SEQ ID NO: 2033 - RNA, 78 nt, Myxoma virus
accacuauaauccccgcuuccuauaaucucuacuuccuaugauuaaauggguaauuaaaugauggguaauuaaguggu

SEQ ID NO: 2034 - RNA, 100 nt, Fowlpox virus
aucguuagcacaccuuaaagauuagaagaaauacagguuaguguaauaauaacguauuauuaucuagcacaaaaauguuucaaagggcguguuauuagau

SEQ ID NO: 2035 - RNA, 68 nt, Fowlpox virus
guuaaauuacgugauuauauuauaaguuaucugcuuacuuuaacauuauauaguaauuauauacuaac

SEQ ID NO: 2036 - RNA, 131 nt, Rabbit fibroma virus
ugucaucaguguugucaggguccugugggccauugucaucaguguugucaggguccugaggcagcgggucaugugggccauugucaucaguguugucaggguccugugggccauugucaucaguguuguca

SEQ ID NO: 2037 - RNA, 83 nt, Myxoma virus
gaggaugucaucgugcguagucuucccaguugucccgcgcuuaugggaauggggucuuugaagacuauccacgucacguuuuu

SEQ ID NO: 2038 - RNA, 88 nt, Camelpox virus
gccgguuaguaugacuuacuuguauaauaaguauaguuuuaaacugauuuuagcagaauauauaagacacagaaauacuguauccggc

SEQ ID NO: 2039 - RNA, 62 nt, Fowlpox virus
cuguauuucuucuaaucuuuaaggugugcuaacgauauaucacgggauuaaaagguuauuag

SEQ ID NO: 2040 - RNA, 79 nt, Rabbit fibroma virus
gcggagucuggcaacgcccggguccuugcuaccugugugguguguuaagggcuggguaaaggugucugccaauucucgc

SEQ ID NO: 2041 - RNA, 76 nt, Rabbit fibroma virus
gcaucuccaauaaguagauccagauaccuaagacugcguugaaaaaagaguguuaggguuggaaaagugggggugu

SEQ ID NO: 2042 - RNA, 90 nt, Simian immunodeficiency virus
uuugacuauuucgaaagaguuauuaacaguuaccgucaaugcguuggagcaagcgacgguguauccuauauucggaagugagaugucaga

SEQ ID NO: 2043 - RNA, 61 nt, Fowlpox virus
acuuguguacuuucuaggggcucccggccuuccuuccgguacaauaccuagugaagcaagu

SEQ ID NO: 2044 - RNA, 75 nt, Monkeypox virus
aagcgcaagagucccaacauuccucauacagagacuguagacuuuguauggggguuuaauguugagacucgccuu

SEQ ID NO: 2045 - RNA, 84 nt, Monkeypox virus
gacuauuucaaaagaguuacuagcaguuaccgucaaugcguuggagcaagcgacgguguauccuauauucggaagugaaauguc

SEQ ID NO: 2046 - RNA, 92 nt, Simian immunodeficiency virus
gaccccuuuauaagauuuacagacgauuuuagaggagaaaugaucaauacuuuuuucaauaaugcucagauguggaauuuuacguucggguc

SEQ ID NO: 2047 - RNA, 118 nt, Lymphocystis disease virus 1
gcgaugguaggucagugguaauaugaccagccguguugauuguuccauugggcuccacuuuaccgaugaugcugucagcaaacauuugucuaaauaugugccacaauucacuguucgc

SEQ ID NO: 2048 - RNA, 101 nt, Paramecium bursaria Chlorella virus 1
ccagugugcucugggcgccggacguggagaucagcacgguccgccggcacagcgcggcgguccgcgcuuucgcgucggcucucaggaacuacauguuuugg

SEQ ID NO: 2049 - RNA, 60 nt, Paramecium bursaria Chlorella virus 1
ccuggagaugaugcugacaguaugauuuuuuacaaaguaacuguuguugaucccauacuc

SEQ ID NO: 2050 - RNA, 83 nt, Paramecium bursaria Chlorella virus 1
cauugucggugugcuuucgggauuagcagucauaaucaucugcauguucauuuuugcuugcugcuauagaaggcuuuaccgac

SEQ ID NO: 2051 - RNA, 75 nt, Meleagrid herpesvirus 1
cuccgaucucgagccgcagcccggcggugucucuuucaguggagcguuagcgccaucaugugguucguggcggug

SEQ ID NO: 2052 - RNA, 60 nt, Meleagrid herpesvirus 1
gaggaggccguaaauauggcgcucguggccugcgaagccgugucucccuacgaccgcuuc

SEQ ID NO: 2053 - RNA, 68 nt, Feline foamy virus
gacuaaacuuccuggggacuagagguguggaaacuuugcugccucugcuucacgggaaguuuuugguu

SEQ ID NO: 2054 - RNA, 71 nt, Meleagrid herpesvirus 1
gugcgaagccgcuucuccgggcgcgaggugcccaccuggcccgccucgucccggaccugccugcucugcgc

SEQ ID NO: 2055 - RNA, 66 nt, Murine adenovirus A
ugaguauagacccaauccuuaaacugauuuaaaaccccaucaagaggguucucuucuaauuccuca

SEQ ID NO: 2056 - RNA, 131 nt, Murine adenovirus A
uuaguagaguuggguaauguuauagcuagucuuggaccgaguuaugaucaauuaaaguugcagcaaggauugaauuauuugguaacuaaccaaagacaagaauauaaaccaucaguaccugacuugacuaa

SEQ ID NO: 2057 - RNA, 108 nt, Odontoglossum ringspot virus
ucucugaauuuauuaauuuaucagccuuugaaaaacuacuaccgucagcuuuaacggcugucaagucgguacguauuccaaagguugauaaaauuauaaguuacgaga

SEQ ID NO: 2058 - RNA, 75 nt, Molluscum contagiosum virus
gucgacgacgaagaugcagugguugugcgcgguuaacggaguuccgccuacuuuuacuucaaucuuugcgucggc

SEQ ID NO: 2059 - RNA, 104 nt, Paramecium bursaria Chlorella virus 1
gucuucucuaucuacuggcagggccacuccgaguuggucuacauccuuacgggucucacacacugcacgaaacuaguggucgaaugugggcagaugaaggggac

SEQ ID NO: 2060 - RNA, 61 nt, Paramecium bursaria Chlorella virus 1
cggaaucuauaugauucgggucucggacgggaauauggguccgaggaacgugguauggccg

SEQ ID NO: 2061 - RNA, 65 nt, Paramecium bursaria Chlorella virus 1
ugccugcacaaguaccaggaggggcugucgacuaucgagcagcugcaaucggugcuacagcagca

SEQ ID NO: 2062 - RNA, 92 nt, Odontoglossum ringspot virus
gugaguaucugucuuguagacaaacgcaugaaaagagcuaaugaagcaacacuuggcucuuaucauacaucugcuugcaagaagagauucac

SEQ ID NO: 2063 - RNA, 63 nt, Molluscum contagiosum virus
gcgcagcagcugcucgcgcagagacaguguuugcggcgcgggcgcgggcggcagagcgcgcgc

SEQ ID NO: 2064 - RNA, 63 nt, African swine fever virus
ucugagggauggcucguacaacaaaacacacaucgaggaauguaauaccuguccucucucaga

SEQ ID NO: 2065 - RNA, 94 nt, African swine fever virus
aucuccuuaaaggaaauaaauaccugggcuacuuaagagaguuuuauacucauacuuaauauaggccuuagaguauucccuauuuuaaggagau

SEQ ID NO: 2066 - RNA, 65 nt, Murine adenovirus A
gcgaccgcacagcagggaauuguagcacaaaauaauacugcgccaccaaccuacugcgcaugcgc

SEQ ID NO: 2067 - RNA, 70 nt, Molluscum contagiosum virus
cagcggcacggcguuguugauggucuugggcuggaacgagcgguccgugauguacagacacgugcuguug

SEQ ID NO: 2068 - RNA, 67 nt, Human herpesvirus 6
guguacaaauguauauguaaacacaacaggaaaauauacaugucccaaggcguauacauucuaacac

SEQ ID NO: 2069 - RNA, 61 nt, African swine fever virus
aaugaaguagaucaacacuauuuggaauauauucuauaauuaguauaugauacauagcauu

SEQ ID NO: 2070 - RNA, 106 nt, Human herpesvirus 8
ggaugucggggguuugaaaauauaggaacaucgagacucaauuuuccaguaucccaagggaggggguagauggugucuguuucaaggucgggcucaccgaauagcc

SEQ ID NO: 2071 - RNA, 65 nt, Meleagrid herpesvirus 1
cauuuuucacaccggaaucgaguaaaacauaauaugcaaaaaauaguucggguauugauauaaug

SEQ ID NO: 2072 - RNA, 61 nt, Paramecium bursaria Chlorella virus 1
aucguuuguguauagugguaggagcauagacgcuucguuuucaauauugauaccaagcggu

SEQ ID NO: 2073 - RNA, 67 nt, Bovine herpesvirus 1
ccagaacacuuuguaacagugcaccauuuuucagauuuuguaucguagcaucccauaagaaaacugg

SEQ ID NO: 2074 - RNA, 70 nt, Bovine herpesvirus 1
uccaaagaucguuguacuaccuguucuaaauuauuacauaauuugaauauuccauaagcgucuuuaugga

SEQ ID NO: 2075 - RNA, 70 nt, Human herpesvirus 8
gccggcgcuuucuaucucaccguagaaugcuucguccacgauuacgggcgugacaauuagaaguaccggu

SEQ ID NO: 2076 - RNA, 67 nt, Amsacta moorei entomopoxvirus
auaauauugaacauauuuuauuguauauauuuuaaaaauagcuuuauaagauaugugaaaguuuuau

SEQ ID NO: 2077 - RNA, 61 nt, Human herpesvirus 7
uccggggguagcaggccuucuggaaagccuugagcugcucgaaggccugcugcgccuugga

SEQ ID NO: 2078 - RNA, 130 nt, Tick-borne encephalitis virus
guuaaaaucuuugccaagucccaacacaaggucaaugaugguuccaucuucggcuccuggaaggccugccaaacauuagcccugaugcacgacuacgugauccuugugcucggaccugucaagaaguacc

SEQ ID NO: 2079 - RNA, 79 nt, Tick-borne encephalitis virus
cugaugaucugcguugacgacggaagugucaaagacaagauucuguccuacauuuccgaguucuccgucggucacucag

SEQ ID NO: 2080 - RNA, 73 nt, Cowpox virus
guauguaauuuaaaaauguguggauauuuguauaaaaaagacauauacauacauuucuuggugaauaacauac

SEQ ID NO: 2081 - RNA, 74 nt, Human herpesvirus 7
cuuaccaaacaaaaacagcucagagugguuauuauaauuuuaauuuuuccuuucugaguaguuuuguuuauaag

SEQ ID NO: 2082 - RNA, 90 nt, Human herpesvirus 7
cuuuauuuaauguuacugaaaaugugcucauaccuaacaguuucaacuuaacuguuacagaugaguacauacaaacgcguauggauaagg

SEQ ID NO: 2083 - RNA, 68 nt, Human herpesvirus 7
auugaucguauucaaggcguuauacagggucuuaaugacucucuaauagaccuugaaaaacuuucaau

SEQ ID NO: 2084 - RNA, 77 nt, Cowpox virus
uaucaagauguguauguuugugaaaauuguggagacauagcagcacaaaucaaagguauuaauacaugucuuagaug

SEQ ID NO: 2085 - RNA, 60 nt, Human herpesvirus 7
gagauaaauaacaaaauccaaacauuacauaucuguggucugauuucuuuauuuuaucuc

SEQ ID NO: 2086 - RNA, 78 nt, Human herpesvirus 5
acuuacgccacggauuuguugacaaucaacaagacgcauacacgcgcuugguugccaacuacucugauacgcggaagu

SEQ ID NO: 2087 - RNA, 63 nt, Human herpesvirus 5
ugcagcgguaucugcguggauuccugggguagggugucugccagaggguguacguuuguugca

SEQ ID NO: 2088 - RNA, 62 nt, Human herpesvirus 5
guggucacucucagcugcuaaccugugcagauggaaacugucaggcucugagaguguuucac

SEQ ID NO: 2089 - RNA, 64 nt, Human herpesvirus 5
uaggaagacaaggaugaucgccaaacugauugacaaggggguuggcgauuauacugcauuccug

SEQ ID NO: 2090 - RNA, 128 nt, Human herpesvirus 5
uuggaaggggaugaguggacuacacauagucaacaggauucguaugggagugagcaacuuaguaaugguuguuagcaaaaucaauccugcaaaagcuaaugugcuagccaaaucaggagauccuacaa

SEQ ID NO: 2091 - RNA, 94 nt, Human herpesvirus 4
aucaguccguauuuuuaauggcuggacuagagaagguguugcuauuacaaacaaaugggaacuuucuagagcuguuccaaaauaugagauagau

SEQ ID NO: 2092 - RNA, 66 nt, Human herpesvirus 7
gacaucuuuguuguacaaggugaauauggucuuaauuauuauaagguuaacccuugcgaagauguc

SEQ ID NO: 2093 - RNA, 71 nt, Human herpesvirus 7
gaaaucuaccagcaauuugacgccauacaagcaaaugcucaaguggaucgucuuauaacugguagauuguc

SEQ ID NO: 2094 - RNA, 67 nt, Human herpesvirus 7
cuauuagguacuccuuuugugguaauggacgacauguucuaaccauaccgcaaaaugcaccuaaugg

SEQ ID NO: 2095 - RNA, 116 nt, Human herpesvirus 5
gugugacgugagucugauccaacacugaacgcuuucgucguguuuuucaugcagcuuuuacagaccaugacaagccugacgagagcguucaucggggcaugaaguacgcauuacac

SEQ ID NO: 2096 - RNA, 81 nt, Human herpesvirus 5
ggaacggaggaggcuuucgccacaccuauccugaaagcguugcauucuuuaugauaggugugacgaugucuuuaccauucc

SEQ ID NO: 2097 - RNA, 78 nt, Human herpesvirus 5
gcgugaugaugacauucaucauguauuuccauucacacauaccuuuugugcauacgguuuauauaugaccauccacgc

SEQ ID NO: 2098 - RNA, 73 nt, Human herpesvirus 5
guucguugucgccccugugaguguggagcuaaucauauuagguuauauccagcaacucugaacgugaccgagc

SEQ ID NO: 2099 - RNA, 75 nt, Human herpesvirus 5
caauggcugauuuuggauuguuacaaugcgaggauacauucccgggcuuuguaccaacagggucuuacgccaaug

SEQ ID NO: 2100 - RNA, 108 nt, Human herpesvirus 5
gcgauuaacaacauuuuucaauacggcguugaacuauugcuaccuggcuaaugcagguauaaacucacuagugccaacgagucuccauaauggugaugauguuuuugc

SEQ ID NO: 2101 - RNA, 76 nt, Human herpesvirus 4
caaauagacuuaaaucacacuguuguugacuauggaaauagagcuacaucacagcagcauaaaaaaagaauauuug

SEQ ID NO: 2102 - RNA, 61 nt, Human herpesvirus 4
gggugauggugcaguaguaguuaaugaugaaggaaagggaauaauugcuguaccauuaacc

SEQ ID NO: 2103 - RNA, 67 nt, Tupaia herpesvirus
acagucggagucgaguuucuuggugacauuggcucuuugucaggcaccaacaacucauccgacaugu

SEQ ID NO: 2104 - RNA, 63 nt, Tupaia herpesvirus
caggacgagacgcgguuccacacggccaugaccgucuggcgaccggacgccccgcugcgccug

SEQ ID NO: 2105 - RNA, 81 nt, Tupaia herpesvirus
agucggcauguuuugacuacuucugccgucauucucccccucaugaaaaggcucuucuaucauccuuugaacugccugacu

SEQ ID NO: 2106 - RNA, 67 nt, Human herpesvirus 4
uuagacaugguaaagaauccaacccuuaaugaugugcaaaaauuaauggggaauauaacauggauga

SEQ ID NO: 2107 - RNA, 87 nt, Human herpesvirus 4
ucaaguuccuccuaauagcuuuggaugggucacugggaaaucaucaauggcaaaacagggguuauuaauuaauggaggaauaauuga

SEQ ID NO: 2108 - RNA, 85 nt, Tupaia herpesvirus
ggagugcaugcgcgagaucugcgacaaccugacgaaguacacgaacucgaucgacuucgccacgcaggacucgcgcuuccagacc

SEQ ID NO: 2109 - RNA, 67 nt, Tupaia herpesvirus
gaucauguucgccaccaacccgacgugccaccuggcguggccgcugggcgagagcgaacacgagauc

SEQ ID NO: 2110 - RNA, 101 nt, Camelpox virus
uuauaugauaucuuacaaaauauauuaaaucuuucuuuaguuauuucugauaacuuauaacuauuugacgaaggauauguuuuuuuaauauaauuauauaa

SEQ ID NO: 2111 - RNA, 87 nt, Tupaia paramyxovirus
ccugugcagaaagugacucggcugagugcuccgguggcccuugccuaccgcgagguuuccacccagccucgggucucuacugccagg

SEQ ID NO: 2112 - RNA, 70 nt, Human herpesvirus 4
gaugugagugcagguucagaaaauaauguguuucuaucacaaauacaauaugcauaugauaagcuacguc

SEQ ID NO: 2113 - RNA, 127 nt, Tupaia herpesvirus
agguuccgcugcgugcugaagugaaagagcgguagcuccggcugcgugucggucuggugcaggaucucgccgacggccagguagugagcggcgcucgacuuguagacggucagcgcgcagugccccu

SEQ ID NO: 2114 - RNA, 131 nt, Tupaia herpesvirus
gcagccggaugauggugcgguuagugagccggaagcccguuuuggugcgacgcacggagaauuugaagguccgguugugcaagcgcaccugcgacgggcggcggaggaggacccuuuccgacagcgggugu

SEQ ID NO: 2115 - RNA, 80 nt, Camelpox virus
ugucuuauuuuuuauuuuauauggauuauuauuaauaaaacaauaauuagcaguucuuauaacaucauaaaauauagaua

SEQ ID NO: 2116 - RNA, 67 nt, Tupaia paramyxovirus
caugugaguaaauggaaaucaauagcugacuguaaaaaacauaaggccgauauccacgugauacaug

SEQ ID NO: 2117 - RNA, 61 nt, Alcelaphine herpesvirus 1
guaaacaguauuguuggacacgucuuccucaaggauuuuuaaauaguccagcauuguuuac

SEQ ID NO: 2118 - RNA, 119 nt, Alcelaphine herpesvirus 1
gauccuaaagagcauguucaacaauuagaaaaaguguuucaaauuuuacuacaggcaggauauguaguaucuuugaaaaaaucagaaauuggucaaaaaacuguagaauuuuuaggauu

SEQ ID NO: 2119 - RNA, 101 nt, Camelpox virus
guaaaaggauuauugcauuuauuaaguauuaaaacauuaucuauauauuuugaauuauuuacuaauguuugaauauauuuaauacaauuuuguccuuguac

SEQ ID NO: 2120 - RNA, 63 nt, Camelpox virus
ggauuuuugcaauaauaugauguuuuauuuuuauuauauguuuuaauuuuuugcauauuaucc

SEQ ID NO: 2121 - RNA, 98 nt, Alcelaphine herpesvirus 1
gagcgaaaggugccuguggaguuuuggaaaauccucuuugauggcugugucgcccugggagugaaagaggacaugcuccucucagaggccgggcgcuc

SEQ ID NO: 2122 - RNA, 97 nt, Alcelaphine herpesvirus 1
aauaguaagagucaauuuuuguauuauaaauagcaguucaaaugugaauaaaaaacaggcugcaguuuucaagcauccaacaauuccucucucuucu

SEQ ID NO: 2123 - RNA, 130 nt, Alcelaphine herpesvirus 1
gauaauaugcuaauaguagguaaacccagacuaugccauccuaauguugaaaccgguaggcagagaagccguuuaggggaguaaacgaaguugaaggcgcuguuaggguaauugaucgaagcagaaaauc

SEQ ID NO: 2124 - RNA, 62 nt, Saimiriine herpesvirus 2
gaggcgcugaucugcagcugcacggccguggagucgugcagccgcaugagacgugauaccuc

SEQ ID NO: 2125 - RNA, 81 nt, Camelpox virus
uagaauauaaaaauacauucgcuauagaagauauaguaucaaaagauaacuacaagcuauacgauauuuuaaaauuuucua

SEQ ID NO: 2126 - RNA, 79 nt, Camelpox virus
gaguauacaauacaaaauguagcauauauuuuucuguacaauauauuguaauauauacuuuauuuguauuuaauaacuu

SEQ ID NO: 2127 - RNA, 93 nt, Alcelaphine herpesvirus 1
agggaaugguccuuuuccgcacugguuaacgguacugaggaggcguugaaaucuuuaggaaaggugcugucuaguuuggaaucuccaauuccu

SEQ ID NO: 2128 - RNA, 83 nt, Alcelaphine herpesvirus 1
uguagguacugguggauuuuaugaguuccugcucuauguucgguuugacauguggauuuccuaaaggaauaccucuaccugca

SEQ ID NO: 2129 - RNA, 64 nt, Saimiriine herpesvirus 2
uuuugaucgaggcaccaagauucugccaaauuccccaaggcaucguugauauaaucuuucaaag

SEQ ID NO: 2130 - RNA, 62 nt, Saimiriine herpesvirus 2
gauaacuaccguucaugcuguaugcaucauuauaaucugacauauagacaucuguaauuauc

SEQ ID NO: 2131 - RNA, 66 nt, Tupaia herpesvirus
gauauuggcucgucucaccuucaaccgguuacagaagauguuggagguaagauauguugacuuauc

SEQ ID NO: 2132 - RNA, 60 nt, Tupaia herpesvirus
cauuccggucaacaaggccaaaaugcucuauaagcuuauacauggcuaugaaccggaaug

SEQ ID NO: 2133 - RNA, 61 nt, Human enterovirus A
cggccgcauucauauucucgauuucuugugcaaacacccguucgaaaugauccaugcgccg

SEQ ID NO: 2134 - RNA, 60 nt, Human enterovirus A
acguaguaucuaucuugauaaggcuaugcgagcaggccccauccgggauaugagcuaggu

SEQ ID NO: 2135 - RNA, 68 nt, Feline immunodeficiency virus
gacuggaacuuugguauaacccccccagcuacaaguaguuuggaggacacauauagguuuguacaguc

SEQ ID NO: 2136 - RNA, 71 nt, Feline immunodeficiency virus
gggucgcaaguuuuuacuacaggcuggccuacgugcacguccgcgccuucggccuguaaagcgugcagccc

SEQ ID NO: 2137 - RNA, 118 nt, Tobacco mosaic virus
gcuucacaagaccaacaaaagguggugaacaacguuuugacucgucuauugccuggauuacuaacucaagaauuaagaacuuuaaaagucaccacacuugcagaugggucugugaagu

SEQ ID NO: 2138 - RNA, 93 nt, Tupaia herpesvirus
cucuggauauauagguacugaauauuuuuaagcuauagguuuacauauuguggcuguguauuauugaguauuuuuuagcuguguauuauugag

SEQ ID NO: 2139 - RNA, 131 nt, Tupaia herpesvirus
uagcuguguauuauugaguauuuuuuagcuguguauuauugaguauuuuuuagcuguguauuauugaguauuuuuuagcuguguauuauugaguauuuuuuagcuguguauuauugaguauuuuuuagcug

SEQ ID NO: 2140 - RNA, 92 nt, Feline immunodeficiency virus
ucuggcaaccacccucuguggaccugguggccugaccuuaccccagauuuauguauguuagcccaccauggaccaucuuauugggggcuaga

SEQ ID NO: 2141 - RNA, 78 nt, Tobacco mosaic virus
ucuagacuacuugcaguggguaaucccuauuucccuauuagaaaagcuaacaaaacuauuguacccaagguaucugga

SEQ ID NO: 2142 - RNA, 109 nt, Tobacco mosaic virus
aacgugcugcaaguacaucuacagccacaccuacacguaaaaagguuaaacggaaauaguuuauaauuguguugguauguguguuauguauguguguuguuuauauguu

SEQ ID NO: 2143 - RNA, 115 nt, Ectromelia virus
gagauaguuuucucuauucugaaauaauuagaacuagaaacauguuuagaaaaaaacgauuauuucugaauuauucuaauuauuugaacaaacaggaaagaaguauacuaucguc

SEQ ID NO: 2144 - RNA, 65 nt, Woolly monkey sarcoma virus
auuuauugguauaauuucaguauucgcauacucuucggcaaacuuucucaaaucaucuaaugaau

SEQ ID NO: 2145 - RNA, 74 nt, Woolly monkey sarcoma virus
guggcgggccaccaauggaggaccugaucacgggcaagacaugccucagggccaccaauggaggaccugaucac

SEQ ID NO: 2146 - RNA, 62 nt, Human enterovirus A
caggucgaugagucacugcgauccccacgggcgaccguggcaguggcugcguuggcggccug

SEQ ID NO: 2147 - RNA, 85 nt, Human enterovirus A
ggagcggaacccauugaauaaugucguguaugagucuaucaauauuucaccguauacguuaacccgcagcauuuuuuccagcucc

SEQ ID NO: 2148 - RNA, 77 nt, Human enterovirus A
gugauacggacaguccccggauauggucaucgacuuaauaaaaaagccguguacaucuccggugucuguaaacucgc

SEQ ID NO: 2149 - RNA, 82 nt, Feline immunodeficiency virus
ccaguuucuaagguugucagcacggaugaauaugugacucgcacaagcauauacuaucaugcaagcagcucuagauuauugg

SEQ ID NO: 2150 - RNA, 63 nt, Feline immunodeficiency virus
uguucgaaaucguuagggaaugucugggguaccccaaacaugacuuucuuacguuggugaaua

SEQ ID NO: 2151 - RNA, 68 nt, Tobacco mosaic virus
caaacauuaccaucgacacuucacaaugcugaacugguggagcaaagugucacucuggcugugcuuug

SEQ ID NO: 2152 - RNA, 64 nt, Tobacco mosaic virus
uugugucuucugaggcccaguuguuuaauaaaccuuacugguuacacaaggcccagggacacaa

SEQ ID NO: 2153 - RNA, 82 nt, Ectromelia virus
gcgaagaugacucucaaauuauuacacuuacggcauucguuaaccaaugccuauggugucauaaacgaguauccguauccgc

SEQ ID NO: 2154 - RNA, 67 nt, Ectromelia virus
gaguguuuauccagggaaaucaaagaagaaguuaauauagacaauucuuuuguauucauagacacuc

SEQ ID NO: 2155 - RNA, 95 nt, Woolly monkey sarcoma virus
ggcauacaacaaacgauacauauaugauugcugguacucccggaacauaccgcacgggaacgucaguuaauuguauuguagaagaagucgaugcu

SEQ ID NO: 2156 - RNA, 83 nt, Woolly monkey sarcoma virus
auacaauacaaaauacaacucuucgcauguaagaacuggagauauccaaacauaucuuacacgcggggguuuuguuauuguau

SEQ ID NO: 2157 - RNA, 63 nt, Variola virus
aucuaguuaguccuuugacgaggaugaaaagagucacgauuugucaacaucaaacuaauugau

SEQ ID NO: 2158 - RNA, 126 nt, Variola virus
auaauuagaacuagaaacaugucuagaaagaaacgauuauuucuaaauuauuccaauuauuugaacaaacaggaaagaaguauacuaucgucauuuuuuucucuagauccagcuacgauugauaau

SEQ ID NO: 2159 - RNA, 80 nt, Variola virus
ccgccgcgcucggucucggugccgcggggucgaggccgguuauccgguuucgggccaggagucggagaggucgcggacgg

SEQ ID NO: 2160 - RNA, 104 nt, Ectromelia virus
aggaacagauguuugccagacauuuuuuuaauagggcuggaacaguuggugaggacguuucccaggaucugguuauuaaaagugcuaguaaaaauacuguuccu

SEQ ID NO: 2161 - RNA, 130 nt, Woolly monkey sarcoma virus
uccccuccuacgggagcagcauaccgcucgacacuaugcuuuacgaagguaauggacaccgcuaggugcaaggcaaggcacugcaaggagaggccuuacuaaggcuacugucgagucuccugagagguaa

SEQ ID NO: 2162 - RNA, 65 nt, Variola virus
cuuuaucuauucugaaucauggagcagcugguucuacagcugaacaacuaucaaaauauauagag

SEQ ID NO: 2163 - RNA, 63 nt, Variola virus
uuuaaaaaauggugugguaaguuauacacuaaaaguauagacuuguauaugccaaaguuuaaa

SEQ ID NO: 2164 - RNA, 65 nt, Cowpox virus
gucuagaaaauauaacgcaauauguuaguuaaaaauguaacuuguuagauugauauuucaugggc

SEQ ID NO: 2165 - RNA, 61 nt, Cowpox virus
auagacgcuauuuauccgggcgguauacccaaaaggggugagaacguuccagagugucuau

SEQ ID NO: 2166 - RNA, 67 nt, Cowpox virus
gagugucuauccagggaaaucaaagaagaaguuaauauagauaauucuuuuguauucauagacacuc

SEQ ID NO: 2167 - RNA, 88 nt, Cowpox virus
gugucggugacgccguguggguacgccggcaccagacuaagaacuuagaaccccgcuggaaaggacccuacaccguccugcugaccac

SEQ ID NO: 2168 - RNA, 70 nt, Woolly monkey sarcoma virus
ggcaccgauacgcguguuguuuuacagaacucuaugagaguuucuggagacucaaagcguuguuacagcc

SEQ ID NO: 2169 - RNA, 84 nt, Woolly monkey sarcoma virus
caaauuacguauaauauaggggaguggcuuuagcauaauauuuaagcagaaacaaacaggcaccucucuaccaagacguuguug

SEQ ID NO: 2170 - RNA, 95 nt, Variola virus
gggugagaacguuccagagugucuauccagggaaaucaaagaagaaguuaauauagacaauucuuuuguauucauagacacucgguuuuuuauuc

SEQ ID NO: 2171 - RNA, 64 nt, Variola virus
gggcgccccgagcaucggcggugucucucgagagcuuucgagaucucucgguccucggggcccc

SEQ ID NO: 2172 - RNA, 90 nt, Variola virus
cgccgcuggcucggagccaagugcgccggcggccgggcucggaucgcucgcucgcccacgcugcugcacucggcucccgggcccucggcg

SEQ ID NO: 2173 - RNA, 126 nt, Cowpox virus
auaauuagaacuagaaacaugucuagaaagaaacgauuauuucugaauuauuccaauuauuugaacaaacaggaaagaaguauacuaucgucauuuuuuucucuauauccagcuacuacugauaau

SEQ ID NO: 2174 - RNA, 126 nt, Cowpox virus
agagacugugauggggcagccuacuccaaagaccccucgacaacuaagggaguuccuagggacggcaggcuucugucgccucuggauccccggguuugcagaaauggcagcccccuuguacccucu

SEQ ID NO: 2175 - RNA, 87 nt, Cowpox virus
cugaagaggggcugcaacaugacugccuugacaucuuggcugaagcccacggaacuagaccagaucuuacggaccagccucucccag

SEQ ID NO: 2176 - RNA, 122 nt, Cowpox virus
gauacccauucaagugaaaggcuauuauaguuaggagggcuagcaauauaagaaaacuuauauucaauguauuuuuuuuuaagcuaugaaaguaaagauaccuauucaagugaaaggcuauu

SEQ ID NO: 2177 - RNA, 79 nt, Camelpox virus
gccgccuguccccggaucaccccgugaucguccgacgccacuaccgggccaacugggccagucugaagggacgcguggc

SEQ ID NO: 2178 - RNA, 68 nt, Camelpox virus
guggugauuuagaaauaggagaccuaccgcaggaugaugaggaagcgugggccgagcuaaguuaccac

SEQ ID NO: 2179 - RNA, 91 nt, Camelpox virus
caaagaaacaccuacuucuucagacaugugcacgauaauagcaucuauuuucguaccguguguagaaugaaggguuguauguguugauuug

SEQ ID NO: 2180 - RNA, 93 nt, Cowpox virus
guauaaaaaacuuaagguuuauuuaaaaguccauauuuuauaaaaguuaaugaaaaagaaacugaauagaaauagauugauaaguccauaugc

SEQ ID NO: 2181 - RNA, 109 nt, Camelpox virus
gacagcgacgaggugcuggugcugggcacgcgccccaggcgccgcuggacggggcggcgcgugcgcgcccaccuaccgcccggugccagccucgccuacgucccggguc

SEQ ID NO: 2182 - RNA, 121 nt, Camelpox virus
uuggcuugaccucgacccaaaguuguguaauucaggaaagauuuccgcaaagagugguaacucucucuuuaggaguuuucacuucacugauuuuuacaauuauacgggugagggagaccaa

SEQ ID NO: 2183 - RNA, 65 nt, Camelpox virus
gccgccccuagccccgcggcgguccagccggcgcaucauucuggcuccgcgccgggcgggccggc

SEQ ID NO: 2184 - RNA, 63 nt, Camelpox virus
ggcgcccgcggcgguuccggugccucccccagccccuccagccccgcgcgcgccgcgugcgcc

SEQ ID NO: 2185 - RNA, 87 nt, Camelpox virus
gcuccacgcuuuggcacgcggccggucaugggcacuuggagcgaaaucggcacgagucagaugaacggcggcgcgcucagcuggagc

SEQ ID NO: 2186 - RNA, 73 nt, Camelpox virus
uugccuccgggguccacggugcccuggacguggccaaccaggccgucucccacgccguggaccgccggugcaa

SEQ ID NO: 2187 - RNA, 70 nt, Human echovirus 1
ccuuuugcuuguucacugugcggcauuauuacauuuacaccgguaaugcugcgcaugaaagagcgaacgg

SEQ ID NO: 2188 - RNA, 81 nt, Equine herpesvirus 2
cucauuuuaaaauagcuugucgggcugugucuauucuucuuuauguccacagacacaacacacaagcuaccuuacuaugag

SEQ ID NO: 2189 - RNA, 60 nt, Equine herpesvirus 2
ccccuccucuugcagguacguggccccgcccagugggaugggcuuuggaugggggagggg

SEQ ID NO: 2190 - RNA, 64 nt, Equine herpesvirus 2
uaugucaugaucuuaauguagcaccuuuauuugaaaaaaaguccuccauuaggaucaucacaua

SEQ ID NO: 2191 - RNA, 131 nt, Equine herpesvirus 2
uuggccuggaucuugagguuggagauguugccgcucuggucgcggcggggguucauguuguggaggacgacgaggacggcguagccggugcagcgggggaagcgggcgugcagcuuggaggggaaggcgug

SEQ ID NO: 2192 - RNA, 62 nt, Equine herpesvirus 2
gccuucuacccuccuuauauauauuauauauuguuuauuauauugaaaaaggaaguacaggu

SEQ ID NO: 2193 - RNA, 77 nt, Camelpox virus
aaugaccuauauguuaauacucgauugauauugauauugauauugauauugauaauuaguguauauuauauuucauu

SEQ ID NO: 2194 - RNA, 69 nt, Human immunodeficiency virus 1
guacugggucucucugguuagaccagaucugagccugggagcucucuggcuaacuagggaacccacugc

SEQ ID NO: 2195 - RNA, 61 nt, Human immunodeficiency virus 2
cacgcuugcuugcuuaaagaccucuucaauaaagcugccaguuagaagcaaguuaagugug

SEQ ID NO: 2196 - RNA, 118 nt, Amsacta moorei entomopoxvirus
aucauuuauuuauuguauaauauuucauauauuuuauuaaaauuuacauauucuaacaaaugugcgauaacaauaaaaauuagauaaauaggauauaaaacaauuuaaagcucaggau

SEQ ID NO: 2197 - RNA, 106 nt, Mouse mammary tumor virus
augauauaaaagagugcuaaauuuuugaguaaacuugcaacaguccuaacauucaccucucguguguuugugucuguucgccaucccgucuccgcucgucacuuau

SEQ ID NO: 2198 - RNA, 60 nt, Fowlpox virus
uuuuuggagguucgcuuuucuauaucucaugaagaaagucgcuguucguccuacuaaaaa

SEQ ID NO: 2199 - RNA, 121 nt, Fowlpox virus
gagcaugagagcggcuuuagcguaaaguuuuucuccgauaguuuugauaaagguccuuaagaaucuuaaccuaucccuuacucugaugaaaaagauugcgguagacgccguuuuagaaauc

SEQ ID NO: 2200 - RNA, 73 nt, Human immunodeficiency virus 1
ggugugaauaucaagcaggacauaacaagguaggaucucuacaauacuuggcacuagcagcauuaauaacacc

SEQ ID NO: 2201 - RNA, 63 nt, Amsacta moorei entomopoxvirus
aaaauggcauauuuuaauauauaugauuuuuauagucuuuaauuuuauuuauauagucauuuu

SEQ ID NO: 2202 - RNA, 61 nt, Aura virus
aagacugagaaaacucgauguacuuccgaggauguggugcauaaugucacacaucagucuu

SEQ ID NO: 2203 - RNA, 85 nt, Human adenovirus D
gcuuaccaguagacaaagagcacagcaguacaagcgccaacagcagcgacugacuacccacugacuuagcucccuauuuaaaggc

SEQ ID NO: 2204 - RNA, 130 nt, Hepatitis G virus
augacucggcgccgacucggcgaccggccaaaaggugguggaugggugaugacaggguugguaggucguaaaucccggucaccuugguagccacuauaggugggucuuaagagaagguuaagauuccucu

SEQ ID NO: 2205 - RNA, 65 nt, Ictalurid herpesvirus 1
gccugggcucgcucgcggucagggaucgaugacggguucacucgcagagcacagagaguccgggc

SEQ ID NO: 2206 - RNA, 65 nt, Human coronavirus 229E
cacaaugguaagccagugguaguaaagguauaagaaauuugcuacuauguuacugaaccuaggug

SEQ ID NO: 2207 - RNA, 78 nt, Montana myotis leukoencephalitis virus
gcggcguggauauauacuccagccagaaaagacucagauugucucaugacuuucugacuggcguacauagccauccgc

SEQ ID NO: 2208 - RNA, 63 nt, Simian hemorrhagic fever virus
ugcuugguaugcauugcuacacuugcuuaugcugcaacugcuuucaaugaacauucccuugca

SEQ ID NO: 2209 - RNA, 77 nt, Fowl adenovirus A
gacuugauuaccgucgacggcccgggcucuucgagguccacgaaguccgccacgucuucgucgcugcugaucgucuc

SEQ ID NO: 2210 - RNA, 94 nt, Paramecium bursaria Chlorella virus 1
uaaaauuugugugugcagcaauugacgaauuuauuccaugacgaaccaacauaaauaauuuaaggaauguaaaauuguuaucacaauggcuuua

SEQ ID NO: 2211 - RNA, 65 nt, Bean pod mottle virus
aaagcaaucguuacuugauuuuaaagacuucucaauuucucucuacauuuccuguauacggcuuu

SEQ ID NO: 2212 - RNA, 81 nt, Bean pod mottle virus
ggugaaaucuucugggcuagugcucucacucuccuaucuggcauaggacuucgugaguagacuuucccauuucuuuucucu

SEQ ID NO: 2213 - RNA, 67 nt, Human papillomavirus type 63
gcagauacuucaaacaggauacugguauccuuuuuggcgcgcgcgcgaauuuugaaguuaccacugu

SEQ ID NO: 2214 - RNA, 118 nt, Human papillomavirus type 63
caacuuguucugagacgucuggaucugaucccgaccgcugucguuacugccaaagacgaaagugguaggcgcgaaccguuugugguuucccuggggcuagcagaaacucuuuagguug

SEQ ID NO: 2215 - RNA, 68 nt, Human papillomavirus type 38
cccugaaaaucuuaugucauauacuguguggacauauauauauuaccugacagaugaggacauauggg

SEQ ID NO: 2216 - RNA, 65 nt, African swine fever virus
uaugauauuuaaaaugguuguuauauaaauuuaccgcuuacagguaaucuuuauucaguaucaua

SEQ ID NO: 2217 - RNA, 94 nt, Amsacta moorei entomopoxvirus
uuauauuuuuuaaauauuuauacauauuauauuuuauuucuauaucauauaauaaaauuuuguguauaucguuacaauauuuauuaaaauguaa

SEQ ID NO: 2218 - RNA, 60 nt, Amsacta moorei entomopoxvirus
gguauuuuuaucauauuuauuuaauauuuuuucauuaauauuaucauauauaauaugacc

SEQ ID NO: 2219 - RNA, 77 nt, Fowlpox virus
cccccaucagaagguuuagguccgguauuuacgccuuuaucaucgguagauggagguuguacauucccuucuggggg

SEQ ID NO: 2220 - RNA, 64 nt, Canine adenovirus
gcagagacgaaagaggaguacucuugagugcgcagcgagaagaguuuucucucagcgaaucugc

SEQ ID NO: 2221 - RNA, 131 nt, Aleutian mink disease virus
uuauauauauacuaacaucuauacuacuaaccuaacuauggccuaauguaugcagugucggcgucgccgacaacuacauuauauuauuaggcauaguuagguuaguaguauagauguuaguauauauauaa

SEQ ID NO: 2222 - RNA, 64 nt, Melanoplus sanguinipes entomopoxvirus
aauaucaucuauugaauaucuuuuuaaauugcuaaaaaagauuauuuuguuaauucauuauauu

SEQ ID NO: 2223 - RNA, 80 nt, Human adenovirus B
cugcugccgaggaacugcuugauauggacggccgcaccucagaacagcgacucgcccaacuacgcauacgccagcagcag

SEQ ID NO: 2224 - RNA, 83 nt, Human herpesvirus 7
aacgcuuaauagaaauuauuguacauuuuucuauuaguaugagugcuaugaaaauuuccuacaaaaguucuguuuugaguguu

SEQ ID NO: 2225 - RNA, 83 nt, Chimpanzee cytomegalovirus
gugacggccccugcggucgccugaccuccguugcccgggacacccaccgcaccauguacgucuuagaccacggguucguacgc

SEQ ID NO: 2226 - RNA, 81 nt, Olive latent virus 2
caaagcauugaagguggcucgccuagagcggauuguuucaguaguccauaaaucugaauggggugaagcagcuaugcugug

SEQ ID NO: 2227 - RNA, 85 nt, Paramecium bursaria Chlorella virus 1
cuuuccacguugaucuuuuauguuucucuucugcgaguuuauucaguugauuuugaagcguugcaacaucuucggccguugaaag

SEQ ID NO: 2228 - RNA, 77 nt, Camelpox virus
aaaucuaucuuauauacacauaauuauucuaucaauuuuaccaauuaguuaguguuuaauaaaaauaugggggauuu

SEQ ID NO: 2229 - RNA, 70 nt, Equine herpesvirus 1
gguauuaccauagacgcggcguauaguaccagcguaucucaccugguagcggcgcguaguggauuuugcc

SEQ ID NO: 2230 - RNA, 86 nt, Olive latent virus 2
gcucguaugagccggugauuccguuaucauucuugcugcguauaacguacgcuuaauugugucaaugguguacucgguucacgagu

SEQ ID NO: 2231 - RNA, 75 nt, Myxoma virus
ugacgaauuacgacauuauuuuagaggacgugugugcguacaucaacgagucgcggguccuuaagagguucguca

SEQ ID NO: 2232 - RNA, 69 nt, Potato virus V
uucccuaguaaggugcgagugacuagcaagauuuacucuuguuaggugaucaaaaccggucauugggag

SEQ ID NO: 2233 - RNA, 94 nt, Grapevine virus A
cuacuggcaauacuagaugacuuguugucuagacuugggagaggcagcgcuuuccuuccaagugaucugggggcagucaaaggugagcugguag

SEQ ID NO: 2234 - RNA, 81 nt, Grapevine virus A
acguuccacucguccagauuaaguguagaccuuuacguuaauaacaagaagguugucacgcgaucagugcaagcggaaggu

SEQ ID NO: 2235 - RNA, 74 nt, Gallid herpesvirus 3
guggucuauucuuuuucguuugccucugauccugggcgguccguacugcggggugauagauaaaagaagacaac

SEQ ID NO: 2236 - RNA, 100 nt, Camelpox virus
uccaauaguacauuuuccagauuagauauuaaugucguauuugaacagagccuguaacaucucaaugucuuuauuaucuauagccaauguaauauccgga

SEQ ID NO: 2237 - RNA, 97 nt, Human herpesvirus 7
cauaaauauucuaagccaaauauuuuucucgugauuagucugcguuacuucugucaccacacucauauuuuucaugguauuuguuagaauaucugug

SEQ ID NO: 2238 - RNA, 80 nt, Human herpesvirus 7
auggcgguuguacuguaauuucucaaaucaaaguuuuaaaguaugcuuugucacggagauacucuacacuacgaaguuau

SEQ ID NO: 2239 - RNA, 112 nt, Rabbit fibroma virus
cuaucgccacggaacucacuaauuaugacauuauuuuagaggacgucuguucguauaucaacgagucuaaacuccuuaaacgguuugucaaguuauacaaaacgacuaauag

SEQ ID NO: 2240 - RNA, 99 nt, Human herpesvirus 8
agaacaaaaagugugugucugacauucacauuuauuuuuacaagacaauuuugugcaguagaguugugccuuccgacaccccgcgccguucgcuguucu

SEQ ID NO: 2241 - RNA, 82 nt, Human adenovirus A
gaagugcgguuccagaaggaguaauaaaaccugugccucagcgggugacugggaggcguagaugugcuguggaaagcauuuu

SEQ ID NO: 2242 - RNA, 60 nt, Barmah Forest virus
guauguaugauaguauauuuauaagauuaguuuguuauguaaguauguaguaguaaguau

SEQ ID NO: 2243 - RNA, 77 nt, Gallid herpesvirus 2
gaugggugggaaauauaauaaagcaaccgaaaugguacauaaaaacuaaaaauaccuacacgguuacaccaccgauc

SEQ ID NO: 2244 - RNA, 60 nt, Vaccinia virus
uaacaauauauuauuaguuuauauuacugaauuaauaauauaaaauucccaaucuuguua

SEQ ID NO: 2245 - RNA, 66 nt, Tupaia herpesvirus
aagguuagugagauuccuauuccaaaaucaugaaggaguuuguauucguuuuuucucauuuuccuu

SEQ ID NO: 2246 - RNA, 79 nt, Tupaia herpesvirus
gcuccaccccgccgacgagccggccgccguccgggugcgcggacgcggacggugggggacgcgggggcggggcgcgagc

SEQ ID NO: 2247 - RNA, 87 nt, Tupaia herpesvirus
aucuaugaaaacagacgacuauaaagagauaggcuagcaauucuaaucgggaaucauacuaaguauaguaguaucacaucauuggau

SEQ ID NO: 2248 - RNA, 62 nt, Camelpox virus
ucucuauccaaggauguaauuaaauguuugaucgauaacaauguuuccauccauagcagaga

SEQ ID NO: 2249 - RNA, 116 nt, Lymphocystis disease virus 1
ugcuaaaauacaaucuaaacaauaaugaauugguguuaaaaaaucaguauccagcuuagcguguguuaaguaauaaaguauuuuuugauaacaaauuucuauuauauuguuaagca

SEQ ID NO: 2250 - RNA, 79 nt, Dengue virus type 2
agauccugcugucuccucagcaucauuccaggcacaggacgccagaaaauggaauggugcuguugaaucaacagguucu

SEQ ID NO: 2251 - RNA, 131 nt, Zaire Ebola virus
aaauagcuaacauuaaguagucaaggaacgaaaacaggaagaauuuuugaugucuaaggugugaauuauuaucacaauaaaagugauucuuauuuuugaauuuaaagcuagcuuauuauuacuagccguuu

SEQ ID NO: 2252 - RNA, 91 nt, Gallid herpesvirus 3
ccggcaagcacucguccgaaggaggacacgccacgcgacccgauucccagccgcuucgcgcccggcuacuucuucgccugcaguccgccgg

SEQ ID NO: 2253 - RNA, 71 nt, Gallid herpesvirus 3
cucccaucuuucccugacggcaucuaaccguuaaaauacgacgucaggcaccguaagggaaaaaauggaag

SEQ ID NO: 2254 - RNA, 84 nt, Gallid herpesvirus 3
cgcgggggaaggucgguccauuucgcuccuauuccgcaccuucguuuggaacagaagcauuacacacaccgccauuuccccgcg

SEQ ID NO: 2255 - RNA, 64 nt, Molluscum contagiosum virus
gggcugugcuagcacgcgccacgaggaggucacggcuccgcgcgugcaaacgcagacaacgccc

SEQ ID NO: 2256 - RNA, 85 nt, Rabbit fibroma virus
uuuuccaauuucguaagucgucuacaaaaacauauacaaacuguaucuagaugauaggauuauuauguggcggaacaauggaaaa

SEQ ID NO: 2257 - RNA, 96 nt, Junonia coenia densovirus
guauugccaccgacgacgacgacggcagucccugccggcgaagccggccgccgcgaagcggcaagggacugccgucgucgucgucgguggcaauac

SEQ ID NO: 2258 - RNA, 84 nt, Chimpanzee cytomegalovirus
acgacggcuacagcucgcggucgaagccgucgcccgacagauagucgaagaugagcgcgagaccguacagguaguagucgacgu

SEQ ID NO: 2259 - RNA, 120 nt, Frog adenovirus 1
uuggaucccaaugucuuguucagaaugcugcuagaugcuuauaagcucgagaagcaguacaagaguaaacugcagucucgugcugcaucgcagucuacuauuuaaccacuugggggccaa

SEQ ID NO: 2260 - RNA, 67 nt, Triatoma virus
gaugaacuguccucaacaaguaugaaaagcaauuauuugugaaguuacuuguuguuguaagauuauu

SEQ ID NO: 2261 - RNA, 106 nt, Triatoma virus
ccugcaggcauuuugugaaaaggguaaaguaugaaagcuacucucagaaaaguacuuauguauugaugagagccuuaaaaugacuuuauauucacaaaacugcugg

SEQ ID NO: 2262 - RNA, 60 nt, Sulfolobus virus SIRV-1
cauuuguaauagaaaauuuaagagaagaaaaagaauuccuaaaauuuuuauaugaaagug

SEQ ID NO: 2263 - RNA, 69 nt, Macaca mulatta rhadinovirus
cgggaaacugcguuuuggauaaugugcaggacguauguucguacgguccuccagaacgccgcguacccg

SEQ ID NO: 2264 - RNA, 67 nt, Fowlpox virus
uauaacgucuaacuuacaacacggucauaauagaaucccuauuaacauguuguauauagaugucgua

SEQ ID NO: 2265 - RNA, 84 nt, Human herpesvirus 4
gacugaauuuucgcagucucuuuucccucuucccuuguuauucccauagaauuacagugagguuacacagguggagauucaguu

SEQ ID NO: 2266 - RNA, 62 nt, Sulfolobus virus SIRV-1
uagauuauaaacauagaccuugccuauugaaaggucuagucuauguugaacuauuagaucua

SEQ ID NO: 2267 - RNA, 78 nt, Vaccinia virus
augauuuaguuacuuuaauaaccguuagacauaaaauugauucuaugaaaacuguguuucagguauuuaacgaaucau

SEQ ID NO: 2268 - RNA, 127 nt, Vaccinia virus
cuaauauaguuaauaguguacuacaaacaggcgaugguaaaaagacucuucgucuucccaaaauguuagagacggaaauaguugucaagauucucuaucgcccuaauauaccauuaaaaauuguuag

SEQ ID NO: 2269 - RNA, 131 nt, Macaca mulatta rhadinovirus
guucuuaaauagcagccagggccuuaccgaccaguuuucguguccucuuggcgcggcucugccuauauaugccacggaaucugucaguugguguaagcccugccaucgcugugauauuuuuauugcguugc

SEQ ID NO: 2270 - RNA, 87 nt, Macaca mulatta rhadinovirus
ucugcuauucgccuaccuagggaaaccucgaaaaaaauccuaaauuuaacguuuuugguugcccugaguguugggcgaauugaaaga

SEQ ID NO: 2271 - RNA, 77 nt, African swine fever virus
ggaauuuuucuugguuuucgggugugauuuuauauucauguagaaaguguuucacaccugaggagaagaaucuuucc

SEQ ID NO: 2272 - RNA, 87 nt, Tupaia herpesvirus
ucgaauucaaacgugcgacaguggcuauugguucgggcgaccggaacccguuaggucguucauguuucugugcacauuugaauucga

SEQ ID NO: 2273 - RNA, 68 nt, Horseradish curly top virus
acgcgcauguugaagucgagguguccacacaaguaguuguguguaccuaacgcucuugcccagcacgu

SEQ ID NO: 2274 - RNA, 62 nt, Horseradish curly top virus
aucggcccacucuugcauuucuucggggacguuugugaaggaggagagaggauacggcggau

SEQ ID NO: 2275 - RNA, 130 nt, Equine herpesvirus 4
ggauaaauaaucguauuauuguaauagggaaauuuaggggagggguuucaauggugggcagagcuaaacuuaacaccaauggaaagcuugccuaaucgcucacauuaauuuagauuuucgacuugugucc

SEQ ID NO: 2276 - RNA, 76 nt, Rat cytomegalovirus
acgcgacaacuucgagaaccucggggucuccgcggccgaccuggccgagauagaccgcgacucggaggucguccgu

SEQ ID NO: 2277 - RNA, 85 nt, Paramecium bursaria Chlorella virus 1
caagaugaaucggugaagucuccauagagugccuuauuuguacagcaaguuucuaaauuacuuggguuuucaucacaacgucuug

SEQ ID NO: 2278 - RNA, 93 nt, Horseradish curly top virus
guucccuucuaugauaauggauuuggccuuauggcugucggcaacaggccugccaaaguaaucaucggcccacucuugcauuucuucggggac

SEQ ID NO: 2279 - RNA, 93 nt, Rat cytomegalovirus
gcgcaccgccgccgagaucgagugucagaaguccaagcgcgucguggaggcccuggacgucgucauccugaagcucgucgucggcgaguucgc

SEQ ID NO: 2280 - RNA, 116 nt, Bovine herpesvirus 1
ggggcgggagggggaagggggagccggagcuuuggcccgcucgcucggccggcccgaauccucggccggcccgaauccccuccuuccccucccuccccuccuuccccucccucccc

SEQ ID NO: 2281 - RNA, 120 nt, Vaccinia virus
gauuuggccaaauguauccaucauaaucuggguuauaaacggguguaaacaagaauauauguuuauauuuuuuaacuaguguagaaaacagagauaguaaauagauaguuuuuccagauc

SEQ ID NO: 2282 - RNA, 78 nt, Turkey adenovirus 3
uuauguaaacaaguuuauaaguugugaagaagauaguaaauuuuccuuuuuuuaauuuauaggcgagcccauacauga

SEQ ID NO: 2283 - RNA, 60 nt, Amsacta moorei entomopoxvirus
aauauaguaccuaaaggauauuauucucaaauacaagaacaaguuccugauaauuauauu

SEQ ID NO: 2284 - RNA, 92 nt, Amsacta moorei entomopoxvirus
guaauuauauauaauauaaucuauauaauaauauuuauuuauuguuaaauacaauaacauauuuuauauauaauauauuauuuauauauuau

SEQ ID NO: 2285 - RNA, 61 nt, Saimiriine herpesvirus 2
gauuagaucuaaguugcuagucaugcacguuuuaagcucuaugacauagcauauucuaguu

SEQ ID NO: 2286 - RNA, 64 nt, Ateline herpesvirus 3
ugacauaagccuugggaucuuugugucugucuaaugucacugcuuagaucuaggcuacugguca

SEQ ID NO: 2287 - RNA, 89 nt, Human herpesvirus 5
cguccgccuguacgcggaccgaucaccagaaggcggacauugggcugugguucauguuucugguuuuuggacuguguucgugguuggcg

SEQ ID NO: 2288 - RNA, 77 nt, Ground squirrel hepatitis virus
accgcggagcuuauagccgccugccuugcucgcugcuggacaggagcucgguuguugggcacugauaacuccguggu

SEQ ID NO: 2289 - RNA, 77 nt, Saimiriine herpesvirus 2
gauguacauuccaacacugcugccauauuuuuggagaaauucaauauggauaugauauuauuugcaguauguauauc

SEQ ID NO: 2290 - RNA, 68 nt, Tupaia paramyxovirus
acauugaguaucuaaauuauacaaguauuaaaaauacuagauuuguguaguuuuaaaauaaauaaugu

SEQ ID NO: 2291 - RNA, 66 nt, Tupaia paramyxovirus
acuagucacaaaucagaucaauggucaaagaucuucggaauccaaacuauuacuccagggauaagu

SEQ ID NO: 2292 - RNA, 75 nt, Lumpy skin disease virus
gauuaguuaauaucgaugauuuaauaaagggagccauaaguguuaaaguucuuacauuaaaugauguuauuaguc

SEQ ID NO: 2293 - RNA, 61 nt, Lumpy skin disease virus
gcguuacucuucccacuuauaauauuuuaggaaaacaaauauuuuuaagccaaaguuucgu

SEQ ID NO: 2294 - RNA, 130 nt, Goose parvovirus
cgugacuuccggucaugugacuuccggugacguguuuccggcuguuagguugaccacgcgcaugccgcgcggucagcccaauaguuaagccggaaacacgucaccggaagucacaugaccggaagucacg

SEQ ID NO: 2295 - RNA, 130 nt, Melanoplus sanguinipes entomopoxvirus
uauuauguaaauuuaaaaaaauuaauuagaccuguuauauauaaugaaaauauauuauuuaauaaagauacauuauaugaaauauuuccacuauuuaugaaaaauauuaauaaugauaauauaaguaaug

SEQ ID NO: 2296 - RNA, 62 nt, Myxoma virus
gccauacaguggaccaauacgggauaauguuuguccucgcaauuggauagaaacguaguggc

SEQ ID NO: 2297 - RNA, 100 nt, Vaccinia virus
guccgcuguuuccguuaauaauacuauuuucguaacuggcggauuauucauaaauaacucuaauagcacgaucgugguuaacaauauggaaaaacuugac

SEQ ID NO: 2298 - RNA, 61 nt, Human herpesvirus 5
guauuuuauugggaauauuggcggggauaaaccuguuucggauguuuacccuuaaucuuac

SEQ ID NO: 2299 - RNA, 70 nt, Ground squirrel hepatitis virus
aaagguugacgggcauucuuaauuauguugcuccuuuuaccaaaugugguuaugcugcuuuacugccuuu

SEQ ID NO: 2300 - RNA, 79 nt, Simian-Human immunodeficiency virus
gagaggcuggcagauugagcccugggagguucucuccagcacuagcagguagagccuggguguucccugcuagacucuc

SEQ ID NO: 2301 - RNA, 61 nt, Simian-Human immunodeficiency virus
cacgcuugcuugcuuaaagcccucuucaauaaagcugccauuuuagaaguaagcuagugug

SEQ ID NO: 2302 - RNA, 85 nt, Simian-Human immunodeficiency virus
aagacccuggucuguuaggacccuuucugcuuugggaaaccgaagcaggaaaaucccuagcagauuggcgccugaacagggacuu

SEQ ID NO: 2303 - RNA, 85 nt, Human herpesvirus 8
gcagcugggguggaagucugaaaaagggaaaggggaggugagcagagugcccaguuagucuccgacccgccguccgcccuacugu

SEQ ID NO: 2304 - RNA, 87 nt, A-2 plaque virus
uauacuaucugaagaauauauaauaacugauauaguauuaucagcuauaucauacaaggauuguuauauauuuucuaaaaauguaua

SEQ ID NO: 2305 - RNA, 126 nt, Variola virus
ugagaauauugaugauuuuuuuuaagaugauauuuacuuuuuauaugcuugcauuacagaauaauauucacagguauuauuaaaaugaguaucggagcuacauuaccauaucaucauccaugcuca

SEQ ID NO: 2306 - RNA, 75 nt, A-2 plaque virus
agauccuugguuauuauauuccuuauacuaguagaauaguuacuuaguuaaugauguaauucuaacaagaaaucu

SEQ ID NO: 2307 - RNA, 70 nt, A-2 plaque virus
ucuggcucuguuauuguacccgauauaacgguaauacuaauuuaucuaaauaugauguauaagaguuaga

SEQ ID NO: 2308 - RNA, 87 nt, Ectromelia virus
gugagauagucauggagacuacaucagauuacgaggaugucguuuuuacuuuguggaugaugaacuauguagccgugacuccaucau

SEQ ID NO: 2309 - RNA, 129 nt, Ectromelia virus
uggaagacuguacaaggaauugaugaaguucgaugauguugcuauacgguacuauggaauugauaaaauuaaugagauuaucgaggcuaugagcgaaggagaccacuacaucaaucuuacagaagucca

SEQ ID NO: 2310 - RNA, 64 nt, Macaca mulatta rhadinovirus
guuaaucucacaacuuuacuguuuuugaacuguucaaaauauagcauagauccgugagaaauac

SEQ ID NO: 2311 - RNA, 62 nt, Vaccinia virus
cauguaguaagugucgauuguaauaaggaacugaugccuauuaggacagauacuacuauuug

SEQ ID NO: 2312 - RNA, 60 nt, Vaccinia virus
cuguguccaagguaaaaucguguuuguguaguuuucacaaugaugccaucauagauauag

SEQ ID NO: 2313 - RNA, 98 nt, Vaccinia virus
gucauucauuuagaaugguuguugggcuuuaucaaguguauuagucagcaucagcaucuggcuauuauguuuaaagaugacaauauuauuaugaagac

SEQ ID NO: 2314 - RNA, 68 nt, Variola virus
auggagauacaacgugaaauacuuuauuacuccauuaaauaauguaucacuuacgauaaugucucuau

SEQ ID NO: 2315 - RNA, 73 nt, Variola virus
aagaugauaaaaacacguuuauuuuauaugucaaccauuacuaaaaaauauauuguucuguuuuuguuuucuu

SEQ ID NO: 2316 - RNA, 98 nt, Frog adenovirus 1
ugggaacuucaggagcugacuuagaaaauauuguuuuaucucuugggcugcauucagguuuuuuaggcauuuuugauaaacauuuccccggguucuua

SEQ ID NO: 2317 - RNA, 66 nt, Frog adenovirus 1
gagauuguacuauuuguauacgcaucuuuaauaaaaguuuugaauaaacaauugaguacuuguuuc

SEQ ID NO: 2318 - RNA, 65 nt, Paramecium bursaria Chlorella virus 1
aagugauauaaggggaauacacaugaguaaucaaaacccagcacauacucuccucgaauucauuu

SEQ ID NO: 2319 - RNA, 97 nt, Cactus virus X
gcccuuagucauccaugcuguggccggugcaggaaagaccacccugauuaggcaauuucuacaccaacacucggccacgaaugcucagacgcugggc

SEQ ID NO: 2320 - RNA, 69 nt, Human herpesvirus 5
gaacagaaaagggggagaauuuuccguaagacuuacauaacguucuuuucaaagcaguucuuucuguuu

SEQ ID NO: 2321 - RNA, 63 nt, Human herpesvirus 5
cguugucgcgcggcgacgccggcgcggcgggccgaggacggaccguuucgccgcucgacgacg

SEQ ID NO: 2322 - RNA, 68 nt, Paramecium bursaria Chlorella virus 1
cccagcacauacucuccucgaauucauuucuccuaccaguugugagucgacgaccaucgccuacuggg

SEQ ID NO: 2323 - RNA, 90 nt, Human herpesvirus 5
guuggauaucuuuuguuugucggauguaaauucguugauuuuaacauguaaauagugagguuuucugaugugacgucuaagauguugaau

SEQ ID NO: 2324 - RNA, 92 nt, Human herpesvirus 5
cuggcgucccucucgguggcgcagagccugccgccgcuccggcucccguucgacgcggcggcggucgggcgggcgucucgggcggacgucgg

SEQ ID NO: 2325 - RNA, 122 nt, Jembrana disease virus
gcucccgcucagucuguuaguccuccuaguucgaauccuuuugcauauucucucucccacuuuucaaaaucaaagaggguggacuguggggagaaagggaacagguggggacgaccgggagc

SEQ ID NO: 2326 - RNA, 90 nt, Woolly monkey sarcoma virus
gccgucccgauuaaccgauuccccgcacggagcaccgcggaccacccgaccgcgagccgacuccuggaguucguuccucauuucgacggc

SEQ ID NO: 2327 - RNA, 113 nt, Pepper ringspot virus
uguaaaaagaaaaugcgagugcaagaacugugguugguuuccugcgauaucaguucaaccugauuacguggaagucuacuucuguuguggcaugaagcauuuacaaaagugca

SEQ ID NO: 2328 - RNA, 79 nt, Cowpox virus
gucuccuuaaagcuucugaugguaacuguguuacaugugcuccgucauacguaaaugccuucuuaagcuauuuggaaac

SEQ ID NO: 2329 - RNA, 65 nt, Pepper ringspot virus
uccggcaacaucaccgcggccgugcggaugcuccaaagccuguccacguaugccgugccgccgga

SEQ ID NO: 2330 - RNA, 62 nt, Pepper ringspot virus
gcccccgucugucgccucucccuuuuuucccccccucaaagaacgugguguugggcgccggc

SEQ ID NO: 2331 - RNA, 103 nt, Fowlpox virus
uucuuuuaaauacguaucacaguuuaaugcuuuacuuauaagcuuuguauuuuuagaauuauaauacuuaguuaauaccuuuacucugucuacguugaaagaa

SEQ ID NO: 2332 - RNA, 69 nt, Camelpox virus
uacgaaacaccgauaaauuauaaaagaagcagugauuccgcuguuucaguuaauaauacuauuuucgua

SEQ ID NO: 2333 - RNA, 88 nt, Tupaia herpesvirus
cuacguaccaccuauaaucaucuguaggaaaauggaagguauguacaucuaucuacuguuccuaauaucauauauggugguguaguag

SEQ ID NO: 2334 - RNA, 93 nt, Human adenovirus C
uugcucccaaaccucagcgccucccaaaagacauauuuccugcagauucacucaaauauggaacauucccagcugcuacaacaaacagagcga

SEQ ID NO: 2335 - RNA, 68 nt, Paramecium bursaria Chlorella virus 1
acuugauucaaagucgggauuuuuucgguugaauuucguaucgacaaauuacugaguucguucaaugu

SEQ ID NO: 2336 - RNA, 66 nt, Amsacta moorei entomopoxvirus
caauauaaauaaauuaucuuuuauuauuucuuuuuuaauauaaguuaaaauuuuaccaguauauug

SEQ ID NO: 2337 - RNA, 77 nt, Lymphocystis disease virus 1
uguugagauauguacauuaauaaauauauuccagaaucauuuuuuguuauauuauuauccaaagucuauccccaaca

SEQ ID NO: 2338 - RNA, 93 nt, Melanoplus sanguinipes entomopoxvirus
uauuuguuuuaaguacaucaccaaaaauuucuuuauaauucauuuuauuaauguauuauauuuucaauuuuaugauuuuauauauaauaaaug

SEQ ID NO: 2339 - RNA, 126 nt, Paramecium bursaria Chlorella virus 1
gccauucucuacaagguaaagacccgggagucuguaagcauauagaugacauaaugguaucacaaugauccguuucauaauuauuagaaaauauuuccggacagucuuuaucggauucuuuauugc

SEQ ID NO: 2340 - RNA, 126 nt, Paramecium bursaria Chlorella virus 1
uccgucuaaaacauaacuuucuguaccauaggguaucuuuuguaaaucaagaauagaacccggucuaaacgauaaugauuugcaagguucuccugguacuauuacgaauuuuuuuuuagcuucggg

SEQ ID NO: 2341 - RNA, 89 nt, Cercopithecine herpesvirus 7
gucaggcauguuugcgcauauauaaaaacauacaacauacacguaauuuuuugguguuuaaaacaaauuguauuguacaugaaauugac

SEQ ID NO: 2342 - RNA, 63 nt, Porcine adenovirus C
ggcgaccguuguguggaguuagaaaagagcacggacaccgugcagggucccuacagcgccgcc

SEQ ID NO: 2343 - RNA, 104 nt, Variola virus
gaugugauaaauacagcgauaccauuugugggcauuguccgagugacgcauucacgucaauauauaaucguucuccuuggugucauaguuguagaggucacauc

SEQ ID NO: 2344 - RNA, 84 nt, Lymphocystis disease virus 1
guuuuuuuuguauuuauauacaacaacacauaguuuguacuaaugacagaguuuauaguguuuuuuauaaauaucuaaaauaac

SEQ ID NO: 2345 - RNA, 77 nt, Variola virus
ucuugauuauuaauacaaauucauugucuaugaaaugugaacaagaauuaaaguguuguaaacuauguaagccagga

SEQ ID NO: 2346 - RNA, 63 nt, Porcine adenovirus C
ucuuucugcauguaguuuuaaaaaagcagaacuuuguaaaauauauacuauaucuggaaaaga

SEQ ID NO: 2347 - RNA, 65 nt, Human herpesvirus 5
gcggggggucuggggcucugaccugagugcagguuacgaaggucagguggcccgagcccccccgc

SEQ ID NO: 2348 - RNA, 99 nt, Human herpesvirus 5
uuuucuccguacaagaaauggacgucacuugagcagacacaguuucaucgaccacgacagucucaugaucugacuaccucugacccgccaacgagaaaa

SEQ ID NO: 2349 - RNA, 70 nt, Human herpesvirus 5
ggggcggcgcccgcgggggagcggccggcuccgggggagggacggggaagggggcgcgcggggcugcccu

SEQ ID NO: 2350 - RNA, 111 nt, Vaccinia virus
caucuuuuaccaacacaaaggguggauauuuguucauuggaguugauaauaauacacacaaaguauuuggauucacgguggguuacgacuaccucagacugguagagaaug

SEQ ID NO: 2351 - RNA, 82 nt, Human herpesvirus 5
cccgucucccucuguggucguggguggugcgagaguacacgauggguggcucucgucucgggggaccacagggggagggggg

SEQ ID NO: 2352 - RNA, 64 nt, Vaccinia virus
guacgcgugucgauucaucaagguauauaaaccuggggaugaggcuaccucgacauacgugugc

SEQ ID NO: 2353 - RNA, 68 nt, Gallid herpesvirus 2
gaccagucagccgcgaacggaaauaacgccgaaucgagcuccucuaauuccgauaaccggcuguuguc

SEQ ID NO: 2354 - RNA, 76 nt, Clover yellow mosaic virus
ggcuuggcccaucaacugcuaaacugauuagggagacuuuaaacauccccuuagaaggcacgggagacgccgagcu

SEQ ID NO: 2355 - RNA, 81 nt, Melanoplus sanguinipes entomopoxvirus
uuucuaagaauuuacaaucuaaaauaguacaugauucacaauuuaauucuauuaauguugaugguaaauuacauuuagaaa

SEQ ID NO: 2356 - RNA, 69 nt, Human herpesvirus 5
ggcaugucggccgacaaaucgcagcugucuucgccgccgcagcuguagcaguuaacgucgccggccucc

SEQ ID NO: 2357 - RNA, 119 nt, Spleen focus-forming virus
uuacauaagguuuuuacaaauauugacuuguuauuuauuaaacaaaugggacauauaacacuuucauuaaauuuaauauaauauuuauucaauauuuuuuuauaauuuaacuuauguaa

SEQ ID NO: 2358 - RNA, 127 nt, Spleen focus-forming virus
ggguacacgaaaacagcuaacguugggccaaacaagauaucugcgguaagcaguuucggccccggcccggggccaagaacagaugguccccagauauggcccaacccucagcaguuucuuaagaccc

SEQ ID NO: 2359 - RNA, 82 nt, Rice stripe virus
auagaaaaucaaaaacaaugaauggugcuaagcaccacauccggauguggugcguagcaccauuuucauaacauuaaucuau

SEQ ID NO: 2360 - RNA, 65 nt, Rice stripe virus
gagcagaacaaaccacaucaagugcauagcacaagauguuagcauacuccggaacugguuaucuc

SEQ ID NO: 2361 - RNA, 76 nt, Variola virus
cauauuacaaaaucgauuccguccaagaugauaaaaacauuuaccggcaucauaaacacggaguuuauuuuauaug

SEQ ID NO: 2362 - RNA, 126 nt, Monkeypox virus
gugcuuuaacgucaaugguacaaauuuuauccucgcuuuguguaucauauucgucucuaguauaaaauucuauauucaaauuaucaugcgauguguauacgcuaacgguaucaauaaacggagcac

SEQ ID NO: 2363 - RNA, 63 nt, Monkeypox virus
ggauuccuaauuuuaacaucaaaacuuaaagacacuggaucuuuaguuaauucaauagcuucc

SEQ ID NO: 2364 - RNA, 82 nt, Avian carcinoma virus
gaaagggggcccgggggaucucccccgcgguaacuggucacaguugccgcggacggagaucaucccccgguuacccccuuuc

SEQ ID NO: 2365 - RNA, 99 nt, Avian carcinoma virus
ggccggaccguugauucccugacgacuacgagcacaugcaugaagcagaaggcuucauuuggugaccccgacgugaucguuagggaauaguggucggcc

SEQ ID NO: 2366 - RNA, 60 nt, Avian carcinoma virus
cugagugacgucggagggagcuccacggccgggggccaagauacccuaccgagaacucag

SEQ ID NO: 2367 - RNA, 61 nt, Hendra virus
cuaaauaguuuaauccaauaaauugaggauaaucaauucuugcauugcauaaacucguuag

SEQ ID NO: 2368 - RNA, 79 nt, Spleen focus-forming virus
gguuaguucaauuuguuaaagacaggaucucaguaguccaggcuuuaguccugacucaacaauaccaccagcuaaaacc

SEQ ID NO: 2369 - RNA, 88 nt, Rice stripe virus
ccuagcccuaacccuagggcugcggcccuaacccuagcccuaacccuaacccuaacccuagggcugcggcccuaacccuaacccuagg

SEQ ID NO: 2370 - RNA, 60 nt, Rice stripe virus
cgcccccacuggcagccaaugucuuguaaugccuucaaggcacuuuuucugcgagccgcg

SEQ ID NO: 2371 - RNA, 95 nt, Spleen focus-forming virus
guuuuauauguuuugauauauauaaccaaucuaaucuaucuuuaauuuuauuaauaaaugauucagauaaugauugauaucuagauauauuauac

SEQ ID NO: 2372 - RNA, 111 nt, A-2 plaque virus
agcgauaaaaguaauagaaaacacuauaccaugucuaccgauaauaugaagauuauauucauaaagucguagauaauuaaagagaaguuuaaauuuauuauaaauuauccu

SEQ ID NO: 2373 - RNA, 61 nt, Ectromelia virus
caguaucauuuaaacauuuaacuugcgggguugaucucacaacuuuauuguuuuugaacug

SEQ ID NO: 2374 - RNA, 63 nt, Ectromelia virus
agauccgugagaaauacguuuagccgccuuuaauagaggaaaucccaccgccuuucuggaucu

SEQ ID NO: 2375 - RNA, 131 nt, Macaca mulatta rhadinovirus
uaaaaaacggcagauuaaguagauugcccuuuccacgacccgcagccaccugagcgcgcgcacgcagaaccuauguuuagugcgauugcgauuauguccgcuagguggcgggcuauuuugauccugccgcg

SEQ ID NO: 2376 - RNA, 130 nt, Macaca mulatta rhadinovirus
ccaccuguuuuaacauauaauaggcaggagauagauauccgucauugcaauauuccuucucguaggcacacaaucgaauauugauaaaaucuccauucucuucucugcauuuauuaucuugucuuggugg

SEQ ID NO: 2377 - RNA, 66 nt, Reston Ebola virus
agugaugaagauuaagaaaaaccagucgguauuuuccagacuuggcauuucuuaucuucaucuucu

SEQ ID NO: 2378 - RNA, 131 nt, Macaca mulatta rhadinovirus
gggcccaugguggcgcgcggcccccaccguccccauuucccacgguuugcucaugggcaccgacggugcccguggugauauguuucagugacccucggaugacccgggcgacguuuugcgcaccauggucc

SEQ ID NO: 2379 - RNA, 61 nt, Fowlpox virus
ucuuuaagaaccaagugugagguagauagagcgguuaaauauuucauaucgguuauaaaga

SEQ ID NO: 2380 - RNA, 65 nt, Human papillomavirus type 47
ugguagucuugauagccuuuaacaagcauuaacgcugcuuugcuacuaacugcuauuaacaacca

SEQ ID NO: 2381 - RNA, 62 nt, Human herpesvirus 7
guagaaguuguauuuuuagaagucgaaucugagucaagaucuauagaaaauauaaacuuuau

SEQ ID NO: 2382 - RNA, 80 nt, Human papillomavirus type 47
uuccuggguagcuggagauagcauugagcgucuaggcagguccagaaugcucauuagcuuuuccugccucacucagagaa

SEQ ID NO: 2383 - RNA, 83 nt, Gallid herpesvirus 2
aggagagcgagcagagaggggccggugcgggaguuuggaacuccgcggucauucaucucccgccacgccccaugcacgugccc

SEQ ID NO: 2384 - RNA, 62 nt, African swine fever virus
accauuaaaaauauuuuuaucuguuagauuuaauuuaauaaauggcucauggaauguguggu

SEQ ID NO: 2385 - RNA, 110 nt, Paramecium bursaria Chlorella virus 1
cagugagauauggucuaauuggagacuauacgcuccaguuccgccgaacuuauaaucuuggaaauuuuuagcuggcugcauauaucuacugaauaaucauauuauuauug

SEQ ID NO: 2386 - RNA, 130 nt, Tupaia herpesvirus
gugugugugugugcguccguucguucguucgucggggugagggaggaagaaaaacgcggguucgucacacaagguccccgggguuuuuuuaccgcuuuauugaaaaaccgaaaugucguacacacauguc

SEQ ID NO: 2387 - RNA, 77 nt, Tupaia herpesvirus
gccuucacgagcacgggcgagcgagcauauggugucuauacgagcgugugugggcgugucgguguguccgugugggu

SEQ ID NO: 2388 - RNA, 70 nt, Tupaia herpesvirus
ccgacgggcugaacguccgggccucucggugacaucggugaagaaacgggcgggcgggcgggcugaccgg

SEQ ID NO: 2389 - RNA, 83 nt, Ectromelia virus
uuuuuuacccauaaauaauaaauacaauaauuaauuucucguaaaaguagaaaauauauucuaauuuauuguaugguaaggaa

SEQ ID NO: 2390 - RNA, 131 nt, Potato virus Y
cuguacuacuuuuaucauaauuaauaaucguuugaauauuacuggcagauaggggugguauagcgauuccgucguuguuagugaccuuagcugucgguucuguauuauuaagucuuagauaaaaagugccg

SEQ ID NO: 2391 - RNA, 69 nt, Potato virus Y
gugacugaucuaucgauuaggugaugcugugauucugucauagcagugacuaugucuggauuuaguuac

SEQ ID NO: 2392 - RNA, 74 nt, Ectromelia virus
uuaguguugguauuauuaguauucuucuugucaucuuguucagaaauauacagcaaugcuauaccuaauacuaa

SEQ ID NO: 2393 - RNA, 109 nt, Ectromelia virus
ggagcaugcggugcuauaucuuuuccguuuauuauacaugagagaacaauauauacgaguauaauacggacuucaugauuuaauaauguaguaauuaucgucuuguucc

SEQ ID NO: 2394 - RNA, 67 nt, Chimpanzee cytomegalovirus
gacucaagcauauauacacggcucggggagcaaggugugacuguggucguguguggugucucugguc

SEQ ID NO: 2395 - RNA, 72 nt, Molluscum contagiosum virus
cgcccgcgcccgacucgcagcucacgagauggcugcucucggcagcgucgcggagcgcgcacggcagcggcg

SEQ ID NO: 2396 - RNA, 71 nt, Molluscum contagiosum virus
gcucgcggugcagcugccgcagagccgcgaaagcgucgugcuccacgcgcagcuucucugcgaucgcgggc

SEQ ID NO: 2397 - RNA, 70 nt, Human herpesvirus 6B
uacauuaaggcaguguugauuuuuuuucauuguacccacuuacgaauaacgaaucaaaagccaugaagua

SEQ ID NO: 2398 - RNA, 93 nt, Tupaia herpesvirus
gucguggucgucgucguggccguggccguguagcggggcgccugcugggguugaggcugcugcugcggcugcggccgcggcgacgacugcggc

SEQ ID NO: 2399 - RNA, 129 nt, Bovine papillomavirus
cuuugcucuaauuucaggaacugcuaaccagguaaagugcuaucgcuuucgggugaaaaagaaccauagacaucgcuacgagaacugcaccaccaccugguucacaguugcugacaacggugcugaaag

SEQ ID NO: 2400 - RNA, 68 nt, Bovine herpesvirus 4
uuuuuauucuuguuauuuagcugagucaucgguaccgaauauacaguuaagaguaucuagagggagaa

SEQ ID NO: 2401 - RNA, 70 nt, Rana tigrina ranavirus
ccucugguacaguucugacaaagaggacucuugcagagaggacucugagggcugcguguucuacuagagg

SEQ ID NO: 2402 - RNA, 131 nt, Alcelaphine herpesvirus 1
aucugcucuguuuuguacaaaaaguggaaguguguguuuauaugauucacaaaacuguaguuuaacaguaaaaguuaauugugguuugugguaugacacacaguucuggaaacugaccaaacaguguucuu

SEQ ID NO: 2403 - RNA, 91 nt, Chimpanzee cytomegalovirus
acagaagaaguucuauaucuaggcacacucuaaaaaaaaaaaagcacacgcuugcuggcaugucccucguaauaaagaacaaaacuacugu

SEQ ID NO: 2404 - RNA, 116 nt, Human herpesvirus 1
uggggaugcgugaguggcccucugugggcggugggggagagucuuauaggaagugcauauaaccacaacccaugggucuaaccaauccccaggggccaagaaacagacacgcccca

SEQ ID NO: 2405 - RNA, 81 nt, Human herpesvirus 6B
uuaucagcgucuuauaaugugaugucuuuuuuuuuauuuucuugucgguauuuuaaaaguagucuguuaagauguuuuuaa

SEQ ID NO: 2406 - RNA, 93 nt, Vaccinia virus
uaccaauauuggaauuauaauauagguguauuugcgcacucgcgacgguugaugcaucgguaaauauagcuguaucuaauguucuagucggua

SEQ ID NO: 2407 - RNA, 127 nt, Rana tigrina ranavirus
ucccaagcuuucguuacccucuagggguaacaaaugcaaugacuguaaauguuuagacuuggaguguuuaaaacacugacauuuaggucaacgauguucucagaaaguagaggguggccaaaccgga

SEQ ID NO: 2408 - RNA, 131 nt, African swine fever virus
uguagauaccauauaaugaauguuuuauuaggauaguaguuaauaguuuaguuaagacaguaguucuuucuguuaagauaguaguucuguuaagauaguaguuuaguuaugauagugguuuaguuaagaca

SEQ ID NO: 2409 - RNA, 93 nt, Porcine adenovirus C
cuuuuucaagauccugguuugauugauaaaugauaugcaaaaucucugaugaucucugcaaugcaaaugucucacagucuaccggagaaaaag

SEQ ID NO: 2410 - RNA, 108 nt, Human papillomavirus type 36
cauuuaguacaacuuggucauggguggcaggagauggcacugagcgucuaggcaggcccagaaugcucauuagcuuuucguccuacaaucagagaagggauuuugaug

SEQ ID NO: 2411 - RNA, 61 nt, Pea early browning virus
guaauugaguuuccaaacuuacauuugauacaguacgaaaaugguguggaaaagaaguugc

SEQ ID NO: 2412 - RNA, 95 nt, Oat golden stripe virus
caacaaacguuguggaaauucaaaauuguuguccuaggccugccacggcaauaaauccuaggcgucucaguuuugguuuuucgcuacguuaguug

SEQ ID NO: 2413 - RNA, 104 nt, Cowpox virus
cuaucuaccagauuauuauguguuauaagguacuuuuucucauaauaaacuagaguaugaguaugauaguguuuuuucaaaacauauaaaucuaaaauugaugg

SEQ ID NO: 2414 - RNA, 60 nt, Cowpox virus
aaucugauaacuuuaaacauggauuuuugaugacauagugguuuaaaguuuaaacagauu

SEQ ID NO: 2415 - RNA, 66 nt, Human papillomavirus type 32
gguugaccuguauuguuaugaacaauuugacaccucagaugaagaugaugaagacgaugaccaacc

SEQ ID NO: 2416 - RNA, 117 nt, Fowlpox virus
guaaauuuaauaacuuuuguaucuauggugaauguaugaauauuauuaauuuagauaaaaaauuuuguauuuguaauaaagguuacaccgguaauaggugcgacauaguaaguauac

SEQ ID NO: 2417 - RNA, 124 nt, Human papillomavirus type 60
uuguuaguuguuuuuaaugauaccacacaacgagauguuuuuaugaaauuaguaacuuugccaagagguuguacauauacauuuggaacauuaaacucuuuguaauauuuguaaaacaaaacaa

SEQ ID NO: 2418 - RNA, 86 nt, Vaccinia virus
uuuuuuuauagcgugaaggauaugauaaaaaauauaauuguuguauuuaucccauuccaaucaccuuauaugauucuguaaaaaaa

SEQ ID NO: 2419 - RNA, 68 nt, Peanut bud necrosis virus
guuuaaguucuagaucaggaaaagagcauaaugucaaaauuuauaauuucggagaaaaggauaaaaac

SEQ ID NO: 2420 - RNA, 61 nt, Paramecium bursaria Chlorella virus 1
guccauuaaccguucuaugaucgacgccgguauucucgcacucaucauaugguuuaugcgc

SEQ ID NO: 2421 - RNA, 95 nt, Paramecium bursaria Chlorella virus 1
gcuuucuuucuaaaauugucauuuaucauaucgacacgaauuguauauuuaaauagcauuucuaacuuaugauaucauaauuuagaaauacaagu

SEQ ID NO: 2422 - RNA, 61 nt, Human herpesvirus 6B
ggugugaaacuaugaggaacugaugagaaaugacuuacggccaugauuuuguuucgucgcu

SEQ ID NO: 2423 - RNA, 60 nt, Gallid herpesvirus 3
acgaaucaugauuugaucuaccauuucagcauuuauugguuuauacauucucggguucgu

SEQ ID NO: 2424 - RNA, 99 nt, Macaca mulatta rhadinovirus
cccaaaaccaagccauccaaacauaaaaacaauaaauugucagauuuuguuuaagcauucguaucuuuauuggagugggguggauggugugggguuggg

SEQ ID NO: 2425 - RNA, 65 nt, Rabbit oral papillomavirus
agguuuuuagaggagguaccgauacccagacauaugcaaguguuuguugggaacuucuuuggcuu

SEQ ID NO: 2426 - RNA, 60 nt, Human papillomavirus type 28
gugguaacacuguguccaaaguguaguucaccacugcgacuggugguagagugcagccac

SEQ ID NO: 2427 - RNA, 70 nt, Human papillomavirus type 70
ucgauugcgaaaauuuaauucauuguaugaaaauauuucauguacuuggcauuggauagggggcaaggga

SEQ ID NO: 2428 - RNA, 98 nt, Human herpesvirus 8
cauugcucuguuguaaacuauauauaaguuaaaccaaaauucgcagggagacaaggugacgguggugagaacucaguugagagucagagaauacagug

SEQ ID NO: 2429 - RNA, 100 nt, Human herpesvirus 5
cuugguuguggugauuucauucucauuauuguuguuuucuuuccgucuugcggaugaagauguugcgaugcgguuguuguugguguugcuauacaccgag

SEQ ID NO: 2430 - RNA, 115 nt, Human herpesvirus 5
agaugaucuuuuuguucuucugguucauuuccuaugauuguuuggcugcugaccgacgcgucaggaugugcagggcaugcggggaaucaggaccggacacgggauaauuucaucu

SEQ ID NO: 2431 - RNA, 60 nt, Potato virus A
uuguuauauagacccaccacauagugagauuuuaucucggugacugguuuuauguuucaa

SEQ ID NO: 2432 - RNA, 110 nt, Monkeypox virus
guccaauauuuuauauaaaaacauuuuauuucuagacguugucagaaaauccuguaauauuuuuaguuuuuuugguugugaauaaaguaucgcccuaauaauauugguac

SEQ ID NO: 2433 - RNA, 63 nt, Influenza A virus
ucgcuuuaaauacggacugaaaggagggccuucuacggaaggagugccaaagucuaugaggga

SEQ ID NO: 2434 - RNA, 67 nt, Chimpanzee cytomegalovirus
guguacgggugcuuuauuaucaucagcgucaugcagacugguuguauauauaacguaccaugaucac

SEQ ID NO: 2435 - RNA, 76 nt, Rabbit oral papillomavirus
acaccgcacuuuguuugacuguauuaguaccacauggaguuggguagauaauagcagcacaugcagaguagguagu

SEQ ID NO: 2436 - RNA, 66 nt, Bovine herpesvirus 1
gagucugcgcugcggcggcgcucuuuauacugggcggacgcccccgcagcggcaaaacacacacuc

SEQ ID NO: 2437 - RNA, 69 nt, Human papillomavirus type 10
cacgcagauauaagggcacuggaacagcugcuacuaggcacauugaagcucguguguccucgcugcgug

SEQ ID NO: 2438 - RNA, 79 nt, Human herpesvirus 1
agaacacgcgguccccugugguguuuuugguuauuuuuauuaaaucucgucgacaaacagggggaaaggggcguggucu

SEQ ID NO: 2439 - RNA, 69 nt, Chimpanzee cytomegalovirus
cgcgaccggccaaaagaccgcgcggcgcccgucgggcccucacagcgcucgucgcgcggccgggcggcg

SEQ ID NO: 2440 - RNA, 85 nt, Rat cytomegalovirus
uuugucgugugcuuuucgugucucggggcgguuuccgcgaccgaacccgucgccgcggacgcgagcagccggaucaacguacaag

SEQ ID NO: 2441 - RNA, 81 nt, Grapevine fanleaf virus
gugcaguuuacuuuuaaucuacauauuuuacuguguuauuuauuuaaguuuaauuuuguaguuguaaaaguuguuugccac

SEQ ID NO: 2442 - RNA, 80 nt, Bean common mosaic necrosis virus
ggaggagccauuccaacaccggagcugccagcgugguuguaccaugagugcuguccgaggugcggguaugaauauucucu

SEQ ID NO: 2443 - RNA, 62 nt, Rat cytomegalovirus
uuuccgucgaucuggaagcuuguguucuaaaugaauauauccuucaccaaauaucgcagaag

SEQ ID NO: 2444 - RNA, 61 nt, Ectromelia virus
ucuacguaucucgucguccaauauuuuauauaaaaacauuuuauuucuagacguugccaga

SEQ ID NO: 2445 - RNA, 89 nt, Equine herpesvirus 1
gauugauaaccuugauguagcaagccaaccuuuggagaguuugagguacagggacccaagaggaugguuuuaugcaccagguauuaguc

SEQ ID NO: 2446 - RNA, 83 nt, Bean common mosaic necrosis virus
cauaguuuucuguauuagauaguacgcuuucaauuccagugugguuauaccaccuugugucuauguaaguuagaguggcuaug

SEQ ID NO: 2447 - RNA, 75 nt, Infectious spleen and kidney necrosis virus
gccuagacaucagaccgcgcaggcuguuguuguguugcuuguaccacgucacagccauauagguuacguucgggu

SEQ ID NO: 2448 - RNA, 67 nt, Human herpesvirus 2
cccgucggucggaagcgagugcccuucaagcguguccgcuccucugggcugcaugccgucggauggg

SEQ ID NO: 2449 - RNA, 63 nt, Human papillomavirus type 50
gguucucacaaaaauaugcagaucucuaugaguguuguagcucugcauggaagugguugggcc

SEQ ID NO: 2450 - RNA, 96 nt, Human papillomavirus type 48
caggucaacaaaauaauuugaaauguuggagaaaucgcuguacuacaaaauaugcuaguuuauuuuuaugcuucagcucuguuuggaaguggcuug

SEQ ID NO: 2451 - RNA, 73 nt, Human herpesvirus 3
cugcucggauggcgaccgugcacuacucccgccgaccugggaccccgccggucacccucacgucgucccccag

SEQ ID NO: 2452 - RNA, 119 nt, Paramecium bursaria Chlorella virus 1
auuuucuuuguucuuuuauguuuauuuuguuugucauuuaaaaaacaacaaacuuuaucaaaugacaaacaaaugacaauuaaaugacaaacaaaguaauagugaaguuuagaaaggau

SEQ ID NO: 2453 - RNA, 75 nt, Frog adenovirus 1
gcugcaaagaucaguggcuuuucuaacugcaacuuauggaacaguuguuuacauuggcuuacuauaucuuugugc

SEQ ID NO: 2454 - RNA, 104 nt, Fowlpox virus
uaguacauuacuuaauauccguaagucuuuuuaguucauuuuuaaucaacuaaccaaguaauaaaaaugucauuaaugcucgcguauaugaaugaaauguauug

SEQ ID NO: 2455 - RNA, 60 nt, Macaca mulatta rhadinovirus
cccuucgccgacgccguggcaccugguucacccccugugggcuauggccggaauauuggg

SEQ ID NO: 2456 - RNA, 68 nt, Melanoplus sanguinipes entomopoxvirus
uuauuauuugcuauucuuucaauauauuuaauauuaaugauauugauaaauauaaaaaaaaaugauaa

SEQ ID NO: 2457 - RNA, 98 nt, Gallid herpesvirus 2
gugagaaacaaagacaaagcgaauacgacaaauucguuuauuaaacgucacauuuacguauaauaucauuuaaguauaguuucguucugccaacucac

SEQ ID NO: 2458 - RNA, 64 nt, Infectious spleen and kidney necrosis virus
cgccaagaccuuuucacagcacuuuauugucacaucaucacacacagcagugccgucauuggug

SEQ ID NO: 2459 - RNA, 97 nt, Human herpesvirus 7
augauacuuuuauuaauucuucguucucuaauuggauuuaacaacgaucuuuggucgcaaucacaacuagcuuuuacuugucugaauaaaaguuuau

SEQ ID NO: 2460 - RNA, 82 nt, Gallid herpesvirus 3
guaacgaaugcucguguacuuuauaauugcaugcccgauuacaaucuguucuguaagaauaauuauacguagcguguuuuac

SEQ ID NO: 2461 - RNA, 66 nt, Infectious flacherie virus
uuaaauauuuaguuugauauuuuugguuuguauaauuguauuauuaauauuauauuguuuaucagg

SEQ ID NO: 2462 - RNA, 62 nt, Infectious flacherie virus
uuagaauuaggacaccggaaguggaacgccuaagagagcgaggcccgcgguguagguuuuga

SEQ ID NO: 2463 - RNA, 129 nt, Gallid herpesvirus 3
guauagaagagacgcagucaacuugccggugccgugaaauugucuccacacuaugauguuuuuacuguuacaagguaauuaaagaccuucgaguuuuucacuccacuugugugacgcuccuucgauuau

SEQ ID NO: 2464 - RNA, 62 nt, Sorghum mosaic virus
aaguauuauauguuuccuaugugagugaggccaugccucguuaguguaauauauauuuacuu

SEQ ID NO: 2465 - RNA, 62 nt, Sorghum mosaic virus
aaaguauuuacuauucugcaagggagugaggacgcauccuccaaccuuuuaguacguacuuu

SEQ ID NO: 2466 - RNA, 69 nt, Equine herpesvirus 4
uuauuggucgcuaaguuuaucccuaauugucacgcgugguaaaaacaacaacauagucaagaucguuaa

SEQ ID NO: 2467 - RNA, 126 nt, Meleagrid herpesvirus 1
gugucuaaugguggaagcguggcacuggccgaaaugauauauugcguauagagcgcgacaaacgaauuagaugcgaaugugaagaucauuuuuauuagauguaacauaugccuacaccaauaguac

SEQ ID NO: 2468 - RNA, 60 nt, Meleagrid herpesvirus 1
ccgugacauuugacagaccuggaauuguuauucugauauauagugggugugucuggccgg

SEQ ID NO: 2469 - RNA, 62 nt, Infectious flacherie virus
guuauagcugggcacacuugcgguuuccgaacgcagucggagauacguagucagcuaguagc

SEQ ID NO: 2470 - RNA, 92 nt, Meleagrid herpesvirus 1
caacauacauaaugugcaugcgaaaccacuuuuucaguguacgcugacauugugcaacacggagggguagcaucuacauacaauauauguug

SEQ ID NO: 2471 - RNA, 65 nt, Lumpy skin disease virus
cuaauaaguggaagccaauuaaguagaagccaauuaaaccuaauaaguggaagccaauuaaguag

SEQ ID NO: 2472 - RNA, 79 nt, Barley yellow mosaic virus
ccgugccuuauacaucacccacccccgcucauaauucagucuuuaaauuauguucgugacgucuuuguaucaggcucgg

SEQ ID NO: 2473 - RNA, 68 nt, Rabbit fibroma virus
uucaacuuauuagguugugacuccaauaccauuuuuaugguaccggaguccuccguaauauagucgaa

SEQ ID NO: 2474 - RNA, 115 nt, Barmah Forest virus
cuaggcagagccggcggguacauuuuuucgucagacacggguccaggccaccuacagcagagauccguuuuacaaaauugcacggcagaauguaucuacgaaccggcaaaacuag

SEQ ID NO: 2475 - RNA, 122 nt, Chimpanzee cytomegalovirus
cgaggacggcgaggcgucugcguguuaaacggcuguacgcggggugugaugugcuuuuaaaaaacuggcucuaaguagucuuucucugcuguccggucgccugcccgaccuugccgucuucg

SEQ ID NO: 2476 - RNA, 78 nt, Human herpesvirus 5
cgccgacaagaccucagcauggcucggaggcuauggaucuugagcuuacuagccgugaccuugacgguggcuuuggcg

SEQ ID NO: 2477 - RNA, 88 nt, Alcelaphine herpesvirus 1
gcuaauauuccaguaaauaaaacuuuuaugaacacuuguaauggcucuguaaauuuuucauuuacugcacuuaaauuugacuguuggu

SEQ ID NO: 2478 - RNA, 121 nt, Lumpy skin disease virus
ggcuucuacuuaauuggcuuccacuuauuagguuuaauuggcuucuacuuaauuggcuuccacuuauuagguuuaauuggcuucuacuuaauuggcuuccacuuauuagguuuaauuggcu

SEQ ID NO: 2479 - RNA, 113 nt, Indian citrus ringspot virus
ggccguucguauuauagcauugggacucgcuguuacugcccucaucuucacauccacaagggacacaucuagacacguaggagacccaucacauucucuaccuuucggcggcc

SEQ ID NO: 2480 - RNA, 123 nt, Vaccinia virus
gacgauaacuugauuucgaaauuacccauggagauacuuuauuacuccauuaaauaauuuaucauggagugauaauguccuguuucauuuguuuccaugacauauuacaaaaucgauuccguc

SEQ ID NO: 2481 - RNA, 60 nt, Equine herpesvirus 4
cggcgcuuugucuagcccucuuaguggguauuguuaccggcugggguuuuauuggcguug

SEQ ID NO: 2482 - RNA, 74 nt, Fowlpox virus
ggaauuuuucuauuuugauuuaugucuauccaguaacuacccuuaccguaucgcgacacgaaauuuagaguuuc

SEQ ID NO: 2483 - RNA, 131 nt, Strawberry mild yellow edge virus
cacacacuggugacaaccugcauucacugccauacggagggaaguauuccgacggaaccaaaagcauuugcuacucuggucccggaccuaccccugacauaccuacacaucugccugcguugcuaguuuug

SEQ ID NO: 2484 - RNA, 78 nt, Equine herpesvirus 4
ugaguguuguguguaccuauuuuccacugagggaggcgcguauucgcaugugggaaaaaaaggugggcauacaauuua

SEQ ID NO: 2485 - RNA, 95 nt, Swinepox virus
gguucuguuucuucuuccuuauauauuuuuuuauuauuacguauuauuacauaauuaucucuaaugaacauguauaguuccauaauaacagaucc

SEQ ID NO: 2486 - RNA, 60 nt, Bovine respiratory syncytial virus
aauguuuacaaucuaaaccucagaaucauaaaugugaugagcuaaauuuacuaauacauu

SEQ ID NO: 2487 - RNA, 131 nt, Human herpesvirus 6B
aaauuggccucuuuauauguuuuuugagaugcuuuccguuggcgcuuuuuugcgguuaaguugugugaaagaacgaaggacgguguugcuaaugcuuuaaucuccggaaaugcugugauauggcgcgauuu

SEQ ID NO: 2488 - RNA, 130 nt, Myxoma virus
uuccaccaaagauaauuauaauaauuuaccccaucauuaauuuacaaaaaguguuuacagcuagcuuaagugguagguagguauguagguauguagguauguagguauguagcuuaguaguuuaguguaa

SEQ ID NO: 2489 - RNA, 65 nt, Rat cytomegalovirus
cgcuguuuucgcggucccgcucgggcugucggcguccgugcgcggcgcgggcccgcguuccggcg

SEQ ID NO: 2490 - RNA, 117 nt, Gallid herpesvirus 2
uugguuggggaggaguucacaauauaaaagucagagucuggcggugaguuacuuuggucacgguuccguuaccggcgcgcauucgacaaauuauacggucauccacucugcgacuaa

SEQ ID NO: 2491 - RNA, 71 nt, Human herpesvirus 3
ggcguugccccgguucggugaucaccgggucuuaucuauauacaccguguaacucgaacccccgugacucc

SEQ ID NO: 2492 - RNA, 116 nt, Ateline herpesvirus 3
gcugcuuguggcuuuuaaccagucacuagucacgcccacacaugacgaggaaaaacuccugucagagauucaagaggugugucuuaagauugcagaagaacuaaagccucuccagc

SEQ ID NO: 2493 - RNA, 119 nt, Molluscum contagiosum virus
ggcacagucucgcgucaagaagggcccggagccccuccgagcgcacgccuguuaucccagcucucggggaagaggccggagggaggagaucuugagcccuggagcucgagaccuuggcc

SEQ ID NO: 2494 - RNA, 116 nt, Rice yellow stunt virus
ccucaugcggaacucgugccaaauuauaaucuugauguguguguaauauauauauuuauguauuuaucaauguuuuauauuguucauauuuuaaaaacccaacuccacauagaagg

SEQ ID NO: 2495 - RNA, 98 nt, Rice yellow stunt virus
accaccagauacauucuguaaauaguuugcugugguugcuuagggaauaggcauagaauacaaccaugguuauaagauagagcagguguaucuggggu

SEQ ID NO: 2496 - RNA, 93 nt, Myxoma virus
ccgcucgauagaucgcgucgaggaaguaccaaccgugaccacuccuccggcggggauccuccgcgacggguacaucgacgcgauucuacgcgg

SEQ ID NO: 2497 - RNA, 61 nt, Tupaia herpesvirus
gccggcgccgcgacgcgucggcgccagacgagcgggcgccggcgucgucgggcgaucgagc

SEQ ID NO: 2498 - RNA, 64 nt, Fowlpox virus
auagcuuagauaauauagauuuugauucacucauaaacauuauuaaauuagaaaauaagacuau

SEQ ID NO: 2499 - RNA, 80 nt, Equine herpesvirus 1
ucccucauaccgccucguguguccaguguguaaacuuccagguucuaguuuuggggauauauaaguggcugugaccugga

SEQ ID NO: 2500 - RNA, 86 nt, Cercopithecine herpesvirus 7
gugucguuuguugugggugggauuauauacuauuuaaggcacauuguaaaauacggacuuucauuucaccaaucaaccaaccacac

SEQ ID NO: 2501 - RNA, 64 nt, Bovine polyomavirus
ucucuccgcccagucuccgccuaagggaaaccagucccauccgcaggagucccucaggacaaga

SEQ ID NO: 2502 - RNA, 122 nt, Taura syndrome virus
uucagguguagacccgucauugugacgcguggguugaggugccaugaauuugucauucauggugcauuuaucucaacaguuuucccuaaccgcgcguugcgcggcaggguuuuuacucugag

SEQ ID NO: 2503 - RNA, 130 nt, African swine fever virus
ugacgcccucucuauucuuuauaugaugauuuaagauugaguccaacauuuuuccaacguuuuacaggaaaaagguauuuuuaacuauggaauuaaucuuaacccacuauuuagaaaaaaauaaaagaca

SEQ ID NO: 2504 - RNA, 60 nt, Human herpesvirus 1
cggccugggugggcggagggaacuaacccaacguauaaauccguccccguuccaaggccg

SEQ ID NO: 2505 - RNA, 63 nt, Human papillomavirus type 49
uggcuacuuggcaguuacaaguucaccucugccagaaguguguuuuugccaagacauuugcca

SEQ ID NO: 2506 - RNA, 130 nt, Equine herpesvirus 4
gguuuuaaaguuuauguauuauuguuucuauauauuaaaaauuguugaaauauaaauaucuuauguaauguuuacauuauucgugauugggacggucuuaggggagguggugcaacuaggguuuaaagcc

SEQ ID NO: 2507 - RNA, 62 nt, Rabbit fibroma virus
cuuaaugguucauucguucguauauucuuuuucgauuuuuuauucaacgcuaauaccuuaag

SEQ ID NO: 2508 - RNA, 124 nt, Rabbit fibroma virus
uucuuuuaugacggauaauguagcggccgauucagcguccaggucgauguccuuguuggucaacaaagucgacaacaagugcaugaaauuagacucguugauauccucgucgcucauuuaagaa

SEQ ID NO: 2509 - RNA, 81 nt, Rice yellow stunt virus
ggacccaccggaacggagggagcgacccggcaaaggccccaccacacagccgcacaacccgccccccuccggaagggaacc

SEQ ID NO: 2510 - RNA, 101 nt, Respiratory syncytial virus
aaucugaacuucaucgaaacucucaucuauaaaccaucucacuuacauuauuuaaguagauuccuaguuuauaguuauauaaaacaauugaauaccagauu

SEQ ID NO: 2511 - RNA, 81 nt, Human herpesvirus 3
uuugcuacagcuuauauaaauuuaugugcgauacaucuuaagugcauccguacguuauuuauacauugccugucacgugaa

SEQ ID NO: 2512 - RNA, 63 nt, Melanoplus sanguinipes entomopoxvirus
aauaaaaauuucauaaauucauauaaagauuuuguuuuuuuuucuuuuuauuaauuuuuuauu

SEQ ID NO: 2513 - RNA, 84 nt, Porcine epidemic diarrhea virus
uaccuucguccaauugguuaaucugugcuucacuugucaccgguuguguaauagcgcaguuuauacaccuauagggcgccugua

SEQ ID NO: 2514 - RNA, 65 nt, Plum pox virus
uccgcuuuaauagcaguacauucagugagguuuuaccuccauaugugcuagucuguuauugucga

SEQ ID NO: 2515 - RNA, 73 nt, Melanoplus sanguinipes entomopoxvirus
uauuuuuguuugaagaaagaaugccauaaugacguaaucaauaaaaugucauuauuuuuucaaaaauaaaaua

SEQ ID NO: 2516 - RNA, 84 nt, Rat cytomegalovirus
gugagcccggccggcggagccuccgacccuuuauagcguuugugacgcacccggaaaggagaaccgcggccgcuggguccucac

SEQ ID NO: 2517 - RNA, 86 nt, Porcine adenovirus A
cuucgccagggaagggauucacccggaguacuuuugcaucacccgcgagcacuuugaggccgagugcauccccgacucucugcaag

SEQ ID NO: 2518 - RNA, 65 nt, Amsacta moorei entomopoxvirus
uuauuuuuuuuuuuuuauuauauuguauuauuuaauacaauauaauaaaauauauuuaaaaauaa

SEQ ID NO: 2519 - RNA, 68 nt, Human herpesvirus 4
gguggccggcaaggugcaauguuuagugaguuaccugucuaacaucuccccuuuaaagccaaggcacc

SEQ ID NO: 2520 - RNA, 63 nt, Lettuce mosaic virus
cugagggcuuuucuaguuuccgcugugagguuuuaccucgaagguugcuagucugguuuucag

SEQ ID NO: 2521 - RNA, 75 nt, Sulfolobus virus SIRV-2
gcuuaauuuuuagauauaguugaauaauugcaaauaauguaguugcaguuguagaaacuacaguuaaaauuaagc

SEQ ID NO: 2522 - RNA, 72 nt, Turnip mosaic virus
ggaaauauguaaguuuguuaaagcagccagugugacuuugucauguguguuguuguuacuuucuguauuuuc

SEQ ID NO: 2523 - RNA, 131 nt, Bovine parvovirus
cucuuuccaccaucuuuuaguuguauucuuaguuaucaauaaaggcgcgaagcgccauaaaaaauuaugucauauggcgcuucgcgccuuuauugauaacuaagaauacaacuaaaagaugguggaaagag

SEQ ID NO: 2524 - RNA, 100 nt, Paramecium bursaria Chlorella virus 1
auuaaauuuuuaaacauuccuuaaaaucuauguaucuaaacgugacaguaaaucagucauccugacauauucuauuccauuuuguuuauaaaauuuuaau

SEQ ID NO: 2525 - RNA, 87 nt, Human adenovirus C
guggauaaauucgcaaggguaucauggcggacgaccgggguucgaaccccggauccggccguccgccgugauccaugcgguuaccgc

SEQ ID NO: 2526 - RNA, 60 nt, Human herpesvirus 6
cacacccaagaacaacgauauggaugaucacgacaacaauaauaucguuuuuucuuugug

SEQ ID NO: 2527 - RNA, 124 nt, Ictalurid herpesvirus 1
uuugaaaaagagggagggggugguaauuuauguguuuuuuaaggaaguggaagagacucucauauguauacacaaguucacuuuauuucagauacauuaucaacucaucaagcuuaaauucaaa

SEQ ID NO: 2528 - RNA, 80 nt, Zucchini yellow mosaic virus
aggaaugccguaguccugucggaagcuuuagugugagccucucacggauaagcucgagauuagacuccguuugcaagccu

SEQ ID NO: 2529 - RNA, 75 nt, Paramecium bursaria Chlorella virus 1
uugacuuugcauuucucuuaacuugugauuugauucuagaguacguuacagggucugugggaacugcuuuuucga

SEQ ID NO: 2530 - RNA, 76 nt, Fowl adenovirus D
gcaggugucaccgagguugucgcugucccaucuuaugugaaaaguggacgaauaacgagagggagacgagaucugc

SEQ ID NO: 2531 - RNA, 71 nt, Black queen cell virus
ccaacaaugugaucuugcuugcggaggcaaaauuugcacaguauaaaaucugcaaguagugcuauuguugg

SEQ ID NO: 2532 - RNA, 107 nt, Molluscum contagiosum virus
gcacgugccgugcugucucucgcccgacuuuucgcgccgcgggcacauggacggcgccuuugccacgccagcccgacuucucgcgcgacuggcacgcgccgcgcggc

SEQ ID NO: 2533 - RNA, 66 nt, Yam mosaic virus
ucuuuacuuuuaagaaugaaugagaugaggguggcccucaaaucucuuccucuuaucgugugaaga

SEQ ID NO: 2534 - RNA, 71 nt, Yam mosaic virus
cucaucuuuggugugauuaggugugguguaacuuuguuacguauccuuucacauuugauuaugagauagag

SEQ ID NO: 2535 - RNA, 63 nt, Scallion mosaic virus
gcguuauuggaguuaacgguuauggugagacuuugucucgaacacccuaacuuuugauaaugc

SEQ ID NO: 2536 - RNA, 69 nt, Camelpox virus
uagacgaccgguuuaucauuaauuaauacaaugucuaaauuccauaacauauuacaaaaucgccgucua

SEQ ID NO: 2537 - RNA, 90 nt, Chinese wheat mosaic virus
cugauacuuuggaacuguauacuaagccaaguuuaggcccguuaugcgauaaauccuagguugguggagaauacgguuucguuguugaag

SEQ ID NO: 2538 - RNA, 100 nt, Taura syndrome virus
uagcaccacccgaucguaaacuccauguauugguuacccaucugcaucgaaaacucuccgaacacuaggugcaguaaggcuuucauggagugguuugcua

SEQ ID NO: 2539 - RNA, 68 nt, Papaya ringspot virus
auuagaauacagaguggcugcgccaccgcuucuauuuuacagugaggguagcccuccgugcuuuuagu

SEQ ID NO: 2540 - RNA, 64 nt, Newcastle disease virus
guucugguagucugucaguucggagaguuaagaaaaaacuaccgguuguagaugaccaaaggac

SEQ ID NO: 2541 - RNA, 87 nt, Chimpanzee cytomegalovirus
gcuacuacgacgacuaagcccaagacgaacaacgugcgcgugcguaccgugcggcgacaggugacgauagcgugucgacguccaugc

SEQ ID NO: 2542 - RNA, 71 nt, Paramecium bursaria Chlorella virus 1
ggccauucaagucuauuuucccaagcacuacuaccacacccaacagcaguccuuuuagugcauuugcagcc

SEQ ID NO: 2543 - RNA, 106 nt, Human herpesvirus 5
cgacggucuuucuuuuccgcgugucgggugacguaguuuuccucuuguagcaacgugaggacgacuacuccguguggcucgacgguacgguggucaaaggcuguug

SEQ ID NO: 2544 - RNA, 88 nt, Ictalurid herpesvirus 1
uacuguaggaaaaaaaaggaugguugucgauguauugguucagacggcuuuccgucuauucaauuucaugacgaguuucuacgaggua

SEQ ID NO: 2545 - RNA, 61 nt, Rat cytomegalovirus
gugggcgcccuacgucggacuaugggaccucugacgcggucucgcugcgugaucgccccac

SEQ ID NO: 2546 - RNA, 122 nt, Periplaneta fuliginosa densovirus
uuggccauagcuucgcuauaccccaccacaaccaccaccaccacgaccggacacauggccuuuggccguguccaugguguggugguggugguuguggugggguauagcgaagcuauggccaa

SEQ ID NO: 2547 - RNA, 69 nt, Human herpesvirus 5
gagcggacacgguuaucguuccuggcggauauaaguauauaaacgcgaguuagccuuucccguccguuu

SEQ ID NO: 2548 - RNA, 80 nt, Equine herpesvirus 2
cuguugacagguagagaucccgggagguaaaggugcauaggcacaccugcgccugacucuccuuuucuaccugaccgcag

SEQ ID NO: 2549 - RNA, 85 nt, Sulfolobus virus SIRV-2
gauaauuuuucucacuuuccaaauauuaauucuaauuuuuaaugauuucuugaaauuaguauuauggaaagaaguuuugauuauc

SEQ ID NO: 2550 - RNA, 65 nt, Tobacco necrosis virus D
auaauuguucagcagaaugauccuuuaccccuuuuggggguuuggaucauagucaucauaauuau

SEQ ID NO: 2551 - RNA, 100 nt, Sulfolobus virus SIRV-2
uuucaccuaauuauuuaauuuuaucgauaauuuuucuccuuuuccaaauauuauuucuaaaaguugaaaauaugaauuugauauacuaaguguuaugaag

SEQ ID NO: 2552 - RNA, 63 nt, Human herpesvirus 5
ggcguccgcgugucuaaaccgcgugcucgcugacgcggguuugcuuccuauauaguggacguc

SEQ ID NO: 2553 - RNA, 77 nt, Sulfolobus virus SIRV-2
uuaaauuuuuaucacucuauauuuucaaccuuuagaaauaguaucugaaaaaugaaaaaaauuaaagauagaauuaa

SEQ ID NO: 2554 - RNA, 67 nt, Tupaia herpesvirus
aaucguucucacacguucgaauuaccgacacacaucugucggcuauaggacuugcugcacaacgguu

SEQ ID NO: 2555 - RNA, 66 nt, Human adenovirus F
ugcaucggugccguaaccuucgcugcuuuacuuaaaaagccugugauuucauuuaccaccccagca

SEQ ID NO: 2556 - RNA, 111 nt, Mice minute virus
uuuuagaacugaccaaccauguucacguaagugacgugaugacgcgcgcugcgcgcgcgccuucggacgucacacgucacuuacguuucacaugguuggucaguucuaaaa

SEQ ID NO: 2557 - RNA, 61 nt, Bovine adenovirus D
uggaucuuuacaaauagaaggaucuauuuuuguuacauuuucuuuccauuguaaagcuuca

SEQ ID NO: 2558 - RNA, 78 nt, Fowl adenovirus D
ggcauuaaaucguaucuaucggauuaccaaaaauuuagcaugucgccguuuuuuuaggucgauccgccgucggcugcc

SEQ ID NO: 2559 - RNA, 96 nt, Ateline herpesvirus 3
aggaguaaaguuguugcuucaagaauguuucauacaacugaagagugguucuguaguugcuauuuauguauucuaagaaaaguccaacccacuucu

SEQ ID NO: 2560 - RNA, 76 nt, Rat cytomegalovirus
ggcgagcggcgagggcgacacugcuggcgcgaggggacccgccgggcucccgcgguccgcccgguccccgcucccc

SEQ ID NO: 2561 - RNA, 89 nt, Meleagrid herpesvirus 1
gcaagaccgcgauggcguguguuccucccgagucucagaccaguuuuggguaggggucgggaggaauugccuuagucacggaucggggu

SEQ ID NO: 2562 - RNA, 72 nt, Melanoplus sanguinipes entomopoxvirus
uauaauauaauuuuaauuuuauauauuuaauaauuuuucaauauuauauaaauauacauuaaaaauauuaua

SEQ ID NO: 2563 - RNA, 66 nt, Paramecium bursaria Chlorella virus 1
gucaacauaacuauuuuguucaguuugaaaccaugauuagcuuuugaaauagauacugauguugau

SEQ ID NO: 2564 - RNA, 63 nt, Cowpox virus
aaaaucgauuccguccaagaugauaaaaacauuuaccggcaucauaaacacggaguuuauuuu

SEQ ID NO: 2565 - RNA, 68 nt, Bovine herpesvirus 1
cggggggaacaaugacgcaaaagggccccgggcgcugaguuaaauccggcgccuacucgcgccgcccg

SEQ ID NO: 2566 - RNA, 101 nt, Sheeppox virus
uuuauaauuagauuuaaauuggcuucaauuagacuuaaaagauugaaugaaaaaaguauccauuuacagguuuaauuggcuuuuuuauaauuagauuuaaa

SEQ ID NO: 2567 - RNA, 82 nt, Human herpesvirus 6B
uucgaagacauuaauacugguuuucuuucucguuaugacgaucaauauagaggacgcaaagagagaccaauuuagauucgag

SEQ ID NO: 2568 - RNA, 67 nt, Macaca mulatta rhadinovirus
gguuggauuguuuguguacauuuauuuucauuuuguguacauuuauuuucauuaaagcgaucugacc

SEQ ID NO: 2569 - RNA, 82 nt, Meleagrid herpesvirus 1
uacuguuaaaggcuccagggaaacugaauuagagccuagaguacguugacguuagaauggucuacuugggguuucuacagug

SEQ ID NO: 2570 - RNA, 84 nt, Swinepox virus
uagauauaacguauauauucauuauauuucccaucuaauaaauuaugggugggaaaucugaaugcgaguguucguuuuuuuuua

SEQ ID NO: 2571 - RNA, 94 nt, Molluscum contagiosum virus
uuugccccccccccgacgcgagaaagaccuugucagugggcguuacagcaccuugccucuucacgaucaagacauuucuccuccggggcgcaag

SEQ ID NO: 2572 - RNA, 96 nt, Equine herpesvirus 4
ggcuacuacuauaaggccuuuagcuucgaucuugguguauacuugcguguaggcgcgcuaacaaaaaaggggcagcagucuuuaaugucacgggcu

SEQ ID NO: 2573 - RNA, 68 nt, Paramecium bursaria Chlorella virus 1
auauaauauuucgucgauacgugauuucucguguuuuuucauauaaaaaaguauuaugaauauaauau

SEQ ID NO: 2574 - RNA, 80 nt, Human herpesvirus 6
ugaucucacgucacaguuuuuuuuuucauaugucucgcguugauacaucccguaugaaauauuuaaggugguugaaauca

SEQ ID NO: 2575 - RNA, 92 nt, Rice ragged stunt virus
acugucucuaugccgccuacuguugccuggugggaaagaacggggccuugaguaagccgcgcccauuggggucggggagugauagagaaggu

SEQ ID NO: 2576 - RNA, 73 nt, Bovine herpesvirus 1
gcgcccccccccccgcgcgcugugccgucugacggaaagcacccgcguguagggcugcauauaaauggagcgc

SEQ ID NO: 2577 - RNA, 100 nt, Paramecium bursaria Chlorella virus 1
guauuuucauacaauaauuuuuuaauguuuauaguuuauuucaaucgauuaucaguaucauugaaauauuaacuuaacaaaauauguauguauagaauac

SEQ ID NO: 2578 - RNA, 75 nt, Ovine adenovirus 7
ugacuuucuggaaauggauuucugcaaauagaaggaucuaucuuuacaacaucauuuuuccaauuuaauguguca

SEQ ID NO: 2579 - RNA, 70 nt, Sonchus yellow net virus
uauguaauauugugggacauguguugugugucauauaagaaaaaccaacagauuuaagugauuuuauaua

SEQ ID NO: 2580 - RNA, 102 nt, Chimpanzee cytomegalovirus
gccgccaacccgagcgccggagaaggaggagaaacaagaagaaucacucgagacacggcucagaacccagcgacucuuuauuccgcgucccucgcacccggc

SEQ ID NO: 2581 - RNA, 87 nt, Molluscum contagiosum virus
gcgcguauuuuuucuucacuguugucggcguccucuagcgagcgcacgaagauugccgcccaccgaccuguucgaaagagugcgcgc

SEQ ID NO: 2582 - RNA, 85 nt, Equine herpesvirus 4
uaaauuucugcgagagcacaccgcacccuuacgcuggcucggauagcuacgaauagcgcauggaauuguugcuggcagcuuuuua

SEQ ID NO: 2583 - RNA, 73 nt, Rat cytomegalovirus
gccgcucggggacugcgcgagacaaaagagaggggacgccggaggggugggagggcgcaaggaccccgcgcgc

SEQ ID NO: 2584 - RNA, 72 nt, Lettuce infectious yellows virus
gguaaaguuauacauuuaccguuggacaagguaagauuaccgacauccuaauagaauuguauaacuuuugcu

SEQ ID NO: 2585 - RNA, 93 nt, Human herpesvirus 5
gucaaaagaggccgccagcuagacaccccagaaaagaagcagagaaagagacuucuuugugcgacacguuuuauucugcguccuccgcucgac

SEQ ID NO: 2586 - RNA, 68 nt, Fowlpox virus
guuuaguguaauaaauuuaauaaaauauugacaaaauaguuaaaugaauauaugaaaguacauuauac

SEQ ID NO: 2587 - RNA, 72 nt, Rat cytomegalovirus
ggcggcgggucccucuugucucggagacggcgggucacggguauuucacgacgucucacgguacucgacgcc

SEQ ID NO: 2588 - RNA, 69 nt, Molluscum contagiosum virus
ggcggcaagcgagaucccuccgagacgucuggcucguacugcugcaggcaaagcggggcgcgcgccgcu

SEQ ID NO: 2589 - RNA, 66 nt, Murray Valley encephalitis virus
guucaucugcgugagcuuccgaucucaguauuguuuggaaggaucauugauuaacgcgguuugaac

SEQ ID NO: 2590 - RNA, 78 nt, Vaccinia virus
uuuggucgauguaaaauuuuugucgauaaaaauuaaaaaauaacuuaauuuauuauugaucucguguguacaaccgaa

SEQ ID NO: 2591 - RNA, 73 nt, Paramecium bursaria Chlorella virus 1
uuguauuuuucaagacguauuuuuuguuuuauuucuucuauugucauauuugaugcguauucaaaaaaaucaa

SEQ ID NO: 2592 - RNA, 78 nt, Melanoplus sanguinipes entomopoxvirus
uauuuuagcuauaucuuuuccuuuauaauauacuucaccaauaguaguauauaaaaggugaauuugauuguuauuaua

SEQ ID NO: 2593 - RNA, 69 nt, Parvovirus H1
uaauaugguagguuaacuguaaaaaauaauagaacuuuuggaauaaauauaguuaguugguuaauguua

SEQ ID NO: 2594 - RNA, 108 nt, Melanoplus sanguinipes entomopoxvirus
uuagcaccauauccaaaauaauuguacauuuaaauauaaaaauuuuaaguuuuuuaaaaaccaauaauucauguuuaaauauuaaacaauuucuuuucuuuuuucuaa

SEQ ID NO: 2595 - RNA, 90 nt, Human herpesvirus 8
auggcacgcgccgccagcaaauuuaaguccugguggcucaccugccagguaaacaagguuaaaguggguuugcuggccuugcguugccau

SEQ ID NO: 2596 - RNA, 70 nt, Rabbit fibroma virus
uauaauaauauacaauaaucuuuucuguguguaagauaacgcguuuaaguauauaaguauauaguuuaua

SEQ ID NO: 2597 - RNA, 82 nt, Melanoplus sanguinipes entomopoxvirus
aaaauaauuguacauuuaaauauaaaaauuuuaaguuuuuuaaaaaccaauaauucauguuuaaauauuaaacaauuucuuu

SEQ ID NO: 2598 - RNA, 97 nt, Melanoplus sanguinipes entomopoxvirus
uuaaucauaucauaauuaaguaauuuuucuuuaucuagaaguaaauucaauuuauauuuagcaauacaaauucuauuugaaauuaucauauuauuaa

SEQ ID NO: 2599 - RNA, 89 nt, Mouse parvovirus 1
uggguaaaaggguggaagggugguugguugguauucccuuagacuugauguuaaggaccaaaaaaacaauaaaaucuuuuuaaaaccua

SEQ ID NO: 2600 - RNA, 73 nt, Lactate dehydrogenase-elevating virus
gugcccuucucgccuucauuuucuucugcugucgagcaguuaggaauuguaugagcuggagauauaagugcac

SEQ ID NO: 2601 - RNA, 84 nt, Rhopalosiphum padi virus
uagcuugccuuaagcagucuuuauaucuucuguauauuauuuuaaaguuuauaggagcaaaguucgcuuuacucgcaauagcua

SEQ ID NO: 2602 - RNA, 73 nt, Zaire Ebola virus
gugugacuuggauuggaaauguggagaaaaaaucgggacccauuucuagguuguucacaauccaaguacagac

SEQ ID NO: 2603 - RNA, 64 nt, Human herpesvirus 8
gucaaccagggcacccucccccaccgagugcuuuaaugcggagaggaaugguggccugguugac

SEQ ID NO: 2604 - RNA, 72 nt, West Nile virus
gcugcgaggugauccacguaagcccucagaaccgucucggaaggaggaccccacgugcuuuagccucaaagc

SEQ ID NO: 2605 - RNA, 79 nt, West Nile virus
ggaucuucugcucugcacaaccagccacacggcacagugcgccgacauagguggcugguggugcuagaacacaggaucu

SEQ ID NO: 2606 - RNA, 76 nt, Human herpesvirus 5
uugugacguagcaauuaucguauugugcaugugucguucaucacagaguuuaguauacuaauaugaagcgucgcga

SEQ ID NO: 2607 - RNA, 131 nt, Human herpesvirus 1
ucuucccccccaucaccccgcaauuugcacccagccuuuaacuacauuaaauuggguucgauuggcaauguugucucccgguugauuuuuggguggguggggaguggguggguggggaguggguggguggg

SEQ ID NO: 2608 - RNA, 72 nt, Zaire Ebola virus
gaaagaucauaacuaauaacauuacaaauaauccuacuauaaucaauacggugauucaaauguuaaucuuuc

SEQ ID NO: 2609 - RNA, 96 nt, Zaire Ebola virus
gcccuucuaauuaagaaaaaaucggcgaugaagauuaagccgacagugagcguaaucuucaucucucuuagauuauuuguuuuccagaguaggggu

SEQ ID NO: 2610 - RNA, 105 nt, Human herpesvirus 8
uuguuuuugaacauguggcacacgcugcaauguacugccaugaaaggugguucuauauccaccacuuggcgucugccgaagucagugccacaauuucauuaacaa

SEQ ID NO: 2611 - RNA, 70 nt, Camelpox virus
uuccugguugguauugcgcuaccgauucuucacagacugaagacugucgagauuguguaccaaaaaggag

SEQ ID NO: 2612 - RNA, 87 nt, Equine herpesvirus 2
uggcagagccuuguuucguuguacaugcugggugaaucgcucaugcaagucuugagcucuaugauauaacacaaucuggucucucca

SEQ ID NO: 2613 - RNA, 75 nt, Equine herpesvirus 4
guuuauacuacacugcaggcguaugcacagcgauaaagguguauguugugaacuuaaaagcagcugaguauaaac

SEQ ID NO: 2614 - RNA, 130 nt, Nipah virus
aauaacuguauuucucacucuugcucuuaguuagucauugugucuaauaauuauuauuacaguacaagguauuaugaauucaaagauacgcaauaaaucugauaucagcauagaguagaaaauuguuguu

SEQ ID NO: 2615 - RNA, 125 nt, Sheeppox virus
uagaaaauuuauuuauuagcucguuuagugcuaaaucaucaucaacaacuucauuguuuucaucuuuuuucuuuuuuaugaugauugauaacaacgauauagaagcuaauauuacagaaggucua

SEQ ID NO: 2616 - RNA, 89 nt, Sheeppox virus
ucauuaaauucaguuuuauaaucuuuuuuuauuaccucacagcauucgcguaucauuauuaaaauuuccaacucauuauuauuuaauga

SEQ ID NO: 2617 - RNA, 62 nt, Gallid herpesvirus 3
gcucgcccuuuuuuguaacagauggcgauggaacagagguuccuaugugggggggggggggc

SEQ ID NO: 2618 - RNA, 86 nt, Gallid herpesvirus 3
cgaacugcuuccauuuuuucccuuacggugccugacgucguauuuuaacgguuagaugccgucagggaaagaugggaguuuguuug

SEQ ID NO: 2619 - RNA, 79 nt, Amsacta moorei entomopoxvirus
ugcaauaaaaauuaaauuauggaauaaccuuaauaguaaauagauauuauuuuuuuaguucaguauauuaggucucgca

SEQ ID NO: 2620 - RNA, 102 nt, Melanoplus sanguinipes entomopoxvirus
guuaugaaaauuuuaauauuucuucauuacaguauauaccuaaaucuauuaaaauauuagauuguagugauacuaauauagaagauuuuaaauuuuuagaac

SEQ ID NO: 2621 - RNA, 85 nt, Langat virus
gcgguucuuguucucccugagccaccaucaccuagacacagauagucugaaaaggaggugaugcgugucucggaaaaacacccgc

SEQ ID NO: 2622 - RNA, 94 nt, Ateline herpesvirus 3
caagucaauaaaacacuauuauguucacccugaaucaaucacucuguugcauuuauaacaaaaaaguaauaauguuuauguaaauauagacuug

SEQ ID NO: 2623 - RNA, 89 nt, Molluscum contagiosum virus
gguugguacucccgcgcgccgggggagaagugcgcgcgcggcaacaacgccuugcgccgcgcgcgcaaccgcggccgucgagaacaacc

SEQ ID NO: 2624 - RNA, 88 nt, Mosquito cell fusing agent
cguaaaugugaaaaaguauggggaaagaacucaucuuaaccucccaccguuagggaguuuugauuaucuuuucuauaccauagaugcg

SEQ ID NO: 2625 - RNA, 87 nt, Monkeypox virus
gcugccauguauuuccuggagagcaaguagaugaugaggaaccagauaguuuauauccauacuugcacuuaaagucuacauuguagu

SEQ ID NO: 2626 - RNA, 60 nt, Meleagrid herpesvirus 1
ucagacugaggggcccuuagguuuauaugaaauauauucuucgcggguuuaacaguuugg

SEQ ID NO: 2627 - RNA, 63 nt, Ateline herpesvirus 3
cuguauacaagacaaaccaaaaauacaauaaacgcgauauuuaaacauuuuauuuguguacag

SEQ ID NO: 2628 - RNA, 65 nt, Tupaia herpesvirus
gccgagcacgccgccgcgaucggagacccagaucugcagggccgaguccguggacggcggccggc

SEQ ID NO: 2629 - RNA, 81 nt, Tupaia herpesvirus
cgggucgccccucgacgacgccgucgccgacccgauccaaaaucguaaauacugcgcgaccgccucgucguuccccacccg

SEQ ID NO: 2630 - RNA, 117 nt, Paramecium bursaria Chlorella virus 1
gaguacuuauuaagaaugacaaauaacaaaugacaaaugacaaaugacaaaugacgauucuaaaagucuauauaagcauuauuugccaauuguuuuucacuaaaauuuaaagcucuc

SEQ ID NO: 2631 - RNA, 83 nt, Himetobi P virus
uuuguaguuuuaagauugagguuuuuugacgcuagcccuauaguagguaagcuuuuuccucauaaauauuucuuuggcacaga

SEQ ID NO: 2632 - RNA, 82 nt, Amsacta moorei entomopoxvirus
uguuaaaauaucaaauguuacaauaguuuuuuuguuaucuucuuuuauuaauaaagccauauuguguauauuaauuuuaaca

SEQ ID NO: 2633 - RNA, 131 nt, Bovine herpesvirus 1
ggcgucgucgucgggccgggugcgucgccguucgggccggacggucggugucucgcguuucuaaaagagggcucgcacuccggcgccguguucgcacugagaccggcauuuuauguucgccggccccaccc

SEQ ID NO: 2634 - RNA, 94 nt, Gallid herpesvirus 3
gaguuggcuacaccgagauccggcaucauaccuuacgugaacugcuuacguuuggggauguuuuugcgucgguguuuggggaggagucaaucuu

SEQ ID NO: 2635 - RNA, 87 nt, Equine herpesvirus 4
gcuguggguuauauguuugcgauuuuccacaaagaacaauaauaacucuucuggucggagaguuauaagcauaccgugccccaaagu

SEQ ID NO: 2636 - RNA, 64 nt, Variola virus
uugcauauuauauuuuauauuuuauauuuuauauuuuguaauaagaauagaaugcuaaugucaa

SEQ ID NO: 2637 - RNA, 74 nt, Equine herpesvirus 1
gucggagaguuauaaacauaccaugcaccaaagggucaguuuuaagggguuuuacuuuaugugaauucaccgac

SEQ ID NO: 2638 - RNA, 61 nt, Monkeypox virus
gacuuuuaucacguuaucucauguauaaaauauuacaaauaguauagcauaaacuaaaguc

SEQ ID NO: 2639 - RNA, 131 nt, Sulfolobus virus SIRV-2
uuuauuuuuuucuuuuuaauuuuaauuuauuaauuuucuuuuucuauauuuagcuaauucuaucaauaauuuuucucaauuucuaaauauuauuucuaaaaguuaaaaaaucagagagauaaaaagauaga

SEQ ID NO: 2640 - RNA, 93 nt, Cowpea mottle virus
uguugaucgcauauugcuauuucugcucaacccaaaguguuagcuacguugucucucacucagaaccuguaguaaauaguaaaguuguuuaca

SEQ ID NO: 2641 - RNA, 79 nt, African swine fever virus
aucaauuuuuaguuuuaaauauauugguaccuaggacaaagaaaguauauauagccaauaauuauuccacuaaauugau

SEQ ID NO: 2642 - RNA, 71 nt, Rat cytomegalovirus
uuacguaauaaugaccggauguaauucgaacaaaucauaaaacaccgaucccguuccgaaaauauacguga

SEQ ID NO: 2643 - RNA, 70 nt, Patchouli mild mosaic virus
uacuacucuuaaaacacauguguauuguguuagguuaaagcauccuuuauauguauaagcuuuaguagua

SEQ ID NO: 2644 - RNA, 71 nt, Molluscum contagiosum virus
ucggaacgcgugaggaggcggcacugcuagcgacgcggacacauugcgaggcaccgcccgcccgcgcucga

SEQ ID NO: 2645 - RNA, 90 nt, Chimpanzee cytomegalovirus
gcgagccgcgucguucgcggacgcggcgguggguccggccacagagcgacacgcggcccacgcuguucguccgcgcucgucgcaguccgc

SEQ ID NO: 2646 - RNA, 60 nt, Rat cytomegalovirus
ccucuuucgauuucuacacgagaaaaguuauaaaauacaucaguuagacgaucauugagg

SEQ ID NO: 2647 - RNA, 63 nt, Human herpesvirus 5
uuugagccccaagcgguacggacuacauauuuuccauaaaucuacacugaacuugagcacaaa

SEQ ID NO: 2648 - RNA, 97 nt, Sonchus yellow net virus
gaaagcacacgauacacauguauccaguaugcuauaugauuaacauaauuauaaaauuaugaugauaaaugggguauagggauuguucugagcuuuu

SEQ ID NO: 2649 - RNA, 64 nt, Porcine reproductive and respiratory syndrome virus
gaggcaucucaguguuugaauuggaagaauguguggugaauggcacugauugacauugugccuc

SEQ ID NO: 2650 - RNA, 65 nt, Lymphocystis disease virus 1
uauguuauaaaacaguguagcguugaauuuuaaaaaaauccaacauuauacuguuuuauaauaua

SEQ ID NO: 2651 - RNA, 72 nt, Chimpanzee cytomegalovirus
ccguggcguaaauauaggacauagaucgguacagauacaccgucaccugaucacccccuauacuaucuaugg

SEQ ID NO: 2652 - RNA, 65 nt, Human herpesvirus 1
acacuuucccgcgugucgcgugugguucaugugugugccuggcgcccccacccucggguucgugu

SEQ ID NO: 2653 - RNA, 131 nt, Human adenovirus C
ugcgugugugguuaacgccuuuguuugcugaaugaguugauguaaguuuaauaaagggugagauaauguuuaacuugcauggcguguuaaauggggcggggcuuaaaggguauauaaugcgccgugggcua

SEQ ID NO: 2654 - RNA, 107 nt, Sulfolobus virus SIRV-1
uaaagcuuucucuaucuuuuuaucucuuuaauuuuucaaccuucugaauuaauaucauaaacuugagaaaaauuauugauaaaauuagauaauuuauggaaaauuua

SEQ ID NO: 2655 - RNA, 130 nt, Porcine reproductive and respiratory syndrome virus
auucuugaggcaucucaguguuugaauuggaagaauguguggugaauggcacugauugacauugugccucuaagucaccuauucaauuagggcgaccgugugggggugagauuuaauuggcgagaaccau

SEQ ID NO: 2656 - RNA, 92 nt, Tupaia herpesvirus
ggcgcacaugaggaauauaauauagcaacagucggcucgggccgacgacgggcgcucgcucggcgucgacucggagccggccgauucucguc

SEQ ID NO: 2657 - RNA, 60 nt, Human herpesvirus 7
ggugucugaaagcucgccaaggucucgcguaaaagaacagaugugaacuucagauguacc

SEQ ID NO: 2658 - RNA, 106 nt, Rice grassy stunt virus
ucuuaaguauuaacuuuaaauauaauuauaaagauuguguauucuucaacgacagaggaguucucuaucuacuuuauaacaguuuuauuaaaguuuguucuugcga

SEQ ID NO: 2659 - RNA, 66 nt, Simian-Human immunodeficiency virus
gucuaggggaaggacauggggcagggggauggagaccaggaccuccuccuccucccccuccaggac

SEQ ID NO: 2660 - RNA, 96 nt, Strawberry mild yellow edge virus
cgagugcucacccccgaggagcucgccgcacccaucuccgcagcuaguaacaagguugccacucgcgagcagauucucggcauuguagcggacuug

SEQ ID NO: 2661 - RNA, 61 nt, Human herpesvirus 3
cacccacaaaggaguuuguaaaauaaaaucucuguuuagaccuuaaaauuuguugugugug

SEQ ID NO: 2662 - RNA, 120 nt, Equine rhinovirus 3
uaccccagauuuacccguuacccuaaaauucccuccccuuucucuucacucgccgaggccacgccgaguaggaccgaggguacagcgagucuuuuaguuuaagguguuagauguaaggua

SEQ ID NO: 2663 - RNA, 98 nt, Paramecium bursaria Chlorella virus 1
ccgucgucacagcuggaaggacaccguuaaucuggagcguugaaauagucuucagagcuuccaguuguucguaaauguauguguagcgcugacgcagg

SEQ ID NO: 2664 - RNA, 79 nt, Human herpesvirus 1
gugaguuuguggacccaaagcccucagagacaacgcgacaggccaguauggaccgugauacuuuuauuuauuaacucac

SEQ ID NO: 2665 - RNA, 74 nt, Human herpesvirus 5
ugacguggauacuaguaaaaaaagugcgucaaagcucuuagcgugugacguggauacuaguaaaagggacguca

SEQ ID NO: 2666 - RNA, 75 nt, Macaca mulatta rhadinovirus
gccguagggcuggcagggacggcacccagcagcuauuuucaucucuagcgccgccuacuagcggaaaucugcggu

SEQ ID NO: 2667 - RNA, 74 nt, Pea seed-borne mosaic virus
uucuaggguucuauuaucaucaauuccauagugagucuuugacuucgguuugguggcaguagggcuuucuggag

SEQ ID NO: 2668 - RNA, 96 nt, African swine fever virus
uguuaucaaauguacuguuuaauacgcaaauggauuuacuacguuuuaauuguaugucuucaugugcaggcucuaguggauaguaauuuucucaca

SEQ ID NO: 2669 - RNA, 62 nt, Infectious spleen and kidney necrosis virus
cuaugcauacuaugugccccgcgauggcggcugucguccuguagcagaguacguucgcaugg

SEQ ID NO: 2670 - RNA, 93 nt, Variola virus
uaauacuugacugacuuaaaacuugauaauuaauaauauaauucguuuuuauaugugacuauuuuaacgucuaaauguauuaguuaaauauua

SEQ ID NO: 2671 - RNA, 70 nt, Murid herpesvirus 4
uagccucccacuuuuauggaaaucugguagcuccuccuacaugagucaugaaaugucccuucaaaggcug

SEQ ID NO: 2672 - RNA, 90 nt, Trichomonas vaginalis virus 3
cgucuaggccacguacagucuauuguccucggacccucugccuauagguuaauaggaauacaguguuacuguuguguguaucgcucuagg

SEQ ID NO: 2673 - RNA, 76 nt, Satellite virus of maize white line mosaic virus
ucugaacacuuucuugaaaguugcggcugaccaccguacaggaauucucucgcacuagucggguuugaagcgcggg

SEQ ID NO: 2674 - RNA, 66 nt, Infectious spleen and kidney necrosis virus
guaguggauguccuggaccaucguggcuacggcugcguaguggaugucauggaccaucguggcuac

SEQ ID NO: 2675 - RNA, 103 nt, Trichomonas vaginalis virus 3
ggcgacaggaagucuguccaaccucauuacccuuuccaaagcaagucggcuaccauaccguaagcugagggaaggcgugagagcgucagacuacaccgucgcc

SEQ ID NO: 2676 - RNA, 89 nt, Cowpox virus
uuuuuuuaaugguguuguggaugaggaaugaggaaugagagugucuuaucuagucauugguuuauuacauggaucaucagagggagaaa

SEQ ID NO: 2677 - RNA, 71 nt, Lumpy skin disease virus
uguguuguuuuuaaaaaaagaaaaaaaaaggcauuauuuuuucuuuuuuuuucuuuuuuuuuaaaaauaua

SEQ ID NO: 2678 - RNA, 88 nt, Amsacta moorei entomopoxvirus
uuauaauuuauuuaucuaauauuaaaauauauauaguuuaauuaaucauuaauaauguauguauuuuaauauguaauauuauuuauaa

SEQ ID NO: 2679 - RNA, 113 nt, Human herpesvirus 1
guuuguaucgcaucuuuccuguguguaguuguuuauguuggaugccugugggucuaucacacccgccccuccaucccacaaacacaaaacacacggguuggaugaaaacacgc

SEQ ID NO: 2680 - RNA, 76 nt, African swine fever virus
uuggauaaauuagguugacauuaguaacagaaaguauucaauauuauguagaccuauaaaaaaugagacccuccaa

SEQ ID NO: 2681 - RNA, 73 nt, Planococcus citri densovirus
gcgaguggucguugacguugugguuguuuuacgaaguaaaauauauagcuaucaaguacaguucuacuuuugc

SEQ ID NO: 2682 - RNA, 62 nt, Alcelaphine herpesvirus 1
cuuuuuuuuugugaggcuuuguauaaauuguuuuuuauauaaaauuguaaauaaaaaaacag

SEQ ID NO: 2683 - RNA, 63 nt, Sulfolobus virus SIRV-2
uagcuacugaagauaaagaagaaguaagaaaaucugaaguauuucaaaaagcuuuagaaguug

SEQ ID NO: 2684 - RNA, 107 nt, Phocoena spinipinnis papillomavirus
ggcgccuacgcacuuuguauauaagacugauuguaaauacuagguggaguaacuaggaaaaacucuaacaaaaagguguugugcuguuuauuaaaguguacggagcc

SEQ ID NO: 2685 - RNA, 114 nt, Sulfolobus virus SIRV-1
ccuguuucaccuaucucuaaaaaucaaaaauucuaugacauuuuuauaucuuuauuuuuuggaauaaguaggauuaauauuuggaauuugagaaaaauuaucgauagaauuagg

SEQ ID NO: 2686 - RNA, 70 nt, Camelpox virus
uuuuuauaaauuuuuaugaguauuuuuacaaaaauguauaaaguguaugucuuauguauauuuauaaaaa

SEQ ID NO: 2687 - RNA, 78 nt, Ictalurid herpesvirus 1
agugcgguggcgauuguauguauccucuuauuucgggaauggacccgaguguaagccgguucgaggcgccacuaaacu

SEQ ID NO: 2688 - RNA, 69 nt, Lymphocystis disease virus 1
ccuuuaaaauugaugcauuauaagaucguguaguaaauccacuauccuguaaugcauuaauuuuaaagg

SEQ ID NO: 2689 - RNA, 64 nt, Cherry mottle leaf virus
agcuuuuaugugugugaagaagugauguuuaggguaaggucugucuuuuugcauuggauuugcu

SEQ ID NO: 2690 - RNA, 73 nt, Little cherry virus
gagaguugaaaccuucgcuacucaaguuaguaagaaacuacuagaauucaugcacaauuugguugcaacucuu

SEQ ID NO: 2691 - RNA, 75 nt, Human herpesvirus 3
ucugugggggagugggguguuguggauauuagaggguagagggugcugguuugaacgucuccauuaacccacggg

SEQ ID NO: 2692 - RNA, 93 nt, Human herpesvirus 5
ggcuccgaagguccgcugcucggcuccgcucaccgcuccggucuggcugcagcagugcuucgcugagaaguagcguguggacugaacgguguu

SEQ ID NO: 2693 - RNA, 88 nt, Sida golden mosaic virus
ucugucugucgcgaaacguacagcucuaauuacauuguuuaaggagauaaugccuaauugaucuaaguacauguugaccaaacgcaga

SEQ ID NO: 2694 - RNA, 60 nt, Porcine epidemic diarrhea virus
gaaauuuuguccuuccuuccggccgcauguucaugcugcuggaagcuggcguggaauuuc

SEQ ID NO: 2695 - RNA, 79 nt, Molluscum contagiosum virus
ggagcacgugaacagacccaguggcguuugccgugacaagacacuguccuuccuccggcgaaaagccgcucgcgucuuc

SEQ ID NO: 2696 - RNA, 65 nt, Cowpox virus
gauauuuacuuuuuauaugcuugcauuacagaaugauauucacagguauuauuaaaaugaguauc

SEQ ID NO: 2697 - RNA, 64 nt, Bovine herpesvirus 4
gccaggccuccugaaaauguucuuugcccgggaugguuauucugugcuuauauaggaaggccgc

SEQ ID NO: 2698 - RNA, 65 nt, Bovine herpesvirus 4
agagagggguugcaacaacaggucaucauuccaaggauaugacacucacacaaccuggaaucucu

SEQ ID NO: 2699 - RNA, 77 nt, Human coronavirus 229E
caacuaaacgaaauuuuugcuauggccggcaucuuugaugcuggagucguaguguaauugaaauuucauuuggguug

SEQ ID NO: 2700 - RNA, 130 nt, Molluscum contagiosum virus
cggcguucucgaugcccuaucuuuccucgugcgcgcucggaaauggcgggcaguugcgugcuuccaaccuccggcggcgaagcccgcuugccuccucggagcacgugaacagacccaguggcguuugccg

SEQ ID NO: 2701 - RNA, 66 nt, Cowpox virus
uauaaucaaugauacguguauuagaauacuuuccgaauaagucuucuaaauauuguauuaauuaug

SEQ ID NO: 2702 - RNA, 62 nt, Red clover mottle virus
gaagaauagcguguggagcgauccuugguguuaauucaccuugaggagcacguuauaucuuu

SEQ ID NO: 2703 - RNA, 111 nt, Paramecium bursaria Chlorella virus 1
cgugcugcugcaaaagcgaaggguagagacgcucuugugaaggcguuagauagggcaauuauugaaaaacgcaaaagacuuggggggucggcucaacguucgcaaagcgcg

SEQ ID NO: 2704 - RNA, 122 nt, Melanoplus sanguinipes entomopoxvirus
auuuaaguauuaauuguccuaaucgugaaugcauaucucuuaaaaaaauauauaaaucauauauauuauuuucauaaucauuuucagguauaauuuuauguaauuuuucaauuaaacuaaau

SEQ ID NO: 2705 - RNA, 68 nt, Bovine coronavirus
ucagaauggaugucuugcugcuauaauagauagagaagguuauagcagacuauagauuaauuaguuga

SEQ ID NO: 2706 - RNA, 130 nt, Aedes albopictus densovirus
caugauauagaaaagaaauauuauuucgugauacggauacuccaagauacaguuacuauuaguaacgaucugucagaucuguaucuuggaguauccguaucacgaaauaauauuucuuuucuauaucaug

SEQ ID NO: 2707 - RNA, 64 nt, Helminthosporium victoriae virus 190S
aagggugguguugguuggcgagggggggcuucggccuuccguugacccaacugauaucacacuu

SEQ ID NO: 2708 - RNA, 131 nt, Amsacta moorei entomopoxvirus
auauaauaauauuuauugaugauugauauuauuagaauauauuauaauaaauggauaaaauuauauggauaauaauuuuauuuauuauaauaauauuuaugauauuauuaaaaauuauagauguguuaugu

SEQ ID NO: 2709 - RNA, 62 nt, Paramecium bursaria Chlorella virus 1
gucgugaacguugcugcuuauaccguggguaaucucacuacaucauccaauguaucgacgac

SEQ ID NO: 2710 - RNA, 72 nt, Cowpox virus
ucuagacgauauaguggaacaaaauauagcggaugaaaaauuuguagauuuuguuauacacggucuacuaga

SEQ ID NO: 2711 - RNA, 63 nt, Human papillomavirus type 13
guccggcuggugguggaguguacaggaccugacauucacgaccuacacgaccuacugcugggc

SEQ ID NO: 2712 - RNA, 82 nt, Fowl adenovirus D
ccuuuccgcgaaucuugcgagaugccugcugguuucuauggugaaggggccgcuagggcuauugaguaggguuugguagagg

SEQ ID NO: 2713 - RNA, 104 nt, Fowl adenovirus D
cuccguaucgagcgaauugcuccggaucccugagacgccauucuccuucggugaaaaugagccucuuuuggagcugguaggcgaguucgcccggauuuucgggg

SEQ ID NO: 2714 - RNA, 84 nt, Equine herpesvirus 1
acgacgagaccccuauuaaauaaaaugacuguaaacgcauauaaacguaucagguguuuuauuuuuucuauaguagugcguggu

SEQ ID NO: 2715 - RNA, 74 nt, Molluscum contagiosum virus
gcagauguuaucgcaguugcgcaccugccauugcacgacaggucuccaguacaacagccguagauucauacugc

SEQ ID NO: 2716 - RNA, 77 nt, Murine adenovirus A
uuguuuggcuuuguuccaacuguuuuuggcccgaguuggguuucguuuucccggguuucacguggugcgucagguga

SEQ ID NO: 2717 - RNA, 63 nt, Human papillomavirus type 12
ccugugaggucaaccuucguauuuuugucaacgcaacugauacuggcauuaggacccuacagg

SEQ ID NO: 2718 - RNA, 65 nt, Paramecium bursaria Chlorella virus 1
caccaaagucaaccgcggguuuuaaaaaauacauuaagacugagacggugaagacugagacggug

SEQ ID NO: 2719 - RNA, 91 nt, Common chimpanzee papillomavirus 1
ggacauuguguuacaccugaguccugacccuguaggucuacauugcaaugagcaauuagacagcucagaagaugagguggacgaacaagcc

SEQ ID NO: 2720 - RNA, 80 nt, Human papillomavirus type 14
cucugacuaagcaaauaugagccgcgcccgauacauaaaggugccaaaugaggugaguuguuugccagaagaggucagag

SEQ ID NO: 2721 - RNA, 65 nt, Human papillomavirus type 47
cagauuguuuaacuuuuacacaguauucaaggaaugucuguuuacugugacuaaguguaacucug

SEQ ID NO: 2722 - RNA, 79 nt, Cercopithecine herpesvirus 7
acguuacauaauuccucuuuauauaugacauaggaggggccauaauagccccuccuaugucauauagcauuaaaaacgu

SEQ ID NO: 2723 - RNA, 81 nt, Paramecium bursaria Chlorella virus 1
cuucaauaguuuuuguaucaaauagcgaaaauauuuuuuuucucaaaaaguuuuuugacugguuagcguaaacuauuuuag

SEQ ID NO: 2724 - RNA, 65 nt, Pepper mottle virus
ucucucagaaaacgagagugacuucuagacacacucuaggaggugaucguaguuggcaugagaga

SEQ ID NO: 2725 - RNA, 92 nt, Murid herpesvirus 4
gcacccugaagaugguuugaaugcucugcaguaugucaagaauuuggaacuugcucuucggcgucugcagucagacagucucaaacaugggc

SEQ ID NO: 2726 - RNA, 77 nt, Tupaia herpesvirus
ggguguguguguggggguggugggcggccgcgggcgcggaggguccggcccguccccgacuccucuguacuagacuc

SEQ ID NO: 2727 - RNA, 130 nt, Red clover mottle virus
gguauaguugcauauuuauuuuauguucauuuucuuucuugcuugaguguguuauuucaauagcuccuguuuagcaggucgaaccuucagcaaguucacaaaaagauuuuccuuuuguguguuucuuuuc

SEQ ID NO: 2728 - RNA, 75 nt, Cowpox virus
gcuuguucaaauuuuauaaagaaucauauucauuaggcauauaauaaaaaauauaauuuauaauacacuuacagc

SEQ ID NO: 2729 - RNA, 60 nt, Cowpox virus
uaguucuuaacaucuauuaaucauuuauucgcuuauugcuuuaauuguuuuuguaaacua

SEQ ID NO: 2730 - RNA, 70 nt, Human papillomavirus type 86
cguccacuuaagcugguggugcguuguggagcugaagaccuaaggcagcuacagcagcuuaugguggacg

SEQ ID NO: 2731 - RNA, 96 nt, Ovine pulmonary adenocarcinoma virus
ggggaccguccguucucucccugugcaggugcgacucuuguuugugcuggucgcggcagguggcgcccaacguggggcucgagcucgacaguuuuc

SEQ ID NO: 2732 - RNA, 114 nt, Human papillomavirus type 6
uguaacaaguguaacaaacacaacuguaaugaugauuauguaacuaugcauuaugauacugcuggugauuauauauauaugaauuagaguaaaacuuuuuuuauauuuguaaca

SEQ ID NO: 2733 - RNA, 61 nt, Cocksfoot streak virus
cucacucugauaugugcaccgugugugauuuuaucacgaaggcuggacauauguuugugag

SEQ ID NO: 2734 - RNA, 102 nt, Monkeypox virus
uuuuuauaaacaugaaaccacugucuaaauguaauuaugaucuugauuuauagaugaugaucagccuucagaggauuuugaccagcauguuuaauaugaaaa

SEQ ID NO: 2735 - RNA, 78 nt, Swinepox virus
auauguacacauauuuuaauuauaucuguuuuacuuggauuuaauaacaauacugaauuaaaacaugauuguauauau

SEQ ID NO: 2736 - RNA, 87 nt, Human papillomavirus type 6
gguuugugguuguuaugugccuuuauuguagggguguugggguuauuauuaaugcacuauagagcuguacaaggcgauaaacacacc

SEQ ID NO: 2737 - RNA, 60 nt, Canine oral papillomavirus
gagcgaccguuauugguuuggagugacgcccggacauuccugacaagaccggauucguuc

SEQ ID NO: 2738 - RNA, 73 nt, Human herpesvirus 8
uuccguaauaucuguuuuauauagugaggguucacgcaugcgcgagucccgacuaaugaggacaauuacugaa

SEQ ID NO: 2739 - RNA, 81 nt, Human herpesvirus 8
gucuauuucccacgacauacuuccgcggaaaaauacccacgcuccuuaauuuccgugggaagacgaugggggaaauguggc

SEQ ID NO: 2740 - RNA, 62 nt, Paramecium bursaria Chlorella virus 1
acaaguuauggaaauaaagaaacucgcauguuuuaguuuuagucuauuucucauucucuugu

SEQ ID NO: 2741 - RNA, 88 nt, Reston Ebola virus
gcauugagcacugcuaauagguuuguaucacguuaaagauuuagaguguaugaauugugcagauuuaaacuuggguuuugccuuaugc

SEQ ID NO: 2742 - RNA, 63 nt, Rabbit fibroma virus
caacgagcuagacuuuguuauggagaaacucuaaaaaaaauuguuaauuaaaguaaauaguug

SEQ ID NO: 2743 - RNA, 108 nt, Amsacta moorei entomopoxvirus
uuuacauuuauuaaauuaacauuauguuuaauacaaaaucuaucaugacaauuauuuacauguggacaguauuuauuuuuuauauaaaauaauuuauuaugaugugga

SEQ ID NO: 2744 - RNA, 91 nt, Paramecium bursaria Chlorella virus 1
gcccaucgaacgcucuucgggauuauaauuucaaugucauccucuacaucuugaaaccguaguagccguuguagagucgcgcgauaauggc

SEQ ID NO: 2745 - RNA, 66 nt, Paramecium bursaria Chlorella virus 1
ggaagucaaguauuuauacacguugagugucauuuacaugugucauuuaagugugucauuugaccc

SEQ ID NO: 2746 - RNA, 115 nt, Cowpox virus
uguugauacuugauauugauaauuaguauaauuaguauaauuaguauaauuaguauaauuacuauguauuauauuucauuauuaugaggauuuaugucauaucaugaaauuaaua

SEQ ID NO: 2747 - RNA, 91 nt, Human adenovirus D
gauggacggccaggccuccgagcagcgcauccugcaacugcgcguccgucagcagcaggagcgugccgccaaggagcuccucgaugccauc

SEQ ID NO: 2748 - RNA, 70 nt, Fowlpox virus
uauauaauaccuuuacaccacgcaacuacauauauugcuuuguauauguuguaugaaagguaauuacgua

SEQ ID NO: 2749 - RNA, 67 nt, Rabbit fibroma virus
cacacaugcuuccguaugucguaucuuguuuaacuuuuuaaguaugaucgacaauagagccagugug

SEQ ID NO: 2750 - RNA, 62 nt, Human herpesvirus 2
caccggaacccaccagaggcggaagccgccuucgcccgugagggugcguguguuuucuggug

SEQ ID NO: 2751 - RNA, 60 nt, Human papillomavirus type 57
gcuggggccauauauaugugcaggacauuaacgaugauaccuggcauaaggugcccgggc

SEQ ID NO: 2752 - RNA, 61 nt, Common chimpanzee papillomavirus 1
gccacauuggaccacagguggugccaccauuacagguaucacagacuaagggacaugaggc

SEQ ID NO: 2753 - RNA, 71 nt, Simian foamy virus
cucuaccucuggacuucaggaccugcagacucuuagugagcuuguuggcccugaaaaugccggagagggag

SEQ ID NO: 2754 - RNA, 66 nt, African swine fever virus
uuauuauauacacagcauacauaaguguauauuauuuacacuuauguuuauaacucgacguaauaa

SEQ ID NO: 2755 - RNA, 77 nt, Common chimpanzee papillomavirus 1
uuauguguauaacacagaaaaggaaauauggcuaaagguaaaaggcaugguagacuauaaaggguuguacuauauga

SEQ ID NO: 2756 - RNA, 71 nt, Rabbit fibroma virus
gggauacuguucgcuuuuuucuuucgugucuguuuaucuuauagaucgugccgaggaaguagcaguauuuc

SEQ ID NO: 2757 - RNA, 66 nt, Jembrana disease virus
agaucuagguuauuugaugacacccgcaggaacacauacaacaggagaauuaaaugaauuagaucu

SEQ ID NO: 2758 - RNA, 93 nt, Tobacco streak virus
cguuagcccaaagagugaagucuauucccuuuauugagucucugaguuuucccagcgauauucaaaggaugcagcuucgugcucuaggugacg

SEQ ID NO: 2759 - RNA, 63 nt, Human papillomavirus type 83
ugaaauggacuauguaagcugggggcacauauauguauauacggaggaaacaaggacauggca

SEQ ID NO: 2760 - RNA, 76 nt, Fowl adenovirus A
gaccgccuauuagguguggcuucgggcuccgccuagugggaggagacaggaaaaccacgccuagugacgcuggguc

SEQ ID NO: 2761 - RNA, 107 nt, Rauscher murine leukemia virus
aaacagcuaacguugggccaaacaggauaucugcggugagcaguuucggccccggcccggggccaagaacagaugguccccagauauggcccaacccucagcaguuu

SEQ ID NO: 2762 - RNA, 68 nt, Sheeppox virus
auguuguuuuacgauauaauacaacuauaaaauauggagaucuuguaacauauauaacaguacaacau

SEQ ID NO: 2763 - RNA, 114 nt, Human papillomavirus type 48
ccuuucauuguaaauguaugguuugauaaugaugaaagaaauucuuuuccuuauaccuguugggauuuuauauauuaucaagaugaccaaaacaaauggcacaagacugaaggg

SEQ ID NO: 2764 - RNA, 62 nt, Paramecium bursaria Chlorella virus 1
gggaaauuuguucaacgcauuuuucaauuucacgcaauuggaaucgucacgcagaugcucuc

SEQ ID NO: 2765 - RNA, 130 nt, Reston Ebola virus
uugauuugaacauagucauaaggggauaaauaauacuuuauauuucugauuguggauugacccauucugcuuaaaaugcuucgcccauugaaaaugugaucuaauagauagcccugacuagacaaauuaa

SEQ ID NO: 2766 - RNA, 70 nt, Equine herpesvirus 2
uccagaaagcucuccagaccauuuuacuguuuauacacaaacaguauacaagucauuuuaugaaucugga

SEQ ID NO: 2767 - RNA, 61 nt, Fusarium poae virus 1
uaugcuacuauugauguacaauuugacacacgcuucauuaugaacuacauccuguaccaug

SEQ ID NO: 2768 - RNA, 64 nt, Human herpesvirus 1
ggccgucugguucgaggauaugacccccgccgagcuggagguugucuucccgacuacggacgcc

SEQ ID NO: 2769 - RNA, 102 nt, Cowpea severe mosaic virus
ucuaaacaguuggcguuaacgcuuaugcauacauucagauuuuaugugcuuuauugcauguacgaauguacagcauuugcuguuguaacgggcuaguuuaga

SEQ ID NO: 2770 - RNA, 131 nt, Goose parvovirus
acgugacuuccggucaugugacuuccggugacguguuuccggcuuaacuauugggcugaccgcgcgcaugcgcguggucaaccuaacagccggaaacacgucaccggaagucacaugaccggaagucacgu

SEQ ID NO: 2771 - RNA, 60 nt, Human herpesvirus 5
gcuuuucgucucuccaaggaacacuggguccgcugaaagggaccguguaccgaccaaagc

SEQ ID NO: 2772 - RNA, 95 nt, Camelpox virus
augucuauccaguauaugcgaguaagucuuaucuugucauugguuuacauugaucagagucagauacaauaucuguauaaguacccuuccgacau

SEQ ID NO: 2773 - RNA, 130 nt, Human herpesvirus 5
cagcuucgagguauaaccuacaacacggaggggaaggggggguacaaaacgugaaauuagacuuuuuuuuuaaugauguuuugucccucugucuuacuuucccauaggcuguaaggcccucgaggaagag

SEQ ID NO: 2774 - RNA, 86 nt, Aura virus
guugaaaauaacuuuauagaauuuuaaaauuuucuuuauuaaaaucuuuuguuuuucuuuuauuauuucaaaauuuuguuuuuaau

SEQ ID NO: 2775 - RNA, 61 nt, Alcelaphine herpesvirus 1
agccacucuuuuaaaaauugccaaccuuuauugguggccaaauaugagaaaggaugugguu

SEQ ID NO: 2776 - RNA, 65 nt, Saimiriine herpesvirus 2
ucugguauacacccgucucgugguacgaaguagagcgcggcaccaccggacggaugcaguccaga

SEQ ID NO: 2777 - RNA, 104 nt, Murine adenovirus A
cguagucuuaaaaauuugauaacuaccauucaugcuauauguaucauuauaaucugacauauagacuucauuaauuauuuuuucaaauucauucuuaauacacg

SEQ ID NO: 2778 - RNA, 62 nt, Infectious hypodermal and hematopoietic necrosis virus
auuaguauuuaauauuuauuuauuuuuuuacaacuaaaaucaacaauuauauuaaugcuaau

SEQ ID NO: 2779 - RNA, 90 nt, Infectious hypodermal and hematopoietic necrosis virus
gguuucagccgaggcaauguuuacauaguccuggugcuuaauuuccauuuuaaugcuuguauacuguuugacugucuccagcuuuucacc

SEQ ID NO: 2780 - RNA, 82 nt, Infectious hypodermal and hematopoietic necrosis virus
ggguaauaacuuucccaaucggguugugcucguagaugauuugacuugucaacgggcccccuuauugugacggugcuuaccc

SEQ ID NO: 2781 - RNA, 99 nt, Murine adenovirus A
aauaccucaaugucuucuaugggcgucgaauucguaugcguauaaucgguauacacgugcgcaugauuuccagauaaaaagaucuuuguacuagguauu

SEQ ID NO: 2782 - RNA, 92 nt, Infectious hypodermal and hematopoietic necrosis virus
cccacaucacacaucaggaaguugaaaccaaugacgaugguggcacaaugccaaccgguugguacuuaccuacuguguaucucaaguguggg

SEQ ID NO: 2783 - RNA, 74 nt, Infectious hypodermal and hematopoietic necrosis virus
uaauuaucaugucaaggaugucauagacauugucaucgucauagacacugucaucgucauugacauugucauua

SEQ ID NO: 2784 - RNA, 131 nt, Yaba-like disease virus
auuauguccuguuugguguccaaaauggagacucuccccccagagcuuggcuaccgcgagauaucccuagaggaugucggacuccguaguuuugaguuucuagagguggagauugagaauaggggcaaagu

SEQ ID NO: 2785 - RNA, 74 nt, Yaba-like disease virus
ucuggcauuuucccaaauuuuuugccauguuuuuuguacaacaguuguuuaaaaauggcuugggaauugcuugg

SEQ ID NO: 2786 - RNA, 64 nt, Yaba-like disease virus
ggacagguuugacaucauagacacuucugaugaagaagaugaaaaugagacagaccguguaacc

SEQ ID NO: 2787 - RNA, 85 nt, Infectious hypodermal and hematopoietic necrosis virus
caauaucaauauugguauaaaauauauaaaacauaaacuagacuuuuauaguauguaaauauaucauauaucaaaacauuuauug

SEQ ID NO: 2788 - RNA, 80 nt, Infectious hypodermal and hematopoietic necrosis virus
auaucagauauaaaaacauuaauuggguauuagauauugauauuuuugauacauuauugauauuuugugauaucagauau

SEQ ID NO: 2789 - RNA, 62 nt, Infectious hypodermal and hematopoietic necrosis virus
cuauguuuauugucauggcgacaguguugauacacuuuguuucccgugacucuuaaaauuag

SEQ ID NO: 2790 - RNA, 95 nt, Infectious hypodermal and hematopoietic necrosis virus
ggaagcaaugauuuuuacauaguguuccugcaaauuuuaauaccucuucaaguucacuuuguuggauaguaucgcaggaacucgguguuguuucu

SEQ ID NO: 2791 - RNA, 61 nt, Infectious hypodermal and hematopoietic necrosis virus
gauuauuauauucaucucgcaccacgaagugauucuuuaagguuucgagagaauauuuauc

SEQ ID NO: 2792 - RNA, 71 nt, Yaba-like disease virus
cgucuccucugggcuaccucauuuugaccccguuuaugggguuguuaagaagugugagccuauggggggcg

SEQ ID NO: 2793 - RNA, 93 nt, Yaba-like disease virus
agguuaacccaucuuggauccaucuccugccuacuucuccugcgauaaauaagguugaaguaggacaggaaucggccauuuugggcaguaccu

SEQ ID NO: 2794 - RNA, 74 nt, Yaba-like disease virus
ggaaauccaaauuugucuuugucaaaggaguucacggaauaaaauucuguuacagcuuuaaaaggacaauuucc

SEQ ID NO: 2795 - RNA, 98 nt, Molluscum contagiosum virus
ggugucuuauauguauccacuaauugauguaccagauauguuuuuagacgcaguucguccaauuuuucaucgucagacgugggcauauacaaguuacc

SEQ ID NO: 2796 - RNA, 69 nt, Molluscum contagiosum virus
aaacacaaucccgacucggaauauauauaugauaauaaauugguaaaucccaguucggguauuuuguuu

SEQ ID NO: 2797 - RNA, 80 nt, Bovine herpesvirus 1
ucuucgucugaggagcuauugcuagugggugugcacugacggugcuuccgcguggcauccguuugcugcuugacggguga

SEQ ID NO: 2798 - RNA, 69 nt, Bovine herpesvirus 1
aaacacaaucccgacucggaauauauauacgauaauaaauugguaaaucccaguucgggaauuuuguuu

SEQ ID NO: 2799 - RNA, 79 nt, Yaba-like disease virus
auguuauguccggacaacauucuuggaagacuagggauuucacauuuucuuuuaaucuauguuguccguggucaaucau

SEQ ID NO: 2800 - RNA, 60 nt, Yaba-like disease virus
ccaggguggaugguauuuguugacaaauacaucuauuguugauggggcuaugccaccugg

SEQ ID NO: 2801 - RNA, 103 nt, Ateline herpesvirus 3
cuagggaaaacauaagaauaggaagaaaccgagguuugggagaaaagcugagauaaaauagcgcauuuuccauacagagguuguuguuuuuguggauccuaag

SEQ ID NO: 2802 - RNA, 74 nt, Yaba-like disease virus
ucugcucugguugagcgcgucauucgcgacauaccuuuauaaguaugugagaacucggcugcucccagaggaga

SEQ ID NO: 2803 - RNA, 67 nt, Yaba-like disease virus
agguaaugauaaaacuauuggucuagauauguaaucaaaucuuacacgaucuaaauuaucccauccu

SEQ ID NO: 2804 - RNA, 115 nt, Yaba-like disease virus
cauagaaguucaaguaaaccccucauggauuagccucuuagguggcucucucaagauaaacggagaugacgccucuaaugagucugcuguguugggaagcuuuuauucuucugug

SEQ ID NO: 2805 - RNA, 65 nt, Yaba-like disease virus
uaugacuaaucuagauauguuaauuagauaugacuaaucuagauauguuaauuagauuagucaua

SEQ ID NO: 2806 - RNA, 66 nt, Cucumber green mottle mosaic virus
aacaaagaaauggaaaucguaauaccaguuauguuuaacuuugaaauuguuuuuuauuuucuuguu

SEQ ID NO: 2807 - RNA, 67 nt, Nudaurelia capensis beta virus
ugaguuguuaaaucuuuacagguguuuagauuuuucagauaaaacaacuagagaaaaguauaacuca

SEQ ID NO: 2808 - RNA, 104 nt, Yaba-like disease virus
gugagagugaaguguaaugaccacgugaaacagaaauaaguuuaacuuuuuuauuauuuuuuuaagguuuguuuuuuuuguauguaugguuagucuucaccugc

SEQ ID NO: 2809 - RNA, 64 nt, Yaba-like disease virus
guguauuauuauaaaguccauaucggaguuacuuuucucuagguauuuuuuauaacuuauacac

SEQ ID NO: 2810 - RNA, 63 nt, Nudaurelia capensis beta virus
ccuccccucccucucccucguccuggucggaaaagucugaggaggagaaggagaauggggagg

SEQ ID NO: 2811 - RNA, 71 nt, Nudaurelia capensis beta virus
ucccggcacacauccuggaugcccuccacgacgcucuuuagcgucuggagguccguggaguaguggcgggg

SEQ ID NO: 2812 - RNA, 130 nt, Yaba-like disease virus
ucccacaaucucauugguccagagcccucucagccgcgcucugauuggucgagagcuagcuggcccucucgaccaaccauaggccagggauuuugauugacagcuccgccggccaaugagaacgcaggga

SEQ ID NO: 2813 - RNA, 83 nt, Saimiriine herpesvirus 2
gaucuagauucuauuguuaaaaggaaaaauguaucgauaauaaaccauuuuuacagaguucagcaucgguggaaucuuaaauc

SEQ ID NO: 2814 - RNA, 86 nt, Saimiriine herpesvirus 2
guccgccgucuagguaaguuuagagcucaggucgagaccgggccuuuguccggcgcucccuuggagccuaccuagacucagccggc

SEQ ID NO: 2815 - RNA, 60 nt, Ateline herpesvirus 3
gaugcaggauuaccauuaaucuuaggaaacaacuuccuaaagcuauauaauccguucauc

SEQ ID NO: 2816 - RNA, 107 nt, Ateline herpesvirus 3
ucuugcucgacgugccgcgucuggagaacuauuuucuuugucaagucugucuuuacgagcuggacgaggacgagaugggcgaggagaugcugggcauguuggccgga

SEQ ID NO: 2817 - RNA, 71 nt, Ateline herpesvirus 3
uagccuugcauauauugaugauauaauuguuuuuacuaagggaacaaaagauuaucaucuuaagcagguug

SEQ ID NO: 2818 - RNA, 67 nt, Ateline herpesvirus 3
ucugcgaccccgccauaaucguccuggacaacuacaccaaguggcucuccucggcuaacggccucgu

SEQ ID NO: 2819 - RNA, 65 nt, Human herpesvirus 5
ggcguucaggccuuaauacuagccgcaucuuaccugucggcagcauguaucggggcuccgacgcc

SEQ ID NO: 2820 - RNA, 72 nt, Human herpesvirus 5
cgccgaaaaaugcuugucuggcugagguuggugucgcuaaugccacuuuuuugucucgcuucaaugucggug

SEQ ID NO: 2821 - RNA, 86 nt, Tupaia herpesvirus
uuuuuccucuguuuuugcuugacguucaaauuuugggucgucuuuaaccugcucuugacuuaaauaagcuucuacggucagaaaaa

SEQ ID NO: 2822 - RNA, 68 nt, Variola virus
uccccgugggcuccacgcguuuuccacccuuuccuggagggguccggaacaccgugaauccacgggga

SEQ ID NO: 2823 - RNA, 131 nt, Variola virus
agucuggccgagcggcgccaucuuggaggaggggcgagucgcgggcaccgccucgguacccccuggccgaggcgaguccgcggucgccgccuguuccgugaugcuaccuagagggcgcugucgaggcgacu

SEQ ID NO: 2824 - RNA, 80 nt, Gallid herpesvirus 3
uacuguuuuauugguaguuuauguaucgacgcuuucccaaaauggaucuggauguaucuaugcuaccuugguggacagua

SEQ ID NO: 2825 - RNA, 64 nt, Gallid herpesvirus 3
gcuucacacguuucuaccaagcccaagauucgaucgguaguaggaacccgcaauugugugacgu

SEQ ID NO: 2826 - RNA, 63 nt, Gallid herpesvirus 3
agcuuguuauuggcucccggcccaguugauggagcugccauguugggagaaacaaagcaaguu

SEQ ID NO: 2827 - RNA, 87 nt, Chimpanzee cytomegalovirus
guucaggcggcggggcucgacgacggaccggacgguacaguuguaccggagccgauagucguaguaacuagacccgaccgugaggac

SEQ ID NO: 2828 - RNA, 63 nt, Chimpanzee cytomegalovirus
cccgucgcguuggguugcagccgcaagcggacgcuggggggagcgguggccagagcgagcggg

SEQ ID NO: 2829 - RNA, 61 nt, Chimpanzee cytomegalovirus
gggcgccgccacccccgaccgggggagcggucgucgcucgccgggcgggggggaagcgccc

SEQ ID NO: 2830 - RNA, 131 nt, Molluscum contagiosum virus
uucagggccccacaaauuucauauuuccagcagccuuuccaccccccgugagucuuccccacagaaacugcauagaacuaacuugugacacagaaagguguuugaaaccaggugauguuaugaaacugaag

SEQ ID NO: 2831 - RNA, 104 nt, Aichi virus
gaaaaggaggagaacacggauaaaguuagcgcucagaauaucucauucaaauccaugaauaaacuauaugggcgauauucugccguguuuaaagauuccuuuuu

SEQ ID NO: 2832 - RNA, 104 nt, Aichi virus
gggaugaaaccucuacugcccuaggaaugccaggcagguaccccaccuccgggugggaucugagccugggcuaauugucuacggguaguuucauuuccaauccu

SEQ ID NO: 2833 - RNA, 66 nt, Human papillomavirus type 7
cauguuugucagcauauuugcauugcauguuucaaauugcuaggucaaaguucccugccaaaaaug

SEQ ID NO: 2834 - RNA, 60 nt, Human papillomavirus type 7
ccaaacuugcuuuuaggcacauaguuuuacugcauaaacauuuagcuaauagcaguuugg

SEQ ID NO: 2835 - RNA, 70 nt, Human herpesvirus 8
gccacagaggucucugcuaguuugggccagcgaaacgggcuaucccgguccgguggaggcagucugucgc

SEQ ID NO: 2836 - RNA, 69 nt, Aichi virus
guauauagaugucaaugaagaguacacagaagcagcugcagcaacuucuguacuaguggcagauugugc

SEQ ID NO: 2837 - RNA, 127 nt, Avian carcinoma virus
caguguuucaaaaguagcauaaacacuauccauuccaagucuguagaguaacaaguguuucagguauaaaugcugcacuggguugauauuggacugggguaaaaaauauagugaauuuugagaccug

SEQ ID NO: 2838 - RNA, 129 nt, Bean leafroll virus
gacuugggucuugcaacgcuacacucuggcaaucauccaacagaaauuugucuaaagagcucuagaggaaagauuuuguauaauauggcaugcgcuagagauguuuuuuuauuaugcaaggacccaguu

SEQ ID NO: 2839 - RNA, 81 nt, Bean leafroll virus
uuauuguuggaaaaauuuuagcccaaaacauugacauagcgucguuguuuuacacaauguuagaauguguugaaaaaauga

SEQ ID NO: 2840 - RNA, 68 nt, Bean leafroll virus
aaccaaucucaaaaguuacuugugcuaaguauuucaaagauacagaagacuuuuuucaugagcugguu

SEQ ID NO: 2841 - RNA, 65 nt, Reston Ebola virus
cgggucucggccacgguggcgaccaggggcaccucccggaccucgccggagugggcgacgacccg

SEQ ID NO: 2842 - RNA, 82 nt, Reston Ebola virus
gccgcggcgcuccaugaggagccagagcccgccggggaaggcggccccgugccgcuccuccuccuccuggaggcgccgccgc

SEQ ID NO: 2843 - RNA, 76 nt, African swine fever virus
cgccguggacagguuuagcgcuuuuucucgccgcgccgucacuucgcggucuuaucacgcuuuagaccacagggcg

SEQ ID NO: 2844 - RNA, 77 nt, Parvovirus H1
auacgaaacauugucggcucaaaaacucccacagauguccaucgacgucgauggaacuguuuggcaaugcuuugugu

SEQ ID NO: 2845 - RNA, 95 nt, Human papillomavirus type 44
gucuguacaaaaguuugagauuuucagauucugcggcuauagagaaguauaauucuuugguagaauggggaacaucuacuuacuggaaaauaggc

SEQ ID NO: 2846 - RNA, 75 nt, Camelpox virus
gagacguccauaucugauuauuaugaugagguaaaaaauaaaccguuuaauauugauccgggguauuauauuuuc

SEQ ID NO: 2847 - RNA, 61 nt, Paramecium bursaria Chlorella virus 1
cacgaaacucuuaauguuucuccuuaggauuucugccagaguuuguccuuagaguuuugug

SEQ ID NO: 2848 - RNA, 94 nt, Paramecium bursaria Chlorella virus 1
gcaagcgcauuauauguuuuugauaucuuaaugauauacaaaguuugcaagcgcauuauauguuuucaagauguugaugauguauaaaaguugc

SEQ ID NO: 2849 - RNA, 66 nt, Camelpox virus
ggaagacacauuauuugacgacgaauuauacucuauuauagaacgaucuuucgaugauaaauuucc

SEQ ID NO: 2850 - RNA, 77 nt, Saimiriine herpesvirus 2
cugcagauccgaaguauucggaguauagggcucaacugauguauuauuucagacaccuuccuucaaguacucugcag

SEQ ID NO: 2851 - RNA, 69 nt, Ryegrass mottle virus
gccgucaggaucaaggaucggagacccccaacagggacucgcuccgccccagaccgcccgaccgacggc

SEQ ID NO: 2852 - RNA, 60 nt, Bovine adenovirus D
gccagguuuccauugccacccgggcgaaaacaagccggguaguuucaggggucaucuggc

SEQ ID NO: 2853 - RNA, 77 nt, Tupaia herpesvirus
ggagcaagccauuuuaaaaucuccguuacaguugaaugguccaagucuauucgaagugcagauuuuccgcuuucucu

SEQ ID NO: 2854 - RNA, 90 nt, Melanoplus sanguinipes entomopoxvirus
cgauauaguacgcgccugccgggagaaacauccccugaaccgcgggggugaccguauacuauguuuccuagagccgugcguaccaugucg

SEQ ID NO: 2855 - RNA, 77 nt, Meleagrid herpesvirus 1
cgguuacuaucaauauuauucaucuagugauuaugaaaauuauaaugaauauuauuaugaugauuaugauagaacug

SEQ ID NO: 2856 - RNA, 101 nt, Meleagrid herpesvirus 1
uauuacuaacauaaagauaauacguaaacuacuuaaucuuagcagacaugcuccacauaaucuauuuagagaucgagucaugcacgauuauauaaguaaua

SEQ ID NO: 2857 - RNA, 64 nt, Meleagrid herpesvirus 1
acgaagaucuugaggcuggguagcugacaggcuucgguccggaaggugcccagcaggaucucgu

SEQ ID NO: 2858 - RNA, 61 nt, Meleagrid herpesvirus 1
uggucaagauguaccccgaaaucaugagagauaauggucccuuugauguggggauauacca

SEQ ID NO: 2859 - RNA, 66 nt, Murid herpesvirus 4
gggcccuaaggaggauagcugugccgguggucucuacacuguucccacccgccgcuccccuagccc

SEQ ID NO: 2860 - RNA, 65 nt, Murid herpesvirus 4
ccuggccauggccgcuucagaguucaaagagacccccgaacucgagagcgccgucagagccaugg

SEQ ID NO: 2861 - RNA, 60 nt, Meleagrid herpesvirus 1
gcauucugucuuuaagggauuuucugacaaaguuagaaaaaaugauuuagacaugaaugu

SEQ ID NO: 2862 - RNA, 84 nt, Meleagrid herpesvirus 1
guugaauggucaucgaauaaguuuuggaaaauagacacucauaagguuaucgaugccgaaacuucuaucagugauuauuacaau

SEQ ID NO: 2863 - RNA, 62 nt, Meleagrid herpesvirus 1
gaguuuagaucugaauugauacuguccaaucaggaucuaguacaauauguuuaucuaagcuu

SEQ ID NO: 2864 - RNA, 130 nt, Meleagrid herpesvirus 1
ggaauguuuggaauauccaaaggcggauuuucuaacauuaguuaauaauaugucauuugauguaaaaaaugguauuguuuuaaauuuuaaguuagaaaauauaaauuguuuagauaauccaaauauaucu

SEQ ID NO: 2865 - RNA, 65 nt, Meleagrid herpesvirus 1
gcacaguaucaaggaucaacucuguuuaucuagacaugaauacuucaaucccaggcuacccgugu

SEQ ID NO: 2866 - RNA, 68 nt, Meleagrid herpesvirus 1
guugccgcucugauacuccuccgggaugagccacauggucucguugcgguagcuguccuggugguaac

SEQ ID NO: 2867 - RNA, 61 nt, Murid herpesvirus 4
acacuguucucagcuaauaucgaugccaucacaagccucagcaucgggggagaacucgugu

SEQ ID NO: 2868 - RNA, 72 nt, Murid herpesvirus 4
ugggagccuagcagugacgauccacgguggcaacuauccaggggcccuccgucccgucacacuaguagccua

SEQ ID NO: 2869 - RNA, 72 nt, Macaca mulatta rhadinovirus
ccacacccccaggaucuuccucuaaggcccccaccaaaccuggugaggaagcaucugguccuaagagugugg

SEQ ID NO: 2870 - RNA, 60 nt, Macaca mulatta rhadinovirus
ugguuuagagcuaaauuugugaacucuuuaagaaaacuuuacaaaaucagcucaucucca

SEQ ID NO: 2871 - RNA, 91 nt, Macaca mulatta rhadinovirus
accugaaaauuggauugauaacaaagaguuaaaguucuguuacuguacaaaaaaacuaggauuuagaauuaucacuccuuugccugcaggu

SEQ ID NO: 2872 - RNA, 67 nt, Meleagrid herpesvirus 1
cagcuccuucugauagguaaacacgucgaacguguaaggcacgauguuggccuuguagaugagcaug

SEQ ID NO: 2873 - RNA, 92 nt, Murid herpesvirus 4
ggcgacacuugggugcacagguggccguaggugucacgugaccuuuuccgccggcaccuuuaagcugccgcgauguacccccggggaucgcc

SEQ ID NO: 2874 - RNA, 108 nt, Murid herpesvirus 4
uugugauuccaaccagcgagauaacccagccaaucacauccaucaaacuggagauaguaaccuccaaaagugguggucaggcgggggaucagaugucauggucagcaa

SEQ ID NO: 2875 - RNA, 82 nt, Murid herpesvirus 4
ccguggucccaauagauggugucugggacgacagcauuaugcuguccaaagaccccauaccuccuauugugggaagcagcgg

SEQ ID NO: 2876 - RNA, 61 nt, Murid herpesvirus 4
gccaccccaagccuucauagacgaagucgccaaagucuaugaagucaaccaugggcguggc

SEQ ID NO: 2877 - RNA, 90 nt, Murid herpesvirus 4
agccaaaacccaauguuccaacacagagacccccuggucgguugggccgcuggaucagggcugucucugaugaggaccuugagugaggcu

SEQ ID NO: 2878 - RNA, 78 nt, Macaca mulatta rhadinovirus
gaagauuuaaaugguuuauuagaccuugcugcuauugauucaacauucaauguagauaaucuaaaagacugugucuuc

SEQ ID NO: 2879 - RNA, 76 nt, Bhendi yellow vein mosaic virus satellite DNA beta
guaaugauaucuccauacuaguagguccacccaacugggaaggucuacuaucagucaaaggagcucauuucauuac

SEQ ID NO: 2880 - RNA, 62 nt, Bhendi yellow vein mosaic virus satellite DNA beta
ccacaaacagagcaaacucgaugaaggccgcuaccgccucaucaugucuguuuccuuggugg

SEQ ID NO: 2881 - RNA, 65 nt, Melanoplus sanguinipes entomopoxvirus
gacguccccgugguuaccgugacaagcuccacgcuagucacagcggacaacuacaggggggcguc

SEQ ID NO: 2882 - RNA, 61 nt, Murid herpesvirus 4
gcgagacagaucagcauuuggcagccuaaacggagacugcacagaaucgagaucguuuugc

SEQ ID NO: 2883 - RNA, 70 nt, Murid herpesvirus 4
uaguaugguuuagagcuaaguuuguuaacgcccuaaggaagcuuuacaagauuaguucaucaccauauug

SEQ ID NO: 2884 - RNA, 60 nt, Murid herpesvirus 4
aacugggagaaguuuguaguacaucagaccaucuaaaaagggccccagacuuuaucaguu

SEQ ID NO: 2885 - RNA, 60 nt, Murid herpesvirus 4
ggguucccuccacauugugggcaaccguuguaggcguuggccaaccaugcaggggaaugu

SEQ ID NO: 2886 - RNA, 74 nt, Murid herpesvirus 4
uucuaacacaugugugggcaacagauauccucaugccaaugcaacaggacuggcacaugcucacggauacagaa

SEQ ID NO: 2887 - RNA, 62 nt, Murid herpesvirus 4
gggucugcaaaacccucugagaauacacagcauuaaaauucucguucuuccucaaaugaccc

SEQ ID NO: 2888 - RNA, 122 nt, Murid herpesvirus 4
uuugagaauaauguacugguguacaaagugcugagacgggagagucccucaaccgugaaaauguguguuugugggacuucucauuaugcaaagccuuugacacuggcaauuauuucuucaga

SEQ ID NO: 2889 - RNA, 126 nt, Tupaia herpesvirus
gcacuaguagcauuuaaccccuggcacuaguagcauuuaaccccuggcacuaguagcauuuaaccccuggcacuaguagcauuuaaccccuggcacuaguagcauuuaaccccuggcacuaguagc

SEQ ID NO: 2890 - RNA, 68 nt, Tupaia herpesvirus
cgacgagaggagaucgacuuuccugggauaacuuccuacaggauuucaaacaggcgguccucucguug

SEQ ID NO: 2891 - RNA, 63 nt, Saimiriine herpesvirus 2
gggaaacgaaaacaaggaagauguagcaauguaugaaaagcaagggucuugagaucguaccuc

SEQ ID NO: 2892 - RNA, 67 nt, Saimiriine herpesvirus 2
gaaaaaagaugacugggaagcuauccguauuguguuugauacauagauucuucucgguccuuguuuu

SEQ ID NO: 2893 - RNA, 71 nt, Ateline herpesvirus 3
aucuucacagcuguuacccgcaccuuuaacgaacgaccccacugcgaucggcccggugcuccccuuugaag

SEQ ID NO: 2894 - RNA, 104 nt, Simian T-lymphotropic virus 2
ugggcgaaggccugcagcuggugauuaguuccacuagacgggcaccacggauccuaccgaugcccaaguuauuugccacugauguccauccaggcuuuuuccca

SEQ ID NO: 2895 - RNA, 65 nt, Ateline herpesvirus 3
gacgacgugguuuuugcuuccgagcuguguuuuuauugcagcggucguuuuaaccgcaggucguc

SEQ ID NO: 2896 - RNA, 100 nt, Ateline herpesvirus 3
gugauuuauugauauuaacuacagaugcuagugauacuacauggggagcaguccuuauggcaguaccuaaugcauacgaagaguuuuuaucauuugucac

SEQ ID NO: 2897 - RNA, 68 nt, Ateline herpesvirus 3
caccguucgccaaacuuccaccuucccccacacauuccgcucuccuaugaucgugauuuuguuacggu

SEQ ID NO: 2898 - RNA, 111 nt, Fowl adenovirus A
gaguauugaaguucaaaucaacccuucauggauaagucuguuggguagcucccuuaaguuaaacguaggugaugcuuccaaugagucugcuguguugggguccuucuacuc

SEQ ID NO: 2899 - RNA, 79 nt, Fowl adenovirus A
ggcuaucaagaguggaccuacuacuauugguuuugguuguagaacuaagaucgauggugaggacugcuuauugacugcc

SEQ ID NO: 2900 - RNA, 101 nt, Fowl adenovirus A
gguagagguaaggcuaaacuugguaagcgugaguucgcuuggauuccagaaucaggcaaguacugggcugaugaggaugaagaugagcugccaccuccucc

SEQ ID NO: 2901 - RNA, 61 nt, Fowl adenovirus A
ugugccacgguaucuaauuuauaauuagacaguuuuaauuuauccauuacaauuguguaca

SEQ ID NO: 2902 - RNA, 63 nt, Fowl adenovirus A
uuaucuaacaaaaaacgugugguagcgucaaccuuaccuucauauuuuuuaaugucuggauaa

SEQ ID NO: 2903 - RNA, 66 nt, Fowl adenovirus A
uuuaaacauuuuuccauaguauguacuuucuguagaauuugcauuacaauuacuaaauguauuaaa

SEQ ID NO: 2904 - RNA, 86 nt, Human herpesvirus 6
gggucguagcgacugaccuuguucagaagcgugguuuuaaagaugguucuccgcguguguagcucugggauguugcucugcgcucc

SEQ ID NO: 2905 - RNA, 76 nt, Human herpesvirus 6
gguuaguauauacuugaucaucgauucaauguacggcucaagguaaucaacugaagagaugauuauguggauaacc

SEQ ID NO: 2906 - RNA, 116 nt, Human herpesvirus 6
aaguauacgaacuuuccguuaacaauaauucaauuuuauuuaauaaaguauuuuuauaaacaucagaaauauuaacaucuuuauauuguucaauuguuuuagaaacaucguuacuu

SEQ ID NO: 2907 - RNA, 100 nt, Human herpesvirus 6
ggcccucgaccagcccagcacgaagcaggcgauuugcguggcguaucuuuuguuugccaccugcuuguccaggcuuuccagauggagcacgguuagggcu

SEQ ID NO: 2908 - RNA, 67 nt, Human herpesvirus 6
augaguguugcuggggauggugggccgcacgaagauguuaaaauggccuuccaucccuaguucucgu

SEQ ID NO: 2909 - RNA, 62 nt, Human herpesvirus 6
cuucuggcaaccucgcccggauggcugucuagccaauagaagccuucgucgagggcuuugag

SEQ ID NO: 2910 - RNA, 74 nt, Human herpesvirus 6
cguuugugcguaggggguugccccggaagcucuugaaguacuuucgggucucuuccagccguuuagcggaaaug

SEQ ID NO: 2911 - RNA, 92 nt, Ictalurid herpesvirus 1
aagggauauugagcuguuagaguacgaaacugacauuucuugaccuugguuguuagugauucgguucauuuugaagcagcguaguaacucuu

SEQ ID NO: 2912 - RNA, 76 nt, Ictalurid herpesvirus 1
uucaggacacucugagucagaucuuugguugucccugcaaucaauacuuccugacucccaacuccaaaauccugaa

SEQ ID NO: 2913 - RNA, 63 nt, Human herpesvirus 6
cucuuccuguucggggucgucugcguagcggaacuguugucguagacucuccucacugaaggg

SEQ ID NO: 2914 - RNA, 124 nt, Human herpesvirus 6
cgcgaucggcuuuuucuuuggcgaggauguuuuucgugacguagucggcacauagcguuuuccauuccggaaaaacaauguucaucucgucauggaggaccuggacucgccauccccgguugug

SEQ ID NO: 2915 - RNA, 80 nt, Human herpesvirus 6
ccgguugagcuccuccacgugcugcgcgguaaauuuuggaucuaggggcauuccguggggcauggggugggugagggcgg

SEQ ID NO: 2916 - RNA, 77 nt, Human herpesvirus 6
gggccagcuuuugggugacgcggacguccugcaugcaguauucgaggcacgcuuggacgaugucguacugcuggccc

SEQ ID NO: 2917 - RNA, 66 nt, Ictalurid herpesvirus 1
gauauguuuauucauaaacgcgucaaauuuuucaugaaucgcuaaggaguuuaagaaucucauguc

SEQ ID NO: 2918 - RNA, 66 nt, Ictalurid herpesvirus 1
uuuucaaauccauuugugagaagucuaucgccuuagauaccuuuucucguagucgagguuugaaga

SEQ ID NO: 2919 - RNA, 75 nt, Yaba-like disease virus
ggccaggguagcucaaucgguagagcagcgguuccuggaguccgcugguucucgguucaagcccgagcccugguu

SEQ ID NO: 2920 - RNA, 94 nt, Ictalurid herpesvirus 1
caggcuuacgcgcaugaaucuuccaucacccaugccaaaaaccucaucuccaacaugaagaaugguuuugauggaaucaugucuucucucacug

SEQ ID NO: 2921 - RNA, 72 nt, Ictalurid herpesvirus 1
cugucuuguugcccucacccgcagccgcacuggcgucuacuucgucggcaaucugcaccuggcaucaaacag

SEQ ID NO: 2922 - RNA, 91 nt, Ictalurid herpesvirus 1
gucucacuaagccaacccaccuccccccucacaucccuaccaaccacucccuggauguccuaguuuccaacccugugcuccuuggugagac

SEQ ID NO: 2923 - RNA, 93 nt, Ictalurid herpesvirus 1
aacacggcgaggcugugguccuggaauguuugaagaugcgccgccucuccaucccggacucucucauucagcuccacucccaccucaaguguu

SEQ ID NO: 2924 - RNA, 71 nt, Ictalurid herpesvirus 1
ggccaccccauucugaucucaggcgaugacuccguccuuugcggcacaccgcccccuucuccacuuuggcc

SEQ ID NO: 2925 - RNA, 60 nt, Human herpesvirus 6
uuuuuaugaguauuuuuacaaaaaugcauaaaguguaugucguauguauauuuauaaaaa

SEQ ID NO: 2926 - RNA, 99 nt, Fowlpox virus
cccuggcaguuguguguauuccccuucucccaguggcucuauuauuacuucugauucucaauuauuuaauaagccauauugguuacauaaggcccaggg

SEQ ID NO: 2927 - RNA, 130 nt, Fowlpox virus
acguauacguaguaagaaauaauauguuagcacauauauguauguuuguauguaugguuuuguauguuguauguauguauguauuugugugauauauuacuguauuuuguuuguuugcgugcguguaugu

SEQ ID NO: 2928 - RNA, 65 nt, Fowlpox virus
ccuaaaggaaaaauuuuccuccgauuuggaucaauauccccuuggucgaaaguuuuuaguucagg

SEQ ID NO: 2929 - RNA, 62 nt, Molluscum contagiosum virus
uaauauaauccuaauucaucuuuuuuaucguauaaaaauucuauagcauagguuuuauauug

SEQ ID NO: 2930 - RNA, 125 nt, Gallid herpesvirus 3
ggcgaggaauuugauuugcaguuuauuuuccaguuauguguuauuaauuuaacuacagagguuauggccuaucugcaugguaugaaugcuacguuacuggaagacuggaauuucgguuccuugcc

SEQ ID NO: 2931 - RNA, 62 nt, Paramecium bursaria Chlorella virus 1
caaaaugguguuugaaaaauagguguacaacacgucaccguuuaucagguacgccgaguuug

SEQ ID NO: 2932 - RNA, 62 nt, Paramecium bursaria Chlorella virus 1
ugucgucuuuauccuucaggaccauguaauucuucaaguaugguaccuuuaacaagacgaca

SEQ ID NO: 2933 - RNA, 65 nt, Paramecium bursaria Chlorella virus 1
gaaacgcgagaucgaucagaaacguucuagaauuagucuguaauaugucgauaucuccauauuuc

SEQ ID NO: 2934 - RNA, 60 nt, Tupaia herpesvirus
gacgcaaauacuccuccauuaacgcguuuacguuacuuaccagaggggacacguuguguc

SEQ ID NO: 2935 - RNA, 101 nt, Tupaia herpesvirus
guguacuagacgggaacauguccgguccuuugagcgucaagacacccaaaacgucuguauacguggauacgaggaucguuugcaguucuaugaugguauac

SEQ ID NO: 2936 - RNA, 60 nt, Saimiriine herpesvirus 2
cuggguagcgcuaccgagggugcgugcucaucucuaaccgccucugugcguaguguccag

SEQ ID NO: 2937 - RNA, 60 nt, Saimiriine herpesvirus 2
ggccagccgaugggugccgguuuggcggccgcggucgccgccguccaccaacgggaggcc

SEQ ID NO: 2938 - RNA, 130 nt, Saimiriine herpesvirus 2
aggagcggcgacgcgaagacgacggugagucgagcggucggucggucggucggucacaacgcgcgucgcggucguuugacugacugacugacugacugaccgaccguucgccggcucucggcgccgcguu

SEQ ID NO: 2939 - RNA, 76 nt, Rabbit fibroma virus
ugggauuuuacuuaauauaauauuauuucccguaauaaauuuuauuagaaaugccaaaucuauaagaaaaguccua

SEQ ID NO: 2940 - RNA, 75 nt, Human adenovirus F
cggguuuuuuaucucuuucaguaugugaauagauagguauuuuaucucuauucaucaucgaauuuaagagauccg

SEQ ID NO: 2941 - RNA, 75 nt, Human adenovirus F
gaguauuuaggguuaaguuaccugaucccaauaaauuuggccuuccagauaacacaguauaugauccuaacucuc

SEQ ID NO: 2942 - RNA, 97 nt, Human adenovirus F
auuuuaggaacuauguucaugguauccuggcgaauauuaaaacuaucaaugauaugauuaucguuuucaucuuuuaucaccauauaguuucuaagau

SEQ ID NO: 2943 - RNA, 62 nt, Human adenovirus F
uguaugugugcauguuguauguuuuguauuguuugccuguuuguauguuguguauauguaca

SEQ ID NO: 2944 - RNA, 90 nt, Bovine enterovirus
gguguugugcccccucccuccacaaguuuagaugauaccuauagguacuugcagucucgcgccauuacuugccaaaagggggccgccgcc

SEQ ID NO: 2945 - RNA, 65 nt, Human adenovirus F
augugugguugcacccaaugaguaagguacugucccuuuauuguuucuuuguccuuauuacacau

SEQ ID NO: 2946 - RNA, 68 nt, Rat cytomegalovirus
gaccccaaccgcgguacccacugaucuuuaucuuuaugaagaaaaacaggaacugcgguugccccguu

SEQ ID NO: 2947 - RNA, 130 nt, Human herpesvirus 2
aaagugucaacauuugaagaaggcaguuggaaccuccagucucgaccacacacauaauguccauaacucauguuuucaaaaggacaccucuuuagucgauccauacuuccuguuuucccuaaacacucuu

SEQ ID NO: 2948 - RNA, 104 nt, Bovine enterovirus
ggcauuuuuuuaacaggcaggguacuaugggugaggaggugccucagucuuuuuaccuuaaggggaccuccucccgggcaacccuuagcaguucuguguaugcc

SEQ ID NO: 2949 - RNA, 66 nt, Human herpesvirus 2
uaauugagguucccggcaaauguuggauagauagguaacuucucacauuugccuggaccuuuuuug

SEQ ID NO: 2950 - RNA, 93 nt, Monkeypox virus
gguuuuuuuaucccuuggaauuauguuaaaaauagguguuuuuucuuuaaacauaagagaauuuauaauaucagauaaagggauuaaaaaauc

SEQ ID NO: 2951 - RNA, 61 nt, Monkeypox virus
gcacuuauuucaugaauuucauuuuuagaacucauuaaaauaguauuugaaaaauaagugu

SEQ ID NO: 2952 - RNA, 76 nt, Monkeypox virus
gcccacagaucgcaccuucaaccgauaagagucucuagaugacaaaucgacaguuaguuggaaaguguucgggggc

SEQ ID NO: 2953 - RNA, 130 nt, Human herpesvirus 2
cgugagagucuguaacaccgcuucacccagaagagacuggcuaaggaagcagcuugagaggggaagugccuaaacccuucccgaaagcugaaagucucuucugcuagucaagcguggugcagaccucaug

SEQ ID NO: 2954 - RNA, 61 nt, Monkeypox virus
ucauugaguuuaguggcaaacgacaaacagacaaaaauuguagaugccgccagcuaguuga

SEQ ID NO: 2955 - RNA, 93 nt, Monkeypox virus
gucggggcacuuuuuccuucccucggggguuacaacuaaauucgucaguacgauacagugaacuccggggggaaggagaaaaaccgcuccggc

SEQ ID NO: 2956 - RNA, 61 nt, Fowlpox virus
gaguugucagcacugaugauuaugugucucgcacaagcauauuuuaucaugcaggcaguuc

SEQ ID NO: 2957 - RNA, 67 nt, Fowlpox virus
acgguaacucguauauuuuuacguacaauaaagcgauuuguaaaaauaaaaacuuuacguaauccgu

SEQ ID NO: 2958 - RNA, 76 nt, Lumpy skin disease virus
cuguuucugauucagauuccccuuggcuaaaaguugcaucaauuaauaguggagguugcccuguagucacggacag

SEQ ID NO: 2959 - RNA, 74 nt, Lumpy skin disease virus
cggccgugugcgcagguuacuacgugggggacucacucuuuguugguacuccaaacgugaccucguacugguug

SEQ ID NO: 2960 - RNA, 83 nt, Lumpy skin disease virus
gggcgcuaaaccucugagacccguugauuuggcuaucaccccuugggaugaccccaaaugugaguuucuggugacacacgccu

SEQ ID NO: 2961 - RNA, 67 nt, Lumpy skin disease virus
agauaucaugggaggcgcugggagaaagucucccagaaagucucccagaaagucucccagaaagucu

SEQ ID NO: 2962 - RNA, 126 nt, Gallid herpesvirus 3
cuuuuuuacgacuccaucagaaagagguuuaauauuuuugugagaccaucgaagagagaaagauaaaacuuuuuuacgacuccaucagaaagagguuuaauauuuuugugagaccaucgaagagag

SEQ ID NO: 2963 - RNA, 114 nt, Lumpy skin disease virus
augugcuaccugccgacaguguugucaagguuggugucagcaagccuggggucgcucacaaagcacucuguacgguaacugauaucuaccucccgaugcugggcuuguacacau

SEQ ID NO: 2964 - RNA, 98 nt, Gallid herpesvirus 3
uaaaauuaaauuaauuauaaaauuauguauaugauuuacuaacuuuaguuagauaaguuaguaauacauaaauuuuaguauauuaauauuauauuuua

SEQ ID NO: 2965 - RNA, 73 nt, Gallid herpesvirus 3
uuaccugcagccuaacccuagcccuaacccuagcucaugcuuggaguguguuggugacaguccuugcagguga

SEQ ID NO: 2966 - RNA, 68 nt, Gallid herpesvirus 3
ggaaauagccuuuggauuaugccuuugauagugccucaggcuacaagaucaauccaacgguuguuucc

SEQ ID NO: 2967 - RNA, 61 nt, Gallid herpesvirus 3
auggauuuuacuagaucauuuauauaccaaaaaauauuauacgaucuacguuuuauuauau

SEQ ID NO: 2968 - RNA, 128 nt, Gallid herpesvirus 3
cuuuuuuacgacuccaucagaaagagguuuaauauuuuugugagaccaucgaagagagaaagagauaaaacuuuuuuacgacuccaucagaaagagguuuaauauuuuugugagaccaucgaagagag

SEQ ID NO: 2969 - RNA, 77 nt, Gallid herpesvirus 3
ccaccugcccgcccgcccgcccaccugacccgcgcagagguaagggagcgagcuguugaguuggauuggcagagugg

SEQ ID NO: 2970 - RNA, 70 nt, Gallid herpesvirus 3
auaaaaauauuuuuguaaaacuuuuuuuaugagaccaucaaagagagaaagagaauaaaaauauuuuugu

SEQ ID NO: 2971 - RNA, 72 nt, Gallid herpesvirus 3
guggaggagagagagaaauaagcaccuuuaccuuuuuuggggauaaaggugaaucucuacucucgcucucac

SEQ ID NO: 2972 - RNA, 131 nt, Variola virus
cccccgacuccaaccucauucaaaaucccgcuugaguuccguaggggaagugagucuggcgauuugagagaccccucgcuucucccagaacucuagaccgguguuuugaagaaucuucgagagucuggggg

SEQ ID NO: 2973 - RNA, 115 nt, Variola virus
gauggucucauaaaaaaaguuuuacaaaaauauuuuuauucucuuucucucuuugauggucucauaaaaaaaguuuuacaaaaauauuuuuauucucuuucucucuuugaugguc

SEQ ID NO: 2974 - RNA, 71 nt, Variola virus
cgcguuagugguccgugggaagcuaaguuggccauuggagacaccuagcuugcacagaccacuaccacgcg

SEQ ID NO: 2975 - RNA, 77 nt, Chimpanzee cytomegalovirus
uaucguuguuuuuauauauaaauauaauuaugaaaaaauauuucaauauuuaaaaguuauauguugaaauaacagua

SEQ ID NO: 2976 - RNA, 66 nt, Chimpanzee cytomegalovirus
uauguuuauaauaaauauuaauuaaaaugauaaaauuauaauuuuuuaauaauuguaagagacaua

SEQ ID NO: 2977 - RNA, 107 nt, Chimpanzee cytomegalovirus
auuguauuugauguauuuuagauauaaugcuauaauaauuauauuugaugcauuuuaaauuguauuugauguauuuuaaauuguauuugauguauuuuagauauaau

SEQ ID NO: 2978 - RNA, 86 nt, Variola virus
auuauaugauuauaguuucuauuuuuacaguaccuugacuaaagucuuuagucacacaauacuaccaaccuacacuauuauaugau

SEQ ID NO: 2979 - RNA, 130 nt, Fowlpox virus
ggauaaaaauuuuuuagaaagauauaaaaauacuucaucgggguaaauaguaaacauaaaaauauaaaauauucuuuuaucuauuuuuguauguuccauugaguauauuaauccuuuuuuuuuuaauucc

SEQ ID NO: 2980 - RNA, 67 nt, Tupaia herpesvirus
gccuuccaaacuggugagauaauuaggaagaagugggauucauuccgaaauccaguuuguguagggc

SEQ ID NO: 2981 - RNA, 70 nt, Fowlpox virus
guuucauaaucuauuagaugauacguuucaaauaaacacauuauagaaauuacguuacuaauagauaaac

SEQ ID NO: 2982 - RNA, 90 nt, Tupaia herpesvirus
ugccaguguuuggcaguuuuuaccguugguuguguagaauugggaaagcuaauacuaaagugaccgagcauccacuguacaaaugcggca

SEQ ID NO: 2983 - RNA, 63 nt, Human herpesvirus 2
agcuggguacuauaaaaaucaaaccacagauagguuauacuauaauucugaauggggcccgcu

SEQ ID NO: 2984 - RNA, 75 nt, Human herpesvirus 2
cucguaaauaaagacgcacagaccucacgcauauaguaccaucacaccguguggcguguacuuuauuacaacgag

SEQ ID NO: 2985 - RNA, 83 nt, Human herpesvirus 4
ugcagaucuuuuuugugaaaaaaaaauaauuauuuuuuugcgcgccggaauaauuauuuuuuuugcgcggaaauauuuuugca

SEQ ID NO: 2986 - RNA, 64 nt, Fowlpox virus
auuuuaaaaucugccgugucuagucucguuauuacaggauuccucgcaguuuagaauuuaaaau

SEQ ID NO: 2987 - RNA, 100 nt, Fowlpox virus
gucacaaagugaaagaaccguauaguuuggaacauuguuaaauuuuaaaguagaaacuccauuaauaaaguuuucauaauccgauucuuuuacaaaggac

SEQ ID NO: 2988 - RNA, 74 nt, Tupaia herpesvirus
gcuuggcguuuggauugucuauuccaaugcaaauagcauuggaggguauauaugacaaucuuaagagaccaggu

SEQ ID NO: 2989 - RNA, 72 nt, Human herpesvirus 4
uuaaacuuauuacuacugcuauaggcguuaaacauuaaaauuauuacuacuguuguaggcgucaaagauuaa

SEQ ID NO: 2990 - RNA, 125 nt, Fowlpox virus
ucccugguagcuacugagcagcagcuguuuaacaggcccuuuuggcugcagagaucccagggccauaacaauggcauacuguggcacaacgaggccuuuguaacauugguugacacuaccagggg

SEQ ID NO: 2991 - RNA, 87 nt, Human herpesvirus 4
gcguuaaacauuaaaauuauuacuacugcuguaggcguuaaacauuauuacugcuguaggcguagcuaaauuuuaauguuuuuucgu

SEQ ID NO: 2992 - RNA, 81 nt, Human herpesvirus 4
ggcauuccugauauucauguuaaagugcuauacuauaaccaucuuaugugggcucuuuauacaucuuauuggcaggaggcc

SEQ ID NO: 2993 - RNA, 102 nt, Fowlpox virus
cgaauugcugguauuguggugcgguguccucgacgguccaugugucaucuuauaaucacuuggucaguccaggguacaccacuccauuaucuauuuacuucg

SEQ ID NO: 2994 - RNA, 69 nt, Gallid herpesvirus 2
gccgucaccgugucgcagcucuuccccggccuccuccugcuggccuacugcgagagccaccgcgccggc

SEQ ID NO: 2995 - RNA, 93 nt, Monkeypox virus
gcgcguuugcgcacguucaccucgcgagugacguuguggaugcgggagcgcgcguccaccaagucgagagccucguguucgucgcaguugcgc

SEQ ID NO: 2996 - RNA, 65 nt, Monkeypox virus
ucuuggaaagcuuacccgcucuuggcacuccuucuucggcuugcggagguaagagcuccccgggg

SEQ ID NO: 2997 - RNA, 63 nt, Monkeypox virus
cgggugccaauaauaaauuuugcgcgaaucuuauuuaagugcacaccguguuauuugcggcug

SEQ ID NO: 2998 - RNA, 67 nt, Lumpy skin disease virus
cgggggggucccccguugggcagggagagggcgcugacgaugcaucuuaucaauugccccguaggga

SEQ ID NO: 2999 - RNA, 61 nt, Murid herpesvirus 4
ggagugugacaacauauuaucauuuauuauuggaaacaaaguugucucugaguacaucucc

SEQ ID NO: 3000 - RNA, 74 nt, Melanoplus sanguinipes entomopoxvirus
gaaaggucuuccgacguggcaagucuggacuacguggacagagucguagucccccacgagcuugucggccuuuu

SEQ ID NO: 3001 - RNA, 67 nt, Lumpy skin disease virus
gaagucguuggagaugcggcccaugagcugcgagaaggcguucaugcccgccucguuccagacgcgg

SEQ ID NO: 3002 - RNA, 76 nt, Murid herpesvirus 4
gggcuuuauucauaaacaauaaaagguguacugacccugaauuuggucacuuacuuaaaacacuugaauauagccu

SEQ ID NO: 3003 - RNA, 67 nt, Tobacco mild green mosaic virus
cuguguccaaaguuuuaaguacggaccgcuauguccagcguaccaaccuguacuauuauggaggcag

SEQ ID NO: 3004 - RNA, 64 nt, Tobacco mild green mosaic virus
ccuccuauuggggagcacugggccaaggguacugugugcucuaguguugugccucagcaggggg

SEQ ID NO: 3005 - RNA, 72 nt, Tobacco mild green mosaic virus
aaugguauuuguugguuuaaugaguuguuuguuacugugguggauaccacccguaguaccaaccuuaccauu

SEQ ID NO: 3006 - RNA, 67 nt, Lumpy skin disease virus
ccugcgucgccggcggcgcacgggcagacggucgaugaagcgcucgauggucucgccgcgccggcgu

SEQ ID NO: 3007 - RNA, 65 nt, Lumpy skin disease virus
agaagaaucgccaggguugcguugcggugugccccgguucgaggccggccggauuccgcggcuaa

SEQ ID NO: 3008 - RNA, 80 nt, Rat cytomegalovirus
cguggccagcgcccucuauaaaagauuuaggauuaauaucauuuccuucauuuucaguugacggagcgacugguaaagcg

SEQ ID NO: 3009 - RNA, 106 nt, Rat cytomegalovirus
ccuccagaaguuguguaucuaguaaacgcgauaauagauagugcuaaacgaauuacugaaucuauuacugacuuuaauauugauacauacauuaaugaccuggugg

SEQ ID NO: 3010 - RNA, 65 nt, Murid herpesvirus 4
ccacugaugucucgugcgagggcuugggggccuggguacccgcagccccuugcgcgcgcaucugg

SEQ ID NO: 3011 - RNA, 62 nt, Tobacco mild green mosaic virus
gcguccauuuugaguucagcgaccgguuucggucucccgcguuuuuguuuuuguuauggcgc

SEQ ID NO: 3012 - RNA, 131 nt, Rat cytomegalovirus
uuacgaucccgcgucgugggccggggucggggacucugcaccucccuuuaggaucuuucccggccucuaccagggcaagggagauccgggggcgagacccagggccgcguacggcuaugcgggccccgugg

SEQ ID NO: 3013 - RNA, 62 nt, Rat cytomegalovirus
ccucuccgaauaauugaaacacuaguaaauaagguacuaguuguuucccauauuuggagugg

SEQ ID NO: 3014 - RNA, 76 nt, Tick-borne encephalitis virus
gcuuaagguuucgcccuuccgagaauccauacuccaucaccccaauggaucagcuucucggcgagcaccuuuucgc

SEQ ID NO: 3015 - RNA, 63 nt, Rat cytomegalovirus
ggcgacgugagggugacggacguaaaguuuaaccaguuugcaaacauccucaguucgugcgcc

SEQ ID NO: 3016 - RNA, 85 nt, Rat cytomegalovirus
aaaauauuucuucgguuuuaaucaggccuuucucuaguuuguauaaaguuauauggguagguuguuuguucuguggaaauauuuu

SEQ ID NO: 3017 - RNA, 103 nt, Rat cytomegalovirus
gaaguuuuccugcucucgguaagaaguuccuggugauguuaaacauaacaaaauagucuuugucuuugacguugucaaggauguggcuugcaagcacgauuuc

SEQ ID NO: 3018 - RNA, 131 nt, Tick-borne encephalitis virus
aggucaaguaccucacugaagcggggauuggccuuacugccgugauggcggaggcgaguuaccguaagacguucucguccacguucucccguagugaccgcgugauccucggcccagugaggcgcagaccu

SEQ ID NO: 3019 - RNA, 79 nt, Cowpox virus
uuuuuaaaaaaggccacuuuuuuuuacaaaagugaaaaaaacaauuuuuuccacuccaaauauuuuaaagaggccacuu

SEQ ID NO: 3020 - RNA, 82 nt, Tick-borne encephalitis virus
gagucggcgacucccacgccaucgaguacccaaccuuacaagaacauugggacucucgauggcucugggcagucaacggcuc

SEQ ID NO: 3021 - RNA, 64 nt, Cowpox virus
uuuacaaaugaacuacauguuguauucucaaauugcccggauacuuguauagaucuauugugaa

SEQ ID NO: 3022 - RNA, 80 nt, Cowpox virus
cuaauuauuaauuaauaauuuaauaguuccuaauuuauauauaucuggaaauguauaauuauuuggaauuuaggaauuua

SEQ ID NO: 3023 - RNA, 74 nt, Cowpox virus
agauguacaauuaauuggaauuuuggaauuuacaauuuuauuaacuuuuuguaauaaauuuccaagauguagaa

SEQ ID NO: 3024 - RNA, 60 nt, Saccharomyces cerevisiae killer virus M1
cucuuauuuuuaaauuaaugugucccaauuagaaacccaagcgcagaaauuaguugagag

SEQ ID NO: 3025 - RNA, 65 nt, Amsacta moorei entomopoxvirus
ggcuugagcuacaccccccaguucccgcgucgguaacuaggguuaaagguuuggcagauuuugcc

SEQ ID NO: 3026 - RNA, 117 nt, Amsacta moorei entomopoxvirus
gccccuaaaaaggauccuuaugauggccuuguauuuugggagguugauuuaaaggacaaacuauccacagauuuagaucaguuuccuuugggccguaaguuucuuuugcaacugggu

SEQ ID NO: 3027 - RNA, 73 nt, Amsacta moorei entomopoxvirus
ccaggcacaucugcuaauaguaggaacacucuuaccagcuacaucuaugcuccuacuccuaguggcucccugg

SEQ ID NO: 3028 - RNA, 130 nt, Encephalomyocarditis virus
uuuuuuacgacuccaucagaaagagguuuaauauuuuugugagaccaucgaagagagaaagagauaaaacuuuuuuuacgacuccaucagaaagagguuuaauauuuuugugagaccaucgaagagagaa

SEQ ID NO: 3029 - RNA, 129 nt, Encephalomyocarditis virus
cuuuuuuacgacuccaucagaaagagguuuaauauuuuugugagaccaucgaagagagaaagagauaaaacuuuuuuuacgacuccaucagaaagagguuuaauauuuuugugagaccaucgaagagag

SEQ ID NO: 3030 - RNA, 84 nt, Variola virus
gaaaugccgcgugauaucccuaugguucaguugguuguuauguaaaagagaccagcuuuccaggggauacacacacggcguuuu

SEQ ID NO: 3031 - RNA, 83 nt, Variola virus
gaugcugugggacagcgcauagagugucugaguucugguaauggagggaucuccaggcacucuaugcacugcuucgcagcguc

SEQ ID NO: 3032 - RNA, 85 nt, Variola virus
gcaagaucccgcaugagucccucugagccguuaguugugauauacuuaucacuaacuagcuuagagagucucucacggugucugc

SEQ ID NO: 3033 - RNA, 67 nt, Cowpox virus
gcgcgucguguacuguaacauguccaaauuacaggaaaaggacuacaucaacguacgaaagaugugc

SEQ ID NO: 3034 - RNA, 71 nt, Cowpox virus
ccacgccgaaaagauguccaggcucgucaagaugggacccuuuuccgccggaucucucacaaucugcgugg

SEQ ID NO: 3035 - RNA, 75 nt, Cowpox virus
cugcccgaccuaaaguccuucaaggccaagugcaaugugacgcugaggcucaugggggacccagagugcgggcag

SEQ ID NO: 3036 - RNA, 61 nt, Cowpox virus
gugugugcuggauuucugcaauguggccauggaacaggggcagauccuccccgccgaacac

SEQ ID NO: 3037 - RNA, 68 nt, Cowpox virus
ggacgcgucuaguaucuacgucucaccucugaauagucuagagacgccaaauacuuuaagacggaucc

SEQ ID NO: 3038 - RNA, 65 nt, Cowpox virus
gcgggagcugggauccuggaggacagagccaggucaggcguccucuuggcggucaggucucccgu

SEQ ID NO: 3039 - RNA, 61 nt, Ateline herpesvirus 3
cuggaacugguggaacuugucuaugcgcaaauuacagaggacgaggaacaccguauaccag

SEQ ID NO: 3040 - RNA, 63 nt, Ateline herpesvirus 3
ggacgcgggaauuuccuugaugauuacgagaacuucguuucaggcaucaagguuccugccgcc

SEQ ID NO: 3041 - RNA, 88 nt, Saimiriine herpesvirus 2
gaggugucgguugacggaaagaguuuuggccagggcggcaaccguuauagauucgucuuucgcuaugacucuuugcugucgacaccuu

SEQ ID NO: 3042 - RNA, 103 nt, Saimiriine herpesvirus 2
guccgauucgauacaagaacccugucaugucucaccaggcugccgaaaucuguggauugaagccuggggaguaugaaguggaugauagguaucaggaaaggau

SEQ ID NO: 3043 - RNA, 68 nt, Saimiriine herpesvirus 2
ucauugacaacuucaagauuugcuuccccguaaacgggaaauggaucuauggucaaggguugucaugg

SEQ ID NO: 3044 - RNA, 117 nt, Saimiriine herpesvirus 2
agagcuuuucagacuaaaaauguguuacaauauuuauagacuaaggauaagauuaucucuauauucuuucagaagauauggagauuguaccaacauuuauagacucuccaacgcucu

SEQ ID NO: 3045 - RNA, 91 nt, Saimiriine herpesvirus 2
aucucguccccauggaagaggcgaaagaggcaccuaggcagcagcuuguuccuaggcguucaacuuucgucgauaaccaugaggaggaggu

SEQ ID NO: 3046 - RNA, 79 nt, Saimiriine herpesvirus 2
gccucaggguuccagacacguuccgccggaggacuuugcggccaggguggcagagucccugagccuggaccugagaggu

SEQ ID NO: 3047 - RNA, 87 nt, Saimiriine herpesvirus 2
gguucuucgccaacauggcgguccucgcaggugucaagacccaucucuugaaacugcagacugcgacguacggcgauuuggagaacc

SEQ ID NO: 3048 - RNA, 127 nt, Saimiriine herpesvirus 2
gugugugugugugcgcucacacggaacgagaacaagugugugugugcgcucacacggaacgagaacaagugugugugugugugcgcucacacggaacgagaacaagugugugugugcgcgcucacac

SEQ ID NO: 3049 - RNA, 131 nt, Saimiriine herpesvirus 2
ugacgaaaugccacacauuaggagugugaggaacacgggcauccaugggcuaccuggggauuucuugucgaauuacccuagacugccuacgccuguauuucaucgccuccgcgauuugugggaugauguca

SEQ ID NO: 3050 - RNA, 83 nt, Saimiriine herpesvirus 2
cggugcugagggguuacaaagccgcguucacuccgcaugucgagcuugacaugccgaacgcaacuucguacaacuuagcaccg

SEQ ID NO: 3051 - RNA, 72 nt, Saimiriine herpesvirus 2
gauccagcuguggugccuaaggacaucagggacaaguacccccugguuccgaacggugaccacaacgagauc

SEQ ID NO: 3052 - RNA, 102 nt, Rat cytomegalovirus
caugugcagcacuggaaguguuuacgcauagaagcagccuuauuauuuaaggcucgugaaaugggcuaugcacaaguaggacaucaaauagugccagcacug

SEQ ID NO: 3053 - RNA, 61 nt, Tupaia herpesvirus
gauguaauguccguauucuucagguaucugucggaaccagucgaguauaguucguugaauc

SEQ ID NO: 3054 - RNA, 67 nt, Rat cytomegalovirus
ugcugcugugguuuuuagccacaguguuuauuuguauauuaguacuguuguuaaacuacugcagaca

SEQ ID NO: 3055 - RNA, 60 nt, Tupaia herpesvirus
guugcuguucgugucgcgaagcuaguuuugagucguaauugcagcaggcagagcagcagc

SEQ ID NO: 3056 - RNA, 88 nt, Tupaia herpesvirus
gcgggucgucgcggggacugguuuggcgugcguacguacguguuucugcacggcuccggccgccgcuucggccucccugcacgcccgc

SEQ ID NO: 3057 - RNA, 87 nt, African swine fever virus
gugguggaauauauguugacgcagucggcgacucggcagagcgaucuggagcggcucgaggcgcacgaucggcugcuguuucauuac

SEQ ID NO: 3058 - RNA, 81 nt, Ectromelia virus
uuuuugaacaauacgcacugguaauauccgugaucccguguggaagagagaggauauaauaaaucguguguaucucaaaaa

SEQ ID NO: 3059 - RNA, 62 nt, Ectromelia virus
ggcucucugcggcucgcguucgcguuccccggugacgaaacccgcgcacaccgcagaacgcc

SEQ ID NO: 3060 - RNA, 79 nt, Equine herpesvirus 2
aagaauauaucuuaagauaguagcuuuucugaaagagauauauauauuaagaguacuacuaucuugcgauauuagucuu

SEQ ID NO: 3061 - RNA, 80 nt, Equine herpesvirus 2
uguccucuaugggucucagaugccuggcggcccugccguacacguggagguugcccgggguuaucugcgacccguggaca

SEQ ID NO: 3062 - RNA, 85 nt, Equine herpesvirus 2
aaauuuuaaacugcaaugucuccucugaaaacucugauagauuaucucuaagaguuuuaucuaaagauuuuuuuuccuaagauuu

SEQ ID NO: 3063 - RNA, 65 nt, Equine herpesvirus 2
gaugcgggagauaagccaaacuuuauaaagaccauggucgucaaguaccuggacgucuuucuguc

SEQ ID NO: 3064 - RNA, 74 nt, Equine herpesvirus 2
uauuaucgaaauuguauuaggagaaauuauaagacaauuuuuuuaucaccauuccagaauuaaguuugauaaua

SEQ ID NO: 3065 - RNA, 73 nt, Equine herpesvirus 2
acguccagccucucggccgaggacgccgugguagacgaguggugcacagucucgggccugaagggaaggacgu

SEQ ID NO: 3066 - RNA, 61 nt, Human herpesvirus 7
gcucuccgacgucagccgcgcagggcacguaccagcacuggucgggguaggcguggagagu

SEQ ID NO: 3067 - RNA, 63 nt, Human herpesvirus 7
ucugggguccaggacacaaucucugcuagagcgcaaccgcggggaggguuccugagcucugga

SEQ ID NO: 3068 - RNA, 72 nt, Human herpesvirus 7
ugggugguuaacaagaacaacacccugcugcgcuuugacuacaccugcgcccucaggucccucugccaccca

SEQ ID NO: 3069 - RNA, 128 nt, Human herpesvirus 7
ccccuguuugacuuuuacgcggugggcgcgccgggcgccagggguguggccuacagggccacccacaggggcauggugggcaacaucccccagucccuggcccccgccggguuucaggagugcagggg

SEQ ID NO: 3070 - RNA, 118 nt, Human herpesvirus 7
ggggcccgccagcuacgcgagcuacguggucaggggggacaaccuggugacggccgucagcuacgggcgggccauggucgccuucgaccaguuuguguccaggcugguggacaacccc

SEQ ID NO: 3071 - RNA, 24 nt, Human herpesvirus 7
aaggaccaaaaguuuagccugagc

SEQ ID NO: 3072 - RNA, 24 nt, Human herpesvirus 7
ugaguagaguacacaugcggagca

SEQ ID NO: 3073 - RNA, 24 nt, Human herpesvirus 7
uguuauaaaaaauaagaauaagau

SEQ ID NO: 3074 - RNA, 18 nt, Human herpesvirus 7
ucgcggaggagggccugu

SEQ ID NO: 3075 - RNA, 24 nt, Human herpesvirus 7
cagccacggccagcucgccaccug

SEQ ID NO: 3076 - RNA, 24 nt, Alcelaphine herpesvirus 1
ucuaaauuuaaaaaaguuuauaua

SEQ ID NO: 3077 - RNA, 24 nt, Alcelaphine herpesvirus 1
uuagaagauuuauuaucuguauac

SEQ ID NO: 3078 - RNA, 24 nt, Alcelaphine herpesvirus 1
uaugacaauuccggauaccuuuuc

SEQ ID NO: 3079 - RNA, 23 nt, Alcelaphine herpesvirus 1
ugcuaucgggagaucaaggugcc

SEQ ID NO: 3080 - RNA, 24 nt, Alcelaphine herpesvirus 1
uauauuauuggcccgagugcgagc

SEQ ID NO: 3081 - RNA, 24 nt, Alcelaphine herpesvirus 1
uggcagaaggccggccggucggag

SEQ ID NO: 3082 - RNA, 24 nt, Alcelaphine herpesvirus 1
gaggaccccggcggugagcaagca

SEQ ID NO: 3083 - RNA, 24 nt, Alcelaphine herpesvirus 1
agacgggggugggggcuggguggg

SEQ ID NO: 3084 - RNA, 17 nt, Alcelaphine herpesvirus 1
aggcagccgcggccgcc

SEQ ID NO: 3085 - RNA, 21 nt, Alcelaphine herpesvirus 1
ugacgcugacuuacaacggcc

SEQ ID NO: 3086 - RNA, 24 nt, Alcelaphine herpesvirus 1
uccaguacgucguggucaacggua

SEQ ID NO: 3087 - RNA, 21 nt, Alcelaphine herpesvirus 1
uagcccccuggcccgcagugc

SEQ ID NO: 3088 - RNA, 24 nt, Vaccinia virus
gcuugcucaccgccgggguccucc

SEQ ID NO: 3089 - RNA, 24 nt, Vaccinia virus
aggggaaggagaaggcgccgcacu

SEQ ID NO: 3090 - RNA, 23 nt, Yaba-like disease virus
ugccuuagagaggggguuagugg

SEQ ID NO: 3091 - RNA, 24 nt, Yaba-like disease virus
uauuucucccaacaccccaguauu

SEQ ID NO: 3092 - RNA, 24 nt, Vaccinia virus
uaaggcaccgcggcugggcccuuc

SEQ ID NO: 3093 - RNA, 24 nt, Vaccinia virus
cgagaugagggugggggcugggug

SEQ ID NO: 3094 - RNA, 24 nt, Vaccinia virus
ccgccgcccauccgccuagcggcu

SEQ ID NO: 3095 - RNA, 24 nt, Vaccinia virus
cauuggauuuuuugcccgcgcggg

SEQ ID NO: 3096 - RNA, 24 nt, Vaccinia virus
cagcugcccccccggcgcgcgcga

SEQ ID NO: 3097 - RNA, 24 nt, Yaba-like disease virus
acggacccacauggcggcggaggg

SEQ ID NO: 3098 - RNA, 24 nt, Yaba-like disease virus
ucaauggguuuguggccuuugcca

SEQ ID NO: 3099 - RNA, 24 nt, Yaba-like disease virus
uauaauggaaggggaucaucaucu

SEQ ID NO: 3100 - RNA, 24 nt, Yaba-like disease virus
uccaauauguuguugugaauggca

SEQ ID NO: 3101 - RNA, 24 nt, Amsacta moorei entomopoxvirus
ccgccgcgcgcccccgcccggccg

SEQ ID NO: 3102 - RNA, 24 nt, Amsacta moorei entomopoxvirus
gcgcgcccuucuccucuccccucc

SEQ ID NO: 3103 - RNA, 18 nt, Amsacta moorei entomopoxvirus
caccucggcggccgcccc

SEQ ID NO: 3104 - RNA, 24 nt, Amsacta moorei entomopoxvirus
aacccguauccuuuuuuucuaggu

SEQ ID NO: 3105 - RNA, 24 nt, Amsacta moorei entomopoxvirus
ugaguauaucagaucauauuauaa

SEQ ID NO: 3106 - RNA, 24 nt, Yaba-like disease virus
caucacaggugggguccuugggug

SEQ ID NO: 3107 - RNA, 24 nt, Amsacta moorei entomopoxvirus
aagcggaaaaacggaggauggaag

SEQ ID NO: 3108 - RNA, 24 nt, Amsacta moorei entomopoxvirus
cccacgccucccgccgcauuaggc

SEQ ID NO: 3109 - RNA, 24 nt, Amsacta moorei entomopoxvirus
uuaaagguaagaguuaugacgcau

SEQ ID NO: 3110 - RNA, 24 nt, Amsacta moorei entomopoxvirus
cagcacaaaucaaaaguauuaaua

SEQ ID NO: 3111 - RNA, 24 nt, Southern bean mosaic virus
acgaaucuccuguggacuugguuc

SEQ ID NO: 3112 - RNA, 24 nt, Southern bean mosaic virus
aagccgcccagaauagguuuucgu

SEQ ID NO: 3113 - RNA, 24 nt, Southern bean mosaic virus
ccgcacaguguguguggcaaaggc

SEQ ID NO: 3114 - RNA, 24 nt, Southern bean mosaic virus
uaugccacguugcucgcacaugcg

SEQ ID NO: 3115 - RNA, 24 nt, Paramecium bursaria Chlorella virus 1
uucccggggaggagggcaccaggu

SEQ ID NO: 3116 - RNA, 24 nt, Paramecium bursaria Chlorella virus 1
uaaaauguuggccgcguguguagg

SEQ ID NO: 3117 - RNA, 24 nt, Paramecium bursaria Chlorella virus 1
acgcagcugcguauacccagcugu

SEQ ID NO: 3118 - RNA, 24 nt, Southern bean mosaic virus
aagcaggagccccacgccucccga

SEQ ID NO: 3119 - RNA, 23 nt, Southern bean mosaic virus
uaagggaagaucgauguugguug

SEQ ID NO: 3120 - RNA, 24 nt, Southern bean mosaic virus
ucgguguuccagaggcauguccuc

SEQ ID NO: 3121 - RNA, 24 nt, Southern bean mosaic virus
accccuuugguccaugucgcgcgg

SEQ ID NO: 3122 - RNA, 24 nt, Paramecium bursaria Chlorella virus 1
ugguauucccagcugagguugccu

SEQ ID NO: 3123 - RNA, 21 nt, Paramecium bursaria Chlorella virus 1
gagugcgcgcgcugcgcugac

SEQ ID NO: 3124 - RNA, 24 nt, Paramecium bursaria Chlorella virus 1
uggauuaggugcugcuggacaagu

SEQ ID NO: 3125 - RNA, 24 nt, Bovine herpesvirus 4
uuuguuacuaauuucuuuauccac

SEQ ID NO: 3126 - RNA, 24 nt, Bovine herpesvirus 4
ucucaccccaggacuaaaagagag

SEQ ID NO: 3127 - RNA, 24 nt, Human herpesvirus 7
uuucacacacucguccucuaccuc

SEQ ID NO: 3128 - RNA, 24 nt, Equine herpesvirus 2
ugugaaaaaucgaaaucguuaaga

SEQ ID NO: 3129 - RNA, 24 nt, Equine herpesvirus 2
uuuguaaaaaaauaaacuuaacau

SEQ ID NO: 3130 - RNA, 24 nt, Equine herpesvirus 2
uuccucuaucguauaaauaauuag

SEQ ID NO: 3131 - RNA, 21 nt, Equine herpesvirus 2
guggagguggucaugagggac

SEQ ID NO: 3132 - RNA, 24 nt, Equine herpesvirus 2
gaagagagaaagagaauaaaaaua

SEQ ID NO: 3133 - RNA, 24 nt, Bovine herpesvirus 4
uuacuacauaguuaucuaucuuaa

SEQ ID NO: 3134 - RNA, 24 nt, Bovine herpesvirus 4
acaacggguugggcagcccaaagg

SEQ ID NO: 3135 - RNA, 24 nt, Human herpesvirus 7
acccgugcauuuuacccucguuaa

SEQ ID NO: 3136 - RNA, 19 nt, Human herpesvirus 7
ugcccuugagcguggggcc

SEQ ID NO: 3137 - RNA, 24 nt, Equine herpesvirus 2
uaaguuuuuucucaucucccuuaa

SEQ ID NO: 3138 - RNA, 18 nt, Equine herpesvirus 2
caccgggccgaccugcag

SEQ ID NO: 3139 - RNA, 24 nt, Gallid herpesvirus 3
aauauuuuuguaaaacuuuuuuua

SEQ ID NO: 3140 - RNA, 24 nt, Gallid herpesvirus 3
aauauuuuuguaaaacuuuuuuua

SEQ ID NO: 3141 - RNA, 24 nt, Equine herpesvirus 2
ugagaccauugaagagagaaagag

SEQ ID NO: 3142 - RNA, 24 nt, Melanoplus sanguinipes entomopoxvirus
ugugaaauuuuguaccaaagaaaa

SEQ ID NO: 3143 - RNA, 24 nt, Equine herpesvirus 2
cgacgagcgacgcgcccggcgcgg

SEQ ID NO: 3144 - RNA, 24 nt, Equine herpesvirus 2
uaaaaauauuuuuguaaaacuuuu

SEQ ID NO: 3145 - RNA, 24 nt, Equine herpesvirus 2
gagcagaugcgccggcgcacccag

SEQ ID NO: 3146 - RNA, 24 nt, Equine herpesvirus 2
cgcccgggcccgacgccgaucugc

SEQ ID NO: 3147 - RNA, 24 nt, Ectromelia virus
ucguauagauagggucgaguaucc

SEQ ID NO: 3148 - RNA, 20 nt, Ectromelia virus
uuacgugucuugacguagug

SEQ ID NO: 3149 - RNA, 24 nt, Ectromelia virus
cagcccucccaccgccgcgcguuu

SEQ ID NO: 3150 - RNA, 24 nt, Ectromelia virus
uggcaaauuuagaagaaaagaaaa

SEQ ID NO: 3151 - RNA, 24 nt, Ectromelia virus
ucgcgggagaccgcggaaaacgac

SEQ ID NO: 3152 - RNA, 24 nt, Ectromelia virus
uagcuuaccuaguacgguaugcug

SEQ ID NO: 3153 - RNA, 24 nt, Ectromelia virus
aggcaguaauaaaaggggcauaga

SEQ ID NO: 3154 - RNA, 24 nt, Sheeppox virus
uguaucaaaaauaucaauauccaa

SEQ ID NO: 3155 - RNA, 24 nt, Sheeppox virus
aguaaagauauuuuuuuagauuau

SEQ ID NO: 3156 - RNA, 24 nt, Sheeppox virus
uuaagggauuggauagcgaaacau

SEQ ID NO: 3157 - RNA, 24 nt, Ectromelia virus
augagccauauagacaauauacau

SEQ ID NO: 3158 - RNA, 24 nt, Ectromelia virus
ucgccgggcuaacggggaucaccg

SEQ ID NO: 3159 - RNA, 24 nt, Tupaia herpesvirus
ucgcugcuggcgaccaacuucaau

SEQ ID NO: 3160 - RNA, 24 nt, Tupaia herpesvirus
aguuguuuauacaguacacgauug

SEQ ID NO: 3161 - RNA, 24 nt, Tupaia herpesvirus
uauagugcggggcacgguugaagg

SEQ ID NO: 3162 - RNA, 24 nt, Tupaia herpesvirus
uaaaaagcauggaaaauuggaacc

SEQ ID NO: 3163 - RNA, 24 nt, Monkeypox virus
aagcagccuaccccgaaggugguu

SEQ ID NO: 3164 - RNA, 24 nt, Monkeypox virus
aaccccguuggcgcgacgcgcuuc

SEQ ID NO: 3165 - RNA, 24 nt, Sheeppox virus
ucuaauguccaauuaauguuuuua

SEQ ID NO: 3166 - RNA, 24 nt, Sheeppox virus
uuagcauguucuagaagacauagu

SEQ ID NO: 3167 - RNA, 24 nt, Melanoplus sanguinipes entomopoxvirus
uguaucaaaaauaucaauaucuaa

SEQ ID NO: 3168 - RNA, 24 nt, Sheeppox virus
ucaauauccaauguccaauuaaug

SEQ ID NO: 3169 - RNA, 24 nt, Tupaia herpesvirus
guucagguccgcauagguucccag

SEQ ID NO: 3170 - RNA, 24 nt, Tupaia herpesvirus
augaauuuaguaacagauaguaga

SEQ ID NO: 3171 - RNA, 24 nt, Monkeypox virus
cagccgccuggccacguccuggug

SEQ ID NO: 3172 - RNA, 24 nt, Sheeppox virus
caauacaggcuagaauuaugaaau

SEQ ID NO: 3173 - RNA, 24 nt, Monkeypox virus
ccgugcccugaguacgggcucggg

SEQ ID NO: 3174 - RNA, 24 nt, Monkeypox virus
cucucucgacggcaaguucuuggg

SEQ ID NO: 3175 - RNA, 24 nt, Monkeypox virus
acggaccgcgugcccgugggcaug

SEQ ID NO: 3176 - RNA, 24 nt, Monkeypox virus
cgagcgccgccggaguaccagcag

SEQ ID NO: 3177 - RNA, 17 nt, Melanoplus sanguinipes entomopoxvirus
uaugauauaucuaauaa

SEQ ID NO: 3178 - RNA, 24 nt, Melanoplus sanguinipes entomopoxvirus
uaguaccccuaaacuuuauagaau

SEQ ID NO: 3179 - RNA, 24 nt, Melanoplus sanguinipes entomopoxvirus
guuuucugcgagggugggaucggc

SEQ ID NO: 3180 - RNA, 24 nt, Melanoplus sanguinipes entomopoxvirus
ggaggagagucugcguugacgggg

SEQ ID NO: 3181 - RNA, 24 nt, Melanoplus sanguinipes entomopoxvirus
aagaguauaucuuuggguauagau

SEQ ID NO: 3182 - RNA, 24 nt, Melanoplus sanguinipes entomopoxvirus
uaaggaaaaaaaugcaauuccgcc

SEQ ID NO: 3183 - RNA, 24 nt, Melanoplus sanguinipes entomopoxvirus
ugcacaaaugcuguggugauuugg

SEQ ID NO: 3184 - RNA, 24 nt, Human herpesvirus 5
ggaggucaauuucgaagauauggg

SEQ ID NO: 3185 - RNA, 24 nt, Human herpesvirus 1
acgcaugcggcgcaggcaggccgu

SEQ ID NO: 3186 - RNA, 24 nt, Human herpesvirus 1
ucgcucaggcuguucugugaauag

SEQ ID NO: 3187 - RNA, 24 nt, Human herpesvirus 1
cguuguggcacaaacaaaacaggc

SEQ ID NO: 3188 - RNA, 23 nt, Alcelaphine herpesvirus 1
ugguagguguggaagggcgcgcc

SEQ ID NO: 3189 - RNA, 24 nt, Alcelaphine herpesvirus 1
cagugcguagccguucugcgucag

SEQ ID NO: 3190 - RNA, 24 nt, Alcelaphine herpesvirus 1
aggcacgcgcgcgugucuuccagc

SEQ ID NO: 3191 - RNA, 17 nt, Alcelaphine herpesvirus 1
uaaaauuguuugucugu

SEQ ID NO: 3192 - RNA, 24 nt, Alcelaphine herpesvirus 1
uauuuuggggugcccgguccaguc

SEQ ID NO: 3193 - RNA, 24 nt, Marburg virus
uucauuauuuaauuuaguuuuauu

SEQ ID NO: 3194 - RNA, 18 nt, Marburg virus
uagaaugucaaguccacu

SEQ ID NO: 3195 - RNA, 24 nt, Marburg virus
gauguugagacugaagcaagaaga

SEQ ID NO: 3196 - RNA, 24 nt, Marburg virus
gaucguuugaacauucguugggua

SEQ ID NO: 3197 - RNA, 24 nt, Marburg virus
auuaaauuagcaucagcuacauuu

SEQ ID NO: 3198 - RNA, 24 nt, Bovine herpesvirus 4
guagaucaagcaacuuuuaaauau

SEQ ID NO: 3199 - RNA, 24 nt, Bovine herpesvirus 4
ucgaauccaggccccugauuggug

SEQ ID NO: 3200 - RNA, 24 nt, Alcelaphine herpesvirus 1
uggcgggcagcucugcuggcaggc

SEQ ID NO: 3201 - RNA, 24 nt, Marburg virus
uguuuuauuauauuucucaaaugc

SEQ ID NO: 3202 - RNA, 24 nt, Marburg virus
ugucguuauacagguaauacauaa

SEQ ID NO: 3203 - RNA, 24 nt, Bovine herpesvirus 4
uauguuagaugcgggggaguaugu

SEQ ID NO: 3204 - RNA, 24 nt, Bovine herpesvirus 4
caggugcucgucguaggugagacu

SEQ ID NO: 3205 - RNA, 24 nt, Bovine herpesvirus 4
ucugcagauaggcgcgcuugcgca

SEQ ID NO: 3206 - RNA, 24 nt, Bovine herpesvirus 4
uauaaccuccgaaguacgggacca

SEQ ID NO: 3207 - RNA, 24 nt, Tupaia herpesvirus
cacccgugagggaggagucgugag

SEQ ID NO: 3208 - RNA, 24 nt, Marburg virus
uauaaauaguauuuuuuucauuau

SEQ ID NO: 3209 - RNA, 24 nt, Marburg virus
uauuaaauauuaaauuaucuaaau

SEQ ID NO: 3210 - RNA, 24 nt, Marburg virus
guagaucaacuacauucauuaaaa

SEQ ID NO: 3211 - RNA, 24 nt, Bovine herpesvirus 4
acuggaugagguaaugucagugau

SEQ ID NO: 3212 - RNA, 24 nt, Bovine herpesvirus 4
uuagaauauccuaaaucugacuuu

SEQ ID NO: 3213 - RNA, 24 nt, Bovine herpesvirus 4
ucggugaagcgcaacuccaccgug

SEQ ID NO: 3214 - RNA, 22 nt, Tupaia herpesvirus
uucccagucauguacgcggaga

SEQ ID NO: 3215 - RNA, 24 nt, Bovine herpesvirus 4
uaucgcgauggaugcuacaguaaa

SEQ ID NO: 3216 - RNA, 24 nt, Bovine herpesvirus 4
uagcacuacgauuacaaugugggc

SEQ ID NO: 3217 - RNA, 24 nt, Bovine herpesvirus 4
ggcguguauacgaauaccugaagc

SEQ ID NO: 3218 - RNA, 24 nt, Tupaia herpesvirus
cgaggcuaccgagggcagucagcc

SEQ ID NO: 3219 - RNA, 24 nt, Tupaia herpesvirus
ggggaggagcggggggaggagcgg

SEQ ID NO: 3220 - RNA, 24 nt, Tupaia herpesvirus
acccguugaaaggaucugggagaa

SEQ ID NO: 3221 - RNA, 24 nt, Tupaia herpesvirus
ugggcgguuacguggcgaggucgg

SEQ ID NO: 3222 - RNA, 24 nt, Primate T-lymphotropic virus 3
gaccgggccaucucccugcuguuu

SEQ ID NO: 3223 - RNA, 24 nt, Tupaia herpesvirus
gggccggggagggcuggggccggg

SEQ ID NO: 3224 - RNA, 23 nt, Tupaia herpesvirus
uccaugaguaaugagagugccga

SEQ ID NO: 3225 - RNA, 24 nt, Tupaia herpesvirus
ggcuauggaaccgucgcuguaugg

SEQ ID NO: 3226 - RNA, 24 nt, Primate T-lymphotropic virus 3
auugucccgcacaucuuuaagguc

SEQ ID NO: 3227 - RNA, 24 nt, Primate T-lymphotropic virus 3
gcccugaaccugucguuuauagag

SEQ ID NO: 3228 - RNA, 24 nt, Bovine herpesvirus 4
aaauguauguucaaccuuuuauua

SEQ ID NO: 3229 - RNA, 24 nt, Tupaia herpesvirus
uucaauucucaacauacguugcug

SEQ ID NO: 3230 - RNA, 24 nt, Tupaia herpesvirus
aguuguuauacaaguaauacauaa

SEQ ID NO: 3231 - RNA, 24 nt, Primate T-lymphotropic virus 3
uuaauuuaaaagaauuagauuguu

SEQ ID NO: 3232 - RNA, 24 nt, Primate T-lymphotropic virus 3
uuacugcagaugggcucacuggaa

SEQ ID NO: 3233 - RNA, 24 nt, Primate T-lymphotropic virus 3
agccguuaacgccgcuaagccuag

SEQ ID NO: 3234 - RNA, 24 nt, Primate T-lymphotropic virus 3
acuggugucccauaauaaagugua

SEQ ID NO: 3235 - RNA, 24 nt, Bovine herpesvirus 4
uguuagggauggucuacaagaaua

SEQ ID NO: 3236 - RNA, 22 nt, Primate T-lymphotropic virus 3
ccccccggucacguucagguuc

SEQ ID NO: 3237 - RNA, 24 nt, Meleagrid herpesvirus 1
uaaccugucacuucacuccaacag

SEQ ID NO: 3238 - RNA, 24 nt, Meleagrid herpesvirus 1
uucgugauagaacggacggugacu

SEQ ID NO: 3239 - RNA, 24 nt, Meleagrid herpesvirus 1
uagaugacgcggaacacauaucuc

SEQ ID NO: 3240 - RNA, 24 nt, Meleagrid herpesvirus 1
uauuguuuuaaauuuuaaguuaga

SEQ ID NO: 3241 - RNA, 22 nt, Meleagrid herpesvirus 1
uaggugccgcugggugcgaaau

SEQ ID NO: 3242 - RNA, 24 nt, Meleagrid herpesvirus 1
gcagaguaucauauagagaaugcg

SEQ ID NO: 3243 - RNA, 24 nt, Poliovirus
uguuguagccgguggcgaacucgg

SEQ ID NO: 3244 - RNA, 24 nt, Equine arteritis virus
gggaaaacggcgaggguagaaacg

SEQ ID NO: 3245 - RNA, 24 nt, Equine arteritis virus
aagaguccgggcccaucagcccag

SEQ ID NO: 3246 - RNA, 24 nt, Equine arteritis virus
acgaagagaauauauguuauguga

SEQ ID NO: 3247 - RNA, 24 nt, Equine arteritis virus
cguuguggggccccgggccggggc

SEQ ID NO: 3248 - RNA, 24 nt, Equine arteritis virus
acgccccuuggccgccccggcugc

SEQ ID NO: 3249 - RNA, 24 nt, Equine arteritis virus
ugagugcgcgcgccggcucugcgg

SEQ ID NO: 3250 - RNA, 24 nt, Amsacta moorei entomopoxvirus
ucguuguaggcuugugauagauga

SEQ ID NO: 3251 - RNA, 24 nt, Equine arteritis virus
aagcggcggggcgguucggggggg

SEQ ID NO: 3252 - RNA, 20 nt, Amsacta moorei entomopoxvirus
uuugauauuucuuuuaaaac

SEQ ID NO: 3253 - RNA, 24 nt, Amsacta moorei entomopoxvirus
uaacgcgagaaaggcgucggaguc

SEQ ID NO: 3254 - RNA, 24 nt, Amsacta moorei entomopoxvirus
uaugaaaugggcgggauacuaucu

SEQ ID NO: 3255 - RNA, 24 nt, Amsacta moorei entomopoxvirus
uauuccacuguccccuuuucucua

SEQ ID NO: 3256 - RNA, 24 nt, Amsacta moorei entomopoxvirus
ucugacgucucucccuacccuggc

SEQ ID NO: 3257 - RNA, 24 nt, Ictalurid herpesvirus 1
cagcggcuucuguuugcgcaacaa

SEQ ID NO: 3258 - RNA, 24 nt, Amsacta moorei entomopoxvirus
uaauuuauauuaagaauaucaaau

SEQ ID NO: 3259 - RNA, 24 nt, Amsacta moorei entomopoxvirus
uaugugacguuuccggaauaaaaa

SEQ ID NO: 3260 - RNA, 20 nt, Amsacta moorei entomopoxvirus
uaucucgacacgcgcacgac

SEQ ID NO: 3261 - RNA, 24 nt, Amsacta moorei entomopoxvirus
uugcuaaugcguaaaccugcccca

SEQ ID NO: 3262 - RNA, 24 nt, Ictalurid herpesvirus 1
ggaguggggucgacggcccgagga

SEQ ID NO: 3263 - RNA, 24 nt, Ictalurid herpesvirus 1
uaaguuauuuuacuauugagccac

SEQ ID NO: 3264 - RNA, 24 nt, Ictalurid herpesvirus 1
uaugucaauacaacagucaauguu

SEQ ID NO: 3265 - RNA, 24 nt, Ictalurid herpesvirus 1
gugcguuauauaaccagaacaagc

SEQ ID NO: 3266 - RNA, 22 nt, Amsacta moorei entomopoxvirus
caucgauggacgcguugucagc

SEQ ID NO: 3267 - RNA, 24 nt, Ictalurid herpesvirus 1
cgaaaguucucaccacacccacuu

SEQ ID NO: 3268 - RNA, 24 nt, Ictalurid herpesvirus 1
ugaccgugugugaaacgaccgcuc

SEQ ID NO: 3269 - RNA, 24 nt, Ictalurid herpesvirus 1
uaucuguauaaacugcaccuguua

SEQ ID NO: 3270 - RNA, 24 nt, Ictalurid herpesvirus 1
uguggagguaagagcucccggggg

SEQ ID NO: 3271 - RNA, 24 nt, Ictalurid herpesvirus 1
ucuuggguuaaacucaucaccgcg

SEQ ID NO: 3272 - RNA, 24 nt, Human enterovirus B
uucgacagcagcgccgcgcgcccc

SEQ ID NO: 3273 - RNA, 24 nt, Human enterovirus B
caucaugccaucacgaucagcagc

SEQ ID NO: 3274 - RNA, 24 nt, Human enterovirus B
acuacgauauacuaguguuggacg

SEQ ID NO: 3275 - RNA, 24 nt, Human enterovirus B
acguugggugacucugucgaucca

SEQ ID NO: 3276 - RNA, 24 nt, Human enterovirus B
ucugcaccaccaaugauuacacug

SEQ ID NO: 3277 - RNA, 24 nt, Human enterovirus B
agucauugucggcacuccacccau

SEQ ID NO: 3278 - RNA, 24 nt, Human herpesvirus 4
uaguauauaaggauaguuucuaga

SEQ ID NO: 3279 - RNA, 24 nt, Human herpesvirus 4
agggagacaucuagugauauaagu

SEQ ID NO: 3280 - RNA, 24 nt, Human herpesvirus 4
cacuauggcgcgucgauggucccu

SEQ ID NO: 3281 - RNA, 24 nt, Ectromelia virus
ugaaaauaucauuaaauuguuuua

SEQ ID NO: 3282 - RNA, 24 nt, Human herpesvirus 4
ugaagaaccucgugacccaaauac

SEQ ID NO: 3283 - RNA, 24 nt, Human herpesvirus 4
uggcacgacuguuccuauaugcuc

SEQ ID NO: 3284 - RNA, 24 nt, Human herpesvirus 4
caagcaagaguggcuaaugucugc

SEQ ID NO: 3285 - RNA, 24 nt, Human herpesvirus 4
aaagaggucuucaucgcacaucgc

SEQ ID NO: 3286 - RNA, 23 nt, Human herpesvirus 4
uaacggcaaugauauuuauagug

SEQ ID NO: 3287 - RNA, 24 nt, Human papillomavirus type 86
uggagagcuuauauugggggaaaa

SEQ ID NO: 3288 - RNA, 24 nt, Human papillomavirus type 86
uacaggaaaaugacgaagaugaag

SEQ ID NO: 3289 - RNA, 24 nt, Amsacta moorei entomopoxvirus
uuaaagguaagaguuaugacgcau

SEQ ID NO: 3290 - RNA, 24 nt, Human papillomavirus type 86
uauuuuggguucuggcuacuguau

SEQ ID NO: 3291 - RNA, 24 nt, Zaire Ebola virus
uaaagauuucaaagauguuuucug

SEQ ID NO: 3292 - RNA, 24 nt, Parvovirus H1
uuauuguuauuuaaaauaauucua

SEQ ID NO: 3293 - RNA, 24 nt, Parvovirus H1
uugaauguauuauugauuuuauua

SEQ ID NO: 3294 - RNA, 24 nt, Parvovirus H1
ucauuaauaauauuuuuaaauuua

SEQ ID NO: 3295 - RNA, 24 nt, Parvovirus H1
uauagauuuaauauuuguuuauca

SEQ ID NO: 3296 - RNA, 24 nt, Parvovirus H1
uauauaauuuuuaauauaauuagu

SEQ ID NO: 3297 - RNA, 24 nt, Parvovirus H1
uauauauucuauuucgcuuaaaau

SEQ ID NO: 3298 - RNA, 24 nt, Human papillomavirus type 86
uccaccugccuucuuucaaucaau

SEQ ID NO: 3299 - RNA, 24 nt, Zaire Ebola virus
ugaguauuuggauuuggaaaagaa

SEQ ID NO: 3300 - RNA, 24 nt, Parvovirus H1
uauuagauauuauauuaauuucau

SEQ ID NO: 3301 - RNA, 24 nt, Parvovirus H1
aagaugauagauguguauuaauuu

SEQ ID NO: 3302 - RNA, 24 nt, Parvovirus H1
ucauguauauaauuuuuuauauuu

SEQ ID NO: 3303 - RNA, 24 nt, Canine adenovirus
ugaaaaagcuucuguuuaugcaug

SEQ ID NO: 3304 - RNA, 22 nt, Hepatitis A virus
ugagaacaaccacaauaagagc

SEQ ID NO: 3305 - RNA, 24 nt, Human herpesvirus 1
uacuucgccgccgcgacccgccac

SEQ ID NO: 3306 - RNA, 24 nt, Fowl adenovirus D
cuccgaauaccugucgaaucuccu

SEQ ID NO: 3307 - RNA, 24 nt, Beet yellows virus
agaggaaucaucggaagcugaacu

SEQ ID NO: 3308 - RNA, 24 nt, Beet yellows virus
ucgaaaacggaguccaacuagugu

SEQ ID NO: 3309 - RNA, 24 nt, Marburg virus
uguagaauuaccguggaucacaac

SEQ ID NO: 3310 - RNA, 24 nt, Camelpox virus
uccaaguauuaauucguuacagau

SEQ ID NO: 3311 - RNA, 22 nt, Human herpesvirus 1
ggggaggagcggggggaggagc

SEQ ID NO: 3312 - RNA, 24 nt, Human herpesvirus 1
agacgccgaaaacgggcccccccc

SEQ ID NO: 3313 - RNA, 24 nt, Meleagrid herpesvirus 1
uaccguaucuaauuccgaggauga

SEQ ID NO: 3314 - RNA, 24 nt, Amsacta moorei entomopoxvirus
uauuauauaauauuuuauaaaauu

SEQ ID NO: 3315 - RNA, 22 nt, Paramecium bursaria Chlorella virus 1
uacagcaccagguucuccacac

SEQ ID NO: 3316 - RNA, 24 nt, Human herpesvirus 1
cgggcggcgugcgcgcgcgcggcg

SEQ ID NO: 3317 - RNA, 24 nt, Tupaia herpesvirus
ggggaggagcggggggaggagcgg

SEQ ID NO: 3318 - RNA, 24 nt, Paramecium bursaria Chlorella virus 1
ugacaccgggcggcccuuagugau

SEQ ID NO: 3319 - RNA, 24 nt, Amsacta moorei entomopoxvirus
uauuacagauucuauagauuuaau

SEQ ID NO: 3320 - RNA, 24 nt, Parsnip yellow fleck virus
aaagugaaggacccgggccaaggc

SEQ ID NO: 3321 - RNA, 22 nt, Myxoma virus
uuuuuugauuuagcugcacccg

SEQ ID NO: 3322 - RNA, 24 nt, Variola virus
uaacaucguaaucaaaagaauugc

SEQ ID NO: 3323 - RNA, 24 nt, Cowpox virus
ucaguauuuuuggaaucauaaaaa

SEQ ID NO: 3324 - RNA, 24 nt, Yellow fever virus
ucugcuuuuccuccagaggucugu

SEQ ID NO: 3325 - RNA, 24 nt, Macaca mulatta rhadinovirus
ugugcacaccuuuccgcgguucac

SEQ ID NO: 3326 - RNA, 24 nt, Paramecium bursaria Chlorella virus 1
acccugcguuuuuucuucguaaaa

SEQ ID NO: 3327 - RNA, 24 nt, Human papillomavirus type 20
aagaagcugugcuacuauauuuug

SEQ ID NO: 3328 - RNA, 24 nt, Human adenovirus A
uaccuuauacuggacuagugccaa

SEQ ID NO: 3329 - RNA, 24 nt, Ateline herpesvirus 3
uguuuguauguagugcuuucuuug

SEQ ID NO: 3330 - RNA, 24 nt, Fowl adenovirus D
acccugcucgggcuggguaccagc

SEQ ID NO: 3331 - RNA, 24 nt, Paramecium bursaria Chlorella virus 1
uaucuaguucguugaaguaugcaa

SEQ ID NO: 3332 - RNA, 17 nt, Paramecium bursaria Chlorella virus 1
cacuauguguaaauuac

SEQ ID NO: 3333 - RNA, 24 nt, Human papillomavirus type 20
ugccuguauuagcugugucagaag

SEQ ID NO: 3334 - RNA, 24 nt, Human adenovirus A
ugaggaaguggggcgcggcguggg

SEQ ID NO: 3335 - RNA, 24 nt, Citrus tristeza virus
uagugcuuuacuaaaagauaauac

SEQ ID NO: 3336 - RNA, 24 nt, Citrus tristeza virus
uaacguugacgauucucgaugcgg

SEQ ID NO: 3337 - RNA, 24 nt, Melanoplus sanguinipes entomopoxvirus
ucaaaaauaucaauaucuaauacc

SEQ ID NO: 3338 - RNA, 24 nt, Sulfolobus virus SIRV-1
uaugaugaacaaguuuuuuuuacu

SEQ ID NO: 3339 - RNA, 24 nt, Human papillomavirus type 36
accaguauagaaacuuuuagaagc

SEQ ID NO: 3340 - RNA, 24 nt, Variola virus
uauauuauaaaaaaguuuuugauu

SEQ ID NO: 3341 - RNA, 24 nt, Melanoplus sanguinipes entomopoxvirus
ugauauguuaaaauaucaauaaug

SEQ ID NO: 3342 - RNA, 24 nt, Amsacta moorei entomopoxvirus
uaaauuuuuauauuauaacaauau

SEQ ID NO: 3343 - RNA, 24 nt, Amsacta moorei entomopoxvirus
uaaauuguucauauacaaucauug

SEQ ID NO: 3344 - RNA, 24 nt, Rat cytomegalovirus
acggaggaaacgaagaaugcaaca

SEQ ID NO: 3345 - RNA, 24 nt, Shallot virus X
uguuuugacuguggugccuacuua

SEQ ID NO: 3346 - RNA, 19 nt, Cryphonectria hypovirus 1
ugaggcccuuguaguaacc

SEQ ID NO: 3347 - RNA, 24 nt, Gallid herpesvirus 2
uguuaaaauuuuagcugagaagua

SEQ ID NO: 3348 - RNA, 24 nt, Garlic virus A
aagcucaucucuucuucacuugcg

SEQ ID NO: 3349 - RNA, 24 nt, Rabbit fibroma virus
uuaauggucucgauguaaucgucg

SEQ ID NO: 3350 - RNA, 24 nt, Amsacta moorei entomopoxvirus
ucuguuaucgaagugggaagauuu

SEQ ID NO: 3351 - RNA, 22 nt, Equine herpesvirus 4
uaucgcgcacaggacagcgacg

SEQ ID NO: 3352 - RNA, 20 nt, Louping ill virus
cacccgacgcaccauccaug

SEQ ID NO: 3353 - RNA, 24 nt, Gallid herpesvirus 2
uagguuccucgauuuacaucaaau

SEQ ID NO: 3354 - RNA, 24 nt, Human herpesvirus 2
uacaguggcugcggcgacgacccc

SEQ ID NO: 3355 - RNA, 24 nt, Ictalurid herpesvirus 1
uacaguguuccauucguacuguac

SEQ ID NO: 3356 - RNA, 24 nt, Louping ill virus
ugacaaggaggugaugugugacuc

SEQ ID NO: 3357 - RNA, 24 nt, Sulfolobus virus SIRV-2
aaguauucuucacuguagacaugu

SEQ ID NO: 3358 - RNA, 17 nt, Ictalurid herpesvirus 1
ugugauccuccuccggu

SEQ ID NO: 3359 - RNA, 24 nt, Marburg virus
cuugaacacaauucuacuaacuuc

SEQ ID NO: 3360 - RNA, 24 nt, Fowlpox virus
uauaaaacuagguaaucuauacac

SEQ ID NO: 3361 - RNA, 24 nt, Reston Ebola virus
aggaagauuaagaaaaaggccucg

SEQ ID NO: 3362 - RNA, 24 nt, Bovine herpesvirus 4
gucauuuuuaaucagccccguuaa

SEQ ID NO: 3363 - RNA, 24 nt, Human herpesvirus 1
acacaaucacccguccgugguuuc

SEQ ID NO: 3364 - RNA, 24 nt, Sheeppox virus
uauuuauuaaauauagacgauccc

SEQ ID NO: 3365 - RNA, 24 nt, Alcelaphine herpesvirus 1
aagcugacagagucccugggugcg

SEQ ID NO: 3366 - RNA, 24 nt, Ectromelia virus
uaacaugguaacuggaauagagau

SEQ ID NO: 3367 - RNA, 24 nt, Infectious spleen and kidney necrosis virus
ugacagguaucuacuggacuuuuc

SEQ ID NO: 3368 - RNA, 24 nt, Monkeypox virus
uagaguauaaugauuuaguuacuu

SEQ ID NO: 3369 - RNA, 24 nt, Fowlpox virus
uguuauauuaagucaaucuaauca

SEQ ID NO: 3370 - RNA, 24 nt, Human adenovirus D
cgaggagaacugcuggcccugcug

SEQ ID NO: 3371 - RNA, 24 nt, Rhopalosiphum padi virus
uccaccaagcccuggaaaucucua

SEQ ID NO: 3372 - RNA, 24 nt, Vaccinia virus
uauuucauauacuauuuauaagau

SEQ ID NO: 3373 - RNA, 24 nt, Hepatitis GB virus C
ugguggaugggugaugacaggguu

SEQ ID NO: 3374 - RNA, 24 nt, Infectious spleen and kidney necrosis virus
uggcggcaaaugauuacauuacau

SEQ ID NO: 3375 - RNA, 24 nt, Infectious spleen and kidney necrosis virus
uguggacaacgagcugacgcugac

SEQ ID NO: 3376 - RNA, 24 nt, Hepatitis GB virus A
ccagcacaggugguaaucgcuaua

SEQ ID NO: 3377 - RNA, 24 nt, Hepatitis GB virus A
ccuccggugugaauaagcccucgu

SEQ ID NO: 3378 - RNA, 24 nt, Hepatitis GB virus A
uauggcaacgccgcuuaaaacccu

SEQ ID NO: 3379 - RNA, 24 nt, Hepatitis GB virus A
guggcauucccucccuuagcagca

SEQ ID NO: 3380 - RNA, 24 nt, Diatraea saccharalis densovirus
cgacgggaguuugcggucaagcga

SEQ ID NO: 3381 - RNA, 24 nt, Lymphocystis disease virus 1
accauaaauaaugucguuguuuua

SEQ ID NO: 3382 - RNA, 24 nt, Bovine herpesvirus 4
uaacugcagaugaaaaauaaaaua

SEQ ID NO: 3383 - RNA, 24 nt, Variola virus
aggcauggacauacuaauaucugu

SEQ ID NO: 3384 - RNA, 24 nt, Alcelaphine herpesvirus 1
ugugaggaucuaacucuaaguuga

SEQ ID NO: 3385 - RNA, 24 nt, Rhopalosiphum padi virus
uaauaggcccuggaaauuguuaau

SEQ ID NO: 3386 - RNA, 24 nt, Rhopalosiphum padi virus
uauguaauagucucaucacuaacc

SEQ ID NO: 3387 - RNA, 24 nt, Camelpox virus
ccgcagcacaaugaaccaacacgg

SEQ ID NO: 3388 - RNA, 24 nt, Human adenovirus D
cagccgcagccgccaugacagcga

SEQ ID NO: 3389 - RNA, 24 nt, Vaccinia virus
caauguauauuuauccaucgucaa

SEQ ID NO: 3390 - RNA, 24 nt, Camelpox virus
ucccucauagaaugauacacguau

SEQ ID NO: 3391 - RNA, 24 nt, Camelpox virus
ccgcagcacaaugaaccaacacgg

SEQ ID NO: 3392 - RNA, 24 nt, Ectromelia virus
ccgcagcacaaugaaccaacacag

SEQ ID NO: 3393 - RNA, 24 nt, Variola virus
uaccucauaaaacaaaaaagcuau

SEQ ID NO: 3394 - RNA, 24 nt, Y73 sarcoma virus
uuggcuggcauacggaauauagga

SEQ ID NO: 3395 - RNA, 24 nt, Y73 sarcoma virus
uagcauguauaggcgaaaagcggg

SEQ ID NO: 3396 - RNA, 24 nt, Variola virus
ucccgcaacacaaugaaccaacac

SEQ ID NO: 3397 - RNA, 24 nt, Variola virus
ugcgaucagauauuugcuaauaau

SEQ ID NO: 3398 - RNA, 24 nt, Equine infectious anemia virus
uaaaugauuauaagaguaaaaaga

SEQ ID NO: 3399 - RNA, 24 nt, Human papillomavirus type 29
gcuaaagcuaaagcaugcagugcu

SEQ ID NO: 3400 - RNA, 17 nt, Bovine papillomavirus
uaugucagaaccuaaac

SEQ ID NO: 3401 - RNA, 24 nt, Soil-borne cereal mosaic virus
uaugcauugugguuuuguugugug

SEQ ID NO: 3402 - RNA, 24 nt, Soil-borne cereal mosaic virus
uacgggucgaguacaaacguggcc

SEQ ID NO: 3403 - RNA, 24 nt, Soil-borne cereal mosaic virus
guucuguuuuucgaacagauguaa

SEQ ID NO: 3404 - RNA, 24 nt, Equine infectious anemia virus
ucccugucucuaguuugucuguuc

SEQ ID NO: 3405 - RNA, 24 nt, Phocoena spinipinnis papillomavirus
ugagagcaaucugauggaauauau

SEQ ID NO: 3406 - RNA, 24 nt, Equine herpesvirus 4
uugcugcaugcacgcgacaaacac

SEQ ID NO: 3407 - RNA, 24 nt, Variola virus
uauacaguauaaugauuuaguuac

SEQ ID NO: 3408 - RNA, 24 nt, Human papillomavirus type 70
uauuaugugcacgagcagcauaag

SEQ ID NO: 3409 - RNA, 17 nt, Human herpesvirus 6
ccgcugcgagacgcgug

SEQ ID NO: 3410 - RNA, 24 nt, Cowpox virus
ucaguauuuuuggaaucauaaaaa

SEQ ID NO: 3411 - RNA, 24 nt, Meleagrid herpesvirus 1
uaaacagccccgauuugacagguu

SEQ ID NO: 3412 - RNA, 22 nt, Paramecium bursaria Chlorella virus 1
uacaucaguugacaccgugugu

SEQ ID NO: 3413 - RNA, 24 nt, Equine herpesvirus 4
caacggugccccuuuaucgccgua

SEQ ID NO: 3414 - RNA, 20 nt, Human herpesvirus 2
cgggacccgcgcgccugccu

SEQ ID NO: 3415 - RNA, 22 nt, Human papillomavirus type 70
uguuacaguggaggugugguac

SEQ ID NO: 3416 - RNA, 24 nt, Ovine lentivirus
ugcugggggacaggaggaggguuc

SEQ ID NO: 3417 - RNA, 24 nt, Meleagrid herpesvirus 1
ugucaaaucggggcuguuuaugcu

SEQ ID NO: 3418 - RNA, 24 nt, Friend murine leukemia virus
gcccggggccaagaacagaugguc

SEQ ID NO: 3419 - RNA, 24 nt, Meleagrid herpesvirus 1
ugucaaaucggggcuauuuaugcu

SEQ ID NO: 3420 - RNA, 20 nt, Gallid herpesvirus 3
aagcaccccgcgaaggagga

SEQ ID NO: 3421 - RNA, 24 nt, Rat cytomegalovirus
aggaggcggcagaggaggccggag

SEQ ID NO: 3422 - RNA, 24 nt, Human herpesvirus 1
uggaaacuugccggucgccgugcu

SEQ ID NO: 3423 - RNA, 24 nt, Chimpanzee cytomegalovirus
ggacaugacgcgcccaagacacgu

SEQ ID NO: 3424 - RNA, 18 nt, Human herpesvirus 6
uuccuguaaaagaaaaac

SEQ ID NO: 3425 - RNA, 24 nt, Myxoma virus
uuuagacuuugucgauuuucuacc

SEQ ID NO: 3426 - RNA, 24 nt, Human papillomavirus type 55
uaagauaugaauguguguuauuac

SEQ ID NO: 3427 - RNA, 24 nt, Melanoplus sanguinipes entomopoxvirus
uucauauaauuuuaauauuucaga

SEQ ID NO: 3428 - RNA, 24 nt, Rat cytomegalovirus
uccgucaccgggagggucguuguu

SEQ ID NO: 3429 - RNA, 23 nt, Melanoplus sanguinipes entomopoxvirus
ugaaauuuuauaaauaaaaauaa

SEQ ID NO: 3430 - RNA, 24 nt, Fowlpox virus
ucuuuuaauaugaauuacuucacu

SEQ ID NO: 3431 - RNA, 24 nt, Amsacta moorei entomopoxvirus
uauaauauauaauauaucuuauaa

SEQ ID NO: 3432 - RNA, 21 nt, Tupaia herpesvirus
cgcaagcacggucacgucggc

SEQ ID NO: 3433 - RNA, 20 nt, Chinese wheat mosaic virus
uggauucgguaaccaggaua

SEQ ID NO: 3434 - RNA, 24 nt, Variola virus
aacacuacuuugguuagauguuuu

SEQ ID NO: 3435 - RNA, 24 nt, Camelpox virus
ugggaauaaaauacuacuguugag

SEQ ID NO: 3436 - RNA, 24 nt, Rat cytomegalovirus
cucccgcccgcgaccccggcgcgg

SEQ ID NO: 3437 - RNA, 24 nt, Peanut clump virus
uguaggaaaagaagaguucguucg

SEQ ID NO: 3438 - RNA, 24 nt, Human coronavirus 229E
uggcagagcugcucuuauaguguu

SEQ ID NO: 3439 - RNA, 24 nt, Paramecium bursaria Chlorella virus 1
cggaaauaaaagaccgcauaacag

SEQ ID NO: 3440 - RNA, 24 nt, Human papillomavirus type 60
uacauguucauacaaaguuuugac

SEQ ID NO: 3441 - RNA, 24 nt, Cowpox virus
uguauuggcuuagaaaacuauuac

SEQ ID NO: 3442 - RNA, 24 nt, Bovine adenovirus B
aaaaagcacuuuugccacagagcg

SEQ ID NO: 3443 - RNA, 24 nt, Human coronavirus 229E
uuagugcugaaguuucacgacagg

SEQ ID NO: 3444 - RNA, 24 nt, Human papillomavirus type 60
aacugguuaaaaaagagcgccaaa

SEQ ID NO: 3445 - RNA, 24 nt, Camelpox virus
ugggaauaaaauacuacuguugag

SEQ ID NO: 3446 - RNA, 24 nt, Peanut clump virus
ucuguguuuaccacucgugacgac

SEQ ID NO: 3447 - RNA, 24 nt, Human coronavirus 229E
ugcuguauuggucucaagcauaua

SEQ ID NO: 3448 - RNA, 24 nt, Human papillomavirus type 53
accauuguguuguguguuaguuuu

SEQ ID NO: 3449 - RNA, 24 nt, Human herpesvirus 6B
uauuguguaccuuguaaucucuag

SEQ ID NO: 3450 - RNA, 24 nt, Human herpesvirus 2
ugccgcagaccaccucgcggcggc

SEQ ID NO: 3451 - RNA, 24 nt, Human herpesvirus 6B
gggaagguuuguaaggacaaagga

SEQ ID NO: 3452 - RNA, 24 nt, Variola virus
uuagugacgaaucaagagaugaaa

SEQ ID NO: 3453 - RNA, 24 nt, Dengue virus type 4
ucucugcaacaucaauccaggcac

SEQ ID NO: 3454 - RNA, 24 nt, Garlic latent virus
uaagagcauaggucggugcccucg

SEQ ID NO: 3455 - RNA, 24 nt, Gallid herpesvirus 2
uaauguagcuauuggaggauggag

SEQ ID NO: 3456 - RNA, 24 nt, Grapevine trichovirus B
ugaguugucugguuaggagggagu

SEQ ID NO: 3457 - RNA, 24 nt, Rat cytomegalovirus
acggacagaucgagacggaccagg

SEQ ID NO: 3458 - RNA, 18 nt, Rabbit oral papillomavirus
uuacucaggcgauuguug

SEQ ID NO: 3459 - RNA, 24 nt, Equine herpesvirus 1
uucacgggcccgcgcccgagagag

SEQ ID NO: 3460 - RNA, 22 nt, Paramecium bursaria Chlorella virus 1
ucaacgucauuucgauuauuuc

SEQ ID NO: 3461 - RNA, 24 nt, Tupaia herpesvirus
uuaacggugguuuguacgauagaa

SEQ ID NO: 3462 - RNA, 24 nt, Apple latent spherical virus
uauuacguuuuguuguuugaaucu

SEQ ID NO: 3463 - RNA, 24 nt, Grapevine trichovirus B
agagguaaucgagcgguugguuaa

SEQ ID NO: 3464 - RNA, 22 nt, Pestivirus Giraffe-1
uaggacuagcaaaaaaucgggg

SEQ ID NO: 3465 - RNA, 19 nt, Fowlpox virus
uaucaaagaaccuuaugau

SEQ ID NO: 3466 - RNA, 24 nt, Chimpanzee cytomegalovirus
agccagaagcggcccucgcagacg

SEQ ID NO: 3467 - RNA, 24 nt, Avian sarcoma virus
ucccugacgacuacgaacaccuaa

SEQ ID NO: 3468 - RNA, 24 nt, Rous sarcoma virus
ucccuaacgauugcgaacaccuga

SEQ ID NO: 3469 - RNA, 24 nt, Alcelaphine herpesvirus 1
uuaguaguuugucccuuugauggu

SEQ ID NO: 3470 - RNA, 24 nt, Avian carcinoma virus
cgucggagggagcuccacggccgg

SEQ ID NO: 3471 - RNA, 24 nt, Paramecium bursaria Chlorella virus 1
ucgaaucuugucacguuuagaucu

SEQ ID NO: 3472 - RNA, 24 nt, Chimpanzee cytomegalovirus
ggaguggcgaaccggcgucauuau

SEQ ID NO: 3473 - RNA, 24 nt, Avian sarcoma virus
uacccuaccgagcacucagagagu

SEQ ID NO: 3474 - RNA, 24 nt, Tupaia paramyxovirus
uucacuugcucuuucacuauccca

SEQ ID NO: 3475 - RNA, 24 nt, Fujinami sarcoma virus
gcgaacaccugaaugaagcggaag

SEQ ID NO: 3476 - RNA, 24 nt, Alcelaphine herpesvirus 1
ugagaggaaccacagaacaucaaa

SEQ ID NO: 3477 - RNA, 24 nt, Paramecium bursaria Chlorella virus 1
uucaaagugucuacguuagacgau

SEQ ID NO: 3478 - RNA, 24 nt, Paramecium bursaria Chlorella virus 1
uaucguagcaacauugguuguaac

SEQ ID NO: 3479 - RNA, 24 nt, Fowlpox virus
uaaagaacuaugcaauauauuagg

SEQ ID NO: 3480 - RNA, 24 nt, Yaba-like disease virus
gacuauguauugguagcuccuguc

SEQ ID NO: 3481 - RNA, 21 nt, Yaba-like disease virus
ugagcaggaguugcgcuuuuc

SEQ ID NO: 3482 - RNA, 24 nt, Yaba-like disease virus
ugaaggccuuagaucugagcuugg

SEQ ID NO: 3483 - RNA, 24 nt, Yaba-like disease virus
ugauagugacagauaguaauuaug

SEQ ID NO: 3484 - RNA, 24 nt, Yaba-like disease virus
uugcccaagugcaacaccgugucc

SEQ ID NO: 3485 - RNA, 24 nt, Yaba-like disease virus
uaaaacaucaaugucgcaauuugu

SEQ ID NO: 3486 - RNA, 24 nt, Yaba-like disease virus
acugugauggggcagccuacuccg

SEQ ID NO: 3487 - RNA, 24 nt, Yaba-like disease virus
aaagaugagaguugaaaugcuaca

SEQ ID NO: 3488 - RNA, 24 nt, Yaba-like disease virus
gaucggcagacccccucucccccu

SEQ ID NO: 3489 - RNA, 24 nt, Yaba-like disease virus
ccugacagcugucaaccuaauccu

SEQ ID NO: 3490 - RNA, 24 nt, Yaba-like disease virus
cagcagaugucguagacaucuuga

SEQ ID NO: 3491 - RNA, 24 nt, Yaba-like disease virus
uuugccagcgguuguagauuuauc

SEQ ID NO: 3492 - RNA, 24 nt, Yaba-like disease virus
aaggguacucucaucaccaaugua

SEQ ID NO: 3493 - RNA, 24 nt, Yaba-like disease virus
uagcagauaaacaagcuguuucag

SEQ ID NO: 3494 - RNA, 24 nt, Yaba-like disease virus
auagagaaauuguaccuguauaug

SEQ ID NO: 3495 - RNA, 24 nt, Human papillomavirus type 29
uaagauauguuuauucauaaacgc

SEQ ID NO: 3496 - RNA, 24 nt, Yaba-like disease virus
uaaacuguucuaauuguauacuua

SEQ ID NO: 3497 - RNA, 24 nt, Yaba-like disease virus
uuugaucgaguucgucgcuacuau

SEQ ID NO: 3498 - RNA, 24 nt, Yaba-like disease virus
uuugccagaaacaggucaaguauc

SEQ ID NO: 3499 - RNA, 23 nt, Yaba-like disease virus
ucuuacggaccagccucucccag

SEQ ID NO: 3500 - RNA, 24 nt, Variola virus
uauuauuuauaacugauguaaccc

SEQ ID NO: 3501 - RNA, 24 nt, Variola virus
ugcuguuggggcgcaagagcgaca

SEQ ID NO: 3502 - RNA, 24 nt, Variola virus
ugugauggggcagccuacuccgaa

SEQ ID NO: 3503 - RNA, 24 nt, Variola virus
acgcgcuccucaacgccacgacgu

SEQ ID NO: 3504 - RNA, 24 nt, Human papillomavirus type 29
uaagauauguuuauucauaaacgc

SEQ ID NO: 3505 - RNA, 24 nt, Human papillomavirus type 29
uaagaauuuagauacaucuauauu

SEQ ID NO: 3506 - RNA, 24 nt, Human papillomavirus type 84
uccaaaauucuuaauagaaauuua

SEQ ID NO: 3507 - RNA, 18 nt, Human papillomavirus type 84
uccacaacaacucugcgg

SEQ ID NO: 3508 - RNA, 24 nt, Human papillomavirus type 84
agacaggaacuguacagacauugg

SEQ ID NO: 3509 - RNA, 24 nt, Human papillomavirus type 84
ucccaagauucgggaugccacagg

SEQ ID NO: 3510 - RNA, 24 nt, Human papillomavirus type 29
cucgccuccgaggucaucccaggu

SEQ ID NO: 3511 - RNA, 24 nt, Variola virus
uggcgucggccgguggccuaccug

SEQ ID NO: 3512 - RNA, 23 nt, Variola virus
ucuuacggaucagccucucccag

SEQ ID NO: 3513 - RNA, 24 nt, Human papillomavirus type 84
cggcaccccaaacuccguagccac

SEQ ID NO: 3514 - RNA, 24 nt, Human papillomavirus type 84
uuugagcguggugauguaggucuu

SEQ ID NO: 3515 - RNA, 24 nt, Human papillomavirus type 84
ugagaaagcggugaauucccucua

SEQ ID NO: 3516 - RNA, 24 nt, Human papillomavirus type 84
cagcacccagacuugauccugcua

SEQ ID NO: 3517 - RNA, 24 nt, Human papillomavirus type 84
ugaaagguuacucgguugaacaga

SEQ ID NO: 3518 - RNA, 24 nt, Human papillomavirus type 29
agggauagaucuugcaaguuaaau

SEQ ID NO: 3519 - RNA, 24 nt, Human papillomavirus type 29
uuuggcuugagcaccgaucauuug

SEQ ID NO: 3520 - RNA, 24 nt, Human papillomavirus type 29
uuuauaguuuauagacauuuggga

SEQ ID NO: 3521 - RNA, 24 nt, Human papillomavirus type 29
uaagauauguuuauucauaaacgc

SEQ ID NO: 3522 - RNA, 24 nt, Human papillomavirus type 29
acgcgucguuaacucgucgguuaa

SEQ ID NO: 3523 - RNA, 24 nt, Human papillomavirus type 29
uaagaauuuagauacaucuauauu

SEQ ID NO: 3524 - RNA, 24 nt, Human papillomavirus type 29
uauaugacauaauaaauugguaaa

SEQ ID NO: 3525 - RNA, 24 nt, Human papillomavirus type 29
cuaaagcaguugccgauuuauuug

SEQ ID NO: 3526 - RNA, 23 nt, Human papillomavirus type 29
ccgguccagaucgcggucgcccg

SEQ ID NO: 3527 - RNA, 24 nt, Human papillomavirus type 29
ugaaagaaguuacuguuggugauc

SEQ ID NO: 3528 - RNA, 24 nt, Human papillomavirus type 29
ucccugaucaucuccucaaguacu

SEQ ID NO: 3529 - RNA, 24 nt, Human herpesvirus 5
cauccgggcguucagaagaguggg

SEQ ID NO: 3530 - RNA, 24 nt, Human herpesvirus 1
uccgugcuugccuagcgaacucac

SEQ ID NO: 3531 - RNA, 24 nt, Human herpesvirus 1
agcuguugccagggugcucaugag

SEQ ID NO: 3532 - RNA, 24 nt, Human herpesvirus 1
uuaggacaaagugcgaacgcuucg

SEQ ID NO: 3533 - RNA, 24 nt, Human herpesvirus 1
uaaaccacacaaggcgguacguuu

SEQ ID NO: 3534 - RNA, 24 nt, Human herpesvirus 1
ugugaggucagccgcuucuugggc

SEQ ID NO: 3535 - RNA, 24 nt, Marburg virus
acuauggugaugcgagggcauuau

SEQ ID NO: 3536 - RNA, 24 nt, Human herpesvirus 5
aucgugcagguuaaauagaaugcu

SEQ ID NO: 3537 - RNA, 24 nt, Human herpesvirus 5
gggcagaggaaaauuuguggcuuc

SEQ ID NO: 3538 - RNA, 24 nt, Human herpesvirus 5
cgggagcucggggccguggccacg

SEQ ID NO: 3539 - RNA, 24 nt, Human herpesvirus 5
augacauugaguauuucuggaaaa

SEQ ID NO: 3540 - RNA, 19 nt, Human herpesvirus 5
uaccaggagaguaaagaag

SEQ ID NO: 3541 - RNA, 23 nt, Melanoplus sanguinipes entomopoxvirus
cggcccccucccgagcuggggcc

SEQ ID NO: 3542 - RNA, 24 nt, Melanoplus sanguinipes entomopoxvirus
ccccugaaaaagcccggccugagc

SEQ ID NO: 3543 - RNA, 24 nt, Melanoplus sanguinipes entomopoxvirus
aaggucaagccgguagcggcguuc

SEQ ID NO: 3544 - RNA, 24 nt, Melanoplus sanguinipes entomopoxvirus
ggagcuccuccaacacauggccau

SEQ ID NO: 3545 - RNA, 23 nt, Fowlpox virus
uauuugguacguaaguauguaua

SEQ ID NO: 3546 - RNA, 24 nt, Fowlpox virus
uuguggggucgugaugauauugac

SEQ ID NO: 3547 - RNA, 22 nt, Infectious hypodermal and hematopoietic necrosis virus
cagcaggccuaagaagcuccuc

SEQ ID NO: 3548 - RNA, 24 nt, Infectious hypodermal and hematopoietic necrosis virus
uagccaacaacgacauccguguac

SEQ ID NO: 3549 - RNA, 17 nt, Melanoplus sanguinipes entomopoxvirus
cccgagcuggggcccgg

SEQ ID NO: 3550 - RNA, 24 nt, Melanoplus sanguinipes entomopoxvirus
uggggcccggauccccccgguucc

SEQ ID NO: 3551 - RNA, 24 nt, Melanoplus sanguinipes entomopoxvirus
ucuaaauuuuuagguaauaauaua

SEQ ID NO: 3552 - RNA, 24 nt, Melanoplus sanguinipes entomopoxvirus
ccucaacgaacucucggaugaggu

SEQ ID NO: 3553 - RNA, 23 nt, Melanoplus sanguinipes entomopoxvirus
uaaggaaaacccaagacccucca

SEQ ID NO: 3554 - RNA, 24 nt, Infectious hypodermal and hematopoietic necrosis virus
ucgaagaacccagaaucagucaaa

SEQ ID NO: 3555 - RNA, 24 nt, Melanoplus sanguinipes entomopoxvirus
uccccggcccccucccgagcuggg

SEQ ID NO: 3556 - RNA, 18 nt, Melanoplus sanguinipes entomopoxvirus
ucgucgcaguccaccggg

SEQ ID NO: 3557 - RNA, 24 nt, Infectious hypodermal and hematopoietic necrosis virus
uagcaccgcuauccacuaugucuc

SEQ ID NO: 3558 - RNA, 24 nt, Infectious hypodermal and hematopoietic necrosis virus
gagaaugccaugcuauagucauag

SEQ ID NO: 3559 - RNA, 24 nt, Infectious hypodermal and hematopoietic necrosis virus
ucagugguuuuguuuccuugauag

SEQ ID NO: 3560 - RNA, 24 nt, Human papillomavirus type 90
uguauauauuccucuuguguugua

SEQ ID NO: 3561 - RNA, 24 nt, Human papillomavirus type 90
ucacaaaacgucugcaccgccugu

SEQ ID NO: 3562 - RNA, 24 nt, Human papillomavirus type 90
uaaguuaacagaguuuuuuauaaa

SEQ ID NO: 3563 - RNA, 24 nt, Infectious hypodermal and hematopoietic necrosis virus
gauuuuguuguauuugguugaauu

SEQ ID NO: 3564 - RNA, 18 nt, Human papillomavirus type 90
uggggucgaagacuagau

SEQ ID NO: 3565 - RNA, 22 nt, Human papillomavirus type 90
uaucagggccucgagcugcggc

SEQ ID NO: 3566 - RNA, 24 nt, Human papillomavirus type 90
cugcagcugcugcuggaaaaccga

SEQ ID NO: 3567 - RNA, 20 nt, Human papillomavirus type 90
cacacuuuugcauuggggaa

SEQ ID NO: 3568 - RNA, 23 nt, Infectious spleen and kidney necrosis virus
gcgcuccgaaaaacgacgccgcc

SEQ ID NO: 3569 - RNA, 24 nt, Equine rhinovirus 3
acggacaaaaccaguucccggacg

SEQ ID NO: 3570 - RNA, 24 nt, Equine rhinovirus 3
ugagugugguagcgcugugugagu

SEQ ID NO: 3571 - RNA, 24 nt, Infectious hypodermal and hematopoietic necrosis virus
uaccccuauccuauagguccuacc

SEQ ID NO: 3572 - RNA, 24 nt, Infectious hypodermal and hematopoietic necrosis virus
aaccuuugguggaaccuaguguua

SEQ ID NO: 3573 - RNA, 24 nt, Infectious hypodermal and hematopoietic necrosis virus
augcugcuggugugcuguaaauaa

SEQ ID NO: 3574 - RNA, 22 nt, Infectious hypodermal and hematopoietic necrosis virus
cuggucccuaucuccacccgcc

SEQ ID NO: 3575 - RNA, 24 nt, Human papillomavirus type 90
uacaguguggagaccuuuauuugc

SEQ ID NO: 3576 - RNA, 24 nt, Human papillomavirus type 90
ccagagcggcaggucgaugacgcu

SEQ ID NO: 3577 - RNA, 24 nt, Human papillomavirus type 90
acccauuguaccuauauguauugu

SEQ ID NO: 3578 - RNA, 24 nt, Human papillomavirus type 90
uauacguaggcuaggaagacaaag

SEQ ID NO: 3579 - RNA, 24 nt, Infectious spleen and kidney necrosis virus
uuugcugaacggccacucuagugu

SEQ ID NO: 3580 - RNA, 24 nt, Infectious spleen and kidney necrosis virus
cgauguguguaaaacaccggagac

SEQ ID NO: 3581 - RNA, 24 nt, Infectious spleen and kidney necrosis virus
agacaagggugccauucugcguug

SEQ ID NO: 3582 - RNA, 24 nt, Infectious spleen and kidney necrosis virus
aagagccuugauacgaucuguggc

SEQ ID NO: 3583 - RNA, 24 nt, Infectious spleen and kidney necrosis virus
uaccuguuguaucgcaaggcucac

SEQ ID NO: 3584 - RNA, 24 nt, Equine rhinovirus 3
agacccgauucuuuugagucgaga

SEQ ID NO: 3585 - RNA, 24 nt, Equine rhinovirus 3
uaccguagcaggagcggcgccucc

SEQ ID NO: 3586 - RNA, 24 nt, Equine rhinovirus 3
caggaccccgcugaggaagacgcg

SEQ ID NO: 3587 - RNA, 24 nt, Equine rhinovirus 3
cccgagcuuuaauauauauagaaa

SEQ ID NO: 3588 - RNA, 24 nt, Fowl adenovirus D
ccacccagaagauuauagaaaaca

SEQ ID NO: 3589 - RNA, 24 nt, Fowl adenovirus D
uuuccaggaaccaaucaacaggcg

SEQ ID NO: 3590 - RNA, 24 nt, Cowpox virus
uagguuaaugguugggucgcgcag

SEQ ID NO: 3591 - RNA, 24 nt, Cowpox virus
ucaaugcauugaaucuucuuuacg

SEQ ID NO: 3592 - RNA, 24 nt, Cowpox virus
uccgcgagcuuuaucagcaaguuu

SEQ ID NO: 3593 - RNA, 24 nt, Cowpox virus
uauuuaguaacugacauaacuuug

SEQ ID NO: 3594 - RNA, 24 nt, Cowpox virus
gccacguacauuguaccucaaaag

SEQ ID NO: 3595 - RNA, 24 nt, Fowl adenovirus D
uucaugagccucucaugcauaugc

SEQ ID NO: 3596 - RNA, 24 nt, Cowpox virus
uugaaguucugacgaacuaucuug

SEQ ID NO: 3597 - RNA, 24 nt, African swine fever virus
ugugaaggcaaaggucaucuucuu

SEQ ID NO: 3598 - RNA, 24 nt, African swine fever virus
ugagaguaaacauugacggauaaa

SEQ ID NO: 3599 - RNA, 24 nt, African swine fever virus
uggaagaucauuuuuuuaccugcu

SEQ ID NO: 3600 - RNA, 24 nt, African swine fever virus
ugccaguuggggauuggcggcuag

SEQ ID NO: 3601 - RNA, 24 nt, African swine fever virus
cacguguagguuucgacgucguag

SEQ ID NO: 3602 - RNA, 24 nt, African swine fever virus
caggagacggguaagggccgaugc

SEQ ID NO: 3603 - RNA, 24 nt, Human herpesvirus 8
aggcaaaacauaguuaccaaugac

SEQ ID NO: 3604 - RNA, 24 nt, Paramecium bursaria Chlorella virus 1
ucgaacauuuguagcauuucauau

SEQ ID NO: 3605 - RNA, 24 nt, Human herpesvirus 1
ugauguugcuuuucuuggaaauaa

SEQ ID NO: 3606 - RNA, 24 nt, Human herpesvirus 1
uauuuaaugguggucuuuguuguu

SEQ ID NO: 3607 - RNA, 24 nt, Equine herpesvirus 2
uguggucguccguaggcagagucu

SEQ ID NO: 3608 - RNA, 24 nt, Equine herpesvirus 2
accccuuggcgaacacgugaggcc

SEQ ID NO: 3609 - RNA, 24 nt, Equine herpesvirus 2
uugaauauacacgauacaauggug

SEQ ID NO: 3610 - RNA, 24 nt, Equine herpesvirus 2
uagcagcggacaaucccgaucuac

SEQ ID NO: 3611 - RNA, 24 nt, Paramecium bursaria Chlorella virus 1
uggcggucccgcgucgggucgugg

SEQ ID NO: 3612 - RNA, 24 nt, Bovine herpesvirus 1
uaauagguuuaagacuucuacuaa

SEQ ID NO: 3613 - RNA, 24 nt, Human herpesvirus 7
ugaccaggggcuuggcacgcgcgc

SEQ ID NO: 3614 - RNA, 24 nt, Human herpesvirus 2
cgccgggucuugucgcggccgggc

SEQ ID NO: 3615 - RNA, 24 nt, Gallid herpesvirus 3
acagaagucugaguaugcuucgga

SEQ ID NO: 3616 - RNA, 22 nt, Gallid herpesvirus 3
uucguaccgcaugccggcgcuu

SEQ ID NO: 3617 - RNA, 24 nt, Gallid herpesvirus 3
aucauccuccaccucccccacccc

SEQ ID NO: 3618 - RNA, 24 nt, Gallid herpesvirus 3
uagcacugagcgucuaggcaggcc

SEQ ID NO: 3619 - RNA, 24 nt, Gallid herpesvirus 2
gagcaguccgucacccggucgcgg

SEQ ID NO: 3620 - RNA, 24 nt, Gallid herpesvirus 2
ugugauucacccaacgcccuugac

SEQ ID NO: 3621 - RNA, 24 nt, Human papillomavirus type 83
ucucucgguaggaccacgggaucc

SEQ ID NO: 3622 - RNA, 24 nt, Human papillomavirus type 83
uuguuauuggccgggacgaagugg

SEQ ID NO: 3623 - RNA, 24 nt, Lucerne transient streak virus
gauuguuuguaaagaaugagcccc

SEQ ID NO: 3624 - RNA, 24 nt, Lucerne transient streak virus
ucaguggccgcggauauacaagua

SEQ ID NO: 3625 - RNA, 24 nt, Amsacta moorei entomopoxvirus
aaauguuuguaaucuuucagauuc

SEQ ID NO: 3626 - RNA, 24 nt, Bovine papillomavirus
uacacauccuguccagcauuugca

SEQ ID NO: 3627 - RNA, 24 nt, Equine herpesvirus 2
uacaagaaacauugcaugaaagac

SEQ ID NO: 3628 - RNA, 22 nt, Bovine papillomavirus
ucagcgaaaaugaauaauugcu

SEQ ID NO: 3629 - RNA, 24 nt, Bovine papillomavirus
ggauuagacggggccaccaguaau

SEQ ID NO: 3630 - RNA, 20 nt, Bovine papillomavirus
ucaaaaccucaaaaaggcgg

SEQ ID NO: 3631 - RNA, 24 nt, Amsacta moorei entomopoxvirus
uagaauauuuagaaaauaauaaaa

SEQ ID NO: 3632 - RNA, 24 nt, Amsacta moorei entomopoxvirus
uacacguaccucacuauggccaua

SEQ ID NO: 3633 - RNA, 24 nt, Human herpesvirus 7
uacauucugaggaucgggguagau

SEQ ID NO: 3634 - RNA, 21 nt, Human herpesvirus 7
aggggcccgggguuaggaccu

SEQ ID NO: 3635 - RNA, 24 nt, Lucerne transient streak virus
ugguacaacaaacauguaauauug

SEQ ID NO: 3636 - RNA, 24 nt, Amsacta moorei entomopoxvirus
uacaaguuuaacauaaucacauuu

SEQ ID NO: 3637 - RNA, 23 nt, Melanoplus sanguinipes entomopoxvirus
aucgcgcaugcgcacagacguuc

SEQ ID NO: 3638 - RNA, 24 nt, Melanoplus sanguinipes entomopoxvirus
ugcacagccagugagcuggccaca

SEQ ID NO: 3639 - RNA, 24 nt, Gallid herpesvirus 2
agaucugggaaaucauggauguuu

SEQ ID NO: 3640 - RNA, 24 nt, Fowl adenovirus D
uucgggcggauuacgcguuacgug

SEQ ID NO: 3641 - RNA, 24 nt, Fowl adenovirus D
ucagagcacggaugagcgagcagc

SEQ ID NO: 3642 - RNA, 24 nt, Bovine papillomavirus
aguggccgggggcccagacgggag

SEQ ID NO: 3643 - RNA, 24 nt, Human herpesvirus 7
uacguguaggcuaccugccggaga

SEQ ID NO: 3644 - RNA, 24 nt, Human herpesvirus 7
uuaaagauccgugggcuggagcuu

SEQ ID NO: 3645 - RNA, 24 nt, Human herpesvirus 7
uagggguagugucguugucggggu

SEQ ID NO: 3646 - RNA, 24 nt, Gallid herpesvirus 2
ucgcauggaccagguauugcgcuc

SEQ ID NO: 3647 - RNA, 24 nt, Fowl adenovirus D
agccguuugcccguggugccggag

SEQ ID NO: 3648 - RNA, 24 nt, Tupaia herpesvirus
ugugccuacauuagccauuucaga

SEQ ID NO: 3649 - RNA, 24 nt, Tupaia herpesvirus
cggcuccgaucuagaucccggucg

SEQ ID NO: 3650 - RNA, 24 nt, Variola virus
ugccaugaugaucgaugucauaug

SEQ ID NO: 3651 - RNA, 24 nt, Variola virus
uaccuuuucauuaauacacacagg

SEQ ID NO: 3652 - RNA, 24 nt, Variola virus
ccccugcagcgugaaggcaguuuc

SEQ ID NO: 3653 - RNA, 24 nt, Variola virus
gugcauuggagauaguagcuuuca

SEQ ID NO: 3654 - RNA, 24 nt, Variola virus
uuucacaguagauuuuauuccggu

SEQ ID NO: 3655 - RNA, 24 nt, Variola virus
cuugaggucauacguuuuagggug

SEQ ID NO: 3656 - RNA, 24 nt, Fowl adenovirus D
uggucagauucuguauguccguuc

SEQ ID NO: 3657 - RNA, 22 nt, Tupaia herpesvirus
cccccaccuccuccaaacgguc

SEQ ID NO: 3658 - RNA, 22 nt, Variola virus
uccggugccugucguagaccug

SEQ ID NO: 3659 - RNA, 24 nt, Cowpox virus
ucggagaguaaacauugacggaua

SEQ ID NO: 3660 - RNA, 24 nt, Cowpox virus
uguaaagauaaacaucaacauugu

SEQ ID NO: 3661 - RNA, 24 nt, Rice yellow mottle virus
caucggcagaugcgacgacauacg

SEQ ID NO: 3662 - RNA, 24 nt, Murid herpesvirus 4
acccuuugaugacuuacugcccug

SEQ ID NO: 3663 - RNA, 24 nt, Murid herpesvirus 4
aaauggacacuugcgguuaggaca

SEQ ID NO: 3664 - RNA, 24 nt, Simian T-lymphotropic virus 1
uaagccaaguaucugucuugcaaa

SEQ ID NO: 3665 - RNA, 24 nt, Periplaneta fuliginosa densovirus
gaagguagcucccucgacugggug

SEQ ID NO: 3666 - RNA, 24 nt, Periplaneta fuliginosa densovirus
guacaugggcaucuugcacgagaa

SEQ ID NO: 3667 - RNA, 24 nt, Rat cytomegalovirus
gugcagggguuccauucuguucug

SEQ ID NO: 3668 - RNA, 24 nt, Ectromelia virus
ugagaaacuuaaaguagacuccga

SEQ ID NO: 3669 - RNA, 24 nt, Ectromelia virus
ugaaauguuuacaauagaaauucg

SEQ ID NO: 3670 - RNA, 24 nt, Drosophila C virus
uugaugguaaggauucuuauuuug

SEQ ID NO: 3671 - RNA, 24 nt, Drosophila C virus
uuacauggaggaacacauuacuuu

SEQ ID NO: 3672 - RNA, 24 nt, Periplaneta fuliginosa densovirus
uauuaugucuguuauuugagauuc

SEQ ID NO: 3673 - RNA, 24 nt, Periplaneta fuliginosa densovirus
ucaguacaaucaagcccauuccuc

SEQ ID NO: 3674 - RNA, 19 nt, Human spumaretrovirus
uaauaggacacaacaccuc

SEQ ID NO: 3675 - RNA, 24 nt, Periplaneta fuliginosa densovirus
aauuguauauuagccuugcuaagg

SEQ ID NO: 3676 - RNA, 24 nt, Rat cytomegalovirus
aagccguuggcgaccuugaggacc

SEQ ID NO: 3677 - RNA, 24 nt, Rat cytomegalovirus
ugaagcccucgggccaggccaggc

SEQ ID NO: 3678 - RNA, 24 nt, Ectromelia virus
uaagacacagaaauacuauauccg

SEQ ID NO: 3679 - RNA, 24 nt, Fowl adenovirus A
cagcagcugguuagcaacgggauc

SEQ ID NO: 3680 - RNA, 24 nt, Drosophila C virus
uggcaaaaguguuucgagaaauua

SEQ ID NO: 3681 - RNA, 24 nt, Drosophila C virus
aacccgcccacuaacccgcccacu

SEQ ID NO: 3682 - RNA, 24 nt, Human herpesvirus 6B
uauuagaauuuacaaaacugguaa

SEQ ID NO: 3683 - RNA, 19 nt, Human herpesvirus 6
ucucucacagcaugaugac

SEQ ID NO: 3684 - RNA, 24 nt, Human herpesvirus 6
uauuagacuacaaaccuaaugaua

SEQ ID NO: 3685 - RNA, 21 nt, Gallid herpesvirus 2
ucugcaauuccgugucgauga

SEQ ID NO: 3686 - RNA, 24 nt, Gallid herpesvirus 2
aauugugugaucucguuacugaaa

SEQ ID NO: 3687 - RNA, 24 nt, Gallid herpesvirus 2
uccaugaaucuacgaagcuugauu

SEQ ID NO: 3688 - RNA, 24 nt, Fowl adenovirus A
uagcacaaaaucaaaaacaaaucu

SEQ ID NO: 3689 - RNA, 24 nt, Fowl adenovirus A
ucaauaacucucacuuuuuugcua

SEQ ID NO: 3690 - RNA, 24 nt, Human herpesvirus 6
ucaaaccuugacaaaaccuauuug

SEQ ID NO: 3691 - RNA, 24 nt, Human herpesvirus 6
aauguauucagauucguuuucagg

SEQ ID NO: 3692 - RNA, 24 nt, Paramecium bursaria Chlorella virus 1
agggagcgcggaaggaguccugcu

SEQ ID NO: 3693 - RNA, 24 nt, Paramecium bursaria Chlorella virus 1
uaccauaaaaagaguuauuaguuc

SEQ ID NO: 3694 - RNA, 24 nt, Variola virus
uuaaugauacacacuauacugucg

SEQ ID NO: 3695 - RNA, 24 nt, Variola virus
ccgcggccccgccccccacgcccg

SEQ ID NO: 3696 - RNA, 24 nt, Paramecium bursaria Chlorella virus 1
ucacgccaacacgucccaccucuu

SEQ ID NO: 3697 - RNA, 24 nt, Paramecium bursaria Chlorella virus 1
uauggaacgguacuggauguagaa

SEQ ID NO: 3698 - RNA, 24 nt, Melanoplus sanguinipes entomopoxvirus
uucagguauaucaacaaauguaua

SEQ ID NO: 3699 - RNA, 24 nt, Melanoplus sanguinipes entomopoxvirus
cuccuguuacuagcucuucgccgg

SEQ ID NO: 3700 - RNA, 24 nt, Melanoplus sanguinipes entomopoxvirus
uauuuuaucgguauauaaaucuaa

SEQ ID NO: 3701 - RNA, 23 nt, Melanoplus sanguinipes entomopoxvirus
auucugguguuaauauuuuuaua

SEQ ID NO: 3702 - RNA, 24 nt, Chimpanzee cytomegalovirus
ucuuuuguccaauagugucgaaua

SEQ ID NO: 3703 - RNA, 22 nt, Fowl adenovirus A
uuuuauggguguucgguguuuu

SEQ ID NO: 3704 - RNA, 23 nt, Variola virus
ccucgcccccucccgccccucgc

SEQ ID NO: 3705 - RNA, 17 nt, Human papillomavirus type 61
uacuacuaggcgcuggc

SEQ ID NO: 3706 - RNA, 24 nt, Fowl adenovirus A
aagcugcagaguucgucuccggag

SEQ ID NO: 3707 - RNA, 24 nt, Fowl adenovirus A
uccccauccgcccgauuaaccccu

SEQ ID NO: 3708 - RNA, 24 nt, Fowlpox virus
uggcauggugacaugagugaugau

SEQ ID NO: 3709 - RNA, 24 nt, Fowlpox virus
uggugucucauuauauacuagcgu

SEQ ID NO: 3710 - RNA, 24 nt, Rice tungro bacilliform virus
uuaaaucggguaaaugguaaagca

SEQ ID NO: 3711 - RNA, 24 nt, Frog adenovirus 1
uguguacuuguggcuuaaauuuau

SEQ ID NO: 3712 - RNA, 24 nt, Paramecium bursaria Chlorella virus 1
ucuaauauaaggacguuaaauacu

SEQ ID NO: 3713 - RNA, 24 nt, Strawberry vein banding virus
agcgugaaucccgagagucaggag

SEQ ID NO: 3714 - RNA, 24 nt, Gallid herpesvirus 2
uggaaaaccggaacgucagcucau

SEQ ID NO: 3715 - RNA, 24 nt, Gallid herpesvirus 2
uuaguccauucgauaguaaucaug

SEQ ID NO: 3716 - RNA, 24 nt, Chimpanzee cytomegalovirus
ugagauaggacaggaaaaguaagg

SEQ ID NO: 3717 - RNA, 24 nt, Rat cytomegalovirus
uaucauaaugaagacauuuuagag

SEQ ID NO: 3718 - RNA, 24 nt, Rat cytomegalovirus
uacguugggaugcucgucgauguc

SEQ ID NO: 3719 - RNA, 24 nt, Rat cytomegalovirus
uaaauggauuucagggagggaccg

SEQ ID NO: 3720 - RNA, 24 nt, Rice tungro bacilliform virus
aagcacuaguagguaacuaagagg

SEQ ID NO: 3721 - RNA, 21 nt, Rat cytomegalovirus
gcgcucggcgcgccgagauga

SEQ ID NO: 3722 - RNA, 24 nt, Pea enation mosaic virus-2
uggcaaggcgcccauugguucuac

SEQ ID NO: 3723 - RNA, 24 nt, Tomato mosaic virus
uagggcugcugggcugcuaguagg

SEQ ID NO: 3724 - RNA, 24 nt, Myxoma virus
cggucaguccuuuguggaucugca

SEQ ID NO: 3725 - RNA, 24 nt, Wheat yellow mosaic virus
ccacugacauacucguaaucguca

SEQ ID NO: 3726 - RNA, 19 nt, Rabbit fibroma virus
ugccacgggauuuagcaau

SEQ ID NO: 3727 - RNA, 24 nt, Rat cytomegalovirus
ucgcacagaauuauggacaucgau

SEQ ID NO: 3728 - RNA, 24 nt, Chimpanzee cytomegalovirus
acgccguuuuacucgccgucgcuu

SEQ ID NO: 3729 - RNA, 24 nt, Rat cytomegalovirus
uaugucccacaucagguucucaga

SEQ ID NO: 3730 - RNA, 24 nt, Rabbit fibroma virus
uugcaugguguuuacuuucuuaac

SEQ ID NO: 3731 - RNA, 24 nt, Rabbit fibroma virus
uucauauugugagccacaguagac

SEQ ID NO: 3732 - RNA, 24 nt, African swine fever virus
uuucagcguggccagccaucgcug

SEQ ID NO: 3733 - RNA, 24 nt, Ectromelia virus
uaucgcaguuaucaagguuaguua

SEQ ID NO: 3734 - RNA, 24 nt, Vaccinia virus
ugaugauuuaugaauugauuccgg

SEQ ID NO: 3735 - RNA, 21 nt, Tomato mosaic virus
uggcuugcuaguagggcugcu

SEQ ID NO: 3736 - RNA, 24 nt, Tomato mosaic virus
ucgcuggccugcuugcuugcucgc

SEQ ID NO: 3737 - RNA, 24 nt, Ateline herpesvirus 3
ugcuaguagggcugcugggcugcu

SEQ ID NO: 3738 - RNA, 24 nt, Macaca mulatta rhadinovirus
uacuguuuggcguuuugggggcac

SEQ ID NO: 3739 - RNA, 22 nt, Rabbit fibroma virus
uguaagguuauaagauauaaug

SEQ ID NO: 3740 - RNA, 24 nt, Rabbit fibroma virus
uaacugaggagcugagaagugacc

SEQ ID NO: 3741 - RNA, 24 nt, Vaccinia virus
uggaagcuugggggcaggucagug

SEQ ID NO: 3742 - RNA, 24 nt, Porcine enterovirus B
uaaauaaucugaucuuuuuucaug

SEQ ID NO: 3743 - RNA, 24 nt, Rabbit fibroma virus
gcgaauagagaaauuaaaucguua

SEQ ID NO: 3744 - RNA, 20 nt, African swine fever virus
cuugauauaaagguggccau

SEQ ID NO: 3745 - RNA, 24 nt, Vaccinia virus
ccgcugagugguaaacaacagaac

SEQ ID NO: 3746 - RNA, 24 nt, Porcine enterovirus B
uaagacaagcccuauauuuacuug

SEQ ID NO: 3747 - RNA, 20 nt, Porcine enterovirus B
uauaaaaacuuagguauggu

SEQ ID NO: 3748 - RNA, 24 nt, Rat cytomegalovirus
ucaauauuaugauauaaauaugaa

SEQ ID NO: 3749 - RNA, 21 nt, Rat cytomegalovirus
ucucgucggcggacgggucgu

SEQ ID NO: 3750 - RNA, 24 nt, Rat cytomegalovirus
uuucaaauucagauuuaaaauuaa

SEQ ID NO: 3751 - RNA, 24 nt, Meleagrid herpesvirus 1
ucugucgcuucuucgcccguuuug

SEQ ID NO: 3752 - RNA, 24 nt, Rat cytomegalovirus
aggagucggcggcgacgauggaga

SEQ ID NO: 3753 - RNA, 19 nt, Human spumaretrovirus
uaauaggacacaacaccuc

SEQ ID NO: 3754 - RNA, 24 nt, Human spumaretrovirus
ccagcaccagcuucugucgguguc

SEQ ID NO: 3755 - RNA, 24 nt, Human spumaretrovirus
aggaguaugcgucguugggucgga

SEQ ID NO: 3756 - RNA, 24 nt, Human herpesvirus 5
acuucauuaaucaagcuuaauuuu

SEQ ID NO: 3757 - RNA, 24 nt, Human herpesvirus 5
caaguuucuuaaaaacaauauuuu

SEQ ID NO: 3758 - RNA, 24 nt, Human herpesvirus 5
gagcauugcuuuauaaacaauuuu

SEQ ID NO: 3759 - RNA, 18 nt, Human spumaretrovirus
ucugccggccaaaauacc

SEQ ID NO: 3760 - RNA, 24 nt, Human spumaretrovirus
ugccggguuaaaacauagacacaa

SEQ ID NO: 3761 - RNA, 24 nt, Human herpesvirus 5
uauguucaacuuugaaauuguuuu

SEQ ID NO: 3762 - RNA, 24 nt, Human herpesvirus 5
uauauuguaccaaagauuuaaauc

SEQ ID NO: 3763 - RNA, 24 nt, Human herpesvirus 5
ccccugauuuugcaguucacccag

SEQ ID NO: 3764 - RNA, 24 nt, Human herpesvirus 5
uguauauuauuuuuuuuuuuugug

SEQ ID NO: 3765 - RNA, 24 nt, Human herpesvirus 3
ucuagaacaaaaaggaggaagaac

SEQ ID NO: 3766 - RNA, 24 nt, Human herpesvirus 3
uugcgcacgcuuuuuaccguggac

SEQ ID NO: 3767 - RNA, 24 nt, Bovine herpesvirus 4
aggaggccacagcgaaggccgcgu

SEQ ID NO: 3768 - RNA, 24 nt, Bovine herpesvirus 4
uuaauauauuauaauaguuuucuu

SEQ ID NO: 3769 - RNA, 22 nt, Bovine herpesvirus 4
cuacugucccacuauauaccac

SEQ ID NO: 3770 - RNA, 24 nt, Bovine herpesvirus 4
ugaguucuagcaagcucuaaauaa

SEQ ID NO: 3771 - RNA, 17 nt, Human herpesvirus 3
uuugauguuuaaucgcc

SEQ ID NO: 3772 - RNA, 24 nt, Bovine herpesvirus 4
uguccaggacucaucgggguucau

SEQ ID NO: 3773 - RNA, 24 nt, Bovine herpesvirus 4
uagcuuauuaucuguuugugcuaa

SEQ ID NO: 3774 - RNA, 24 nt, Bovine herpesvirus 4
uguacaguuuccuuaguacccugc

SEQ ID NO: 3775 - RNA, 24 nt, Bovine herpesvirus 4
uaauaacacuuacguuuuuaucga

SEQ ID NO: 3776 - RNA, 24 nt, Bovine herpesvirus 4
aguaaggaaucagucuguucuggu

SEQ ID NO: 3777 - RNA, 24 nt, Bovine herpesvirus 4
uguuguuaaguacgagggaggagc

SEQ ID NO: 3778 - RNA, 23 nt, Bovine herpesvirus 4
ugcgauguucagcugcacguacu

SEQ ID NO: 3779 - RNA, 24 nt, Human herpesvirus 7
caccgcgcuugcgcuuggcgcgcc

SEQ ID NO: 3780 - RNA, 24 nt, Equine herpesvirus 2
auaauauuguaaauaaugacauua

SEQ ID NO: 3781 - RNA, 24 nt, Equine herpesvirus 2
caugacuaccugggccagguugag

SEQ ID NO: 3782 - RNA, 24 nt, Equine herpesvirus 2
uaccgcacacuuuuauugccccuu

SEQ ID NO: 3783 - RNA, 24 nt, Equine herpesvirus 2
uguuaccccuuuuuaacucucuaa

SEQ ID NO: 3784 - RNA, 24 nt, Equine herpesvirus 2
acagauccuaacccaaucuaucuu

SEQ ID NO: 3785 - RNA, 24 nt, Equine herpesvirus 2
aaaguaacaagucaccgccucauc

SEQ ID NO: 3786 - RNA, 24 nt, Equine herpesvirus 2
ucggagcugugggcgucgcugcgg

SEQ ID NO: 3787 - RNA, 24 nt, Equine herpesvirus 2
uuccacggaaucaaugucggcauc

SEQ ID NO: 3788 - RNA, 24 nt, Equine herpesvirus 2
uaacuuguugccucagcuaaaggu

SEQ ID NO: 3789 - RNA, 24 nt, Equine herpesvirus 2
ugaaauuauauaucauuuguuuaa

SEQ ID NO: 3790 - RNA, 24 nt, Equine herpesvirus 2
uuaaagcccggaauguuuuuuuuu

SEQ ID NO: 3791 - RNA, 24 nt, Equine herpesvirus 2
uggugaguggcgcucgcagcagcu

SEQ ID NO: 3792 - RNA, 24 nt, Equine herpesvirus 2
ucccaggcgacuaccuccugcggg

SEQ ID NO: 3793 - RNA, 24 nt, Equine herpesvirus 2
uuuauagucucuaaccaggauaua

SEQ ID NO: 3794 - RNA, 24 nt, Equine herpesvirus 2
uaaaaaguuuaauuauuccaaaua

SEQ ID NO: 3795 - RNA, 24 nt, Equine herpesvirus 2
agagagcaccuuaagcuaucauac

SEQ ID NO: 3796 - RNA, 24 nt, Equine herpesvirus 2
uuuaauuuuaucuuuaauguuaac

SEQ ID NO: 3797 - RNA, 24 nt, Equine herpesvirus 2
uggagagaagcuuggcgaugcugc

SEQ ID NO: 3798 - RNA, 24 nt, Equine herpesvirus 2
uaaauuaaaaaaauuggaaauauu

SEQ ID NO: 3799 - RNA, 24 nt, Equine herpesvirus 2
auggugcucaacaugcgugcgcca

SEQ ID NO: 3800 - RNA, 24 nt, Equine herpesvirus 2
uucauguaaaguuuuaagcuuaca

SEQ ID NO: 3801 - RNA, 24 nt, Equine herpesvirus 2
aggugggugcgaccguagccccgc

SEQ ID NO: 3802 - RNA, 24 nt, Equine herpesvirus 2
ucacucaugccaguacacucgcac

SEQ ID NO: 3803 - RNA, 22 nt, Equine herpesvirus 2
uccaugggcagugcgcaugccg

SEQ ID NO: 3804 - RNA, 24 nt, Equine herpesvirus 2
cacccgcucacugucugucuacag

SEQ ID NO: 3805 - RNA, 24 nt, Equine herpesvirus 2
uaaguuaaauaaaaauauaaaugu

SEQ ID NO: 3806 - RNA, 24 nt, Equine herpesvirus 2
uccaggaaccggugguaggcgccc

SEQ ID NO: 3807 - RNA, 24 nt, Equine herpesvirus 2
ucucuugcuagguagccuguacaa

SEQ ID NO: 3808 - RNA, 24 nt, Equine herpesvirus 2
ucgcgcagcacugccgggacgagg

SEQ ID NO: 3809 - RNA, 24 nt, Equine herpesvirus 2
accagguagccgugcauaagcuua

SEQ ID NO: 3810 - RNA, 24 nt, Equine herpesvirus 2
uugguagugaagccugccaggcuc

SEQ ID NO: 3811 - RNA, 24 nt, Equine herpesvirus 2
ugaaagaguuggauuucagcaccu

SEQ ID NO: 3812 - RNA, 24 nt, Equine herpesvirus 2
uagccugcuuuaacacauauccca

SEQ ID NO: 3813 - RNA, 24 nt, Equine herpesvirus 2
cgacgcggaugcaggcgcugcccu

SEQ ID NO: 3814 - RNA, 24 nt, Equine herpesvirus 2
accagaguacuuggcaaagaucuu

SEQ ID NO: 3815 - RNA, 18 nt, Equine herpesvirus 2
uaauucagagcaguuauu

SEQ ID NO: 3816 - RNA, 23 nt, Equine herpesvirus 2
caccugcugacacucuaccgcga

SEQ ID NO: 3817 - RNA, 24 nt, Equine herpesvirus 2
uagcauaguaaaaaucaguucagu

SEQ ID NO: 3818 - RNA, 20 nt, Fowlpox virus
uauuacacggagcggauaua

SEQ ID NO: 3819 - RNA, 24 nt, Fowlpox virus
ugagucaucgcccgaggacgcgcc

SEQ ID NO: 3820 - RNA, 24 nt, Fowlpox virus
ucguaggccuuggucauguccgac

SEQ ID NO: 3821 - RNA, 17 nt, Fowlpox virus
cagguccccgucgagga

SEQ ID NO: 3822 - RNA, 24 nt, Fowlpox virus
uggcgggagguucagcgucaccgg

SEQ ID NO: 3823 - RNA, 20 nt, Fowlpox virus
uauuccguacugcuccgacc

SEQ ID NO: 3824 - RNA, 24 nt, Fowlpox virus
acgcuuuucuuccuucucccgcag

SEQ ID NO: 3825 - RNA, 24 nt, Fowlpox virus
cgucaaaguuaagcuuggucauga

SEQ ID NO: 3826 - RNA, 23 nt, Fowlpox virus
ugacaaagauauuucccaccuca

SEQ ID NO: 3827 - RNA, 24 nt, Fowlpox virus
cgcuccgggggcagccgggcggcc

SEQ ID NO: 3828 - RNA, 24 nt, Fowlpox virus
uuaagcuucacgucaucugcaacg

SEQ ID NO: 3829 - RNA, 24 nt, Fowlpox virus
acccugugggcuccccccaaaugu

SEQ ID NO: 3830 - RNA, 24 nt, Fowlpox virus
ucgcagaggagcuagcaggaggac

SEQ ID NO: 3831 - RNA, 21 nt, Fowlpox virus
cgagacaaaaaugguccugau

SEQ ID NO: 3832 - RNA, 24 nt, Amsacta moorei entomopoxvirus
uucauuagaauugauuuuauuaga

SEQ ID NO: 3833 - RNA, 24 nt, Fowlpox virus
accgaguuuacgacagcgcaaauc

SEQ ID NO: 3834 - RNA, 22 nt, Fowlpox virus
gggccuguggacaccugaggga

SEQ ID NO: 3835 - RNA, 24 nt, Fowlpox virus
gaucauggacaagagaaaggccaa

SEQ ID NO: 3836 - RNA, 24 nt, Amsacta moorei entomopoxvirus
uucauuagaauugauuuuauuaga

SEQ ID NO: 3837 - RNA, 24 nt, Amsacta moorei entomopoxvirus
uaggaucauuaaaauuauuuuuac

SEQ ID NO: 3838 - RNA, 24 nt, Amsacta moorei entomopoxvirus
ugaaaacgccacggaaaucgaucu

SEQ ID NO: 3839 - RNA, 21 nt, Fowlpox virus
cuugccugguucuggggcucc

SEQ ID NO: 3840 - RNA, 24 nt, Amsacta moorei entomopoxvirus
uaaaugacggauaugaugugaaug

SEQ ID NO: 3841 - RNA, 19 nt, Amsacta moorei entomopoxvirus
ugaaauagagcuaaaaaac

SEQ ID NO: 3842 - RNA, 24 nt, Amsacta moorei entomopoxvirus
gaaugcgauggcuguuagugcggg

SEQ ID NO: 3843 - RNA, 24 nt, Amsacta moorei entomopoxvirus
aaaaacuaaaaccuguagaacaaa

SEQ ID NO: 3844 - RNA, 24 nt, Amsacta moorei entomopoxvirus
cucuuggucaauuucgguuucuau

SEQ ID NO: 3845 - RNA, 24 nt, Fowlpox virus
aagccuacugucaacacgauggga

SEQ ID NO: 3846 - RNA, 24 nt, Fowlpox virus
acccuguacggcaccaggaacgcc

SEQ ID NO: 3847 - RNA, 24 nt, Fowlpox virus
uauuuuacgcugacauuuuuacuc

SEQ ID NO: 3848 - RNA, 24 nt, Fowlpox virus
caccauggcgacgcgagcccgccu

SEQ ID NO: 3849 - RNA, 24 nt, Amsacta moorei entomopoxvirus
uuuaaaguuuuaaauugaguuuuc

SEQ ID NO: 3850 - RNA, 20 nt, Amsacta moorei entomopoxvirus
uucgagaauagcgagcaugg

SEQ ID NO: 3851 - RNA, 24 nt, Amsacta moorei entomopoxvirus
ugaaauauuuaucuaacaaugguc

SEQ ID NO: 3852 - RNA, 24 nt, Amsacta moorei entomopoxvirus
ucguggaguacgguugauuucuuu

SEQ ID NO: 3853 - RNA, 19 nt, Amsacta moorei entomopoxvirus
uauguagacgaugacacug

SEQ ID NO: 3854 - RNA, 24 nt, Amsacta moorei entomopoxvirus
uauuaugcaacaguaacagaacca

SEQ ID NO: 3855 - RNA, 24 nt, Amsacta moorei entomopoxvirus
guccagaauagggaaguccgccau

SEQ ID NO: 3856 - RNA, 24 nt, Amsacta moorei entomopoxvirus
uaucgcaauagugggccgggcccg

SEQ ID NO: 3857 - RNA, 24 nt, Amsacta moorei entomopoxvirus
uaguggacagcccccauugggcca

SEQ ID NO: 3858 - RNA, 24 nt, Amsacta moorei entomopoxvirus
gaaaaggugacaguugaauaaucu

SEQ ID NO: 3859 - RNA, 24 nt, Amsacta moorei entomopoxvirus
aguggguagcccccauugggccgc

SEQ ID NO: 3860 - RNA, 24 nt, Amsacta moorei entomopoxvirus
ucagugggagguacccauuaaggg

SEQ ID NO: 3861 - RNA, 24 nt, Ateline herpesvirus 3
ugaguacaucguggaugacgagua

SEQ ID NO: 3862 - RNA, 24 nt, Ateline herpesvirus 3
cauccuaauuuuaacucuaaaagg

SEQ ID NO: 3863 - RNA, 17 nt, Ateline herpesvirus 3
ccggaagucacuagagc

SEQ ID NO: 3864 - RNA, 24 nt, Ateline herpesvirus 3
gccaccuagccagccagcccgggg

SEQ ID NO: 3865 - RNA, 24 nt, Ateline herpesvirus 3
uguggauuugucuucuacgcuaga

SEQ ID NO: 3866 - RNA, 24 nt, Ateline herpesvirus 3
ugaagugcccaauagaagcauuuc

SEQ ID NO: 3867 - RNA, 17 nt, Ateline herpesvirus 3
uucaucauagcagaugc

SEQ ID NO: 3868 - RNA, 23 nt, Ateline herpesvirus 3
cacccugccacguaaacccgccu

SEQ ID NO: 3869 - RNA, 24 nt, Ateline herpesvirus 3
uaugauuccuguagugcucuuucc

SEQ ID NO: 3870 - RNA, 24 nt, Ateline herpesvirus 3
uggaaaacauuaagaguuguuauu

SEQ ID NO: 3871 - RNA, 24 nt, Ateline herpesvirus 3
gaggauuacguuggggcugcuggu

SEQ ID NO: 3872 - RNA, 24 nt, Encephalomyocarditis virus
uccaucagaaagagguuuaauauu

SEQ ID NO: 3873 - RNA, 24 nt, Equine herpesvirus 1
ugauggagucguaaaaaaaguuuu

SEQ ID NO: 3874 - RNA, 24 nt, Equine herpesvirus 1
ugauggagucguaaaaaaaguuuu

SEQ ID NO: 3875 - RNA, 24 nt, Equine herpesvirus 1
agaaauaaauauaucuuuguuaaa

SEQ ID NO: 3876 - RNA, 24 nt, Human herpesvirus 5
agcggcugcuggaagagggcgacg

SEQ ID NO: 3877 - RNA, 24 nt, Human herpesvirus 5
uguggacaacaaacauaauuauua

SEQ ID NO: 3878 - RNA, 24 nt, Human herpesvirus 5
cguucaguccgauaucggagaaag

SEQ ID NO: 3879 - RNA, 24 nt, Human herpesvirus 5
uccaaguucacugacucuugauaa

SEQ ID NO: 3880 - RNA, 24 nt, Human herpesvirus 5
ccauaugcuaaaaguuauggagua

SEQ ID NO: 3881 - RNA, 21 nt, Human herpesvirus 5
ucucacaccagggacaacaua

SEQ ID NO: 3882 - RNA, 24 nt, Human papillomavirus type 89
uauacaggcuaugcaaggucauau

SEQ ID NO: 3883 - RNA, 23 nt, Human herpesvirus 5
uaguuugugugggaucuccaacu

SEQ ID NO: 3884 - RNA, 24 nt, Human papillomavirus type 89
ggagugauauacuugugcugcuua

SEQ ID NO: 3885 - RNA, 24 nt, Human papillomavirus type 89
uuugacagacaugauguuggguua

SEQ ID NO: 3886 - RNA, 24 nt, Human papillomavirus type 89
agugaagccgaaaaauuuuguaga

SEQ ID NO: 3887 - RNA, 24 nt, Southern cowpea mosaic virus
uaauauaugcuaaaauuaguucau

SEQ ID NO: 3888 - RNA, 24 nt, Southern cowpea mosaic virus
gugcaucgccaugggugacgacuc

SEQ ID NO: 3889 - RNA, 24 nt, Human herpesvirus 5
uaccuguccaauugucugugaggu

SEQ ID NO: 3890 - RNA, 17 nt, Human herpesvirus 5
uggcaugcugaccgaac

SEQ ID NO: 3891 - RNA, 24 nt, Southern cowpea mosaic virus
ccucggacuuugaccguucccacg

SEQ ID NO: 3892 - RNA, 24 nt, Tupaia herpesvirus
cuugcgaauccuaaacuuguaaau

SEQ ID NO: 3893 - RNA, 24 nt, Tupaia herpesvirus
uuugaugaggacgucgaaauugug

SEQ ID NO: 3894 - RNA, 20 nt, Tupaia herpesvirus
ugguaugaagccuagguuug

SEQ ID NO: 3895 - RNA, 24 nt, Tupaia herpesvirus
acggggaucgcgagcggucgaguc

SEQ ID NO: 3896 - RNA, 24 nt, Southern cowpea mosaic virus
uaauauagauagcagauuacuuaa

SEQ ID NO: 3897 - RNA, 24 nt, Tupaia herpesvirus
uucccgggacuuaucucgucacga

SEQ ID NO: 3898 - RNA, 24 nt, Equine herpesvirus 2
uauuggauaaacagcaaaggugaa

SEQ ID NO: 3899 - RNA, 24 nt, Equine herpesvirus 2
ugugaaucuuggcacaggccuuaa

SEQ ID NO: 3900 - RNA, 24 nt, Cowpox virus
uacuucagagcuuucauuuuaaaa

SEQ ID NO: 3901 - RNA, 24 nt, Cowpox virus
caacuguaugaaccugaagaguaa

SEQ ID NO: 3902 - RNA, 24 nt, Cowpox virus
uuaaaucggguacaugauaaagca

SEQ ID NO: 3903 - RNA, 24 nt, Rabbit fibroma virus
uaugugaauagauagguauuuuau

SEQ ID NO: 3904 - RNA, 24 nt, Southern cowpea mosaic virus
ucgcugggaguacacccggacccg

SEQ ID NO: 3905 - RNA, 24 nt, Southern cowpea mosaic virus
ugagugaauuuaaugauaacacau

SEQ ID NO: 3906 - RNA, 24 nt, Tupaia herpesvirus
ugccauuagcucuuaugcucauuc

SEQ ID NO: 3907 - RNA, 24 nt, Tupaia herpesvirus
ugagcgagcgacugucucgagucg

SEQ ID NO: 3908 - RNA, 24 nt, Tupaia herpesvirus
uaaaguauguauggagguuucauu

SEQ ID NO: 3909 - RNA, 24 nt, Cowpox virus
uauuauuuuaauaaacuuauugag

SEQ ID NO: 3910 - RNA, 24 nt, Cowpox virus
uagcgucuuauuaaaguuuaaguu

SEQ ID NO: 3911 - RNA, 24 nt, Satellite tobacco mosaic virus
uauccuaaggucaauccgacucca

SEQ ID NO: 3912 - RNA, 24 nt, Equine herpesvirus 2
gcgcguaggccagcaccugagcca

SEQ ID NO: 3913 - RNA, 24 nt, Cowpox virus
cauuguguuuacuuuauuuagcaa

SEQ ID NO: 3914 - RNA, 24 nt, Human adenovirus F
uucaucuuuuaucaccauauaguu

SEQ ID NO: 3915 - RNA, 24 nt, Satellite tobacco mosaic virus
caccugauuuacaaaacagacuuu

SEQ ID NO: 3916 - RNA, 24 nt, Satellite tobacco mosaic virus
ucuaagauauucuuccaucaacuu

SEQ ID NO: 3917 - RNA, 24 nt, Satellite tobacco mosaic virus
cacgagcuggcccuccugcgggcc

SEQ ID NO: 3918 - RNA, 24 nt, Satellite tobacco mosaic virus
gggcuucaccuccaaccaccugag

SEQ ID NO: 3919 - RNA, 24 nt, Rabbit fibroma virus
uaugugaauagauagguauuuuau

SEQ ID NO: 3920 - RNA, 24 nt, Camelpox virus
ucgaauauacgggccaaguuagaa

SEQ ID NO: 3921 - RNA, 24 nt, Junonia coenia densovirus
uuuguauucauucaaugucuccuu

SEQ ID NO: 3922 - RNA, 24 nt, Feline leukemia virus
uggcuacaaacuuuuccuuuucca

SEQ ID NO: 3923 - RNA, 23 nt, Fowlpox virus
uaacaauaucauuuuuggauguu

SEQ ID NO: 3924 - RNA, 24 nt, Fowlpox virus
uauuguguacaaguaaaauaauua

SEQ ID NO: 3925 - RNA, 19 nt, Chimpanzee cytomegalovirus
ugacgggaagccuuacgag

SEQ ID NO: 3926 - RNA, 24 nt, Vaccinia virus
uacgguggagaauuauuaaauuac

SEQ ID NO: 3927 - RNA, 23 nt, Rous sarcoma virus
uacgcggauaggaauccccucag

SEQ ID NO: 3928 - RNA, 24 nt, Camelpox virus
ugggaugggggugugggauggggg

SEQ ID NO: 3929 - RNA, 22 nt, Myxoma virus
uauaaauuuaauaagacuuuga

SEQ ID NO: 3930 - RNA, 22 nt, Rous sarcoma virus
uaaggcaggcaagacagcuauu

SEQ ID NO: 3931 - RNA, 24 nt, Rous sarcoma virus
uuaauuggaauuuuggaauuuaca

SEQ ID NO: 3932 - RNA, 24 nt, Rous sarcoma virus
uaauaauuuuccaagauguacaau

SEQ ID NO: 3933 - RNA, 24 nt, Sulfolobus virus SIRV-1
aagcuuuaaaguuaaauauccugc

SEQ ID NO: 3934 - RNA, 24 nt, Hendra virus
aacuuuaugaggaacuggugagaa

SEQ ID NO: 3935 - RNA, 24 nt, Rabbit fibroma virus
uuuguauucauucaaugucucuuu

SEQ ID NO: 3936 - RNA, 24 nt, Vaccinia virus
uuuuucguuuuuuucguuuuuuuc

SEQ ID NO: 3937 - RNA, 24 nt, African swine fever virus
ucuaucguuggcauuucaaguucc

SEQ ID NO: 3938 - RNA, 24 nt, Hendra virus
uauacuuaacuauacuuauagacu

SEQ ID NO: 3939 - RNA, 24 nt, Human papillomavirus type 54
uauuauggcaauguauuacaacag

SEQ ID NO: 3940 - RNA, 24 nt, Human herpesvirus 3
uuaaugacucaucccauaaguggu

SEQ ID NO: 3941 - RNA, 24 nt, Foot-and-mouth disease virus SAT 2
aaagugcauguaucaauuuuaguc

SEQ ID NO: 3942 - RNA, 22 nt, Fowlpox virus
ugcguugaugucguuauucuga

SEQ ID NO: 3943 - RNA, 24 nt, Chimpanzee cytomegalovirus
uaugaugcaauaaauacacgacau

SEQ ID NO: 3944 - RNA, 24 nt, African swine fever virus
uugaauccaaaacaucaguuaaca

SEQ ID NO: 3945 - RNA, 24 nt, Human herpesvirus 3
ucuguggugccuuaugaaucagac

SEQ ID NO: 3946 - RNA, 24 nt, Foot-and-mouth disease virus SAT 2
ucucugaaccuugcgugugugcaa

SEQ ID NO: 3947 - RNA, 24 nt, B19 virus
uacauugaacaauugauauaagug

SEQ ID NO: 3948 - RNA, 24 nt, Rat cytomegalovirus
uggcguccucgccguccagcacga

SEQ ID NO: 3949 - RNA, 24 nt, Rat cytomegalovirus
uguguaaacuaaauaacguuuucu

SEQ ID NO: 3950 - RNA, 24 nt, Hendra virus
ucuugcugaauaggcuaucuacua

SEQ ID NO: 3951 - RNA, 24 nt, Human papillomavirus type 54
ugcuauguguauauagugagguau

SEQ ID NO: 3952 - RNA, 24 nt, Human papillomavirus type 54
uccacgguccacuccuccucaagc

SEQ ID NO: 3953 - RNA, 24 nt, Fowlpox virus
uauacagauuugauuuaucuauua

SEQ ID NO: 3954 - RNA, 24 nt, Rat cytomegalovirus
uacagggaggugcagaucaugcgc

SEQ ID NO: 3955 - RNA, 24 nt, Hendra virus
ucagauuauaaauuuucuaauaaa

SEQ ID NO: 3956 - RNA, 24 nt, Tupaia paramyxovirus
uaaaagaaaguagacagugauacg

SEQ ID NO: 3957 - RNA, 24 nt, Fowlpox virus
ucuauguaauaauaacgauuacau

SEQ ID NO: 3958 - RNA, 24 nt, Simian T-lymphotropic virus 1
ucuagguaaguuuagagcucaggu

SEQ ID NO: 3959 - RNA, 17 nt, Fowl adenovirus A
uagcuuugauguuguau

SEQ ID NO: 3960 - RNA, 24 nt, Beet yellows virus
ggaggaaagaaguuccuggucaag

SEQ ID NO: 3961 - RNA, 24 nt, Meleagrid herpesvirus 1
cggcaagaccgcuccccggcaacc

SEQ ID NO: 3962 - RNA, 24 nt, Melanoplus sanguinipes entomopoxvirus
uggcauauuaaguguaguuauauu

SEQ ID NO: 3963 - RNA, 24 nt, Melanoplus sanguinipes entomopoxvirus
uggaaagcuucuaccucuggacau

SEQ ID NO: 3964 - RNA, 24 nt, Melanoplus sanguinipes entomopoxvirus
uguuaagcugagauggcugcauuu

SEQ ID NO: 3965 - RNA, 21 nt, Simian T-lymphotropic virus 1
cugccgccucccgccuguggu

SEQ ID NO: 3966 - RNA, 24 nt, Fowl adenovirus A
ucugcagcauugucugccugguca

SEQ ID NO: 3967 - RNA, 24 nt, Beet yellows virus
ucacugauuccuuuuucgaugccg

SEQ ID NO: 3968 - RNA, 24 nt, Simian type D virus 1
uucccgaggggucauuucuuauca

SEQ ID NO: 3969 - RNA, 24 nt, Paramecium bursaria Chlorella virus 1
ucuuuugauuuauccguacacucg

SEQ ID NO: 3970 - RNA, 24 nt, Paramecium bursaria Chlorella virus 1
ucugaauauccaaaguuaucaggu

SEQ ID NO: 3971 - RNA, 24 nt, Human papillomavirus type 66
uaauuuguguguuugcgcuuugcu

SEQ ID NO: 3972 - RNA, 24 nt, Cercopithecine herpesvirus 7
uacaagcacgcaggugcaaaccga

SEQ ID NO: 3973 - RNA, 24 nt, Tupaia paramyxovirus
aaucaacccuaggcaaacacacua

SEQ ID NO: 3974 - RNA, 24 nt, Fowl adenovirus A
uaugcagagucggcaagcuuugga

SEQ ID NO: 3975 - RNA, 24 nt, Human herpesvirus 6
caagaucgacgugacuauuuugca

SEQ ID NO: 3976 - RNA, 24 nt, Gallid herpesvirus 3
ugggaguaucugucaaguauauuc

SEQ ID NO: 3977 - RNA, 24 nt, Gallid herpesvirus 3
uuuaaauuagacaaggugcgcguc

SEQ ID NO: 3978 - RNA, 24 nt, Lymphocystis disease virus 1
uuaacgccuguagaacaauggacu

SEQ ID NO: 3979 - RNA, 24 nt, Lymphocystis disease virus 1
ugcaaaagauagaggcuuaauuug

SEQ ID NO: 3980 - RNA, 24 nt, Nipah virus
ugauggagucguaaaaaguuuuau

SEQ ID NO: 3981 - RNA, 23 nt, Sheeppox virus
uuaguucuuucucuaacuuauac

SEQ ID NO: 3982 - RNA, 24 nt, Sheeppox virus
uucgcgcguguauggggagugcgg

SEQ ID NO: 3983 - RNA, 23 nt, Sheeppox virus
cguggcggugggcggcgcggggg

SEQ ID NO: 3984 - RNA, 24 nt, Sheeppox virus
gcggacuuuggggcguuuugccgc

SEQ ID NO: 3985 - RNA, 24 nt, Sheeppox virus
ccccguggacgccgcccucgagcc

SEQ ID NO: 3986 - RNA, 24 nt, Sheeppox virus
uauaaugucuuaucucguauauau

SEQ ID NO: 3987 - RNA, 24 nt, Sheeppox virus
uccacaaguuugagggcaagaacc

SEQ ID NO: 3988 - RNA, 17 nt, Sheeppox virus
gcccggugccgcuuggc

SEQ ID NO: 3989 - RNA, 24 nt, Sheeppox virus
uggcgugagacauggugugaccua

SEQ ID NO: 3990 - RNA, 24 nt, Sheeppox virus
cagccgcggcggacgucgcuggcg

SEQ ID NO: 3991 - RNA, 24 nt, Sheeppox virus
ucuugcugcucuugcugcucuugc

SEQ ID NO: 3992 - RNA, 24 nt, Sheeppox virus
gguugcgccgcugcagcggcuggc

SEQ ID NO: 3993 - RNA, 24 nt, Sheeppox virus
ucaaagaccgauauggaaacucaa

SEQ ID NO: 3994 - RNA, 24 nt, Sheeppox virus
ugcccaugagcagguacacuuugg

SEQ ID NO: 3995 - RNA, 24 nt, Sheeppox virus
uaccagcgccuggacgcgcuguug

SEQ ID NO: 3996 - RNA, 19 nt, Sheeppox virus
cagccgccgucgccauccc

SEQ ID NO: 3997 - RNA, 21 nt, Sheeppox virus
gaucugggcccccguccucuu

SEQ ID NO: 3998 - RNA, 24 nt, Sheeppox virus
cacaaguauuauuaaaaaugagua

SEQ ID NO: 3999 - RNA, 24 nt, Sheeppox virus
uggauggugagcuuggagagagcg

SEQ ID NO: 4000 - RNA, 24 nt, Sheeppox virus
caucgcguggugggacgcguuuuc

SEQ ID NO: 4001 - RNA, 24 nt, Human herpesvirus 5
cuggcgcgggcggccgugccgcgu

SEQ ID NO: 4002 - RNA, 22 nt, Human herpesvirus 5
ucucgcggcccuucaacggcac

SEQ ID NO: 4003 - RNA, 24 nt, Human herpesvirus 5
uuccaaagcggcgugucugaguca

SEQ ID NO: 4004 - RNA, 24 nt, Human herpesvirus 5
uggaguaggcgauguuguccuccg

SEQ ID NO: 4005 - RNA, 24 nt, Sheeppox virus
gaccucgucacgugcgcgcugcug

SEQ ID NO: 4006 - RNA, 24 nt, Sheeppox virus
gccccgguuccggcuccggccccg

SEQ ID NO: 4007 - RNA, 24 nt, Human herpesvirus 5
caucauguuccuacacgccuugca

SEQ ID NO: 4008 - RNA, 20 nt, Human herpesvirus 5
cuugcggaacaggucgcgga

SEQ ID NO: 4009 - RNA, 24 nt, Human herpesvirus 5
cgccguagcgggguguuuuuuaau

SEQ ID NO: 4010 - RNA, 24 nt, Human herpesvirus 5
cguugcacgcggcggguaccgaaa

SEQ ID NO: 4011 - RNA, 24 nt, Human herpesvirus 5
ucgccuaugcuucgcgcgucacca

SEQ ID NO: 4012 - RNA, 24 nt, Human herpesvirus 5
uccaugagcuccacgauccgcugg

SEQ ID NO: 4013 - RNA, 24 nt, Sheeppox virus
acgccaugagaaagcucuacaagg

SEQ ID NO: 4014 - RNA, 24 nt, Sheeppox virus
caucgaggccgugcucgcguucaa

SEQ ID NO: 4015 - RNA, 24 nt, Human herpesvirus 5
uacaauuucuuuagcacauuuccu

SEQ ID NO: 4016 - RNA, 24 nt, Human herpesvirus 5
cagcagcuucugcauguugcccag

SEQ ID NO: 4017 - RNA, 24 nt, Human herpesvirus 5
uggcgugcgcguuccacucguccg

SEQ ID NO: 4018 - RNA, 24 nt, Human herpesvirus 5
acgcgaagcgcgcaugcgcacguu

SEQ ID NO: 4019 - RNA, 24 nt, Human herpesvirus 5
uggaagcgguaccgcgggcgcguc

SEQ ID NO: 4020 - RNA, 24 nt, Human herpesvirus 5
uugcuuauggccagucccuagcuu

SEQ ID NO: 4021 - RNA, 21 nt, Human herpesvirus 5
ggagaaagcguaacggagagc

SEQ ID NO: 4022 - RNA, 20 nt, Human herpesvirus 5
cagcucgcggguguaugcgu

SEQ ID NO: 4023 - RNA, 21 nt, Human herpesvirus 5
ugcccuggccuccccuccccc

SEQ ID NO: 4024 - RNA, 24 nt, Human herpesvirus 5
aucacuuucacggugauuuauucu

SEQ ID NO: 4025 - RNA, 24 nt, Human herpesvirus 5
uaacgaacugucucaacgacugca

SEQ ID NO: 4026 - RNA, 24 nt, Human herpesvirus 5
cauuaaacaggcuggacaugcgcg

SEQ ID NO: 4027 - RNA, 24 nt, Human herpesvirus 5
cagaacuauguaucagccuagagu

SEQ ID NO: 4028 - RNA, 24 nt, Human herpesvirus 5
uagaacuugccauucucauugaca

SEQ ID NO: 4029 - RNA, 24 nt, Human herpesvirus 5
uucgagcgucagcggcguggggaa

SEQ ID NO: 4030 - RNA, 24 nt, Human herpesvirus 5
augcgguucggggacccgcgggga

SEQ ID NO: 4031 - RNA, 24 nt, Human herpesvirus 5
ugguauguguggcuacuaauaggc

SEQ ID NO: 4032 - RNA, 24 nt, Lumpy skin disease virus
uaucuuaagauauuucuuuagucu

SEQ ID NO: 4033 - RNA, 24 nt, Lumpy skin disease virus
aagaggguuacgugcccgggacgg

SEQ ID NO: 4034 - RNA, 24 nt, Zaire Ebola virus
caccuuugaaagcaccuccuaacg

SEQ ID NO: 4035 - RNA, 24 nt, Zaire Ebola virus
agacgauagugacgacgaaguagg

SEQ ID NO: 4036 - RNA, 22 nt, Zaire Ebola virus
ugacuacaccuuuagcugaaau

SEQ ID NO: 4037 - RNA, 24 nt, Fowlpox virus
uuuauggguggaggucuccugucu

SEQ ID NO: 4038 - RNA, 24 nt, Peanut chlorotic streak virus
gauaaaaaaguuuuucgaaaucuc

SEQ ID NO: 4039 - RNA, 24 nt, Human herpesvirus 5
ggggauugugaaccguggcugagg

SEQ ID NO: 4040 - RNA, 24 nt, Human herpesvirus 5
ucuuugacgccuacagcaguagua

SEQ ID NO: 4041 - RNA, 24 nt, Human herpesvirus 5
uuaauguuuaacgccuacaacagu

SEQ ID NO: 4042 - RNA, 24 nt, Peanut chlorotic streak virus
aagcuuuucgaaaucucgauaaaa

SEQ ID NO: 4043 - RNA, 24 nt, Peanut chlorotic streak virus
gauaaaaaagcuuuucgaaaucuc

SEQ ID NO: 4044 - RNA, 19 nt, Human herpesvirus 5
ucccgcggauggacguucu

SEQ ID NO: 4045 - RNA, 24 nt, Human herpesvirus 5
cagcaguaguaauaauuuuaaugu

SEQ ID NO: 4046 - RNA, 24 nt, Human herpesvirus 8
uggcugcuguucaacggacccgcc

SEQ ID NO: 4047 - RNA, 23 nt, Human herpesvirus 8
uaacaggaaaugcucuuaggcag

SEQ ID NO: 4048 - RNA, 24 nt, Peanut chlorotic streak virus
uaacucgagcucucgauaaaaaag

SEQ ID NO: 4049 - RNA, 24 nt, Human herpesvirus 5
cagcaguaguaauaauuuuaaugu

SEQ ID NO: 4050 - RNA, 24 nt, Himetobi P virus
aaguaguuuuuugauaucgaaugg

SEQ ID NO: 4051 - RNA, 22 nt, Himetobi P virus
uacguuaacagguuucgaaaca

SEQ ID NO: 4052 - RNA, 24 nt, Macaca mulatta rhadinovirus
gcgcggcgcggaccuuucaagugu

SEQ ID NO: 4053 - RNA, 24 nt, Macaca mulatta rhadinovirus
uccuuuaccgcucauauggcuucu

SEQ ID NO: 4054 - RNA, 24 nt, Macaca mulatta rhadinovirus
gucgcgcaguucgcgcacgcgauu

SEQ ID NO: 4055 - RNA, 24 nt, Macaca mulatta rhadinovirus
ugaacagcagcuugucgcgcucau

SEQ ID NO: 4056 - RNA, 24 nt, Human herpesvirus 5
aaaaugcuuuccggcgaaaaaaua

SEQ ID NO: 4057 - RNA, 24 nt, Himetobi P virus
uauaaguuuucaagaagaauaccu

SEQ ID NO: 4058 - RNA, 24 nt, Himetobi P virus
uauuuggcgcgaguaagccuauga

SEQ ID NO: 4059 - RNA, 24 nt, Macaca mulatta rhadinovirus
gugccuuguuuuaucugccguaug

SEQ ID NO: 4060 - RNA, 24 nt, Cocksfoot mottle virus
ggccaggaggcaaucccagaggag

SEQ ID NO: 4061 - RNA, 22 nt, Bovine herpesvirus 4
uccgcgguccaccauacccgcc

SEQ ID NO: 4062 - RNA, 24 nt, Bovine herpesvirus 4
acaugcugggccuaccguggacuc

SEQ ID NO: 4063 - RNA, 24 nt, Murid herpesvirus 4
aagggcacuucuacugaugauagg

SEQ ID NO: 4064 - RNA, 24 nt, Macaca mulatta rhadinovirus
acgcguaccucgggcgcguuggcu

SEQ ID NO: 4065 - RNA, 24 nt, Cocksfoot mottle virus
ucuaagggucgagcagagcuggag

SEQ ID NO: 4066 - RNA, 24 nt, Bovine herpesvirus 4
uagaucuccggaucgaugcggacg

SEQ ID NO: 4067 - RNA, 24 nt, Murid herpesvirus 4
uuugucacaguaguagacaacacg

SEQ ID NO: 4068 - RNA, 24 nt, Avian infectious bronchitis virus
uauggaacacgauuauuauaaaau

SEQ ID NO: 4069 - RNA, 24 nt, Paramecium bursaria Chlorella virus 1
ugaaauauccgauucaucucuaga

SEQ ID NO: 4070 - RNA, 24 nt, Paramecium bursaria Chlorella virus 1
cuagaaggugauguuuuggccgga

SEQ ID NO: 4071 - RNA, 21 nt, Paramecium bursaria Chlorella virus 1
uuccagaucaaagaggguggu

SEQ ID NO: 4072 - RNA, 24 nt, Paramecium bursaria Chlorella virus 1
ucggaacucucccugggggcuuuu

SEQ ID NO: 4073 - RNA, 24 nt, Macaca mulatta rhadinovirus
uacgcaccaauccacguagagacc

SEQ ID NO: 4074 - RNA, 24 nt, Cocksfoot mottle virus
ucgaaagcuagccaagucgcgcug

SEQ ID NO: 4075 - RNA, 24 nt, Cocksfoot mottle virus
gcgaaggcagcuauaucgcgguuu

SEQ ID NO: 4076 - RNA, 24 nt, Cocksfoot mottle virus
cucgccuugguguaucgcaauggg

SEQ ID NO: 4077 - RNA, 24 nt, Cocksfoot mottle virus
uccccagggucauuaacaaucuau

SEQ ID NO: 4078 - RNA, 24 nt, Bovine herpesvirus 4
ugacggggguucgcgaagacgggc

SEQ ID NO: 4079 - RNA, 24 nt, Bovine herpesvirus 4
uaccuuuugaagagcagcgcuuaa

SEQ ID NO: 4080 - RNA, 24 nt, Murid herpesvirus 4
cgagagcaauguuaugcuagacau

SEQ ID NO: 4081 - RNA, 20 nt, Avian infectious bronchitis virus
ucgguuggcgugauugguuu

SEQ ID NO: 4082 - RNA, 24 nt, Paramecium bursaria Chlorella virus 1
ucagccuuuugcgguuaccgcugg

SEQ ID NO: 4083 - RNA, 24 nt, Paramecium bursaria Chlorella virus 1
ugagagguuucaaacgauuguuua

SEQ ID NO: 4084 - RNA, 17 nt, Paramecium bursaria Chlorella virus 1
uccccugguuugacaua

SEQ ID NO: 4085 - RNA, 24 nt, Paramecium bursaria Chlorella virus 1
uuccaguuggcccgauaacguacu

SEQ ID NO: 4086 - RNA, 24 nt, Human herpesvirus 5
ugaaaugaaaggauggaaacaugg

SEQ ID NO: 4087 - RNA, 24 nt, Human herpesvirus 5
uaccauagucuuauuuuuuuuucu

SEQ ID NO: 4088 - RNA, 24 nt, Human herpesvirus 5
uauccaauuaggcaagugaaacuu

SEQ ID NO: 4089 - RNA, 24 nt, Yaba-like disease virus
ugucgaggacguaucccugcacca

SEQ ID NO: 4090 - RNA, 24 nt, Monkeypox virus
cacccguagacaacgaggcgggac

SEQ ID NO: 4091 - RNA, 24 nt, Monkeypox virus
uaucagauuuuuacacccaaacca

SEQ ID NO: 4092 - RNA, 24 nt, Human foamy virus
ucaggaccugcagacucugaguga

SEQ ID NO: 4093 - RNA, 24 nt, Human foamy virus
uguaaauggaguauuuaucugaga

SEQ ID NO: 4094 - RNA, 24 nt, Human foamy virus
ugaauuaauucuucugauagcuca

SEQ ID NO: 4095 - RNA, 24 nt, Human foamy virus
uauaagaauuaucagauucuaacu

SEQ ID NO: 4096 - RNA, 24 nt, Reston Ebola virus
uuccuuaaggccucguccgaaucu

SEQ ID NO: 4097 - RNA, 24 nt, Reston Ebola virus
uaaggugauuauauuuuaguauua

SEQ ID NO: 4098 - RNA, 24 nt, Human foamy virus
ucaacauauuaaacugcaggauug

SEQ ID NO: 4099 - RNA, 24 nt, Human foamy virus
ugcuagaucuuuuaaugagauauu

SEQ ID NO: 4100 - RNA, 24 nt, Equine herpesvirus 4
aggccacacccacauggaggccac

SEQ ID NO: 4101 - RNA, 24 nt, Swinepox virus
gggcaugggggcuacggucacguu

SEQ ID NO: 4102 - RNA, 24 nt, Human herpesvirus 1
uuagaguucugacaaaucaaacca

SEQ ID NO: 4103 - RNA, 24 nt, Human herpesvirus 1
caagaacuguuaucccgaggcacg

SEQ ID NO: 4104 - RNA, 24 nt, Equine herpesvirus 4
uacacaauuguuccugcucguuaa

SEQ ID NO: 4105 - RNA, 24 nt, Equine herpesvirus 4
uuggagcuccucccuaaaugccuu

SEQ ID NO: 4106 - RNA, 24 nt, Equine herpesvirus 4
ugauggacuucuuggcgucgcuac

SEQ ID NO: 4107 - RNA, 21 nt, Human herpesvirus 1
uaccucaguuaauagauauag

SEQ ID NO: 4108 - RNA, 24 nt, Equine herpesvirus 4
agccgguuguccuccacgggcagc

SEQ ID NO: 4109 - RNA, 24 nt, Sesbania mosaic virus
ucucguugcccugcugcugaggcu

SEQ ID NO: 4110 - RNA, 21 nt, Sesbania mosaic virus
uacugcaccuccucaaccaau

SEQ ID NO: 4111 - RNA, 24 nt, Fowlpox virus
caccggagaaaauacgcccaagcc

SEQ ID NO: 4112 - RNA, 24 nt, Fowlpox virus
uaguacauacagaauuucuuucgu

SEQ ID NO: 4113 - RNA, 24 nt, Fowlpox virus
ucuuggucggcgucucauugccgg

SEQ ID NO: 4114 - RNA, 24 nt, Sesbania mosaic virus
cacacguuauuagggcuaacaggu

SEQ ID NO: 4115 - RNA, 24 nt, Fowlpox virus
cacaccucggcgguccauaagaaa

SEQ ID NO: 4116 - RNA, 24 nt, Fowlpox virus
aaugaaauuauagcuacgucuauc

SEQ ID NO: 4117 - RNA, 24 nt, Equine herpesvirus 2
uaccagcaggugacgcaccucagg

SEQ ID NO: 4118 - RNA, 24 nt, Equine herpesvirus 2
cauggaucucucgcggggugcgua

SEQ ID NO: 4119 - RNA, 17 nt, Equine herpesvirus 2
ugaggucguaggcaccc

SEQ ID NO: 4120 - RNA, 20 nt, Sulfolobus virus SIRV-2
uucaacuugcugucucacug

SEQ ID NO: 4121 - RNA, 24 nt, Sulfolobus virus SIRV-2
ucuggaauaguaucuacaacauua

SEQ ID NO: 4122 - RNA, 19 nt, Fowlpox virus
ucacgcgccaagguucggc

SEQ ID NO: 4123 - RNA, 18 nt, Equine herpesvirus 2
ugggagggcgagggcggc

SEQ ID NO: 4124 - RNA, 24 nt, Equine herpesvirus 2
ugucagggacggcaccuggaaccu

SEQ ID NO: 4125 - RNA, 24 nt, Equine herpesvirus 2
ugaggucguaggcacccaguaaug

SEQ ID NO: 4126 - RNA, 24 nt, Equine herpesvirus 2
uacguuguccgcgggauucuagcc

SEQ ID NO: 4127 - RNA, 20 nt, Sulfolobus virus SIRV-2
uaaauuggaucuuguucugu

SEQ ID NO: 4128 - RNA, 24 nt, Sulfolobus virus SIRV-2
uaauguauauaguuuguucucauu

SEQ ID NO: 4129 - RNA, 24 nt, Sulfolobus virus SIRV-2
cagcccuagaaagcuuguuuucac

SEQ ID NO: 4130 - RNA, 24 nt, Sulfolobus virus SIRV-2
aaagugaagaaauugaaguauaag

SEQ ID NO: 4131 - RNA, 24 nt, Sulfolobus virus SIRV-2
agaggcagaccuaagggcucuaaa

SEQ ID NO: 4132 - RNA, 24 nt, Bovine herpesvirus 4
ugacugaauguuguguccgaugau

SEQ ID NO: 4133 - RNA, 24 nt, Bovine herpesvirus 4
uaaggaagaguuuuuuuguguuuu

SEQ ID NO: 4134 - RNA, 24 nt, Myxoma virus
uauggaguggucucaggagcuguc

SEQ ID NO: 4135 - RNA, 24 nt, Human herpesvirus 5
acucucgucguagcacguucaaau

SEQ ID NO: 4136 - RNA, 24 nt, Ateline herpesvirus 3
ugaaaaaaagauauagugaaggac

SEQ ID NO: 4137 - RNA, 24 nt, Bovine herpesvirus 4
ugagugcaaauaggauguuauuuc

SEQ ID NO: 4138 - RNA, 24 nt, Myxoma virus
uaucgauacguucgucaacgugau

SEQ ID NO: 4139 - RNA, 24 nt, Myxoma virus
uggaaguuucgccuuauacggacg

SEQ ID NO: 4140 - RNA, 24 nt, Myxoma virus
ucuacgguggcguguuuaaacugc

SEQ ID NO: 4141 - RNA, 24 nt, Equine herpesvirus 2
uuuaacaguauaucuucaauagaa

SEQ ID NO: 4142 - RNA, 24 nt, Human herpesvirus 5
uuugucccaggagcgggguccuau

SEQ ID NO: 4143 - RNA, 24 nt, Ictalurid herpesvirus 1
cccgguaguuacuuggacaauauc

SEQ ID NO: 4144 - RNA, 22 nt, Ictalurid herpesvirus 1
uagcacaucguuuauugacagu

SEQ ID NO: 4145 - RNA, 24 nt, Ictalurid herpesvirus 1
caccagguccucagcgccgcuuaa

SEQ ID NO: 4146 - RNA, 24 nt, Ictalurid herpesvirus 1
uagccguucuagcuccgucgcuag

SEQ ID NO: 4147 - RNA, 24 nt, Ateline herpesvirus 3
uagauguuugucuaauuuaguaaa

SEQ ID NO: 4148 - RNA, 24 nt, Ateline herpesvirus 3
uacagaagaauggaaauuagcuuu

SEQ ID NO: 4149 - RNA, 24 nt, Ateline herpesvirus 3
uuuaccgguugcccaucugucuaa

SEQ ID NO: 4150 - RNA, 24 nt, Ateline herpesvirus 3
ucuaaaauaauauucguuuucuaa

SEQ ID NO: 4151 - RNA, 24 nt, Ictalurid herpesvirus 1
ugauuguaacauaguaucuauauu

SEQ ID NO: 4152 - RNA, 24 nt, Ictalurid herpesvirus 1
uauuagaugauauauuucguauaa

SEQ ID NO: 4153 - RNA, 24 nt, Paramecium bursaria Chlorella virus 1
uggaaugggaagauaagaauccua

SEQ ID NO: 4154 - RNA, 24 nt, Rat cytomegalovirus
gcgagcgugcgcgggauccccggc

SEQ ID NO: 4155 - RNA, 24 nt, Rat cytomegalovirus
gucguucuuucgucgggagaagaa

SEQ ID NO: 4156 - RNA, 24 nt, Monkeypox virus
aggcagacagacggcaggcggccg

SEQ ID NO: 4157 - RNA, 24 nt, Monkeypox virus
uaugccgacugacguugacguuaa

SEQ ID NO: 4158 - RNA, 24 nt, Monkeypox virus
ugugucugacacuccuccccuucc

SEQ ID NO: 4159 - RNA, 24 nt, Ectromelia virus
uuucuggcuuuuaaaaauaaaaac

SEQ ID NO: 4160 - RNA, 24 nt, Cowpox virus
uagauuuuaauuuaaaacuccuau

SEQ ID NO: 4161 - RNA, 24 nt, Cowpox virus
uaagaauauagcaacaaugauaau

SEQ ID NO: 4162 - RNA, 24 nt, Monkeypox virus
acccggccuacgacugcgugcucu

SEQ ID NO: 4163 - RNA, 22 nt, Monkeypox virus
cagccgcgucaaccccguggcc

SEQ ID NO: 4164 - RNA, 24 nt, Cowpox virus
caaaagcuuuuuugcgacuuuuag

SEQ ID NO: 4165 - RNA, 21 nt, Camelpox virus
uugguugacugcgcagcucac

SEQ ID NO: 4166 - RNA, 24 nt, Camelpox virus
uuagaaaauagcaaugauuuuccc

SEQ ID NO: 4167 - RNA, 24 nt, Variola virus
uugaaaaaauuuuuguguccgugu

SEQ ID NO: 4168 - RNA, 18 nt, Alcelaphine herpesvirus 1
ccgcgcagcagauagccc

SEQ ID NO: 4169 - RNA, 24 nt, Ectromelia virus
aaguauacuucguaaaauauucgu

SEQ ID NO: 4170 - RNA, 24 nt, Cowpox virus
caucucauuagcgcccggcgcggg

SEQ ID NO: 4171 - RNA, 24 nt, Cowpox virus
ucuauauuaauaggagauaguugu

SEQ ID NO: 4172 - RNA, 24 nt, Camelpox virus
uuaaagcuaaauugcuuauggugg

SEQ ID NO: 4173 - RNA, 23 nt, Alcelaphine herpesvirus 1
aaacacccgugcggucucuguau

SEQ ID NO: 4174 - RNA, 24 nt, Alcelaphine herpesvirus 1
uucaauaucugaaucuaaaguaaa

SEQ ID NO: 4175 - RNA, 24 nt, Alcelaphine herpesvirus 1
uugaaucuguuccuccaugcauuu

SEQ ID NO: 4176 - RNA, 24 nt, Alcelaphine herpesvirus 1
uucguguuuauucaauucugagua

SEQ ID NO: 4177 - RNA, 24 nt, Ectromelia virus
caaaagccuuguuuuguauauucu

SEQ ID NO: 4178 - RNA, 24 nt, Ectromelia virus
auggauuuauagguuuuguagcua

SEQ ID NO: 4179 - RNA, 24 nt, Ectromelia virus
uggcaauauauaaguaaaagcucc

SEQ ID NO: 4180 - RNA, 24 nt, Cowpox virus
aauacagauacuaauguuucaggg

SEQ ID NO: 4181 - RNA, 24 nt, Camelpox virus
ucuuuguuaauuagcguaaauuuu

SEQ ID NO: 4182 - RNA, 24 nt, Variola virus
uucucaugaacggaacgauuccua

SEQ ID NO: 4183 - RNA, 24 nt, Murid herpesvirus 4
uucagcauaaguuuauuuuggucu

SEQ ID NO: 4184 - RNA, 24 nt, Camelpox virus
uaucuguucagucccugccaacua

SEQ ID NO: 4185 - RNA, 24 nt, Variola virus
cguuccguuagaaacguuuucaac

SEQ ID NO: 4186 - RNA, 19 nt, Variola virus
uaccccgccgacuccuuug

SEQ ID NO: 4187 - RNA, 17 nt, Murid herpesvirus 4
uaccacagguaccuuuu

SEQ ID NO: 4188 - RNA, 24 nt, Murid herpesvirus 4
uagaagauuguauaaguucggggc

SEQ ID NO: 4189 - RNA, 24 nt, Sulfolobus virus SIRV-1
uaagaguaucgccaccgacgacga

SEQ ID NO: 4190 - RNA, 24 nt, Sulfolobus virus SIRV-1
caaauggaaaauuuguuuuaucua

SEQ ID NO: 4191 - RNA, 24 nt, Sulfolobus virus SIRV-1
ugauuuguuaugugauccuaaaaa

SEQ ID NO: 4192 - RNA, 24 nt, Murid herpesvirus 4
caauuuuugaguucuauuucaaug

SEQ ID NO: 4193 - RNA, 22 nt, Murid herpesvirus 4
uaaugcuguauuuaauacaacu

SEQ ID NO: 4194 - RNA, 24 nt, Rat cytomegalovirus
uaacgagauugaagagacagacaa

SEQ ID NO: 4195 - RNA, 24 nt, Rat cytomegalovirus
uacaccgccaccguaaaaccacgc

SEQ ID NO: 4196 - RNA, 24 nt, Rat cytomegalovirus
aaguagcugacgucaaggauugac

SEQ ID NO: 4197 - RNA, 24 nt, Rat cytomegalovirus
uaggccccgucacgugacuuacca

SEQ ID NO: 4198 - RNA, 24 nt, Sulfolobus virus SIRV-1
uggaaaaauccagcuaaugcagau

SEQ ID NO: 4199 - RNA, 24 nt, Sulfolobus virus SIRV-1
uccgaagaccuuggagcugaaggu

SEQ ID NO: 4200 - RNA, 24 nt, Rat cytomegalovirus
gaccgggccgcccgaucgaagaug

SEQ ID NO: 4201 - RNA, 24 nt, Sulfolobus virus SIRV-1
cuccccguuccccgagggucccgg

SEQ ID NO: 4202 - RNA, 24 nt, Human adenovirus C
ccgcuccauggagucucagcugca

SEQ ID NO: 4203 - RNA, 24 nt, Sulfolobus virus SIRV-1
agaaaguuuuuagcgugugucaaa

SEQ ID NO: 4204 - RNA, 24 nt, Sulfolobus virus SIRV-1
uugaaagccaaauauuugccaaaa

SEQ ID NO: 4205 - RNA, 24 nt, Rat cytomegalovirus
caggagaccaaaacauacacauga

SEQ ID NO: 4206 - RNA, 24 nt, Human adenovirus C
uggaaacuuacucgccacccccca

SEQ ID NO: 4207 - RNA, 24 nt, Human adenovirus C
caucguggagaucaucgacgagcu

SEQ ID NO: 4208 - RNA, 24 nt, Human adenovirus C
gcuacaguuugcauacgaucacau

SEQ ID NO: 4209 - RNA, 24 nt, Human adenovirus C
agaguacguuuacuacgagaacua

SEQ ID NO: 4210 - RNA, 24 nt, Equine herpesvirus 2
uagaaacuauaacuuagaauuaaa

SEQ ID NO: 4211 - RNA, 24 nt, Equine herpesvirus 2
uuugaaacauagcuuuuccaacaa

SEQ ID NO: 4212 - RNA, 24 nt, Equine herpesvirus 2
ugaggagugccuuucucgauugag

SEQ ID NO: 4213 - RNA, 24 nt, Equine herpesvirus 2
ucucuuguagcccuccaacauugg

SEQ ID NO: 4214 - RNA, 24 nt, African swine fever virus
uggaacuggaucauuaggaccucu

SEQ ID NO: 4215 - RNA, 24 nt, Rice yellow stunt virus
uaccucaacauucucaacagaaaa

SEQ ID NO: 4216 - RNA, 22 nt, Ryegrass mottle virus
uguugcgucucccauagugaag

SEQ ID NO: 4217 - RNA, 24 nt, Fowl adenovirus D
ugagcuccgcgaagacucuguaag

SEQ ID NO: 4218 - RNA, 24 nt, Human herpesvirus 5
accccguauaucacaagucucugu

SEQ ID NO: 4219 - RNA, 24 nt, Human herpesvirus 5
uagagagcacacacgacgaccggg

SEQ ID NO: 4220 - RNA, 24 nt, Cactus virus X
ucaagggcugugaacacauuggca

SEQ ID NO: 4221 - RNA, 24 nt, Swinepox virus
uuuaauguguuuuauauuauauuu

SEQ ID NO: 4222 - RNA, 24 nt, Equine herpesvirus 1
caugccgccgcucaaacuuaaacc

SEQ ID NO: 4223 - RNA, 24 nt, Lymphocystis disease virus 1
cauuucuaaauauaaauuaaauuu

SEQ ID NO: 4224 - RNA, 24 nt, Human herpesvirus 1
agggagugggauaggguucgacgg

SEQ ID NO: 4225 - RNA, 24 nt, Bovine herpesvirus 1
uuugccguuuauuuguuuauuggg

SEQ ID NO: 4226 - RNA, 24 nt, Paramecium bursaria Chlorella virus 1
ugacaaaguaagguaauauaaauu

SEQ ID NO: 4227 - RNA, 22 nt, Rat cytomegalovirus
aucgcgguccguucgggagcgg

SEQ ID NO: 4228 - RNA, 17 nt, Paramecium bursaria Chlorella virus 1
ucaaaagauuaauacga

SEQ ID NO: 4229 - RNA, 24 nt, African swine fever virus
ugaguauauuauaugccuuagccu

SEQ ID NO: 4230 - RNA, 18 nt, Equine herpesvirus 1
guauggcuguaaagggua

SEQ ID NO: 4231 - RNA, 24 nt, Respiratory syncytial virus
uucaaauggagccugaaaauuaua

SEQ ID NO: 4232 - RNA, 24 nt, Camelpox virus
ugggaauaaaauacuacuguugag

SEQ ID NO: 4233 - RNA, 24 nt, Rat cytomegalovirus
ugagcaccuccccagggaagauga

SEQ ID NO: 4234 - RNA, 21 nt, Tupaia herpesvirus
uccgcgcucgggccccccgcc

SEQ ID NO: 4235 - RNA, 24 nt, Equine herpesvirus 4
uccugggugucaggauuuuuauag

SEQ ID NO: 4236 - RNA, 24 nt, Fowl adenovirus D
ccucugggucgcgaggaaguggcg

SEQ ID NO: 4237 - RNA, 23 nt, Zucchini yellow mosaic virus
aucacuuuguuuauuuuagacac

SEQ ID NO: 4238 - RNA, 24 nt, Gallid herpesvirus 3
caccguguugcgucuccgacacug

SEQ ID NO: 4239 - RNA, 24 nt, African swine fever virus
uuuaaacuuauuuuaagcuagcac

SEQ ID NO: 4240 - RNA, 24 nt, Cowpox virus
uaaauuaucauuuuugaauguauu

SEQ ID NO: 4241 - RNA, 24 nt, Bovine herpesvirus 1
cugccgcaagcgcgaucccgcgac

SEQ ID NO: 4242 - RNA, 24 nt, Bovine herpesvirus 1
ucagccaccacgcccgcgcgcccg

SEQ ID NO: 4243 - RNA, 24 nt, Okra enation virus
ucagaugcuucucuccaauauauc

SEQ ID NO: 4244 - RNA, 24 nt, Myxoma virus
ugaaggauuuaucacuguauacag

SEQ ID NO: 4245 - RNA, 22 nt, Paramecium bursaria Chlorella virus 1
uaaaugguuaaauauacaauga

SEQ ID NO: 4246 - RNA, 24 nt, Wheat streak mosaic virus
acgaacaaaacgaacucaaagcac

SEQ ID NO: 4247 - RNA, 24 nt, Sendai virus
uagcuuucaccucaaguaaguaca

SEQ ID NO: 4248 - RNA, 24 nt, Fowl adenovirus D
auagaaccgcugucgccgccgucg

SEQ ID NO: 4249 - RNA, 24 nt, Paramecium bursaria Chlorella virus 1
uuuaugauguaacauauauuaaug

SEQ ID NO: 4250 - RNA, 24 nt, Infectious spleen and kidney necrosis virus
ugaccacagagaccaacaaauaaa

SEQ ID NO: 4251 - RNA, 24 nt, Rat cytomegalovirus
uggaacucccggauauaccucgcc

SEQ ID NO: 4252 - RNA, 24 nt, Human herpesvirus 4
uaagucaugacaauuuuagaugag

SEQ ID NO: 4253 - RNA, 24 nt, Chimpanzee cytomegalovirus
ugcauggaguguccuacauaucaa

SEQ ID NO: 4254 - RNA, 24 nt, Molluscum contagiosum virus
ugcaagacgugugaaguagcgaac

SEQ ID NO: 4255 - RNA, 24 nt, Equine herpesvirus 4
ugggguggagacggcgugggcgau

SEQ ID NO: 4256 - RNA, 24 nt, Amsacta moorei entomopoxvirus
uaaggauuaaugauuauuuaacaa

SEQ ID NO: 4257 - RNA, 24 nt, Rat cytomegalovirus
agaggaaaccggggacucaccggc

SEQ ID NO: 4258 - RNA, 24 nt, African swine fever virus
uccacguucucauaaaaacaggca

SEQ ID NO: 4259 - RNA, 24 nt, Theilovirus
ucucgaucggaucgcaacgcuuua

SEQ ID NO: 4260 - RNA, 24 nt, Sulfolobus virus SIRV-2
uauaugaauuauaguugcaagagu

SEQ ID NO: 4261 - RNA, 24 nt, Meleagrid herpesvirus 1
uaaguuaaugaauaaaguagaugg

SEQ ID NO: 4262 - RNA, 24 nt, Human parainfluenza virus 1 strain Washington/1964
uuuuaggguuaaaguaauacuuua

SEQ ID NO: 4263 - RNA, 24 nt, Cucumber mosaic virus
ucgugcuguccgcacauauuuuau

SEQ ID NO: 4264 - RNA, 24 nt, Pepper ringspot virus
uuugaugcauauugaauaucacau

SEQ ID NO: 4265 - RNA, 24 nt, Paramecium bursaria Chlorella virus 1
ucgaaacgauguuauuuuuaauuu

SEQ ID NO: 4266 - RNA, 24 nt, Chimpanzee cytomegalovirus
acgacauuaaauaggaagggacgg

SEQ ID NO: 4267 - RNA, 24 nt, Rice black streaked dwarf virus
uggaaggauguuggaaacugucac

SEQ ID NO: 4268 - RNA, 24 nt, Human herpesvirus 5
aaccggauaucugcggggauuuaa

SEQ ID NO: 4269 - RNA, 24 nt, Cercopithecine herpesvirus 7
uauggugcacuauguaaacgacau

SEQ ID NO: 4270 - RNA, 20 nt, Meleagrid herpesvirus 1
cacuuggugagagaaagggg

SEQ ID NO: 4271 - RNA, 24 nt, Paramecium bursaria Chlorella virus 1
uuuaagaaugaaaauaaaauauuu

SEQ ID NO: 4272 - RNA, 24 nt, Human parainfluenza virus 3
uaucuuaaccuuuaucuuugagcc

SEQ ID NO: 4273 - RNA, 24 nt, Equine herpesvirus 2
gaaagugugugguuggggggugac

SEQ ID NO: 4274 - RNA, 24 nt, Melanoplus sanguinipes entomopoxvirus
aauguaauauaauauuuauaucau

SEQ ID NO: 4275 - RNA, 24 nt, Rat cytomegalovirus
uaccgaggaggccggggacgcccc

SEQ ID NO: 4276 - RNA, 24 nt, Molluscum contagiosum virus
ucacguagucgccgcgcgccagca

SEQ ID NO: 4277 - RNA, 24 nt, Caprine arthritis-encephalitis virus
cauggcaauggacaagcaucagag

SEQ ID NO: 4278 - RNA, 24 nt, Equine arteritis virus
uucaugauugggcaugguucacuc

SEQ ID NO: 4279 - RNA, 24 nt, Human herpesvirus 6
uuuugcuggcuccauuguauauua

SEQ ID NO: 4280 - RNA, 24 nt, Transmissible gastroenteritis virus
ggacaagcguugauuauuuccauu

SEQ ID NO: 4281 - RNA, 24 nt, Paramecium bursaria Chlorella virus 1
uauuuuguuucgaacggagcagaa

SEQ ID NO: 4282 - RNA, 23 nt, Paramecium bursaria Chlorella virus 1
uacuauacgcgaauacccucuau

SEQ ID NO: 4283 - RNA, 24 nt, Human herpesvirus 2
aggcaaaaagaaagaaaacaccca

SEQ ID NO: 4284 - RNA, 24 nt, Human papillomavirus type 22
uguagaauggucauauggccaguu

SEQ ID NO: 4285 - RNA, 17 nt, Rat cytomegalovirus
caccgcguucaucaacg

SEQ ID NO: 4286 - RNA, 23 nt, Bovine immunodeficiency virus
cauucggcaucuacccgugccuc

SEQ ID NO: 4287 - RNA, 24 nt, Human herpesvirus 5
caugugcagaaaaauguguaaaua

SEQ ID NO: 4288 - RNA, 24 nt, Camelpox virus
ucccuggaguaugagacuaggggg

SEQ ID NO: 4289 - RNA, 24 nt, Human papillomavirus type 37
cacugggucauuuagaugaauugu

SEQ ID NO: 4290 - RNA, 24 nt, Gallid herpesvirus 2
aagcgguucuuuauuucuuuaaua

SEQ ID NO: 4291 - RNA, 24 nt, African swine fever virus
uaaguaauuaauagauagauuuua

SEQ ID NO: 4292 - RNA, 24 nt, Tupaia paramyxovirus
uagaauauaucaaacuguuaaaaa

SEQ ID NO: 4293 - RNA, 24 nt, Cowpox virus
uuaaugauacacacuacacugucg

SEQ ID NO: 4294 - RNA, 18 nt, Hepatitis GB virus C
uaccuuauagcguaaucc

SEQ ID NO: 4295 - RNA, 21 nt, Human papillomavirus type 24
uauaaagcauuuagcacaucu

SEQ ID NO: 4296 - RNA, 24 nt, Ictalurid herpesvirus 1
ucgaccguacaccucgagacggug

SEQ ID NO: 4297 - RNA, 24 nt, Paramecium bursaria Chlorella virus 1
ucccuauagugaaacugauuagua

SEQ ID NO: 4298 - RNA, 24 nt, Gallid herpesvirus 2
ccgcggcuucuauaaucagagaug

SEQ ID NO: 4299 - RNA, 24 nt, Cycas necrotic stunt virus
ugaaugaugcgcguuuauugcaca

SEQ ID NO: 4300 - RNA, 24 nt, Hop latent virus
uccaggcaaguugaauucccuuga

SEQ ID NO: 4301 - RNA, 24 nt, Human papillomavirus type 6
ugacaaacacagacauuuauuuga

SEQ ID NO: 4302 - RNA, 24 nt, Rabbit oral papillomavirus
cagcacaaugcuaaacaggcuauu

SEQ ID NO: 4303 - RNA, 24 nt, Paramecium bursaria Chlorella virus 1
gggcacccugcgcacccugcccug

SEQ ID NO: 4304 - RNA, 20 nt, Giardia lamblia virus
ugcguaguagcauagcuguu

SEQ ID NO: 4305 - RNA, 23 nt, Equine herpesvirus 1
uagguuguuugggggagagcggu

SEQ ID NO: 4306 - RNA, 24 nt, Equine herpesvirus 2
uagcagaagugaaaauuugggaag

SEQ ID NO: 4307 - RNA, 24 nt, Foxtail mosaic virus
caguacucuuuuuccucacacagc

SEQ ID NO: 4308 - RNA, 24 nt, Macaca mulatta rhadinovirus
agaaugguuccuggggcguuuugg

SEQ ID NO: 4309 - RNA, 24 nt, Cherry virus A
gagguuaguuucucuucccugguu

SEQ ID NO: 4310 - RNA, 24 nt, Human herpesvirus 7
uaaguagagaauaguguaagccug

SEQ ID NO: 4311 - RNA, 24 nt, Variola virus
ugcuggaucuaaauauuuuagaac

SEQ ID NO: 4312 - RNA, 24 nt, Triatoma virus
uauacauucauuuauuguaaauaa

SEQ ID NO: 4313 - RNA, 24 nt, Tupaia herpesvirus
aguccuugcaucggcgcgcccgag

SEQ ID NO: 4314 - RNA, 24 nt, Newcastle disease virus
agagggauauucagagaucagggc

SEQ ID NO: 4315 - RNA, 24 nt, Human papillomavirus type 21
ucaaggaaauguaagucugccaau

SEQ ID NO: 4316 - RNA, 24 nt, Human papillomavirus type 20
aaccaguugaccuguuuugugaag

SEQ ID NO: 4317 - RNA, 24 nt, Human herpesvirus 7
aaaaagcucuucaaagucgucaua

SEQ ID NO: 4318 - RNA, 24 nt, Foxtail mosaic virus
ccacacgucggugauaacauccac

SEQ ID NO: 4319 - RNA, 24 nt, Variola virus
uauaugggaguaaagcauauaacg

SEQ ID NO: 4320 - RNA, 22 nt, Human papillomavirus type 21
ugagccaaaugaggugaguugu

SEQ ID NO: 4321 - RNA, 24 nt, Tupaia herpesvirus
aacgguggaccucgucuuuuuccg

SEQ ID NO: 4322 - RNA, 24 nt, Tupaia herpesvirus
ucaaauagucgagccuccgucgcg

SEQ ID NO: 4323 - RNA, 24 nt, Human herpesvirus 1
acgcgggggcugcucuaaaaauuu

SEQ ID NO: 4324 - RNA, 24 nt, Human herpesvirus 1
uuaagggcccuacgguccacagac

SEQ ID NO: 4325 - RNA, 24 nt, Human herpesvirus 2
uaugggccgggcgucccgaugagu

SEQ ID NO: 4326 - RNA, 24 nt, African swine fever virus
aagccgguuauuuacguuguuaug

SEQ ID NO: 4327 - RNA, 24 nt, Macaca mulatta rhadinovirus
caccggggugucgccaggaaaccg

SEQ ID NO: 4328 - RNA, 24 nt, Human adenovirus A
aagcguucaauaguugccacgcuu

SEQ ID NO: 4329 - RNA, 23 nt, Tupaia herpesvirus
aggcggccgacuccgucgaggcg

SEQ ID NO: 4330 - RNA, 24 nt, African swine fever virus
aagcggaaccgaucgaccgccacc

SEQ ID NO: 4331 - RNA, 24 nt, Northern cereal mosaic virus
uucaagugguauauguugagaaag

SEQ ID NO: 4332 - RNA, 24 nt, Vaccinia virus
gaacacacuuuucucaaccuucug

SEQ ID NO: 4333 - RNA, 24 nt, Bovine papillomavirus type 2
uaaagugcuaucgcuuucguguga

SEQ ID NO: 4334 - RNA, 24 nt, Human herpesvirus 3
aggggguguuccuuaauagggacu

SEQ ID NO: 4335 - RNA, 24 nt, Casphalia extranea densovirus
uaucgcaauaggauugggcuuggg

SEQ ID NO: 4336 - RNA, 24 nt, Human adenovirus C
agaaugcaccguaggaggggcaug

SEQ ID NO: 4337 - RNA, 18 nt, Human adenovirus C
ucgcuugguccuguaacu

SEQ ID NO: 4338 - RNA, 24 nt, Cymbidium ringspot virus
aaggaucucgugcgcuauaagucu

SEQ ID NO: 4339 - RNA, 24 nt, Human herpesvirus 7
cucacauagagacaagcacaagcu

SEQ ID NO: 4340 - RNA, 24 nt, Variola virus
uuagugcacucuauaaaaacgaga

SEQ ID NO: 4341 - RNA, 24 nt, Bovine adenovirus D
cuuuaauuuuauucuuauuuuaaa

SEQ ID NO: 4342 - RNA, 24 nt, Casphalia extranea densovirus
uacgugagauaauguaaugaggug

SEQ ID NO: 4343 - RNA, 17 nt, Human adenovirus D
ugacauggguggggaug

SEQ ID NO: 4344 - RNA, 24 nt, Oat mosaic virus
cuggugccacgguuucacccccuu

SEQ ID NO: 4345 - RNA, 23 nt, Satellite virus of maize white line mosaic virus
ggugcauacugacauugugaggg

SEQ ID NO: 4346 - RNA, 20 nt, Satellite virus of maize white line mosaic virus
guuacugucuaacuaucccc

SEQ ID NO: 4347 - RNA, 24 nt, Saimiriine herpesvirus 2
uaagauacuuauuuucuaguagcu

SEQ ID NO: 4348 - RNA, 24 nt, Molluscum contagiosum virus
gaccugcacgacccucuucgacuu

SEQ ID NO: 4349 - RNA, 24 nt, Human erythrovirus V9
ugaacaacauguaauuagaaugcu

SEQ ID NO: 4350 - RNA, 24 nt, Monkeypox virus
uccaaauucaccagcgauuuaucg

SEQ ID NO: 4351 - RNA, 24 nt, Camelpox virus
uuggugaaauccaaggauuuauua

SEQ ID NO: 4352 - RNA, 24 nt, Saimiriine herpesvirus 2
uauaaacauauuuuaagcuuuacu

SEQ ID NO: 4353 - RNA, 24 nt, Saimiriine herpesvirus 2
uuuaaaauguuaaacuuuuguuau

SEQ ID NO: 4354 - RNA, 24 nt, Molluscum contagiosum virus
acuuacggacgcccuccucgaccu

SEQ ID NO: 4355 - RNA, 24 nt, Camelpox virus
agcaaauauauuagagaagcgcuc

SEQ ID NO: 4356 - RNA, 23 nt, Bombyx mori densovirus 1
uuccgggggguuguggugguggu

SEQ ID NO: 4357 - RNA, 24 nt, Cowpox virus
ucacccaacauacuugaagcacca

SEQ ID NO: 4358 - RNA, 24 nt, Human herpesvirus 7
uguuaucggauuaaaaaccucuug

SEQ ID NO: 4359 - RNA, 24 nt, Bovine papillomavirus type 2
ucugugacugucugcugcggacac

SEQ ID NO: 4360 - RNA, 24 nt, Horseradish curly top virus
auccuuaggguuuaguuuugaagc

SEQ ID NO: 4361 - RNA, 24 nt, Human herpesvirus 2
uccguugguugggugguuggggug

SEQ ID NO: 4362 - RNA, 24 nt, Bovine herpesvirus 1
uuugcggaacacauuuuauuuaaa

SEQ ID NO: 4363 - RNA, 24 nt, Equine herpesvirus 1
uaaggaacgugggcugcuagauac

SEQ ID NO: 4364 - RNA, 24 nt, Hepatitis C virus
caccggaauugccaggacgaccgg

SEQ ID NO: 4365 - RNA, 24 nt, Fowlpox virus
uauugaguacauauaaauuaauuu

SEQ ID NO: 4366 - RNA, 24 nt, Bombyx mori densovirus 5
ucgcugaccacgacgcgcgaaacg

SEQ ID NO: 4367 - RNA, 24 nt, Rhesus monkey papillomavirus
aaccauuuccacaaccgcaaccgg

SEQ ID NO: 4368 - RNA, 24 nt, Bombyx mori densovirus 1
ucgcugaccacgacgcgcgaagcg

SEQ ID NO: 4369 - RNA, 24 nt, Equine herpesvirus 4
gauggcccggguagcuuguuuccc

SEQ ID NO: 4370 - RNA, 24 nt, Equine herpesvirus 2
uggugugugggugagugauggcag

SEQ ID NO: 4371 - RNA, 24 nt, Amsacta moorei entomopoxvirus
uagaugcuauuaaugauaauuuag

SEQ ID NO: 4372 - RNA, 24 nt, Amsacta moorei entomopoxvirus
uaaaguauguucaauguuaauaaa

SEQ ID NO: 4373 - RNA, 23 nt, Simian-Human immunodeficiency virus
cuuggaaaggauuuugcuauaag

SEQ ID NO: 4374 - RNA, 24 nt, Polyomavirus muris
agccauugcgguauccgggcaauc

SEQ ID NO: 4375 - RNA, 24 nt, Vaccinia virus
auaaguggacauauagaugcagaa

SEQ ID NO: 4376 - RNA, 24 nt, Rana tigrina ranavirus
ucacugaaagacuuuuaggccaag

SEQ ID NO: 4377 - RNA, 24 nt, Camelpox virus
agcuaguucuucauaacguccaga

SEQ ID NO: 4378 - RNA, 24 nt, Human herpesvirus 2
ugauacggugccagcccuggcccc

SEQ ID NO: 4379 - RNA, 24 nt, Cercopithecine herpesvirus 7
uaaugcauguuuccgguuauuuac

SEQ ID NO: 4380 - RNA, 24 nt, Duck adenovirus A
agauugcagauguguuggagcuga

SEQ ID NO: 4381 - RNA, 23 nt, Chimpanzee cytomegalovirus
ccgccgagccguuccucagggac

SEQ ID NO: 4382 - RNA, 24 nt, Chimpanzee cytomegalovirus
uucacguacguucuggcccgcugc

SEQ ID NO: 4383 - RNA, 24 nt, Porcine teschovirus
ugguaagugauaauccuuggaagc

SEQ ID NO: 4384 - RNA, 24 nt, Porcine epidemic diarrhea virus
ucuaaaccuuugcacgaguaauua

SEQ ID NO: 4385 - RNA, 24 nt, Paramecium bursaria Chlorella virus 1
uugacauauccguuguuucaccau

SEQ ID NO: 4386 - RNA, 23 nt, Camelpox virus
acgagcuggugcuugcuagacac

SEQ ID NO: 4387 - RNA, 24 nt, Camelpox virus
uaggaucauauuuacauauuuacg

SEQ ID NO: 4388 - RNA, 23 nt, Y73 sarcoma virus
uacgcgguuaggaguccccucag

SEQ ID NO: 4389 - RNA, 24 nt, Bean leafroll virus
uaagugcaaaaaaauuagcaaaag

SEQ ID NO: 4390 - RNA, 24 nt, Human herpesvirus 6
uaaaaucacaccucgguggaaaga

SEQ ID NO: 4391 - RNA, 24 nt, Human herpesvirus 6
uuacugcauauccgucuuuuaucc

SEQ ID NO: 4392 - RNA, 24 nt, Human herpesvirus 6
uuucaaaguacuguuguucguauc

SEQ ID NO: 4393 - RNA, 24 nt, Human herpesvirus 6
ugucauguaucguuguguuuggcu

SEQ ID NO: 4394 - RNA, 24 nt, Human adenovirus E
ucgcgauggcccggagcgcgcucg

SEQ ID NO: 4395 - RNA, 24 nt, Alcelaphine herpesvirus 1
cggcacuaauauuaacuuaucuaa

SEQ ID NO: 4396 - RNA, 24 nt, Reston Ebola virus
gccccgacggccaccccgacgaag

SEQ ID NO: 4397 - RNA, 24 nt, African swine fever virus
ugaagauaaagugugccaaagaaa

SEQ ID NO: 4398 - RNA, 24 nt, Alcelaphine herpesvirus 1
uagagauuaucaguauccaagaca

SEQ ID NO: 4399 - RNA, 24 nt, Alcelaphine herpesvirus 1
uuuuucauucuucuagaaacauuu

SEQ ID NO: 4400 - RNA, 24 nt, Diatraea saccharalis densovirus
ucgaagcuggagccgugugcaaaa

SEQ ID NO: 4401 - RNA, 24 nt, Diatraea saccharalis densovirus
ucgaaaucuucaaccccggaggcg

SEQ ID NO: 4402 - RNA, 24 nt, Melanoplus sanguinipes entomopoxvirus
uauaagcauauacuguaucuucug

SEQ ID NO: 4403 - RNA, 24 nt, Diatraea saccharalis densovirus
acggcagucgagcgcggcuucgcc

SEQ ID NO: 4404 - RNA, 24 nt, Barley mild mosaic virus
uuugcaaucauauagugaguucua

SEQ ID NO: 4405 - RNA, 24 nt, Barley mild mosaic virus
aguaaguacuuuuaucguuucguu

SEQ ID NO: 4406 - RNA, 24 nt, Lumpy skin disease virus
uaggaaaaacugauuuuucaaaua

SEQ ID NO: 4407 - RNA, 24 nt, Lumpy skin disease virus
ugaauucuuucucuugguuugcag

SEQ ID NO: 4408 - RNA, 24 nt, Human herpesvirus 6
ucacuuguucucauaaaagcgguc

SEQ ID NO: 4409 - RNA, 23 nt, Human adenovirus E
cacguggucugugcggcucuccc

SEQ ID NO: 4410 - RNA, 24 nt, Diatraea saccharalis densovirus
ugagugaaagagauagcaugaaaa

SEQ ID NO: 4411 - RNA, 24 nt, Vaccinia virus
uuauuuguaugauucagacucuuu

SEQ ID NO: 4412 - RNA, 21 nt, Vaccinia virus
aaaaauccaagaaacaagaag

SEQ ID NO: 4413 - RNA, 24 nt, Barley mild mosaic virus
uagcaucaucggauacgccuaucc

SEQ ID NO: 4414 - RNA, 24 nt, Gallid herpesvirus 2
uaaaugauguuugugaauauauau

SEQ ID NO: 4415 - RNA, 24 nt, Gallid herpesvirus 2
ucuguuguauaauuauaauuauaa

SEQ ID NO: 4416 - RNA, 24 nt, Alcelaphine herpesvirus 1
uuuagauagcgguacugaugucca

SEQ ID NO: 4417 - RNA, 24 nt, Sheeppox virus
uaaaauaucaugacgauugggaag

SEQ ID NO: 4418 - RNA, 24 nt, Sheeppox virus
auaaggcucgaggguuggaaagaa

SEQ ID NO: 4419 - RNA, 24 nt, Sheeppox virus
uaauguacuuguuuacuguuuaua

SEQ ID NO: 4420 - RNA, 24 nt, Human herpesvirus 5
ugacuaaaguggaagccugacgcc

SEQ ID NO: 4421 - RNA, 24 nt, Tupaia herpesvirus
agacaaacacaguuacaacauagc

SEQ ID NO: 4422 - RNA, 23 nt, Human adenovirus C
uaaaauguuacugugaugaagaa

SEQ ID NO: 4423 - RNA, 24 nt, Gallid herpesvirus 2
uauuaaacauauuuuuuauaacuc

SEQ ID NO: 4424 - RNA, 24 nt, Human adenovirus C
uguguugcaacagcgcuaaaaaau

SEQ ID NO: 4425 - RNA, 24 nt, Human adenovirus C
uugcugacggucuauauucuguuu

SEQ ID NO: 4426 - RNA, 24 nt, Human T-lymphotropic virus 2
ucggcaccuccugaacugcuccuc

SEQ ID NO: 4427 - RNA, 24 nt, Human T-lymphotropic virus 2
uccccgagggucuuuagagacacc

SEQ ID NO: 4428 - RNA, 24 nt, Ectromelia virus
ucuguuauaugguauagggagagu

SEQ ID NO: 4429 - RNA, 24 nt, Cowpox virus
agucaauugguagaguuuuauaac

SEQ ID NO: 4430 - RNA, 24 nt, Camelpox virus
ugaaugacauaggcgacaaaguga

SEQ ID NO: 4431 - RNA, 24 nt, Human herpesvirus 5
uuuuugggaaaguugggcucggcc

SEQ ID NO: 4432 - RNA, 24 nt, Human herpesvirus 5
ugcggcaacaccagccagcaaaag

SEQ ID NO: 4433 - RNA, 24 nt, Human herpesvirus 5
ugccgugggcgcgcggcgccccca

SEQ ID NO: 4434 - RNA, 24 nt, Human adenovirus C
uagauuguuuacgaagcagaagca

SEQ ID NO: 4435 - RNA, 24 nt, Human T-lymphotropic virus 2
ucaaaauaaaagaugccgagucua

SEQ ID NO: 4436 - RNA, 24 nt, Ectromelia virus
ugauuuauuaaagaauauaguuug

SEQ ID NO: 4437 - RNA, 24 nt, Cowpox virus
aguuacuucugcagcauauaacua

SEQ ID NO: 4438 - RNA, 24 nt, Human adenovirus C
uguaaguuguauucuuuuuaucga

SEQ ID NO: 4439 - RNA, 24 nt, Camelpox virus
uaguguugagguaauucuagaaag

SEQ ID NO: 4440 - RNA, 24 nt, Camelpox virus
aaugacaauggggguaaaugacaa

SEQ ID NO: 4441 - RNA, 24 nt, Camelpox virus
ucgaauauacgggccaaguuagaa

SEQ ID NO: 4442 - RNA, 24 nt, Myxoma virus
uaagcugcaaaauaggugaaacaa

SEQ ID NO: 4443 - RNA, 22 nt, Myxoma virus
uggcuacaaacuuuuccuuuuc

SEQ ID NO: 4444 - RNA, 24 nt, Feline leukemia virus
uggcuacaaacuuuuccuuuucca

SEQ ID NO: 4445 - RNA, 24 nt, Ovine adenovirus 7
agagaacaaggcggaauacacugg

SEQ ID NO: 4446 - RNA, 24 nt, Ovine adenovirus 7
uacaguagaaagaaauacucaaag

SEQ ID NO: 4447 - RNA, 24 nt, Camelpox virus
uuaguucuguaguaauaucuuuaa

SEQ ID NO: 4448 - RNA, 24 nt, Rabbit fibroma virus
uacuauguggcuauaauaaaauua

SEQ ID NO: 4449 - RNA, 24 nt, Swinepox virus
uuaaaaauagaacuguauacguau

SEQ ID NO: 4450 - RNA, 24 nt, Swinepox virus
uggccaugaucguaucaauaaggu

SEQ ID NO: 4451 - RNA, 24 nt, Myxoma virus
uacgucugcgucuuuguaaguuuu

SEQ ID NO: 4452 - RNA, 24 nt, Gibbon ape leukemia virus
acgcagcagccaggcagacucggg

SEQ ID NO: 4453 - RNA, 24 nt, Camelpox virus
uauguuaaugucauaaaaacuaau

SEQ ID NO: 4454 - RNA, 24 nt, Paramecium bursaria Chlorella virus 1
aaccuuuccacucuaucauauugc

SEQ ID NO: 4455 - RNA, 24 nt, Chimpanzee cytomegalovirus
uaucgcgacaugucggcgacccac

SEQ ID NO: 4456 - RNA, 24 nt, Feline immunodeficiency virus
uguuaagcagaacuccugcugacc

SEQ ID NO: 4457 - RNA, 24 nt, Paramecium bursaria Chlorella virus 1
ucaauaccauuucgaagaguauca

SEQ ID NO: 4458 - RNA, 24 nt, Sheeppox virus
aaucguauuuauuaaaaauagaaa

SEQ ID NO: 4459 - RNA, 17 nt, Yaba-like disease virus
uauuacuuuuugaugua

SEQ ID NO: 4460 - RNA, 24 nt, Ovine adenovirus 7
cucccagagcugcuaggaaccggu

SEQ ID NO: 4461 - RNA, 24 nt, Yaba-like disease virus
uaauauaguuuauuauucauuuua

SEQ ID NO: 4462 - RNA, 24 nt, Camelpox virus
uaauaggagaaaaaauauauaaug

SEQ ID NO: 4463 - RNA, 24 nt, Tobacco necrosis satellite virus
ugguaagcagaaauccaaggguac

SEQ ID NO: 4464 - RNA, 24 nt, Duck adenovirus A
uugaaagcauugaugaaauccuua

SEQ ID NO: 4465 - RNA, 24 nt, B19 virus
uuaguggcacgucaaccccaagcg

SEQ ID NO: 4466 - RNA, 24 nt, B19 virus
agccauuuuaaguguuucacuaua

SEQ ID NO: 4467 - RNA, 24 nt, Yaba-like disease virus
aauguugugguaacaaaaaggugu

SEQ ID NO: 4468 - RNA, 24 nt, B19 virus
aggcaaccccaagcaagcuggccc

SEQ ID NO: 4469 - RNA, 24 nt, Molluscum contagiosum virus
uguggcuacaugcaacgcaggaca

SEQ ID NO: 4470 - RNA, 24 nt, Molluscum contagiosum virus
ggacacuggaggugagucacgcuu

SEQ ID NO: 4471 - RNA, 18 nt, Gallid herpesvirus 3
uuugcgggauaagguugu

SEQ ID NO: 4472 - RNA, 20 nt, Camelpox virus
uccaguaguuacguguuucg

SEQ ID NO: 4473 - RNA, 24 nt, Camelpox virus
uauuaaguuuuauugcuacuaacc

SEQ ID NO: 4474 - RNA, 24 nt, Petunia vein clearing virus
uccuaugugucuaaagcaugcgug

SEQ ID NO: 4475 - RNA, 24 nt, Petunia vein clearing virus
uggcauuuuguaauaaugcucugu

SEQ ID NO: 4476 - RNA, 24 nt, Petunia vein clearing virus
ugugaauaacucucucuuguuucc

SEQ ID NO: 4477 - RNA, 24 nt, Murray Valley encephalitis virus
aacacugugacugaugggggagaa

SEQ ID NO: 4478 - RNA, 24 nt, Amsacta moorei entomopoxvirus
uaaaaucuauuacaauuuuuaaau

SEQ ID NO: 4479 - RNA, 24 nt, Fowl adenovirus D
uaacgcgaggguuccuuaauaaau

SEQ ID NO: 4480 - RNA, 24 nt, Bovine adenovirus D
aagcguacaauguacguguucagg

SEQ ID NO: 4481 - RNA, 24 nt, Japanese encephalitis virus
uagcugguggugaggaagaacaca

SEQ ID NO: 4482 - RNA, 21 nt, Murid herpesvirus 4
uguguuaucugaugugcgauu

SEQ ID NO: 4483 - RNA, 24 nt, Vaccinia virus
cagcacaaaucaaggguauuaaua

SEQ ID NO: 4484 - RNA, 24 nt, Amsacta moorei entomopoxvirus
uauauauuucucuuucuauauaau

SEQ ID NO: 4485 - RNA, 24 nt, Equine herpesvirus 1
ugagcaacgcuaaacaacaaccgu

SEQ ID NO: 4486 - RNA, 18 nt, Equine herpesvirus 1
uggcuucguuuauauggu

SEQ ID NO: 4487 - RNA, 24 nt, Sheeppox virus
uuaaaacuaaacuuguuacauugu

SEQ ID NO: 4488 - RNA, 24 nt, Tobacco mosaic virus
ucuucugguuugguuuggaccucu

SEQ ID NO: 4489 - RNA, 24 nt, Ovine adenovirus A
agcgcaaugcgagccgccagagcu

SEQ ID NO: 4490 - RNA, 20 nt, Paramecium bursaria Chlorella virus 1
ucauuggucaucugucaguu

SEQ ID NO: 4491 - RNA, 22 nt, Acute bee paralysis virus
ucuaauguagauaauuuuguuu

SEQ ID NO: 4492 - RNA, 24 nt, Paramecium bursaria Chlorella virus 1
uuugcauauacauaugcgguuuua

SEQ ID NO: 4493 - RNA, 24 nt, Maize chlorotic mottle virus
ugacaagcaaauguauuccccagg

SEQ ID NO: 4494 - RNA, 24 nt, Melanoplus sanguinipes entomopoxvirus
ucauuaauuucuuuauuugauaau

SEQ ID NO: 4495 - RNA, 24 nt, Parvovirus H1
uugguugagcgcaaccaaccggua

SEQ ID NO: 4496 - RNA, 22 nt, Rabbit fibroma virus
uaaaaaaguacuaccagcgaua

SEQ ID NO: 4497 - RNA, 24 nt, Acute bee paralysis virus
uuaguguaacauuuaagauuagaa

SEQ ID NO: 4498 - RNA, 20 nt, Human herpesvirus 4
uauuuugcaugccaccuccc

SEQ ID NO: 4499 - RNA, 24 nt, Human herpesvirus 4
uugagauucugaugagaggcuugg

SEQ ID NO: 4500 - RNA, 24 nt, Leek yellow stripe potyvirus
auaacccaccuuuacccugcgacg

SEQ ID NO: 4501 - RNA, 24 nt, Leek yellow stripe potyvirus
gagcuguucauuugaagacacuga

SEQ ID NO: 4502 - RNA, 24 nt, Chimpanzee cytomegalovirus
augauguacccgcgucugaucccg

SEQ ID NO: 4503 - RNA, 24 nt, Macaca mulatta rhadinovirus
cguugauuuuauguacuaccuaca

SEQ ID NO: 4504 - RNA, 23 nt, Human herpesvirus 8
aagcugcaauaccgccgauggcc

SEQ ID NO: 4505 - RNA, 24 nt, Yaba-like disease virus
aucauguuuuuucucacaguaucg

SEQ ID NO: 4506 - RNA, 24 nt, Gallid herpesvirus 3
uggggaaccgaaaacugaaccaaa

SEQ ID NO: 4507 - RNA, 19 nt, Human adenovirus C
caucguagucaugcucaug

SEQ ID NO: 4508 - RNA, 24 nt, Human herpesvirus 2
ugaguucgcuaggcaagcacggac

SEQ ID NO: 4509 - RNA, 24 nt, Paramecium bursaria Chlorella virus 1
ccccagagcgucuguguauucagu

SEQ ID NO: 4510 - RNA, 24 nt, Paramecium bursaria Chlorella virus 1
uucagagucuuccugaaaguuacg

SEQ ID NO: 4511 - RNA, 24 nt, Paramecium bursaria Chlorella virus 1
uguacauaucagaaggauuuauau

SEQ ID NO: 4512 - RNA, 24 nt, Human herpesvirus 5
cucgcaccacccacgaccacagag

SEQ ID NO: 4513 - RNA, 24 nt, Zaire Ebola virus
ucuaaauuaaauuacauuaugcuu

SEQ ID NO: 4514 - RNA, 24 nt, Cercopithecine herpesvirus 7
acgccuuuuuguuuauuuacgccu

SEQ ID NO: 4515 - RNA, 21 nt, Human herpesvirus 2
cccgccuucgcgccccccccc

SEQ ID NO: 4516 - RNA, 24 nt, Monkeypox virus
uucacggucuuaguauuuuuagau

SEQ ID NO: 4517 - RNA, 24 nt, Monkeypox virus
uagaagcugugggucauuguuaug

SEQ ID NO: 4518 - RNA, 24 nt, Equine herpesvirus 1
uguguauguauaacucaucccgga

SEQ ID NO: 4519 - RNA, 24 nt, Rat cytomegalovirus
ugaagaguagaaauaauuacgggu

SEQ ID NO: 4520 - RNA, 24 nt, Monkeypox virus
uucacggucuuaguauuuuuagau

SEQ ID NO: 4521 - RNA, 23 nt, Monkeypox virus
uaucgcauuuucuaacgugaugg

SEQ ID NO: 4522 - RNA, 24 nt, Equine herpesvirus 4
uggcaugcagccugcuccggacac

SEQ ID NO: 4523 - RNA, 24 nt, Equine herpesvirus 1
uuuacagcgcuaguauuagaguuu

SEQ ID NO: 4524 - RNA, 24 nt, Camelpox virus
uagaagcuguuggucauuguuaug

SEQ ID NO: 4525 - RNA, 24 nt, Swinepox virus
uaauaccaauaaucuuaauauaaa

SEQ ID NO: 4526 - RNA, 24 nt, Myxoma virus
ugcguggauaagggauauuuggca

SEQ ID NO: 4527 - RNA, 24 nt, Canine adenovirus
uguuacaauagugggcccacugug

SEQ ID NO: 4528 - RNA, 24 nt, Canine adenovirus
uauguugcacucauagaaguacac

SEQ ID NO: 4529 - RNA, 24 nt, Human papillomavirus type 65
augcauuuguucugccaauagaaa

SEQ ID NO: 4530 - RNA, 24 nt, Human papillomavirus type 50
ugcaaaaaaagaaaauaugagcag

SEQ ID NO: 4531 - RNA, 24 nt, Human adenovirus D
ccucaaugucagcugcaaaaaguc

SEQ ID NO: 4532 - RNA, 22 nt, Canine adenovirus
ucucgcggucuugcucucuuau

SEQ ID NO: 4533 - RNA, 24 nt, Sheeppox virus
ucuauaucauuucuauauaaaaau

SEQ ID NO: 4534 - RNA, 24 nt, Sheeppox virus
uuuuucuauaucuauagggcauau

SEQ ID NO: 4535 - RNA, 24 nt, Bovine herpesvirus 4
ucuagagcuucaggucagaggagu

SEQ ID NO: 4536 - RNA, 24 nt, Walleye dermal sarcoma virus
ugugguguugugauuccucuucug

SEQ ID NO: 4537 - RNA, 24 nt, Walleye dermal sarcoma virus
uaaaaagagauaaauaagguacaa

SEQ ID NO: 4538 - RNA, 24 nt, Paramecium bursaria Chlorella virus 1
ugucauaggcuaaaacacgcucuc

SEQ ID NO: 4539 - RNA, 24 nt, Paramecium bursaria Chlorella virus 1
ucgaagauucaacagguccaaacg

SEQ ID NO: 4540 - RNA, 24 nt, Variola virus
uaauauuauaaagccuuuauuuaa

SEQ ID NO: 4541 - RNA, 24 nt, Molluscum contagiosum virus
cuaaaucgcgcgcgggcucaaguc

SEQ ID NO: 4542 - RNA, 24 nt, Fowlpox virus
uaagcguucuuauacguucuaaag

SEQ ID NO: 4543 - RNA, 24 nt, Lumpy skin disease virus
uagaaucaccagagccgauaacau

SEQ ID NO: 4544 - RNA, 24 nt, Molluscum contagiosum virus
caaggacaccgcgggcgugcccgg

SEQ ID NO: 4545 - RNA, 24 nt, Molluscum contagiosum virus
cuagcgcuccgcgugcgagaagau

SEQ ID NO: 4546 - RNA, 24 nt, Molluscum contagiosum virus
cuucugcucgggcccgaccuuucc

SEQ ID NO: 4547 - RNA, 24 nt, Macaca mulatta rhadinovirus
uaucgcgccaccuuguggcuacau

SEQ ID NO: 4548 - RNA, 24 nt, Bovine herpesvirus 4
ccuggcuacacacccaaaggcacg

SEQ ID NO: 4549 - RNA, 24 nt, European brown hare syndrome virus
uuaguuguuuagugauuuauaguu

SEQ ID NO: 4550 - RNA, 17 nt, Human papillomavirus type 24
uaugauggugauccgga

SEQ ID NO: 4551 - RNA, 24 nt, Equine herpesvirus 4
uuaccaccccgagcacugcagcua

SEQ ID NO: 4552 - RNA, 24 nt, African swine fever virus
cuugcacaagugcuugcacaagug

SEQ ID NO: 4553 - RNA, 24 nt, Ectromelia virus
uaguauucaucuucaugcuauuua

SEQ ID NO: 4554 - RNA, 24 nt, Molluscum contagiosum virus
ucgcgcacacgccguacacacugc

SEQ ID NO: 4555 - RNA, 24 nt, Beet virus Q
uaauacuaguugauuuuucuagca

SEQ ID NO: 4556 - RNA, 17 nt, Beet virus Q
uuugucguuacagagau

SEQ ID NO: 4557 - RNA, 24 nt, Human papillomavirus type 63
uucugaacaguggucuuuacaaga

SEQ ID NO: 4558 - RNA, 24 nt, Melanoplus sanguinipes entomopoxvirus
uaaauuacuauauauauauuuaca

SEQ ID NO: 4559 - RNA, 24 nt, Ectromelia virus
ucaggaguacaucuugcacaacua

SEQ ID NO: 4560 - RNA, 24 nt, Ectromelia virus
aggcagcauacauuucaauccugg

SEQ ID NO: 4561 - RNA, 24 nt, O'nyong-nyong virus
uaggugcccccuuagagguacacc

SEQ ID NO: 4562 - RNA, 24 nt, Human herpesvirus 6B
ugcuagaugagcggcaaagaacuc

SEQ ID NO: 4563 - RNA, 18 nt, Fowlpox virus
uagaaaguuuaugaagau

SEQ ID NO: 4564 - RNA, 24 nt, Yaba-like disease virus
uaaaguauuauccuguaaaucguc

SEQ ID NO: 4565 - RNA, 24 nt, Garlic virus X
uccgaacacuggcgccuccucaca

SEQ ID NO: 4566 - RNA, 24 nt, Garlic virus A
aaggugcgccgcaagggugcguua

SEQ ID NO: 4567 - RNA, 24 nt, Macaca mulatta rhadinovirus
uauauaacguuuuuuacguaaaac

SEQ ID NO: 4568 - RNA, 24 nt, Human herpesvirus 5
uacgggacccaaugacuggauaag

SEQ ID NO: 4569 - RNA, 24 nt, Sulfolobus virus SIRV-1
ugacaagaaauauauaguagcagu

SEQ ID NO: 4570 - RNA, 24 nt, Camelpox virus
aaugugauuguauguuguuacauu

SEQ ID NO: 4571 - RNA, 24 nt, Camelpox virus
uauaccuagugcuauuuugacaua

SEQ ID NO: 4572 - RNA, 24 nt, Fowlpox virus
uguuuauuucauaaugucauuauu

SEQ ID NO: 4573 - RNA, 24 nt, Human herpesvirus 1
ucgacgcccccucccuguuugucg

SEQ ID NO: 4574 - RNA, 24 nt, Taura syndrome virus
ucaguuaaccacucuugaauaugc

SEQ ID NO: 4575 - RNA, 24 nt, Human herpesvirus 5
aaggucucagcgaguuggacacgu

SEQ ID NO: 4576 - RNA, 24 nt, Reston Ebola virus
ugcuugauuuacaauaugauauuu

SEQ ID NO: 4577 - RNA, 24 nt, Avian leukosis virus
uggcauguauaggcgcaaagcggg

SEQ ID NO: 4578 - RNA, 24 nt, Vaccinia virus
gauuguaucaguuucguagucuug

SEQ ID NO: 4579 - RNA, 24 nt, Sulfolobus virus SIRV-1
agaccauaguaaugcuuuauauaa

SEQ ID NO: 4580 - RNA, 24 nt, Variola virus
acgagaaucuuuauaccuuuccug

SEQ ID NO: 4581 - RNA, 24 nt, Sugarcane striate mosaic associated virus
ucaaucauuuaauggccaaggcaa

SEQ ID NO: 4582 - RNA, 19 nt, Chimpanzee cytomegalovirus
ggguacggggacacggcgu

SEQ ID NO: 4583 - RNA, 24 nt, Variola virus
uaugugguguuacaguuaggugaa

SEQ ID NO: 4584 - RNA, 24 nt, Fowlpox virus
ucuaaaaacuaaucucaaguauug

SEQ ID NO: 4585 - RNA, 24 nt, Igbo Ora virus
uaagugcccccuuaguggcacacu

SEQ ID NO: 4586 - RNA, 24 nt, Paramecium bursaria Chlorella virus 1
uugauaccauugcgugcaaaaggu

SEQ ID NO: 4587 - RNA, 24 nt, Amsacta moorei entomopoxvirus
uaauauauuuaccgugauuuuaau

SEQ ID NO: 4588 - RNA, 24 nt, Human papillomavirus type 50
cuugaacauuucacaaaaugaaua

SEQ ID NO: 4589 - RNA, 24 nt, Ovine adenovirus 7
uuuuucagaaaacucaaguguuca

SEQ ID NO: 4590 - RNA, 24 nt, Fowlpox virus
uauuuugcuaaaacuauuacuuca

SEQ ID NO: 4591 - RNA, 24 nt, Beet soil-borne mosaic virus
uggcugauucuaucucucgugugg

SEQ ID NO: 4592 - RNA, 24 nt, Equine infectious anemia virus
uuggcgcccgaacagggaccugag

SEQ ID NO: 4593 - RNA, 24 nt, Amsacta moorei entomopoxvirus
uauuauaugcucaaacuaagguag

SEQ ID NO: 4594 - RNA, 24 nt, Human herpesvirus 5
ccccggggagaggaguguuaguaa

SEQ ID NO: 4595 - RNA, 23 nt, Equine herpesvirus 2
uaaaauaccugcauguugcaauc

SEQ ID NO: 4596 - RNA, 24 nt, Swinepox virus
uaguaugguaacuguauaugacgg

SEQ ID NO: 4597 - RNA, 24 nt, Swinepox virus
uaauauacuuggauuauuucugua

SEQ ID NO: 4598 - RNA, 24 nt, Paramecium bursaria Chlorella virus 1
cuuucugcaccgcaaucccgugaa

SEQ ID NO: 4599 - RNA, 24 nt, Arctic ground squirrel hepatitis B virus
ucuauagaacacuuuuuugcagcu

SEQ ID NO: 4600 - RNA, 23 nt, Human papillomavirus type 54
uacaaaguguuacagcaccaggc

SEQ ID NO: 4601 - RNA, 24 nt, Indian citrus ringspot virus
gagcugcgcacuucuuggcgcacg

SEQ ID NO: 4602 - RNA, 24 nt, Variola virus
uguauggaagaaguaaccauauua

SEQ ID NO: 4603 - RNA, 24 nt, Fowlpox virus
uuacuccauagauucgauauaauu

SEQ ID NO: 4604 - RNA, 22 nt, Fowlpox virus
aucagauuuaucauuaauauua

SEQ ID NO: 4605 - RNA, 24 nt, Gallid herpesvirus 2
acgcugcguauaguuauguauucu

SEQ ID NO: 4606 - RNA, 24 nt, Gallid herpesvirus 2
ugaggccgguguauguagagaguc

SEQ ID NO: 4607 - RNA, 22 nt, Indian citrus ringspot virus
ugccaggcucaauuacugcuac

SEQ ID NO: 4608 - RNA, 24 nt, Paramecium bursaria Chlorella virus 1
uaggagaucuuggcaauauucugg

SEQ ID NO: 4609 - RNA, 24 nt, Paramecium bursaria Chlorella virus 1
ugaaaaccgggaacgcaggaaaac

SEQ ID NO: 4610 - RNA, 24 nt, Fowlpox virus
uaugaccuacguuuauuauaaucu

SEQ ID NO: 4611 - RNA, 24 nt, Fowlpox virus
aagaauuaagaaaacaguaucgcg

SEQ ID NO: 4612 - RNA, 24 nt, Amsacta moorei entomopoxvirus
uagaauauaacauuuuaaauaaua

SEQ ID NO: 4613 - RNA, 20 nt, Myxoma virus
uaccuaguaaacauuuuucc

SEQ ID NO: 4614 - RNA, 24 nt, Bovine herpesvirus 1
acgcucggcacuuagcucucgagu

SEQ ID NO: 4615 - RNA, 23 nt, Bovine herpesvirus 1
gccccuguuugucuagacggggc

SEQ ID NO: 4616 - RNA, 24 nt, Bovine herpesvirus 1
gcuuuguguuuuucccaccccugc

SEQ ID NO: 4617 - RNA, 24 nt, Fowlpox virus
uacaauauaaguauauuaauuuug

SEQ ID NO: 4618 - RNA, 24 nt, Yaba-like disease virus
uaaguuuacuaauaaaugguuaaa

SEQ ID NO: 4619 - RNA, 24 nt, Saimiriine herpesvirus 2
uguugcuuucccugacgaaccuuc

SEQ ID NO: 4620 - RNA, 24 nt, Saimiriine herpesvirus 2
cacgggguuagaaaaagagagcgu

SEQ ID NO: 4621 - RNA, 24 nt, Human adenovirus E
cuagaacauuuuugauuaauauag

SEQ ID NO: 4622 - RNA, 24 nt, Human adenovirus E
uacacguacuuuucaaauaccgcc

SEQ ID NO: 4623 - RNA, 18 nt, Human herpesvirus 5
uggcaccagcucgaagcc

SEQ ID NO: 4624 - RNA, 24 nt, Human adenovirus E
uggcaggaaguuuuuaaugcaggu

SEQ ID NO: 4625 - RNA, 24 nt, Human herpesvirus 5
uacaggaaucuaaaucagaugugc

SEQ ID NO: 4626 - RNA, 24 nt, Human herpesvirus 5
uaagugcuaucgcuuucgggaacg

SEQ ID NO: 4627 - RNA, 24 nt, Human herpesvirus 5
uaggacuaugaaauuaccaccuac

SEQ ID NO: 4628 - RNA, 18 nt, Cryphonectria hypovirus 3
uuuugcccaauuucccag

SEQ ID NO: 4629 - RNA, 24 nt, Human herpesvirus 5
uguaaagcgcaccaauauauuuua

SEQ ID NO: 4630 - RNA, 24 nt, Cryphonectria hypovirus 3
acgacaauaacccgcuccgccacg

SEQ ID NO: 4631 - RNA, 24 nt, Cryphonectria hypovirus 3
uuugugcuuugcgugugugugugu

SEQ ID NO: 4632 - RNA, 24 nt, Equine herpesvirus 1
ggggaugguagggauuggugggug

SEQ ID NO: 4633 - RNA, 24 nt, Equine herpesvirus 1
ugauggagucguaaaaauauuuuu

SEQ ID NO: 4634 - RNA, 24 nt, Equine herpesvirus 1
uacaggggaguguacccaccaaaa

SEQ ID NO: 4635 - RNA, 24 nt, Equine herpesvirus 1
ucuuugguacaaaauuucacacaa

SEQ ID NO: 4636 - RNA, 24 nt, Equine herpesvirus 1
aauauuuuuauucucuuucucucu

SEQ ID NO: 4637 - RNA, 24 nt, Equine herpesvirus 1
ucagauuguuagacagcuacaaca

SEQ ID NO: 4638 - RNA, 24 nt, Equine herpesvirus 1
uauuuuauucucuuucucucuuca

SEQ ID NO: 4639 - RNA, 24 nt, Equine herpesvirus 1
ucauaaaaaaguuuuacaaaaaua

SEQ ID NO: 4640 - RNA, 24 nt, Equine herpesvirus 1
aauauuuuuauucucuuucucucu

SEQ ID NO: 4641 - RNA, 24 nt, Equine herpesvirus 1
uaauguacaguacaguguaacaua

SEQ ID NO: 4642 - RNA, 24 nt, Equine herpesvirus 1
aauauuuuuauucucuuucucgcu

SEQ ID NO: 4643 - RNA, 24 nt, Equine herpesvirus 1
ucggucccacucaucccaggcggc

SEQ ID NO: 4644 - RNA, 24 nt, Equine herpesvirus 1
ugagcucgucuguaagagccugaa

SEQ ID NO: 4645 - RNA, 24 nt, Equine herpesvirus 1
ucuggcgcaccggugcgcgcuccu

SEQ ID NO: 4646 - RNA, 24 nt, Fowlpox virus
uucaugagaguaugagcucgucug

SEQ ID NO: 4647 - RNA, 24 nt, Fowlpox virus
uuucaacggacgccccgggaggaa

SEQ ID NO: 4648 - RNA, 24 nt, Cowpox virus
uuaaugauacacacuacacugucg

SEQ ID NO: 4649 - RNA, 24 nt, Cowpox virus
uaacuuuuaugacccuaacacaca

SEQ ID NO: 4650 - RNA, 24 nt, Cowpox virus
uccacaguuacuacaccauauaau

SEQ ID NO: 4651 - RNA, 24 nt, Fowlpox virus
ugaucauucuuauuaucauuauuc

SEQ ID NO: 4652 - RNA, 24 nt, Cowpox virus
ugcaaaagcgggggggacugcggu

SEQ ID NO: 4653 - RNA, 24 nt, Cowpox virus
acguugcuuauauuuauguuguug

SEQ ID NO: 4654 - RNA, 24 nt, Cowpox virus
aaccacaacacugcuaauccucug

SEQ ID NO: 4655 - RNA, 24 nt, Simian T-lymphotropic virus 1
cccuucuauauuauuauugaugua

SEQ ID NO: 4656 - RNA, 24 nt, Cowpox virus
uacccguaaacggggauguauaaa

SEQ ID NO: 4657 - RNA, 24 nt, Cowpox virus
uugcauaguuggccacaauuucag

SEQ ID NO: 4658 - RNA, 24 nt, Simian T-lymphotropic virus 1
ucuuucuauaauccugaccaggaa

SEQ ID NO: 4659 - RNA, 24 nt, Periplaneta fuliginosa densovirus
gagcaugacggcgacuaccuccac

SEQ ID NO: 4660 - RNA, 18 nt, Paramecium bursaria Chlorella virus 1
uuagucagauagcagggc

SEQ ID NO: 4661 - RNA, 23 nt, Gallid herpesvirus 3
uuggacccguggcucgcgaccac

SEQ ID NO: 4662 - RNA, 24 nt, Gallid herpesvirus 3
agagggccaggcugacccaaaauu

SEQ ID NO: 4663 - RNA, 24 nt, Human herpesvirus 7
uguugugugaugugagaggaguaa

SEQ ID NO: 4664 - RNA, 24 nt, Human herpesvirus 7
uagaaagcucugaucaaacuucau

SEQ ID NO: 4665 - RNA, 24 nt, Human herpesvirus 7
cuugugcugugaauucuaucuuga

SEQ ID NO: 4666 - RNA, 24 nt, Human herpesvirus 6
gaaguggaaacccucagucacggg

SEQ ID NO: 4667 - RNA, 24 nt, Human herpesvirus 6
ugaggaccaacaacccugugcuug

SEQ ID NO: 4668 - RNA, 22 nt, Paramecium bursaria Chlorella virus 1
caccagggacuaccuaggucaa

SEQ ID NO: 4669 - RNA, 24 nt, Paramecium bursaria Chlorella virus 1
agguaguauaaucagcuaggccuc

SEQ ID NO: 4670 - RNA, 19 nt, Paramecium bursaria Chlorella virus 1
ugugauagcccaucacagg

SEQ ID NO: 4671 - RNA, 24 nt, Paramecium bursaria Chlorella virus 1
uguugcguugguugggaguuuggg

SEQ ID NO: 4672 - RNA, 24 nt, Gallid herpesvirus 3
cgggcagauccugugagaugcgcc

SEQ ID NO: 4673 - RNA, 21 nt, Gallid herpesvirus 3
gucuaugguuggcugcgcugc

SEQ ID NO: 4674 - RNA, 24 nt, Gallid herpesvirus 3
ucuguggaguuugguuucgagggc

SEQ ID NO: 4675 - RNA, 24 nt, Gallid herpesvirus 3
uaagguguacgugcguguacgaga

SEQ ID NO: 4676 - RNA, 24 nt, Gallid herpesvirus 3
uuaaagacuuuuuuccccaaccuc

SEQ ID NO: 4677 - RNA, 24 nt, Gallid herpesvirus 3
cacgucuuugccccuugcuccagu

SEQ ID NO: 4678 - RNA, 24 nt, Human herpesvirus 6
acccuaauucgauagcauaugcuu

SEQ ID NO: 4679 - RNA, 24 nt, Tupaia herpesvirus
cguccauguugaucaggucaucgg

SEQ ID NO: 4680 - RNA, 24 nt, Tupaia herpesvirus
uuuauguuuauuuuuuuauuauuu

SEQ ID NO: 4681 - RNA, 19 nt, Gallid herpesvirus 3
cgguugggcgcgugggcga

SEQ ID NO: 4682 - RNA, 24 nt, Gallid herpesvirus 3
uuaaauuuuuuuauugguuaauuu

SEQ ID NO: 4683 - RNA, 24 nt, Human herpesvirus 7
uauggaauuaguagugggacccgg

SEQ ID NO: 4684 - RNA, 24 nt, Human herpesvirus 6
ucgcagcguugcgacaucgucucc

SEQ ID NO: 4685 - RNA, 24 nt, Human herpesvirus 6
uggcguguuuucugagguuauccc

SEQ ID NO: 4686 - RNA, 24 nt, Human herpesvirus 6
ucuuacgcucauggguacuucggu

SEQ ID NO: 4687 - RNA, 24 nt, Tupaia herpesvirus
ugccuaaccugauaccuggaucua

SEQ ID NO: 4688 - RNA, 24 nt, Tupaia herpesvirus
auuaaauuuaucauuuaauauuuu

SEQ ID NO: 4689 - RNA, 24 nt, Tupaia herpesvirus
ucggcgcgacggacgcguagcggc

SEQ ID NO: 4690 - RNA, 24 nt, Tupaia herpesvirus
agucucaggcuagccggcagcccc

SEQ ID NO: 4691 - RNA, 24 nt, Simian T-lymphotropic virus 1
agauuacaguagauuuuaaaaaua

SEQ ID NO: 4692 - RNA, 24 nt, Fowlpox virus
uauguauuuuuauuccgcuagaac

SEQ ID NO: 4693 - RNA, 19 nt, Fowlpox virus
uaaguguauuggaagcucu

SEQ ID NO: 4694 - RNA, 24 nt, Fowlpox virus
uucaaguuuucggcgguuaagaug

SEQ ID NO: 4695 - RNA, 24 nt, Tupaia herpesvirus
uucgaugagccgcccgaagggaca

SEQ ID NO: 4696 - RNA, 24 nt, Simian T-lymphotropic virus 1
aucuccuugauaagauuuccauuu

SEQ ID NO: 4697 - RNA, 24 nt, Fowlpox virus
auccuguaguuuuugaugguuuuu

SEQ ID NO: 4698 - RNA, 24 nt, Equine foamy virus
ugagggauggcucguccaacaaac

SEQ ID NO: 4699 - RNA, 24 nt, Equine foamy virus
uaaacgauaagcaauaaaggucau

SEQ ID NO: 4700 - RNA, 24 nt, Human herpesvirus 5
ccagcgcgagcgguuccaccgcga

SEQ ID NO: 4701 - RNA, 24 nt, Human herpesvirus 5
accccaaugacggguuccuguggg

SEQ ID NO: 4702 - RNA, 24 nt, Fowlpox virus
ugaguuaaaaaauauagaauaucu

SEQ ID NO: 4703 - RNA, 24 nt, Equine foamy virus
uagcucagcucgcuaaugcauaau

SEQ ID NO: 4704 - RNA, 23 nt, Equine foamy virus
uuauguauauucuuccuugcucc

SEQ ID NO: 4705 - RNA, 24 nt, Zaire Ebola virus
augaagauuaaugcggaggucuga

SEQ ID NO: 4706 - RNA, 24 nt, Zaire Ebola virus
uaccuucuacuucuauugauaauc

SEQ ID NO: 4707 - RNA, 24 nt, Fowlpox virus
acuaaaauaaccauuuauacuuuu

SEQ ID NO: 4708 - RNA, 24 nt, Equine foamy virus
ugagucgagcaggccacagacugg

SEQ ID NO: 4709 - RNA, 24 nt, Peanut chlorotic streak virus
uaacucgagcucucgauaaaaaag

SEQ ID NO: 4710 - RNA, 24 nt, Fowl adenovirus D
uacauagugacaacgggccgugcu

SEQ ID NO: 4711 - RNA, 24 nt, Cowpox virus
uccggcaucgaguguugcaaaauc

SEQ ID NO: 4712 - RNA, 24 nt, Cowpox virus
gaggaaacaaacugucuuggaaca

SEQ ID NO: 4713 - RNA, 24 nt, Cowpox virus
uacaacaccuccucgucuaacucu

SEQ ID NO: 4714 - RNA, 24 nt, African swine fever virus
ucgaauagcauaaguuugaaacga

SEQ ID NO: 4715 - RNA, 24 nt, African swine fever virus
ugauacgauacuauauguauucuu

SEQ ID NO: 4716 - RNA, 24 nt, Fowlpox virus
ucuagaauacaaaaauauggucua

SEQ ID NO: 4717 - RNA, 24 nt, Cowpox virus
ccccaaguuuuacuucucuaaaca

SEQ ID NO: 4718 - RNA, 24 nt, Human herpesvirus 4
uguccagggguccccgagggugag

SEQ ID NO: 4719 - RNA, 24 nt, Human herpesvirus 4
uauguuauagcuuuuaauggaaau

SEQ ID NO: 4720 - RNA, 24 nt, Human herpesvirus 4
aaagguacuuaugaaaaggaaaaa

SEQ ID NO: 4721 - RNA, 24 nt, Human herpesvirus 4
ucgcagcucuuucccggccuggcu

SEQ ID NO: 4722 - RNA, 24 nt, Human herpesvirus 4
ugaggauuggggauggcuggcaua

SEQ ID NO: 4723 - RNA, 24 nt, Human herpesvirus 4
ucugucaucuguauuagcagaaug

SEQ ID NO: 4724 - RNA, 24 nt, Human herpesvirus 4
uaccacuauauauacacagaauug

SEQ ID NO: 4725 - RNA, 24 nt, Fowlpox virus
auggauggacucuuucacaagccu

SEQ ID NO: 4726 - RNA, 24 nt, Fowlpox virus
uagaugacacuaaagaauacuauu

SEQ ID NO: 4727 - RNA, 24 nt, Fowlpox virus
ggccggcaccggaagcaagcauuu

SEQ ID NO: 4728 - RNA, 18 nt, Cherry mottle leaf virus
ugccaaguuuagaugugu

SEQ ID NO: 4729 - RNA, 24 nt, Cherry mottle leaf virus
ucaaugauuugaauuucagaagug

SEQ ID NO: 4730 - RNA, 24 nt, Macaca mulatta rhadinovirus
uagcacaaauccagauauaucuuc

SEQ ID NO: 4731 - RNA, 24 nt, Macaca mulatta rhadinovirus
aaggggaaagaguuccaccaaaua

SEQ ID NO: 4732 - RNA, 24 nt, Macaca mulatta rhadinovirus
uuuaaugcaauguaaaagcuuaug

SEQ ID NO: 4733 - RNA, 24 nt, Human herpesvirus 4
aguuauuugguuuuaucaaguacu

SEQ ID NO: 4734 - RNA, 24 nt, Human herpesvirus 4
ucgcaagggccaaggcagagcuuc

SEQ ID NO: 4735 - RNA, 24 nt, Human herpesvirus 4
aaggacacugcuggagguauuuuu

SEQ ID NO: 4736 - RNA, 24 nt, Cherry mottle leaf virus
aucaugccugaugacauuggggau

SEQ ID NO: 4737 - RNA, 19 nt, Cherry mottle leaf virus
ugcccuuuucaaaaagcag

SEQ ID NO: 4738 - RNA, 24 nt, Macaca mulatta rhadinovirus
aggaaugcauaugguugcgacacc

SEQ ID NO: 4739 - RNA, 24 nt, Macaca mulatta rhadinovirus
uacccuuucuaaugcgccgaggag

SEQ ID NO: 4740 - RNA, 24 nt, Macaca mulatta rhadinovirus
uuaaggguaaauaaaggcacaugu

SEQ ID NO: 4741 - RNA, 24 nt, Macaca mulatta rhadinovirus
uacaguuucuaagcguguuuuguc

SEQ ID NO: 4742 - RNA, 24 nt, Macaca mulatta rhadinovirus
gggcucgagaaacggagauuuaac

SEQ ID NO: 4743 - RNA, 20 nt, Macaca mulatta rhadinovirus
ugucccagguugauuuccag

SEQ ID NO: 4744 - RNA, 18 nt, Macaca mulatta rhadinovirus
cgaguucauccaauucca

SEQ ID NO: 4745 - RNA, 24 nt, Monkeypox virus
ucuauguuacuuuuaguucguauc

SEQ ID NO: 4746 - RNA, 24 nt, Simian immunodeficiency virus
acgcuguccgccuguuccacgcgc

SEQ ID NO: 4747 - RNA, 24 nt, Simian immunodeficiency virus
ugacaggaucguccccuuggcucg

SEQ ID NO: 4748 - RNA, 24 nt, Simian immunodeficiency virus
cgagaagcgcccgacgcggccugg

SEQ ID NO: 4749 - RNA, 24 nt, Simian immunodeficiency virus
ugggaucgcgcucggagcucuccc

SEQ ID NO: 4750 - RNA, 24 nt, Macaca mulatta rhadinovirus
guuuuguuucaagcacaaaacaaa

SEQ ID NO: 4751 - RNA, 24 nt, Simian immunodeficiency virus
cgacaugauuccugcccgucgauc

SEQ ID NO: 4752 - RNA, 24 nt, Simian immunodeficiency virus
uccguccgcccucgguguccgcca

SEQ ID NO: 4753 - RNA, 24 nt, Simian immunodeficiency virus
ugaaagauuauuaccucugagagg

SEQ ID NO: 4754 - RNA, 24 nt, Simian immunodeficiency virus
uauuaucuuaauauauagucuuua

SEQ ID NO: 4755 - RNA, 24 nt, Ectromelia virus
ugaaaauaucauuaaauuguuuua

SEQ ID NO: 4756 - RNA, 24 nt, Variola virus
uaucgguacauauacguaauucac

SEQ ID NO: 4757 - RNA, 24 nt, Variola virus
ucuacaaugauuuccugaagcuug

SEQ ID NO: 4758 - RNA, 24 nt, Variola virus
uacccaucccccuuccacccgucg

SEQ ID NO: 4759 - RNA, 24 nt, Variola virus
ugggaugucucagcaagacgugau

SEQ ID NO: 4760 - RNA, 21 nt, Variola virus
uaccacggugcacacgagauc

SEQ ID NO: 4761 - RNA, 24 nt, Ectromelia virus
aggaauugcgguuucccccauuag

SEQ ID NO: 4762 - RNA, 24 nt, Variola virus
accgaggaccaagucgaaaguuuu

SEQ ID NO: 4763 - RNA, 24 nt, Variola virus
uccaaaagagugggucguacaaca

SEQ ID NO: 4764 - RNA, 24 nt, Variola virus
ucgaagcgccagauacagauuuga

SEQ ID NO: 4765 - RNA, 24 nt, Equine rhinitis B virus
gguggaucccccucgugguaacac

SEQ ID NO: 4766 - RNA, 24 nt, Meleagrid herpesvirus 1
ucuaaaucugauguuuuugcaugg

SEQ ID NO: 4767 - RNA, 24 nt, Meleagrid herpesvirus 1
uccccggccgugagcggagccgug

SEQ ID NO: 4768 - RNA, 24 nt, Ateline herpesvirus 3
caucucuaguuacuucguggauca

SEQ ID NO: 4769 - RNA, 24 nt, Ateline herpesvirus 3
uaaucccagguacaguuaaucccc

SEQ ID NO: 4770 - RNA, 24 nt, Ateline herpesvirus 3
ucggaaccacccggaagauuacag

SEQ ID NO: 4771 - RNA, 24 nt, Ateline herpesvirus 3
uucauuaacagccaugguguauua

SEQ ID NO: 4772 - RNA, 24 nt, Ateline herpesvirus 3
auggauugccgggugauuuucucc

SEQ ID NO: 4773 - RNA, 24 nt, Ateline herpesvirus 3
agccagcccggggacggggccacc

SEQ ID NO: 4774 - RNA, 24 nt, Ateline herpesvirus 3
gaccgcauuccaaccugcguugua

SEQ ID NO: 4775 - RNA, 24 nt, Ateline herpesvirus 3
uaagucaaagauguaccaagccuu

SEQ ID NO: 4776 - RNA, 24 nt, Ateline herpesvirus 3
uccccgcaaggauggugguuucaa

SEQ ID NO: 4777 - RNA, 23 nt, Ateline herpesvirus 3
ucaacggacguaaggcagauuau

SEQ ID NO: 4778 - RNA, 24 nt, Ateline herpesvirus 3
ucgguucgcggggccggggguccc

SEQ ID NO: 4779 - RNA, 24 nt, Ateline herpesvirus 3
uagcggccggucguucaauguauc

SEQ ID NO: 4780 - RNA, 24 nt, Ateline herpesvirus 3
uccggccgagcccggcggcgccgc

SEQ ID NO: 4781 - RNA, 24 nt, Ateline herpesvirus 3
cugcuaguagggcugcugggcugc

SEQ ID NO: 4782 - RNA, 24 nt, Ateline herpesvirus 3
caccauguucgaauuuacccgccc

SEQ ID NO: 4783 - RNA, 24 nt, Ateline herpesvirus 3
acccugaguauuuaaaggauuuac

SEQ ID NO: 4784 - RNA, 24 nt, Ateline herpesvirus 3
aggaaauuuuauuaguacguuugu

SEQ ID NO: 4785 - RNA, 24 nt, Ateline herpesvirus 3
uccuuuguaugaacccggugggca

SEQ ID NO: 4786 - RNA, 24 nt, Ateline herpesvirus 3
cagcggacguacaucaaucagauu

SEQ ID NO: 4787 - RNA, 24 nt, Ateline herpesvirus 3
ucacgcuacccuaaacguacaaua

SEQ ID NO: 4788 - RNA, 24 nt, Ateline herpesvirus 3
uuccucaugaugccgcgauuuguc

SEQ ID NO: 4789 - RNA, 22 nt, Ateline herpesvirus 3
uuggcagaaucaugaagggugu

SEQ ID NO: 4790 - RNA, 24 nt, Tomato mosaic virus
uggcuugcuugcuugcuugcuagu

SEQ ID NO: 4791 - RNA, 24 nt, Ateline herpesvirus 3
uguuuuguggauuagguaaaacag

SEQ ID NO: 4792 - RNA, 24 nt, Vaccinia virus
acgauuauuucugaauuauuccaa

SEQ ID NO: 4793 - RNA, 24 nt, Camelpox virus
ugccgaggcggcccaucgugcugc

SEQ ID NO: 4794 - RNA, 24 nt, Human echovirus 1
uacaauauacaacauauguacagc

SEQ ID NO: 4795 - RNA, 24 nt, Human echovirus 1
aagggggcacauguggcuauagua

SEQ ID NO: 4796 - RNA, 24 nt, Ictalurid herpesvirus 1
ugagcugagguuacagauuucuaa

SEQ ID NO: 4797 - RNA, 24 nt, Ictalurid herpesvirus 1
uccacccuccgugcugguuaccga

SEQ ID NO: 4798 - RNA, 24 nt, Ictalurid herpesvirus 1
caagagcuguggucagcgcucaac

SEQ ID NO: 4799 - RNA, 24 nt, Camelpox virus
cacugcacuguggcccaauuugac

SEQ ID NO: 4800 - RNA, 24 nt, Camelpox virus
uuucuauuuggugacagucguucu

SEQ ID NO: 4801 - RNA, 24 nt, Camelpox virus
ugcugggggagucaggagacaccg

SEQ ID NO: 4802 - RNA, 24 nt, Camelpox virus
agaggcugucgccgcgcccgaggu

SEQ ID NO: 4803 - RNA, 24 nt, Human echovirus 1
ugagucaccguauuccccacgggc

SEQ ID NO: 4804 - RNA, 24 nt, Human echovirus 1
ucuauaacaaccucccccaggucc

SEQ ID NO: 4805 - RNA, 24 nt, Ictalurid herpesvirus 1
uggaaggacgggaaguggaagucc

SEQ ID NO: 4806 - RNA, 20 nt, Ictalurid herpesvirus 1
uaccaggcuggcauggaagc

SEQ ID NO: 4807 - RNA, 24 nt, Human echovirus 1
agagaaguuagguguuuguuggga

SEQ ID NO: 4808 - RNA, 24 nt, Ictalurid herpesvirus 1
ugccuggcucucuaugcuuggguc

SEQ ID NO: 4809 - RNA, 22 nt, Ictalurid herpesvirus 1
aucucuuuccagccaguuacua

SEQ ID NO: 4810 - RNA, 24 nt, Ictalurid herpesvirus 1
uaacugccccucugacaaaaagaa

SEQ ID NO: 4811 - RNA, 24 nt, Vaccinia virus
aaacaggaaagaaguauacuaucg

SEQ ID NO: 4812 - RNA, 24 nt, Human echovirus 1
uacaguuuauguuucaauuaugua

SEQ ID NO: 4813 - RNA, 24 nt, Human echovirus 1
uaggaagaaguaguauguguuauu

SEQ ID NO: 4814 - RNA, 24 nt, Ictalurid herpesvirus 1
ugaguacgaagucaauucucuuac

SEQ ID NO: 4815 - RNA, 24 nt, Vaccinia virus
uuccagaguguuuauccagggaaa

SEQ ID NO: 4816 - RNA, 24 nt, Vaccinia virus
aagcugauuguauaaauuuacuau

SEQ ID NO: 4817 - RNA, 24 nt, Monkeypox virus
auggagaugaugguggcccagagg

SEQ ID NO: 4818 - RNA, 24 nt, Vaccinia virus
acgauuauuucugaauuauuccaa

SEQ ID NO: 4819 - RNA, 24 nt, Ictalurid herpesvirus 1
uucagcuaguguuguaugauagga

SEQ ID NO: 4820 - RNA, 24 nt, Ictalurid herpesvirus 1
acccggcgauuuucccaaccaccc

SEQ ID NO: 4821 - RNA, 24 nt, Monkeypox virus
uauuacacucacggcauucguuaa

SEQ ID NO: 4822 - RNA, 24 nt, Monkeypox virus
gcccaguagagcgccggguucucc

SEQ ID NO: 4823 - RNA, 22 nt, Monkeypox virus
ugugauagaauacgauagggcc

SEQ ID NO: 4824 - RNA, 24 nt, Monkeypox virus
cugcaguuggugaucgacuuccgc

SEQ ID NO: 4825 - RNA, 24 nt, Monkeypox virus
agccaagacguuuacaagucggag

SEQ ID NO: 4826 - RNA, 24 nt, Monkeypox virus
aagaggcugucgguguccccguag

SEQ ID NO: 4827 - RNA, 24 nt, Monkeypox virus
ucgcgaaguauucgcuccgugcgg

SEQ ID NO: 4828 - RNA, 24 nt, Monkeypox virus
uaguagacguuggcgcggauggga

SEQ ID NO: 4829 - RNA, 24 nt, Murid herpesvirus 4
uccacagugggcguggcagccaca

SEQ ID NO: 4830 - RNA, 24 nt, Murid herpesvirus 4
aggcauggcugcugaccccuaugg

SEQ ID NO: 4831 - RNA, 24 nt, Murid herpesvirus 4
uggcagugccauauacagucccac

SEQ ID NO: 4832 - RNA, 24 nt, Murid herpesvirus 4
ugguauuuccggaagcauuaccaa

SEQ ID NO: 4833 - RNA, 24 nt, Poliovirus
cgggugcgguugccugacccuaau

SEQ ID NO: 4834 - RNA, 24 nt, Monkeypox virus
uucgucuuugaaguacuugucgua

SEQ ID NO: 4835 - RNA, 24 nt, Monkeypox virus
uggaagaggacgucguuaaagagg

SEQ ID NO: 4836 - RNA, 24 nt, Murid herpesvirus 4
aacacugggguaagggcacugugu

SEQ ID NO: 4837 - RNA, 24 nt, Murid herpesvirus 4
uuggccccuacagaaaagcaggau

SEQ ID NO: 4838 - RNA, 24 nt, Murid herpesvirus 4
cagcaccccaggagccccggcagc

SEQ ID NO: 4839 - RNA, 24 nt, Poliovirus
acagggcgauugcccuccccugga

SEQ ID NO: 4840 - RNA, 24 nt, Poliovirus
uuuuugauuguagcggaaaaaugu

SEQ ID NO: 4841 - RNA, 24 nt, Poliovirus
acuuuuggucacccaccucgaacg

SEQ ID NO: 4842 - RNA, 24 nt, Poliovirus
uacaauacucuccuauuacgcccc

SEQ ID NO: 4843 - RNA, 24 nt, Poliovirus
ugucuagagauaucaggccauuga

SEQ ID NO: 4844 - RNA, 24 nt, Poliovirus
uacuaugucguacacgugaaaucu

SEQ ID NO: 4845 - RNA, 24 nt, Equine arteritis virus
ccgccgugggcaaucgguuguuag

SEQ ID NO: 4846 - RNA, 24 nt, Equine arteritis virus
uugggucuaaggcgggaaggggau

SEQ ID NO: 4847 - RNA, 24 nt, Camelpox virus
uaauagggauaaaggauuaaugau

SEQ ID NO: 4848 - RNA, 24 nt, Tupaia herpesvirus
ucgcaauaauuucugguuagauaa

SEQ ID NO: 4849 - RNA, 24 nt, Melanoplus sanguinipes entomopoxvirus
uaucugauaucacaaaauaucaau

SEQ ID NO: 4850 - RNA, 24 nt, Bovine adenovirus B
ugugguuauauggcuacaauuuca

SEQ ID NO: 4851 - RNA, 24 nt, Marburg virus
uaugauaagcggaggaaaaccugc

SEQ ID NO: 4852 - RNA, 24 nt, Melanoplus sanguinipes entomopoxvirus
ucccgaguucuagggaccuacuug

SEQ ID NO: 4853 - RNA, 21 nt, Murine type C retrovirus
gaggccgucgacaccgcccuc

SEQ ID NO: 4854 - RNA, 24 nt, Murine type C retrovirus
cccccggucuucuacgagcccgug

SEQ ID NO: 4855 - RNA, 24 nt, Murine osteosarcoma virus
cuagaucuguaucuggcgguuccg

SEQ ID NO: 4856 - RNA, 24 nt, Murine osteosarcoma virus
ucucagaggcaucgggggccauuu

SEQ ID NO: 4857 - RNA, 24 nt, Murine osteosarcoma virus
uauugggcggcgaggggccgaaac

SEQ ID NO: 4858 - RNA, 24 nt, Equine herpesvirus 4
cccccguucgcccacuacgagguc

SEQ ID NO: 4859 - RNA, 24 nt, Murine type C retrovirus
ucggacccgcgcucggaccgggac

SEQ ID NO: 4860 - RNA, 24 nt, Banana mild mosaic virus
ucagagcauggucuagaaauucau

SEQ ID NO: 4861 - RNA, 24 nt, Banana mild mosaic virus
uacaagaacugcgagauggugcac

SEQ ID NO: 4862 - RNA, 24 nt, Rana tigrina ranavirus
uugguggaaggcuguaacaauguc

SEQ ID NO: 4863 - RNA, 24 nt, Rana tigrina ranavirus
uacguucgacaccauuaaaaaaga

SEQ ID NO: 4864 - RNA, 17 nt, Rana tigrina ranavirus
caccgccuguuagguug

SEQ ID NO: 4865 - RNA, 17 nt, Ribgrass mosaic virus
ugagugcgauugugaca

SEQ ID NO: 4866 - RNA, 21 nt, Simian type D virus 1
cucgccgcguugcgcggcguu

SEQ ID NO: 4867 - RNA, 24 nt, Simian type D virus 1
acgccaucuucgaggaguacccgg

SEQ ID NO: 4868 - RNA, 24 nt, Simian type D virus 1
ccuccagggccugcuucgacgauc

SEQ ID NO: 4869 - RNA, 22 nt, Melanoplus sanguinipes entomopoxvirus
aagaagcgacagaauccguccu

SEQ ID NO: 4870 - RNA, 24 nt, Melanoplus sanguinipes entomopoxvirus
ucucauacuuaugguagguucaag

SEQ ID NO: 4871 - RNA, 24 nt, Marburg virus
ugacaaaauuucguaguuaaauuu

SEQ ID NO: 4872 - RNA, 17 nt, Marburg virus
uggcaugaggaugguug

SEQ ID NO: 4873 - RNA, 24 nt, Murine osteosarcoma virus
uaccuuuaaaccuuauguagacug

SEQ ID NO: 4874 - RNA, 24 nt, Ribgrass mosaic virus
augaaguccuuugauacuagaaau

SEQ ID NO: 4875 - RNA, 24 nt, Ribgrass mosaic virus
uauuacagugggaauaacuaaaag

SEQ ID NO: 4876 - RNA, 21 nt, Marburg virus
auagaggaacuaauauuacua

SEQ ID NO: 4877 - RNA, 24 nt, Lumpy skin disease virus
uucacauugccagcuuuuacuuca

SEQ ID NO: 4878 - RNA, 24 nt, Crucifer tobamovirus
ugagugagcuuuccaguggacaug

SEQ ID NO: 4879 - RNA, 24 nt, Banana mild mosaic virus
uacaucaagaagaaaagucacaga

SEQ ID NO: 4880 - RNA, 24 nt, Turnip vein-clearing virus
ucaaacuuguuaagugcgguugug

SEQ ID NO: 4881 - RNA, 24 nt, Turnip vein-clearing virus
ugccauuagaagucaaauucagcu

SEQ ID NO: 4882 - RNA, 24 nt, Turnip vein-clearing virus
uauuacagugggaauaaguaaaag

SEQ ID NO: 4883 - RNA, 24 nt, Human adenovirus B
uccaccacggggugaacuuccccc

SEQ ID NO: 4884 - RNA, 23 nt, Gallid herpesvirus 2
ugcaauagaucauucaguaaaac

SEQ ID NO: 4885 - RNA, 24 nt, Ectromelia virus
ugaggaaccgguaugggucgauca

SEQ ID NO: 4886 - RNA, 21 nt, Meleagrid herpesvirus 1
ugagaggaggcggguugcggc

SEQ ID NO: 4887 - RNA, 24 nt, Crucifer tobamovirus
ucgaacuuguuaagugcgauugug

SEQ ID NO: 4888 - RNA, 24 nt, Crucifer tobamovirus
ucgcauacugaauuguuuguuggg

SEQ ID NO: 4889 - RNA, 24 nt, Human adenovirus B
cauuacuaccgucaccuccacagc

SEQ ID NO: 4890 - RNA, 24 nt, Ectromelia virus
caugacaaugaacaaaccuaagac

SEQ ID NO: 4891 - RNA, 24 nt, African swine fever virus
aggugcaaaugcgaccagacuguc

SEQ ID NO: 4892 - RNA, 24 nt, African swine fever virus
cuccggagagcggcuuggugcgga

SEQ ID NO: 4893 - RNA, 24 nt, Gibbon ape leukemia virus
cacccgaggcggccugggucuucc

SEQ ID NO: 4894 - RNA, 19 nt, Paramecium bursaria Chlorella virus 1
uaaaauaccuauucccguu

SEQ ID NO: 4895 - RNA, 24 nt, Molluscum contagiosum virus
ucgcaagcagcccuuucccagccc

SEQ ID NO: 4896 - RNA, 24 nt, Vaccinia virus
aacucuguuguauaucuacugaua

SEQ ID NO: 4897 - RNA, 24 nt, Vaccinia virus
uauuuuaacaaagcaucgauuugc

SEQ ID NO: 4898 - RNA, 24 nt, Alcelaphine herpesvirus 1
uguugacaguuuuaacuguucaua

SEQ ID NO: 4899 - RNA, 24 nt, Human herpesvirus 2
uccaaccgauaaaucaagcgccga

SEQ ID NO: 4900 - RNA, 24 nt, Human papillomavirus type 90
uuguagguguugcuguacaguaag

SEQ ID NO: 4901 - RNA, 24 nt, Human papillomavirus type 6
uugcuguggaugugacagcaacgu

SEQ ID NO: 4902 - RNA, 24 nt, Fowlpox virus
uuaacauaaauagaaaaaaaacga

SEQ ID NO: 4903 - RNA, 24 nt, Paramecium bursaria Chlorella virus 1
gugaagacugagacggugaagacu

SEQ ID NO: 4904 - RNA, 17 nt, Cercopithecine herpesvirus 7
ucucuaaguugauaaac

SEQ ID NO: 4905 - RNA, 24 nt, Cowpox virus
uuaguacuacccaauaaucaaaug

SEQ ID NO: 4906 - RNA, 24 nt, Sulfolobus virus SIRV-2
acuaacauuuuuauaguuaucauu

SEQ ID NO: 4907 - RNA, 24 nt, Meleagrid herpesvirus 1
uaucgcaugcgauugugcgaaugu

SEQ ID NO: 4908 - RNA, 24 nt, Meleagrid herpesvirus 1
cuuugcacguaccaaccagaacgu

SEQ ID NO: 4909 - RNA, 24 nt, Avian paramyxovirus 6
uaugucgagggaugacauugauga

SEQ ID NO: 4910 - RNA, 24 nt, Lymphocystis disease virus 1
uauggcacaugcguuagaugcugc

SEQ ID NO: 4911 - RNA, 24 nt, Tupaia herpesvirus
uggagagacgcucaaacugccuug

SEQ ID NO: 4912 - RNA, 24 nt, Bovine respiratory syncytial virus
uaccucaguuagauaaauaaaaau

SEQ ID NO: 4913 - RNA, 24 nt, Avian paramyxovirus 6
ugcagcacuaacucuuuacaaccc

SEQ ID NO: 4914 - RNA, 21 nt, Peanut clump virus
uaucuggcuaagaugggagug

SEQ ID NO: 4915 - RNA, 24 nt, Paramecium bursaria Chlorella virus 1
gggcaagaauugaccgauuuaucu

SEQ ID NO: 4916 - RNA, 24 nt, Transmissible gastroenteritis virus
aaagauccgcuacgacgagccaac

SEQ ID NO: 4917 - RNA, 24 nt, Sulfolobus virus SIRV-1
uuuuacgugaguuaaaaguuuaaa

SEQ ID NO: 4918 - RNA, 18 nt, Brome mosaic virus
gucgugguugacacgcag

SEQ ID NO: 4919 - RNA, 24 nt, Human papillomavirus type 60
gagcagguguuagauuuacuauua

SEQ ID NO: 4920 - RNA, 24 nt, Pestivirus type 3
ggaccacacuacacucauuuuuaa

SEQ ID NO: 4921 - RNA, 23 nt, Paramecium bursaria Chlorella virus 1
uuucuugguuucuuauuuguaua

SEQ ID NO: 4922 - RNA, 24 nt, Human papillomavirus type 65
uauaaugcaaaacaagcaauacaa

SEQ ID NO: 4923 - RNA, 24 nt, Human papillomavirus type 55
uuagacagcucagaggaugaggug

SEQ ID NO: 4924 - RNA, 22 nt, Human papillomavirus type 63
cuaaggguggguguugggguau

SEQ ID NO: 4925 - RNA, 24 nt, Human papillomavirus type 44
uucacuggauauauuguguccugu

SEQ ID NO: 4926 - RNA, 24 nt, Human papillomavirus type 25
ucaggcagcugcucgccagaugcg

SEQ ID NO: 4927 - RNA, 24 nt, Fowlpox virus
uaacaaaaguaucuauaauuccca

SEQ ID NO: 4928 - RNA, 24 nt, Paramecium bursaria Chlorella virus 1
uauuacaccaucauuauuuuaugu

SEQ ID NO: 4929 - RNA, 23 nt, Monkeypox virus
ucgaucauucuuuuagcacaugu

SEQ ID NO: 4930 - RNA, 22 nt, Human papillomavirus type 63
uaaagcuucaaauucaucugac

SEQ ID NO: 4931 - RNA, 24 nt, Feline immunodeficiency virus
uauccuauaaaauuuuuauuagac

SEQ ID NO: 4932 - RNA, 24 nt, Feline immunodeficiency virus
uaauguacauuuagagauuagaga

SEQ ID NO: 4933 - RNA, 24 nt, Human herpesvirus 1
ggucauuggacggggugcaguuaa

SEQ ID NO: 4934 - RNA, 24 nt, Equine herpesvirus 2
cauugugguuuucgcgccucagag

SEQ ID NO: 4935 - RNA, 24 nt, Camelpox virus
aaagggcaauauuuugcgucauuu

SEQ ID NO: 4936 - RNA, 24 nt, Human papillomavirus type 89
uggcagaacgagcacagcaggccu

SEQ ID NO: 4937 - RNA, 24 nt, Monkeypox virus
uccuccuugauuuuagcauccucu

SEQ ID NO: 4938 - RNA, 24 nt, Human papillomavirus type 15
guaguuccguguugcuuuugugau

SEQ ID NO: 4939 - RNA, 24 nt, Human papillomavirus type 9
acuucguuuauacgugcuugcuac

SEQ ID NO: 4940 - RNA, 24 nt, Equine herpesvirus 2
acuacauuucucagaaccaaaaau

SEQ ID NO: 4941 - RNA, 24 nt, Paramecium bursaria Chlorella virus 1
uaaguuucauaaguuuauuuuauu

SEQ ID NO: 4942 - RNA, 24 nt, Camelpox virus
uaaguaaagcauauaacgacuaac

SEQ ID NO: 4943 - RNA, 24 nt, Cercopithecine herpesvirus 7
uacaugggaaacaaagcauuucca

SEQ ID NO: 4944 - RNA, 24 nt, Human papillomavirus type 84
accagcacagcuggccuauagggu

SEQ ID NO: 4945 - RNA, 23 nt, Human herpesvirus 5
uagaguguaauagaaucaccguc

SEQ ID NO: 4946 - RNA, 24 nt, Bovine adenovirus B
ucggaaguuacugauggaacaaca

SEQ ID NO: 4947 - RNA, 24 nt, Pepper mottle virus
uaguauggcuuuucucguuccagu

SEQ ID NO: 4948 - RNA, 24 nt, Fowlpox virus
uaagaaaauaagaagcacaguuau

SEQ ID NO: 4949 - RNA, 24 nt, Rat cytomegalovirus
uaugcagauguggucugacacgua

SEQ ID NO: 4950 - RNA, 24 nt, Lymphocystis disease virus 1
uacggaaacaaauuaucauuuuua

SEQ ID NO: 4951 - RNA, 24 nt, Mouse parvovirus 1
ucacaugguuggucaguucuaaaa

SEQ ID NO: 4952 - RNA, 24 nt, Y73 sarcoma virus
ucccugacgacuacgagcaccuga

SEQ ID NO: 4953 - RNA, 24 nt, Tupaia herpesvirus
aggcggugagccacacagcccggg

SEQ ID NO: 4954 - RNA, 24 nt, Sheeppox virus
ugacgaaauaacugauagaccuac

SEQ ID NO: 4955 - RNA, 19 nt, Equine herpesvirus 1
ucugaaagauaucaagccc

SEQ ID NO: 4956 - RNA, 24 nt, Canine adenovirus
uguaacaaaccgcguccucaccua

SEQ ID NO: 4957 - RNA, 24 nt, Melanoplus sanguinipes entomopoxvirus
ugaaagauaugaguaaaauauuua

SEQ ID NO: 4958 - RNA, 24 nt, Human herpesvirus 7
cacucguaauaguauuuauuuuuc

SEQ ID NO: 4959 - RNA, 24 nt, Ovine adenovirus A
ucaauaguaggagugguuuucugu

SEQ ID NO: 4960 - RNA, 24 nt, Tupaia herpesvirus
gaggacacaacggagucgagguug

SEQ ID NO: 4961 - RNA, 24 nt, Fowlpox virus
uaccgcgcagaguauaaaagauua

SEQ ID NO: 4962 - RNA, 24 nt, Lumpy skin disease virus
uaaaugaauaaaauuagauucauc

SEQ ID NO: 4963 - RNA, 24 nt, Vaccinia virus
ugauuggucaaugugaauguauuc

SEQ ID NO: 4964 - RNA, 24 nt, Equine herpesvirus 1
uuuaaauugggcccaggcggauca

SEQ ID NO: 4965 - RNA, 24 nt, Equine herpesvirus 4
uaucgcccauuuaacaguacaaaa

SEQ ID NO: 4966 - RNA, 24 nt, Vaccinia virus
ugauuggucaaugugaauguauuc

SEQ ID NO: 4967 - RNA, 24 nt, Gallid herpesvirus 3
uacguucccuaaaaugcugugcuc

SEQ ID NO: 4968 - RNA, 24 nt, Simian immunodeficiency virus
gaccuacagccaguucauuauccc

SEQ ID NO: 4969 - RNA, 24 nt, Sorghum chlorotic spot virus
uaugaugggaugugguggguugcc

SEQ ID NO: 4970 - RNA, 24 nt, Canine adenovirus
caggagauuccagcauuguuccaa

SEQ ID NO: 4971 - RNA, 18 nt, Chimpanzee cytomegalovirus
caccggcacguucgacgu

SEQ ID NO: 4972 - RNA, 20 nt, Monkeypox virus
cggcaugguuucugugacua

SEQ ID NO: 4973 - RNA, 24 nt, Rat cytomegalovirus
accacguuuuuaucuuuuuuuauu

SEQ ID NO: 4974 - RNA, 24 nt, Human papillomavirus type 4
ugauagacagaaugcaaugcugua

SEQ ID NO: 4975 - RNA, 24 nt, Canine adenovirus
uuacugcaucaacgugcucagaaa

SEQ ID NO: 4976 - RNA, 24 nt, Variola virus
uaugaauucuacccccguuacauu

SEQ ID NO: 4977 - RNA, 24 nt, Rat cytomegalovirus
aagguugucguuacgaacauaucc

SEQ ID NO: 4978 - RNA, 24 nt, Tupaia herpesvirus
uugcagcguuauuacggauacgga

SEQ ID NO: 4979 - RNA, 24 nt, Macaca mulatta rhadinovirus
ugagaggaaaacuuuauugcaggg

SEQ ID NO: 4980 - RNA, 24 nt, Cowpox virus
uaaaaaguguagugagugagagua

SEQ ID NO: 4981 - RNA, 22 nt, Bovine parvovirus
ugugaaaaauguaauuacuggg

SEQ ID NO: 4982 - RNA, 24 nt, Porcine adenovirus A
cucgagcugaggauccgugaugga

SEQ ID NO: 4983 - RNA, 24 nt, Cowpox virus
ucgcagcauaaguaguaugucgau

SEQ ID NO: 4984 - RNA, 24 nt, Human herpesvirus 4
aagaagagaauaguggccagggcc

SEQ ID NO: 4985 - RNA, 24 nt, Turkey adenovirus 3
ccuacaguuucugcuguaccagua

SEQ ID NO: 4986 - RNA, 24 nt, Peanut chlorotic streak virus
auagaaacaauacaacgagaaaua

SEQ ID NO: 4987 - RNA, 24 nt, Paramecium bursaria Chlorella virus 1
uauuuuaccauugacaaacucaca

SEQ ID NO: 4988 - RNA, 24 nt, Paramecium bursaria Chlorella virus 1
uacauauaucuguugauaugauug

SEQ ID NO: 4989 - RNA, 19 nt, Trichomonas vaginalis virus 3
uuccugauucugguguagc

SEQ ID NO: 4990 - RNA, 24 nt, Porcine adenovirus A
uaaaggaaaauaaagacucagaga

SEQ ID NO: 4991 - RNA, 24 nt, Tupaia paramyxovirus
aaggaugugcaugaauaaaccaau

SEQ ID NO: 4992 - RNA, 24 nt, Myxoma virus
agagggauuuagagaccuuucuuc

SEQ ID NO: 4993 - RNA, 24 nt, Cowpox virus
uacaacaaugcuauaccuaauacu

SEQ ID NO: 4994 - RNA, 24 nt, Human papillomavirus type 48
ugugaucaauaaacacugugaaua

SEQ ID NO: 4995 - RNA, 24 nt, Gallid herpesvirus 2
cauucgaaaauaauccuaacacau

SEQ ID NO: 4996 - RNA, 24 nt, Human herpesvirus 7
uuacugguggcugcuucugggacg

SEQ ID NO: 4997 - RNA, 24 nt, Human herpesvirus 1
uacaaugcaaaagccuucgacgug

SEQ ID NO: 4998 - RNA, 24 nt, Human herpesvirus 1
agaggaaacaggccgcggacaccc

SEQ ID NO: 4999 - RNA, 24 nt, Paramecium bursaria Chlorella virus 1
acucaaaagcucgaacaacgccuc

SEQ ID NO: 5000 - RNA, 24 nt, Feline calicivirus
caaggcccaauccaauccguucgc

SEQ ID NO: 5001 - RNA, 24 nt, Eimeria brunetti RNA virus 1
uaguaggccgucauguggugguaa

SEQ ID NO: 5002 - RNA, 24 nt, Chimpanzee cytomegalovirus
cauuucacuagaacgcugguucag

SEQ ID NO: 5003 - RNA, 24 nt, Pea enation mosaic virus-2
agucaccaacccacccugaaucga

SEQ ID NO: 5004 - RNA, 24 nt, Gallid herpesvirus 2
ucuuaaguuauagguacgucaaac

SEQ ID NO: 5005 - RNA, 24 nt, Chimpanzee cytomegalovirus
ugccucgggagcucgaagggugcu

SEQ ID NO: 5006 - RNA, 24 nt, Human papillomavirus type 19
gaaguuacucauucggugcuuguu

SEQ ID NO: 5007 - RNA, 24 nt, Human papillomavirus type 23
ugaccguaggcguucauuuacuaa

SEQ ID NO: 5008 - RNA, 24 nt, Human papillomavirus type 36
uaucaugugaauaauauacuguau

SEQ ID NO: 5009 - RNA, 24 nt, Aleutian mink disease virus
aaaguaaccuaacaccauaacacu

SEQ ID NO: 5010 - RNA, 24 nt, Banana mild mosaic virus
uuaauggaaauagggcguuuguua

SEQ ID NO: 5011 - RNA, 24 nt, Human papillomavirus type 25
uauuauauauauacacguagacac

SEQ ID NO: 5012 - RNA, 24 nt, Human papillomavirus type 20
uaauauauauauauauauauauau

SEQ ID NO: 5013 - RNA, 24 nt, Human papillomavirus type 49
uugaaacagauauacauguaaccg

SEQ ID NO: 5014 - RNA, 24 nt, Human papillomavirus type 9
aggugguuauuugaucguugggau

SEQ ID NO: 5015 - RNA, 24 nt, Vaccinia virus
ucuauaaacauaaguauauaauaa

SEQ ID NO: 5016 - RNA, 24 nt, Human herpesvirus 4
uaacauggaggauugaggacccac

SEQ ID NO: 5017 - RNA, 24 nt, Human herpesvirus 1
cgucccaucugugcggggaggggg

SEQ ID NO: 5018 - RNA, 24 nt, Meleagrid herpesvirus 1
uugguugcaaauauucauuacuuc

SEQ ID NO: 5019 - RNA, 24 nt, Porcine adenovirus C
ucuuucccacguuguaugccaucu

SEQ ID NO: 5020 - RNA, 24 nt, Fowl adenovirus A
uucccgaacgaggacauagucagc

SEQ ID NO: 5021 - RNA, 24 nt, Cowpox virus
uuaguaguaauaagauaguuuaaa

SEQ ID NO: 5022 - RNA, 24 nt, Tupaia herpesvirus
aggccggcgggcgccucggacuuc

SEQ ID NO: 5023 - RNA, 23 nt, Chimpanzee cytomegalovirus
ugaacucauugccuccggcuguc

SEQ ID NO: 5024 - RNA, 24 nt, Cercopithecine herpesvirus 7
gcaauauuacuaauauuuucacac

SEQ ID NO: 5025 - RNA, 21 nt, Fowlpox virus
uauagaauuuaguauagaacu

SEQ ID NO: 5026 - RNA, 24 nt, Ophiostoma mitovirus 3a
uacuuugucuuucaaauaugacua

SEQ ID NO: 5027 - RNA, 24 nt, Cercopithecine herpesvirus 7
uucaugugacuuuguauaauuuac

SEQ ID NO: 5028 - RNA, 21 nt, Molluscum contagiosum virus
gcgcggggcaggcagugccgc

SEQ ID NO: 5029 - RNA, 24 nt, Fowlpox virus
aagaauauaauacuaaacuuugcu

SEQ ID NO: 5030 - RNA, 24 nt, Lymphocystis disease virus 1
uagcauuaauaaauguaaaacuau

SEQ ID NO: 5031 - RNA, 24 nt, Clover yellow vein virus
uaagaucauuucaguuucgucuuu

SEQ ID NO: 5032 - RNA, 21 nt, Ovine adenovirus A
uaacgugcgugccgucuucua

SEQ ID NO: 5033 - RNA, 24 nt, Sugarcane striate mosaic associated virus
agaccagacaaucaaagaucaggu

SEQ ID NO: 5034 - RNA, 24 nt, Rat cytomegalovirus
uguggaguggaagcggagcgugau

SEQ ID NO: 5035 - RNA, 24 nt, Variola virus
uuaauugcuaccguuacauuguac

SEQ ID NO: 5036 - RNA, 24 nt, Apple chlorotic leaf spot virus
uaaagagucaugguauuuaauugg

SEQ ID NO: 5037 - RNA, 24 nt, Human respiratory syncytial virus
ucuaccaucaugcugugucaaauu

SEQ ID NO: 5038 - RNA, 24 nt, Apple latent spherical virus
uugaacuaguuuguucucgugauc

SEQ ID NO: 5039 - RNA, 24 nt, Cercopithecine herpesvirus 7
uuuaauacuaguuguacauuccau

SEQ ID NO: 5040 - RNA, 24 nt, Cherry necrotic rusty mottle virus
uuauuugagugugugugagcuuuc

SEQ ID NO: 5041 - RNA, 24 nt, Human herpesvirus 5
aaguugcgugucugaguggacgug

SEQ ID NO: 5042 - RNA, 24 nt, Tobacco etch virus
uuuaagcuuauuguaauauauaug

SEQ ID NO: 5043 - RNA, 24 nt, Sulfolobus virus SIRV-1
uaguauauaauuuccgggauuauu

SEQ ID NO: 5044 - RNA, 21 nt, Human papillomavirus type 15
caccuggugcgauuuuaucac

SEQ ID NO: 5045 - RNA, 24 nt, Common chimpanzee papillomavirus 1
augauggugacacaugguuguugu

SEQ ID NO: 5046 - RNA, 24 nt, Human herpesvirus 3
uuacuuggaaacacccauacauau

SEQ ID NO: 5047 - RNA, 20 nt, Acute bee paralysis virus
uuaaggcuuguuguguugga

SEQ ID NO: 5048 - RNA, 23 nt, Gallid herpesvirus 2
uagcggcugguguucgaugucac

SEQ ID NO: 5049 - RNA, 24 nt, Fowlpox virus
ucaagauuacuuacuucuauuuua

SEQ ID NO: 5050 - RNA, 24 nt, Equine herpesvirus 2
acaaaaauuucaauaaaaacaauu

SEQ ID NO: 5051 - RNA, 24 nt, Paramecium bursaria Chlorella virus 1
uauugugcagacgugguucuuggg

SEQ ID NO: 5052 - RNA, 24 nt, Amsacta moorei entomopoxvirus
ucgauaguugugauaaugugcucu

SEQ ID NO: 5053 - RNA, 24 nt, Camelpox virus
ugaaaauaaauacaaagguuccug

SEQ ID NO: 5054 - RNA, 24 nt, Potato virus Y
uaaguuucaguuuaaaucauuucc

SEQ ID NO: 5055 - RNA, 24 nt, African swine fever virus
uauuguucauggcuuaagucuauu

SEQ ID NO: 5056 - RNA, 24 nt, Human herpesvirus 6
acgcguucaauaaaacgaaugguu

SEQ ID NO: 5057 - RNA, 24 nt, Variola virus
uaucacacugcgacgugcugacaa

SEQ ID NO: 5058 - RNA, 24 nt, Equine rhinitis B virus
agacaaaauuguaaccacuucguu

SEQ ID NO: 5059 - RNA, 24 nt, Meleagrid herpesvirus 1
gacacgguggcgggcgcgguggcg

SEQ ID NO: 5060 - RNA, 24 nt, Monkeypox virus
uacauuauauacauuauauacauu

SEQ ID NO: 5061 - RNA, 24 nt, Vaccinia virus
accaagauagagagcuccuuuggu

SEQ ID NO: 5062 - RNA, 21 nt, Vaccinia virus
uacacagcguacugaauuucu

SEQ ID NO: 5063 - RNA, 24 nt, Ictalurid herpesvirus 1
caccucuaagcauaaccugucggg

SEQ ID NO: 5064 - RNA, 24 nt, Ictalurid herpesvirus 1
uggacuguuuauacuuaucuucaa

SEQ ID NO: 5065 - RNA, 24 nt, Equine rhinitis B virus
uuuacauauuacccuucuucaaau

SEQ ID NO: 5066 - RNA, 24 nt, Ictalurid herpesvirus 1
ucuaacucugacccuaggccuaac

SEQ ID NO: 5067 - RNA, 24 nt, Rat cytomegalovirus
gcccgggucucggucguucacgcg

SEQ ID NO: 5068 - RNA, 24 nt, Rat cytomegalovirus
ucguggguguguucuucguccagc

SEQ ID NO: 5069 - RNA, 24 nt, Rat cytomegalovirus
ugagccaguuuuuucagauggauu

SEQ ID NO: 5070 - RNA, 24 nt, Rat cytomegalovirus
ucucugcuucuuuucuguguucuc

SEQ ID NO: 5071 - RNA, 24 nt, Melanoplus sanguinipes entomopoxvirus
uucacauaaacagccagcuggggg

SEQ ID NO: 5072 - RNA, 24 nt, Meleagrid herpesvirus 1
ucgggcccggcgcggagaaggcgg

SEQ ID NO: 5073 - RNA, 17 nt, Monkeypox virus
uagaagggggguggggu

SEQ ID NO: 5074 - RNA, 24 nt, Ictalurid herpesvirus 1
agacuguuugccaagcgcagucug

SEQ ID NO: 5075 - RNA, 24 nt, Melanoplus sanguinipes entomopoxvirus
uggaauagguaaacgcuugggggu

SEQ ID NO: 5076 - RNA, 24 nt, Melanoplus sanguinipes entomopoxvirus
uaucuugcagcuuuagaaaucugc

SEQ ID NO: 5077 - RNA, 24 nt, Rat cytomegalovirus
aacaacauauacucauagagcuua

SEQ ID NO: 5078 - RNA, 24 nt, Melanoplus sanguinipes entomopoxvirus
uauuuucuuaguacaaaagucaau

SEQ ID NO: 5079 - RNA, 18 nt, Rat cytomegalovirus
uccccuggguuuucuccu

SEQ ID NO: 5080 - RNA, 24 nt, Melanoplus sanguinipes entomopoxvirus
ucagaaagagaauaaaaauauuuu

SEQ ID NO: 5081 - RNA, 24 nt, Bovine syncytial virus
uagcauauccaucauuuuuuaaau

SEQ ID NO: 5082 - RNA, 21 nt, Rat cytomegalovirus
gcgcuuggccugcagaccguc

SEQ ID NO: 5083 - RNA, 24 nt, Paramecium bursaria Chlorella virus 1
augaagguccucaaugccaucaag

SEQ ID NO: 5084 - RNA, 24 nt, Melanoplus sanguinipes entomopoxvirus
uuaaauguuguauuuuuacuaggu

SEQ ID NO: 5085 - RNA, 24 nt, Lettuce infectious yellows virus
uguaucagcgaauguacaugaauc

SEQ ID NO: 5086 - RNA, 23 nt, Lettuce infectious yellows virus
aaguagaucugauuaauuguuac

SEQ ID NO: 5087 - RNA, 18 nt, Equine rhinitis A virus
uagagcaagcuuuguugu

SEQ ID NO: 5088 - RNA, 24 nt, Rat cytomegalovirus
guagagcgucucgacggagguggg

SEQ ID NO: 5089 - RNA, 24 nt, Fowlpox virus
uucacacguuauauguucuccuag

SEQ ID NO: 5090 - RNA, 24 nt, Paramecium bursaria Chlorella virus 1
ugacgugauuuauuacauguauac

SEQ ID NO: 5091 - RNA, 24 nt, Fowlpox virus
uuaaugccuauuaugauguagucu

SEQ ID NO: 5092 - RNA, 24 nt, Fowlpox virus
uagaauacaaaaugcgcacggacg

SEQ ID NO: 5093 - RNA, 18 nt, Fowlpox virus
cacagcuacggcgggauu

SEQ ID NO: 5094 - RNA, 24 nt, Fowlpox virus
gcccuguuuuauuaacaacauuaa

SEQ ID NO: 5095 - RNA, 24 nt, Marburg virus
uugcacaguuuuuuguauuacuua

SEQ ID NO: 5096 - RNA, 24 nt, Equine rhinitis A virus
ugguacucacagacaacaauggcg

SEQ ID NO: 5097 - RNA, 24 nt, Fowlpox virus
uuugugcuaugucggaguuacaaa

SEQ ID NO: 5098 - RNA, 23 nt, Camelpox virus
uaucacguccaccgacucugggc

SEQ ID NO: 5099 - RNA, 24 nt, Fowlpox virus
uagccuugaacuguggugccaugu

SEQ ID NO: 5100 - RNA, 24 nt, Fowlpox virus
uaggagacgauaaauccuaugugg

SEQ ID NO: 5101 - RNA, 19 nt, Fowlpox virus
ugucguguuuuccacacgu

SEQ ID NO: 5102 - RNA, 24 nt, Myxoma virus
uauuacgucgaagucagagguaua

SEQ ID NO: 5103 - RNA, 24 nt, Myxoma virus
uauaauccccgcuuccuauaaucu

SEQ ID NO: 5104 - RNA, 24 nt, Fowlpox virus
uagcacaccuuaaagauuagaaga

SEQ ID NO: 5105 - RNA, 24 nt, Fowlpox virus
cgugauuauauuauaaguuaucug

SEQ ID NO: 5106 - RNA, 24 nt, Rabbit fibroma virus
ggccauugucaucaguguugucag

SEQ ID NO: 5107 - RNA, 24 nt, Myxoma virus
caucgugcguagucuucccaguug

SEQ ID NO: 5108 - RNA, 24 nt, Camelpox virus
uaagacacagaaauacuguauccg

SEQ ID NO: 5109 - RNA, 24 nt, Fowlpox virus
uaucacgggauuaaaagguuauua

SEQ ID NO: 5110 - RNA, 24 nt, Rabbit fibroma virus
uguguuaagggcuggguaaaggug

SEQ ID NO: 5111 - RNA, 24 nt, Rabbit fibroma virus
ucuccaauaaguagauccagauac

SEQ ID NO: 5112 - RNA, 24 nt, Simian immunodeficiency virus
uauuucgaaagaguuauuaacagu

SEQ ID NO: 5113 - RNA, 20 nt, Fowlpox virus
caauaccuagugaagcaagu

SEQ ID NO: 5114 - RNA, 24 nt, Monkeypox virus
uauggggguuuaauguugagacuc

SEQ ID NO: 5115 - RNA, 24 nt, Monkeypox virus
uauuucaaaagaguuacuagcagu

SEQ ID NO: 5116 - RNA, 24 nt, Simian immunodeficiency virus
uauaagauuuacagacgauuuuag

SEQ ID NO: 5117 - RNA, 24 nt, Lymphocystis disease virus 1
agugguaauaugaccagccguguu

SEQ ID NO: 5118 - RNA, 24 nt, Paramecium bursaria Chlorella virus 1
cgguccgcgcuuucgcgucggcuc

SEQ ID NO: 5119 - RNA, 24 nt, Paramecium bursaria Chlorella virus 1
ugaugcugacaguaugauuuuuua

SEQ ID NO: 5120 - RNA, 22 nt, Paramecium bursaria Chlorella virus 1
ugcuauagaaggcuuuaccgac

SEQ ID NO: 5121 - RNA, 24 nt, Meleagrid herpesvirus 1
uuagcgccaucaugugguucgugg

SEQ ID NO: 5122 - RNA, 24 nt, Meleagrid herpesvirus 1
cguaaauauggcgcucguggccug

SEQ ID NO: 5123 - RNA, 24 nt, Feline foamy virus
uaaacuuccuggggacuagaggug

SEQ ID NO: 5124 - RNA, 23 nt, Meleagrid herpesvirus 1
ucccggaccugccugcucugcgc

SEQ ID NO: 5125 - RNA, 24 nt, Murine adenovirus A
uauagacccaauccuuaaacugau

SEQ ID NO: 5126 - RNA, 24 nt, Murine adenovirus A
uggguaauguuauagcuagucuug

SEQ ID NO: 5127 - RNA, 24 nt, Odontoglossum ringspot virus
ugucaagucgguacguauuccaaa

SEQ ID NO: 5128 - RNA, 24 nt, Molluscum contagiosum virus
acgaagaugcagugguugugcgcg

SEQ ID NO: 5129 - RNA, 24 nt, Paramecium bursaria Chlorella virus 1
ugcacgaaacuaguggucgaaugu

SEQ ID NO: 5130 - RNA, 24 nt, Paramecium bursaria Chlorella virus 1
ugauucgggucucggacgggaaua

SEQ ID NO: 5131 - RNA, 24 nt, Paramecium bursaria Chlorella virus 1
caaguaccaggaggggcugucgac

SEQ ID NO: 5132 - RNA, 24 nt, Odontoglossum ringspot virus
ugucuuguagacaaacgcaugaaa

SEQ ID NO: 5133 - RNA, 24 nt, Molluscum contagiosum virus
cagcagcugcucgcgcagagacag

SEQ ID NO: 5134 - RNA, 21 nt, African swine fever virus
uaauaccuguccucucucaga

SEQ ID NO: 5135 - RNA, 24 nt, African swine fever virus
ucauacuuaauauaggccuuagag

SEQ ID NO: 5136 - RNA, 24 nt, Murine adenovirus A
ccgcacagcagggaauuguagcac

SEQ ID NO: 5137 - RNA, 20 nt, Molluscum contagiosum virus
uguacagacacgugcuguug

SEQ ID NO: 5138 - RNA, 24 nt, Human herpesvirus 6
ucccaaggcguauacauucuaaca

SEQ ID NO: 5139 - RNA, 24 nt, African swine fever virus
aaguagaucaacacuauuuggaau

SEQ ID NO: 5140 - RNA, 24 nt, Human herpesvirus 8
acucaauuuuccaguaucccaagg

SEQ ID NO: 5141 - RNA, 24 nt, Meleagrid herpesvirus 1
caccggaaucgaguaaaacauaau

SEQ ID NO: 5142 - RNA, 24 nt, Paramecium bursaria Chlorella virus 1
uguauagugguaggagcauagacg

SEQ ID NO: 5143 - RNA, 22 nt, Bovine herpesvirus 1
uagcaucccauaagaaaacugg

SEQ ID NO: 5144 - RNA, 24 nt, Bovine herpesvirus 1
gaucguuguacuaccuguucuaaa

SEQ ID NO: 5145 - RNA, 24 nt, Human herpesvirus 8
ucucaccguagaaugcuucgucca

SEQ ID NO: 5146 - RNA, 24 nt, Amsacta moorei entomopoxvirus
uauuuuauuguauauauuuuaaaa

SEQ ID NO: 5147 - RNA, 24 nt, Human herpesvirus 7
uagcaggccuucuggaaagccuug

SEQ ID NO: 5148 - RNA, 24 nt, Tick-borne encephalitis virus
aaacauuagcccugaugcacgacu

SEQ ID NO: 5149 - RNA, 24 nt, Tick-borne encephalitis virus
ugcguugacgacggaagugucaaa

SEQ ID NO: 5150 - RNA, 20 nt, Cowpox virus
uuucuuggugaauaacauac

SEQ ID NO: 5151 - RNA, 20 nt, Human herpesvirus 7
ugaguaguuuuguuuauaag

SEQ ID NO: 5152 - RNA, 24 nt, Human herpesvirus 7
ugaguacauacaaacgcguaugga

SEQ ID NO: 5153 - RNA, 24 nt, Human herpesvirus 7
uucaaggcguuauacagggucuua

SEQ ID NO: 5154 - RNA, 24 nt, Cowpox virus
cagcacaaaucaaagguauuaaua

SEQ ID NO: 5155 - RNA, 24 nt, Human herpesvirus 7
uaaauaacaaaauccaaacauuac

SEQ ID NO: 5156 - RNA, 24 nt, Human herpesvirus 5
acggauuuguugacaaucaacaag

SEQ ID NO: 5157 - RNA, 24 nt, Human herpesvirus 5
cagcgguaucugcguggauuccug

SEQ ID NO: 5158 - RNA, 21 nt, Human herpesvirus 5
caggcucugagaguguuucac

SEQ ID NO: 5159 - RNA, 24 nt, Human herpesvirus 5
acaaggaugaucgccaaacugauu

SEQ ID NO: 5160 - RNA, 24 nt, Human herpesvirus 5
uuagcaaaaucaauccugcaaaag

SEQ ID NO: 5161 - RNA, 24 nt, Human herpesvirus 4
uuaauggcuggacuagagaaggug

SEQ ID NO: 5162 - RNA, 24 nt, Human herpesvirus 7
uacaaggugaauauggucuuaauu

SEQ ID NO: 5163 - RNA, 24 nt, Human herpesvirus 7
ucuaccagcaauuugacgccauac

SEQ ID NO: 5164 - RNA, 24 nt, Human herpesvirus 7
uaaccauaccgcaaaaugcaccua

SEQ ID NO: 5165 - RNA, 24 nt, Human herpesvirus 5
ugacaagccugacgagagcguuca

SEQ ID NO: 5166 - RNA, 23 nt, Human herpesvirus 5
ugugacgaugucuuuaccauucc

SEQ ID NO: 5167 - RNA, 24 nt, Human herpesvirus 5
cauacgguuuauauaugaccaucc

SEQ ID NO: 5168 - RNA, 24 nt, Human herpesvirus 5
ugugaguguggagcuaaucauauu

SEQ ID NO: 5169 - RNA, 24 nt, Human herpesvirus 5
cuuuguaccaacagggucuuacgc

SEQ ID NO: 5170 - RNA, 24 nt, Human herpesvirus 5
ucacuagugccaacgagucuccau

SEQ ID NO: 5171 - RNA, 24 nt, Human herpesvirus 4
caucacagcagcauaaaaaaagaa

SEQ ID NO: 5172 - RNA, 24 nt, Human herpesvirus 4
ugauggugcaguaguaguuaauga

SEQ ID NO: 5173 - RNA, 24 nt, Tupaia herpesvirus
aggcaccaacaacucauccgacau

SEQ ID NO: 5174 - RNA, 24 nt, Tupaia herpesvirus
cgaccggacgccccgcugcgccug

SEQ ID NO: 5175 - RNA, 24 nt, Tupaia herpesvirus
uguuuugacuacuucugccgucau

SEQ ID NO: 5176 - RNA, 24 nt, Human herpesvirus 4
gacaugguaaagaauccaacccuu

SEQ ID NO: 5177 - RNA, 24 nt, Human herpesvirus 4
uggcaaaacagggguuauuaauua

SEQ ID NO: 5178 - RNA, 24 nt, Tupaia herpesvirus
ccacgcaggacucgcgcuuccaga

SEQ ID NO: 5179 - RNA, 24 nt, Tupaia herpesvirus
gccgcugggcgagagcgaacacga

SEQ ID NO: 5180 - RNA, 24 nt, Camelpox virus
uaugauaucuuacaaaauauauua

SEQ ID NO: 5181 - RNA, 24 nt, Tupaia paramyxovirus
cuaccgcgagguuuccacccagcc

SEQ ID NO: 5182 - RNA, 24 nt, Human herpesvirus 4
uacaauaugcauaugauaagcuac

SEQ ID NO: 5183 - RNA, 24 nt, Tupaia herpesvirus
uuccgcugcgugcugaagugaaag

SEQ ID NO: 5184 - RNA, 24 nt, Tupaia herpesvirus
ugugcaagcgcaccugcgacgggc

SEQ ID NO: 5185 - RNA, 24 nt, Camelpox virus
uaauuagcaguucuuauaacauca

SEQ ID NO: 5186 - RNA, 24 nt, Tupaia paramyxovirus
uggaaaucaauagcugacuguaaa

SEQ ID NO: 5187 - RNA, 24 nt, Alcelaphine herpesvirus 1
acaguauuguuggacacgucuucc

SEQ ID NO: 5188 - RNA, 24 nt, Alcelaphine herpesvirus 1
uuugaaaaaaucagaaauugguca

SEQ ID NO: 5189 - RNA, 24 nt, Camelpox virus
uaaguauuaaaacauuaucuauau

SEQ ID NO: 5190 - RNA, 24 nt, Camelpox virus
uuauauguuuuaauuuuuugcaua

SEQ ID NO: 5191 - RNA, 24 nt, Alcelaphine herpesvirus 1
ugaaagaggacaugcuccucucag

SEQ ID NO: 5192 - RNA, 24 nt, Alcelaphine herpesvirus 1
uaaauagcaguucaaaugugaaua

SEQ ID NO: 5193 - RNA, 24 nt, Alcelaphine herpesvirus 1
uaauaugcuaauaguagguaaacc

SEQ ID NO: 5194 - RNA, 24 nt, Saimiriine herpesvirus 2
cgugcagccgcaugagacgugaua

SEQ ID NO: 5195 - RNA, 22 nt, Camelpox virus
uacgauauuuuaaaauuuucua

SEQ ID NO: 5196 - RNA, 24 nt, Camelpox virus
uacaauacaaaauguagcauauau

SEQ ID NO: 5197 - RNA, 24 nt, Alcelaphine herpesvirus 1
ugucuaguuuggaaucuccaauuc

SEQ ID NO: 5198 - RNA, 24 nt, Alcelaphine herpesvirus 1
ugaguuccugcucuauguucgguu

SEQ ID NO: 5199 - RNA, 24 nt, Saimiriine herpesvirus 2
caucguugauauaaucuuucaaag

SEQ ID NO: 5200 - RNA, 24 nt, Saimiriine herpesvirus 2
uaccguucaugcuguaugcaucau

SEQ ID NO: 5201 - RNA, 24 nt, Tupaia herpesvirus
uuggagguaagauauguugacuua

SEQ ID NO: 5202 - RNA, 22 nt, Tupaia herpesvirus
uacauggcuaugaaccggaaug

SEQ ID NO: 5203 - RNA, 24 nt, Human enterovirus A
gccgcauucauauucucgauuucu

SEQ ID NO: 5204 - RNA, 24 nt, Human enterovirus A
uaucuugauaaggcuaugcgagca

SEQ ID NO: 5205 - RNA, 24 nt, Feline immunodeficiency virus
acuuugguauaacccccccagcua

SEQ ID NO: 5206 - RNA, 24 nt, Feline immunodeficiency virus
ucgcaaguuuuuacuacaggcugg

SEQ ID NO: 5207 - RNA, 24 nt, Tobacco mosaic virus
uaacucaagaauuaagaacuuuaa

SEQ ID NO: 5208 - RNA, 24 nt, Tupaia herpesvirus
uagguacugaauauuuuuaagcua

SEQ ID NO: 5209 - RNA, 24 nt, Tupaia herpesvirus
ugaguauuuuuuagcuguguauua

SEQ ID NO: 5210 - RNA, 24 nt, Feline immunodeficiency virus
uuagcccaccauggaccaucuuau

SEQ ID NO: 5211 - RNA, 24 nt, Tobacco mosaic virus
aguggguaaucccuauuucccuau

SEQ ID NO: 5212 - RNA, 24 nt, Tobacco mosaic virus
ugcaaguacaucuacagccacacc

SEQ ID NO: 5213 - RNA, 24 nt, Ectromelia virus
ugaaauaauuagaacuagaaacau

SEQ ID NO: 5214 - RNA, 24 nt, Woolly monkey sarcoma virus
uauugguauaauuucaguauucgc

SEQ ID NO: 5215 - RNA, 24 nt, Woolly monkey sarcoma virus
uggaggaccugaucacgggcaaga

SEQ ID NO: 5216 - RNA, 24 nt, Human enterovirus A
ugagucacugcgauccccacgggc

SEQ ID NO: 5217 - RNA, 24 nt, Human enterovirus A
uacguuaacccgcagcauuuuuuc

SEQ ID NO: 5218 - RNA, 24 nt, Human enterovirus A
uccccggauauggucaucgacuua

SEQ ID NO: 5219 - RNA, 24 nt, Feline immunodeficiency virus
ucuaagguugucagcacggaugaa

SEQ ID NO: 5220 - RNA, 24 nt, Feline immunodeficiency virus
aaacaugacuuucuuacguuggug

SEQ ID NO: 5221 - RNA, 24 nt, Tobacco mosaic virus
ucgacacuucacaaugcugaacug

SEQ ID NO: 5222 - RNA, 22 nt, Tobacco mosaic virus
uacacaaggcccagggacacaa

SEQ ID NO: 5223 - RNA, 24 nt, Ectromelia virus
uauuacacuuacggcauucguuaa

SEQ ID NO: 5224 - RNA, 24 nt, Cowpox virus
agggaaaucaaagaagaaguuaau

SEQ ID NO: 5225 - RNA, 24 nt, Woolly monkey sarcoma virus
ugauugcugguacucccggaacau

SEQ ID NO: 5226 - RNA, 24 nt, Woolly monkey sarcoma virus
uacaaaauacaacucuucgcaugu

SEQ ID NO: 5227 - RNA, 24 nt, Variola virus
cgauuugucaacaucaaacuaauu

SEQ ID NO: 5228 - RNA, 24 nt, Variola virus
acgauuauuucuaaauuauuccaa

SEQ ID NO: 5229 - RNA, 24 nt, Variola virus
ucggugccgcggggucgaggccgg

SEQ ID NO: 5230 - RNA, 24 nt, Ectromelia virus
uuucccaggaucugguuauuaaaa

SEQ ID NO: 5231 - RNA, 24 nt, Woolly monkey sarcoma virus
acuaugcuuuacgaagguaaugga

SEQ ID NO: 5232 - RNA, 24 nt, Variola virus
ucuauucugaaucauggagcagcu

SEQ ID NO: 5233 - RNA, 18 nt, Variola virus
uauaugccaaaguuuaaa

SEQ ID NO: 5234 - RNA, 24 nt, Cowpox virus
uaacgcaauauguuaguuaaaaau

SEQ ID NO: 5235 - RNA, 23 nt, Cowpox virus
ugagaacguuccagagugucuau

SEQ ID NO: 5236 - RNA, 24 nt, Cowpox virus
uaauucuuuuguauucauagacac

SEQ ID NO: 5237 - RNA, 24 nt, Cowpox virus
ucggugacgccguguggguacgcc

SEQ ID NO: 5238 - RNA, 19 nt, Woolly monkey sarcoma virus
ucaaagcguuguuacagcc

SEQ ID NO: 5239 - RNA, 24 nt, Woolly monkey sarcoma virus
aauuacguauaauauaggggagug

SEQ ID NO: 5240 - RNA, 24 nt, Cowpox virus
agggaaaucaaagaagaaguuaau

SEQ ID NO: 5241 - RNA, 21 nt, Variola virus
ucucucgguccucggggcccc

SEQ ID NO: 5242 - RNA, 24 nt, Variola virus
cucgcccacgcugcugcacucggc

SEQ ID NO: 5243 - RNA, 24 nt, Cowpox virus
uagaaagaaacgauuauuucugaa

SEQ ID NO: 5244 - RNA, 24 nt, Cowpox virus
acugugauggggcagccuacucca

SEQ ID NO: 5245 - RNA, 23 nt, Yaba-like disease virus
ucuuacggaccagccucucccag

SEQ ID NO: 5246 - RNA, 24 nt, Cowpox virus
ugaaaggcuauuauaguuaggagg

SEQ ID NO: 5247 - RNA, 24 nt, Camelpox virus
uccccggaucaccccgugaucguc

SEQ ID NO: 5248 - RNA, 24 nt, Camelpox virus
ugauuuagaaauaggagaccuacc

SEQ ID NO: 5249 - RNA, 24 nt, Camelpox virus
uucguaccguguguagaaugaagg

SEQ ID NO: 5250 - RNA, 24 nt, Cowpox virus
aagaaacugaauagaaauagauug

SEQ ID NO: 5251 - RNA, 24 nt, Camelpox virus
cggcgcgugcgcgcccaccuaccg

SEQ ID NO: 5252 - RNA, 24 nt, Camelpox virus
uguguaauucaggaaagauuuccg

SEQ ID NO: 5253 - RNA, 21 nt, Camelpox virus
cuccgcgccgggcgggccggc

SEQ ID NO: 5254 - RNA, 21 nt, Camelpox virus
cccgcgcgcgccgcgugcgcc

SEQ ID NO: 5255 - RNA, 24 nt, Camelpox virus
ggucaugggcacuuggagcgaaau

SEQ ID NO: 5256 - RNA, 24 nt, Camelpox virus
uccacggugcccuggacguggcca

SEQ ID NO: 5257 - RNA, 24 nt, Human echovirus 1
augcugcgcaugaaagagcgaacg

SEQ ID NO: 5258 - RNA, 24 nt, Equine herpesvirus 2
uagcuugucgggcugugucuauuc

SEQ ID NO: 5259 - RNA, 18 nt, Equine herpesvirus 2
cuuuggaugggggagggg

SEQ ID NO: 5260 - RNA, 24 nt, Equine herpesvirus 2
ugucaugaucuuaauguagcaccu

SEQ ID NO: 5261 - RNA, 24 nt, Equine herpesvirus 2
agauguugccgcucuggucgcggc

SEQ ID NO: 5262 - RNA, 24 nt, Equine herpesvirus 2
uuauauugaaaaaggaaguacagg

SEQ ID NO: 5263 - RNA, 24 nt, Camelpox virus
uaauacucgauugauauugauauu

SEQ ID NO: 5264 - RNA, 24 nt, Human immunodeficiency virus 1
ucucugguuagaccagaucugagc

SEQ ID NO: 5265 - RNA, 24 nt, Human immunodeficiency virus 2
aagcugccaguuagaagcaaguua

SEQ ID NO: 5266 - RNA, 24 nt, Amsacta moorei entomopoxvirus
uauuuuauuaaaauuuacauauuc

SEQ ID NO: 5267 - RNA, 24 nt, Mouse mammary tumor virus
ugcaacaguccuaacauucaccuc

SEQ ID NO: 5268 - RNA, 24 nt, Fowlpox virus
uuggagguucgcuuuucuauaucu

SEQ ID NO: 5269 - RNA, 24 nt, Fowlpox virus
ugagagcggcuuuagcguaaaguu

SEQ ID NO: 5270 - RNA, 24 nt, Human immunodeficiency virus 1
aagcaggacauaacaagguaggau

SEQ ID NO: 5271 - RNA, 24 nt, Amsacta moorei entomopoxvirus
aauggcauauuuuaauauauauga

SEQ ID NO: 5272 - RNA, 24 nt, Aura virus
ggugcauaaugucacacaucaguc

SEQ ID NO: 5273 - RNA, 19 nt, Human adenovirus D
uagcucccuauuuaaaggc

SEQ ID NO: 5274 - RNA, 24 nt, Hepatitis G virus
uaggugggucuuaagagaagguua

SEQ ID NO: 5275 - RNA, 24 nt, Ictalurid herpesvirus 1
uucacucgcagagcacagagaguc

SEQ ID NO: 5276 - RNA, 23 nt, Human coronavirus 229E
uacuauguuacugaaccuaggug

SEQ ID NO: 5277 - RNA, 24 nt, Montana myotis leukoencephalitis virus
ugacuggcguacauagccauccgc

SEQ ID NO: 5278 - RNA, 24 nt, Simian hemorrhagic fever virus
augcauugcuacacuugcuuaugc

SEQ ID NO: 5279 - RNA, 24 nt, Fowl adenovirus A
cgccacgucuucgucgcugcugau

SEQ ID NO: 5280 - RNA, 24 nt, Paramecium bursaria Chlorella virus 1
aggaauguaaaauuguuaucacaa

SEQ ID NO: 5281 - RNA, 24 nt, Bean pod mottle virus
aaucguuacuugauuuuaaagacu

SEQ ID NO: 5282 - RNA, 24 nt, Bean pod mottle virus
uagugcucucacucuccuaucugg

SEQ ID NO: 5283 - RNA, 24 nt, Human papillomavirus type 63
cuuuuuggcgcgcgcgcgaauuuu

SEQ ID NO: 5284 - RNA, 24 nt, Human papillomavirus type 63
ucccuggggcuagcagaaacucuu

SEQ ID NO: 5285 - RNA, 24 nt, Human papillomavirus type 38
uuaccugacagaugaggacauaug

SEQ ID NO: 5286 - RNA, 21 nt, African swine fever virus
uaaucuuuauucaguaucaua

SEQ ID NO: 5287 - RNA, 22 nt, Amsacta moorei entomopoxvirus
uacaauauuuauuaaaauguaa

SEQ ID NO: 5288 - RNA, 24 nt, Amsacta moorei entomopoxvirus
ucauauuuauuuaauauuuuuuca

SEQ ID NO: 5289 - RNA, 21 nt, Fowlpox virus
uuguacauucccuucuggggg

SEQ ID NO: 5290 - RNA, 24 nt, Canine adenovirus
aggaguacucuugagugcgcagcg

SEQ ID NO: 5291 - RNA, 24 nt, Aleutian mink disease virus
uauauacuaacaucuauacuacua

SEQ ID NO: 5292 - RNA, 24 nt, Melanoplus sanguinipes entomopoxvirus
aagauuauuuuguuaauucauuau

SEQ ID NO: 5293 - RNA, 24 nt, Human adenovirus B
ucgcccaacuacgcauacgccagc

SEQ ID NO: 5294 - RNA, 24 nt, Human herpesvirus 7
uauuguacauuuuucuauuaguau

SEQ ID NO: 5295 - RNA, 24 nt, Chimpanzee cytomegalovirus
ccgcaccauguacgucuuagacca

SEQ ID NO: 5296 - RNA, 24 nt, Olive latent virus 2
ugaauggggugaagcagcuaugcu

SEQ ID NO: 5297 - RNA, 24 nt, Paramecium bursaria Chlorella virus 1
uugaagcguugcaacaucuucggc

SEQ ID NO: 5298 - RNA, 24 nt, Camelpox virus
uuaguguuuaauaaaaauaugggg

SEQ ID NO: 5299 - RNA, 24 nt, Equine herpesvirus 1
uaccauagacgcggcguauaguac

SEQ ID NO: 5300 - RNA, 24 nt, Olive latent virus 2
ucaaugguguacucgguucacgag

SEQ ID NO: 5301 - RNA, 24 nt, Myxoma virus
uagaggacgugugugcguacauca

SEQ ID NO: 5302 - RNA, 24 nt, Potato virus V
uuaggugaucaaaaccggucauug

SEQ ID NO: 5303 - RNA, 24 nt, Grapevine virus A
uggcaauacuagaugacuuguugu

SEQ ID NO: 5304 - RNA, 24 nt, Grapevine virus A
uaaguguagaccuuuacguuaaua

SEQ ID NO: 5305 - RNA, 24 nt, Gallid herpesvirus 3
cugcggggugauagauaaaagaag

SEQ ID NO: 5306 - RNA, 24 nt, Camelpox virus
uuagauauuaaugucguauuugaa

SEQ ID NO: 5307 - RNA, 18 nt, Human herpesvirus 7
uuuguuagaauaucugug

SEQ ID NO: 5308 - RNA, 24 nt, Human herpesvirus 7
ucacggagauacucuacacuacga

SEQ ID NO: 5309 - RNA, 24 nt, Rabbit fibroma virus
agaggacgucuguucguauaucaa

SEQ ID NO: 5310 - RNA, 24 nt, Human herpesvirus 8
ugugcaguagaguugugccuuccg

SEQ ID NO: 5311 - RNA, 24 nt, Human adenovirus A
ggcguagaugugcuguggaaagca

SEQ ID NO: 5312 - RNA, 24 nt, Barmah Forest virus
uguaugauaguauauuuauaagau

SEQ ID NO: 5313 - RNA, 21 nt, Gallid herpesvirus 2
uacacgguuacaccaccgauc

SEQ ID NO: 5314 - RNA, 24 nt, Vaccinia virus
uuaauaauauaaaauucccaaucu

SEQ ID NO: 5315 - RNA, 24 nt, Tupaia herpesvirus
uuagugagauuccuauuccaaaau

SEQ ID NO: 5316 - RNA, 24 nt, Tupaia herpesvirus
ggacggugggggacgcgggggcgg

SEQ ID NO: 5317 - RNA, 24 nt, Tupaia herpesvirus
aucauacuaaguauaguaguauca

SEQ ID NO: 5318 - RNA, 24 nt, Camelpox virus
uccaaggauguaauuaaauguuug

SEQ ID NO: 5319 - RNA, 24 nt, Lymphocystis disease virus 1
uguuaaaaaaucaguauccagcuu

SEQ ID NO: 5320 - RNA, 24 nt, Dengue virus type 2
uggaauggugcuguugaaucaaca

SEQ ID NO: 5321 - RNA, 24 nt, Zaire Ebola virus
uagcuaacauuaaguagucaagga

SEQ ID NO: 5322 - RNA, 24 nt, Gallid herpesvirus 3
aagcacucguccgaaggaggacac

SEQ ID NO: 5323 - RNA, 24 nt, Gallid herpesvirus 3
ucuuucccugacggcaucuaaccg

SEQ ID NO: 5324 - RNA, 24 nt, Gallid herpesvirus 3
uuggaacagaagcauuacacacac

SEQ ID NO: 5325 - RNA, 24 nt, Molluscum contagiosum virus
uagcacgcgccacgaggaggucac

SEQ ID NO: 5326 - RNA, 24 nt, Rabbit fibroma virus
gaugauaggauuauuauguggcgg

SEQ ID NO: 5327 - RNA, 24 nt, Junonia coenia densovirus
acggcagucccugccggcgaagcc

SEQ ID NO: 5328 - RNA, 24 nt, Chimpanzee cytomegalovirus
gaagaugagcgcgagaccguacag

SEQ ID NO: 5329 - RNA, 24 nt, Frog adenovirus 1
acugcagucucgugcugcaucgca

SEQ ID NO: 5330 - RNA, 20 nt, Triatoma virus
cuuguuguuguaagauuauu

SEQ ID NO: 5331 - RNA, 24 nt, Triatoma virus
uugaugagagccuuaaaaugacuu

SEQ ID NO: 5332 - RNA, 24 nt, Sulfolobus virus SIRV-1
uagaaaauuuaagagaagaaaaag

SEQ ID NO: 5333 - RNA, 24 nt, Macaca mulatta rhadinovirus
ugcguuuuggauaaugugcaggac

SEQ ID NO: 5334 - RNA, 24 nt, Fowlpox virus
uaacgucuaacuuacaacacgguc

SEQ ID NO: 5335 - RNA, 24 nt, Human herpesvirus 4
auuacagugagguuacacaggugg

SEQ ID NO: 5336 - RNA, 24 nt, Sulfolobus virus SIRV-1
uauaaacauagaccuugccuauug

SEQ ID NO: 5337 - RNA, 21 nt, Vaccinia virus
uucagguauuuaacgaaucau

SEQ ID NO: 5338 - RNA, 24 nt, Vaccinia virus
uaguguacuacaaacaggcgaugg

SEQ ID NO: 5339 - RNA, 24 nt, Macaca mulatta rhadinovirus
ucugucaguugguguaagcccugc

SEQ ID NO: 5340 - RNA, 24 nt, Macaca mulatta rhadinovirus
gggaaaccucgaaaaaaauccuaa

SEQ ID NO: 5341 - RNA, 24 nt, African swine fever virus
uuuuucuugguuuucgggugugau

SEQ ID NO: 5342 - RNA, 24 nt, Tupaia herpesvirus
uucauguuucugugcacauuugaa

SEQ ID NO: 5343 - RNA, 24 nt, Horseradish curly top virus
uugaagucgagguguccacacaag

SEQ ID NO: 5344 - RNA, 24 nt, Horseradish curly top virus
ugaaggaggagagaggauacggcg

SEQ ID NO: 5345 - RNA, 24 nt, Equine herpesvirus 4
aaucguauuauuguaauagggaaa

SEQ ID NO: 5346 - RNA, 24 nt, Rat cytomegalovirus
cgagauagaccgcgacucggaggu

SEQ ID NO: 5347 - RNA, 24 nt, Paramecium bursaria Chlorella virus 1
gugaagucuccauagagugccuua

SEQ ID NO: 5348 - RNA, 24 nt, Horseradish curly top virus
uaugauaauggauuuggccuuaug

SEQ ID NO: 5349 - RNA, 24 nt, Rat cytomegalovirus
ucagaaguccaagcgcgucgugga

SEQ ID NO: 5350 - RNA, 24 nt, Bovine herpesvirus 1
agggggagccggagcuuuggcccg

SEQ ID NO: 5351 - RNA, 24 nt, Vaccinia virus
uaacuaguguagaaaacagagaua

SEQ ID NO: 5352 - RNA, 24 nt, Turkey adenovirus 3
uaaguugugaagaagauaguaaau

SEQ ID NO: 5353 - RNA, 24 nt, Amsacta moorei entomopoxvirus
uauaguaccuaaaggauauuauuc

SEQ ID NO: 5354 - RNA, 24 nt, Amsacta moorei entomopoxvirus
uauaauauaaucuauauaauaaua

SEQ ID NO: 5355 - RNA, 20 nt, Saimiriine herpesvirus 2
ugacauagcauauucuaguu

SEQ ID NO: 5356 - RNA, 21 nt, Ateline herpesvirus 3
uuagaucuaggcuacugguca

SEQ ID NO: 5357 - RNA, 24 nt, Human herpesvirus 5
uuucugguuuuuggacuguguucg

SEQ ID NO: 5358 - RNA, 24 nt, Ground squirrel hepatitis virus
uagccgccugccuugcucgcugcu

SEQ ID NO: 5359 - RNA, 24 nt, Saimiriine herpesvirus 2
uguacauuccaacacugcugccau

SEQ ID NO: 5360 - RNA, 24 nt, Tupaia paramyxovirus
uaaauuauacaaguauuaaaaaua

SEQ ID NO: 5361 - RNA, 24 nt, Tupaia paramyxovirus
uccaaacuauuacuccagggauaa

SEQ ID NO: 5362 - RNA, 24 nt, Lumpy skin disease virus
uuacauuaaaugauguuauuaguc

SEQ ID NO: 5363 - RNA, 24 nt, Lumpy skin disease virus
uacucuucccacuuauaauauuuu

SEQ ID NO: 5364 - RNA, 24 nt, Goose parvovirus
ucagcccaauaguuaagccggaaa

SEQ ID NO: 5365 - RNA, 24 nt, Melanoplus sanguinipes entomopoxvirus
uguaaauuuaaaaaaauuaauuag

SEQ ID NO: 5366 - RNA, 24 nt, Myxoma virus
caguggaccaauacgggauaaugu

SEQ ID NO: 5367 - RNA, 24 nt, Vaccinia virus
uaauagcacgaucgugguuaacaa

SEQ ID NO: 5368 - RNA, 24 nt, Human herpesvirus 5
uguuucggauguuuacccuuaauc

SEQ ID NO: 5369 - RNA, 24 nt, Ground squirrel hepatitis virus
gggcauucuuaauuauguugcucc

SEQ ID NO: 5370 - RNA, 24 nt, Simian-Human immunodeficiency virus
uagagccuggguguucccugcuag

SEQ ID NO: 5371 - RNA, 24 nt, Simian-Human immunodeficiency virus
gcuugcuugcuuaaagcccucuuc

SEQ ID NO: 5372 - RNA, 24 nt, Simian-Human immunodeficiency virus
uguuaggacccuuucugcuuuggg

SEQ ID NO: 5373 - RNA, 24 nt, Human herpesvirus 8
uuagucuccgacccgccguccgcc

SEQ ID NO: 5374 - RNA, 24 nt, A-2 plaque virus
uaucauacaaggauuguuauauau

SEQ ID NO: 5375 - RNA, 24 nt, Variola virus
ugauauuuacuuuuuauaugcuug

SEQ ID NO: 5376 - RNA, 24 nt, A-2 plaque virus
uccuugguuauuauauuccuuaua

SEQ ID NO: 5377 - RNA, 24 nt, A-2 plaque virus
uauuguacccgauauaacgguaau

SEQ ID NO: 5378 - RNA, 24 nt, Ectromelia virus
cuuuguggaugaugaacuauguag

SEQ ID NO: 5379 - RNA, 24 nt, Ectromelia virus
ugagcgaaggagaccacuacauca

SEQ ID NO: 5380 - RNA, 23 nt, Macaca mulatta rhadinovirus
uagcauagauccgugagaaauac

SEQ ID NO: 5381 - RNA, 22 nt, Vaccinia virus
uuaggacagauacuacuauuug

SEQ ID NO: 5382 - RNA, 24 nt, Vaccinia virus
uccaagguaaaaucguguuugugu

SEQ ID NO: 5383 - RNA, 24 nt, Vaccinia virus
uauuauguuuaaagaugacaauau

SEQ ID NO: 5384 - RNA, 24 nt, Variola virus
uaauguaucacuuacgauaauguc

SEQ ID NO: 5385 - RNA, 24 nt, Variola virus
aacacguuuauuuuauaugucaac

SEQ ID NO: 5386 - RNA, 24 nt, Frog adenovirus 1
caggagcugacuuagaaaauauug

SEQ ID NO: 5387 - RNA, 24 nt, Frog adenovirus 1
gauuguacuauuuguauacgcauc

SEQ ID NO: 5388 - RNA, 24 nt, Paramecium bursaria Chlorella virus 1
uaaggggaauacacaugaguaauc

SEQ ID NO: 5389 - RNA, 24 nt, Cactus virus X
uccaugcuguggccggugcaggaa

SEQ ID NO: 5390 - RNA, 24 nt, Human herpesvirus 5
cauaacguucuuuucaaagcaguu

SEQ ID NO: 5391 - RNA, 24 nt, Human herpesvirus 5
cgggccgaggacggaccguuucgc

SEQ ID NO: 5392 - RNA, 24 nt, Paramecium bursaria Chlorella virus 1
ugagucgacgaccaucgccuacug

SEQ ID NO: 5393 - RNA, 24 nt, Human herpesvirus 5
ucuuuuguuugucggauguaaauu

SEQ ID NO: 5394 - RNA, 24 nt, Human herpesvirus 5
gcgcagagccugccgccgcuccgg

SEQ ID NO: 5395 - RNA, 24 nt, Jembrana disease virus
gcucagucuguuaguccuccuagu

SEQ ID NO: 5396 - RNA, 24 nt, Woolly monkey sarcoma virus
uaaccgauuccccgcacggagcac

SEQ ID NO: 5397 - RNA, 24 nt, Pepper ringspot virus
uggcaugaagcauuuacaaaagug

SEQ ID NO: 5398 - RNA, 24 nt, Cowpox virus
ugaugguaacuguguuacaugugc

SEQ ID NO: 5399 - RNA, 17 nt, Pepper ringspot virus
uaugccgugccgccgga

SEQ ID NO: 5400 - RNA, 24 nt, Pepper ringspot virus
cccgucugucgccucucccuuuuu

SEQ ID NO: 5401 - RNA, 24 nt, Fowlpox virus
uaauacuuaguuaauaccuuuacu

SEQ ID NO: 5402 - RNA, 24 nt, Camelpox virus
uaaauuauaaaagaagcagugauu

SEQ ID NO: 5403 - RNA, 24 nt, Tupaia herpesvirus
uguaggaaaauggaagguauguac

SEQ ID NO: 5404 - RNA, 24 nt, Human adenovirus C
aaauauggaacauucccagcugcu

SEQ ID NO: 5405 - RNA, 24 nt, Paramecium bursaria Chlorella virus 1
ucaaagucgggauuuuuucgguug

SEQ ID NO: 5406 - RNA, 24 nt, Amsacta moorei entomopoxvirus
uaaguuaaaauuuuaccaguauau

SEQ ID NO: 5407 - RNA, 24 nt, Lymphocystis disease virus 1
uuauauuauuauccaaagucuauc

SEQ ID NO: 5408 - RNA, 24 nt, Melanoplus sanguinipes entomopoxvirus
uuuaaguacaucaccaaaaauuuc

SEQ ID NO: 5409 - RNA, 24 nt, Paramecium bursaria Chlorella virus 1
uguaagcauauagaugacauaaug

SEQ ID NO: 5410 - RNA, 24 nt, Paramecium bursaria Chlorella virus 1
ucuaaaacauaacuuucuguacca

SEQ ID NO: 5411 - RNA, 24 nt, Cercopithecine herpesvirus 7
uuaaaacaaauuguauuguacaug

SEQ ID NO: 5412 - RNA, 24 nt, Porcine adenovirus C
gaccguuguguggaguuagaaaag

SEQ ID NO: 5413 - RNA, 24 nt, Variola virus
ugucauaguuguagaggucacauc

SEQ ID NO: 5414 - RNA, 24 nt, Lymphocystis disease virus 1
uauaguguuuuuuauaaauaucua

SEQ ID NO: 5415 - RNA, 24 nt, Variola virus
aacaagaauuaaaguguuguaaac

SEQ ID NO: 5416 - RNA, 24 nt, Porcine adenovirus C
cauguaguuuuaaaaaagcagaac

SEQ ID NO: 5417 - RNA, 23 nt, Human herpesvirus 5
ucagguggcccgagcccccccgc

SEQ ID NO: 5418 - RNA, 24 nt, Human herpesvirus 5
uacaagaaauggacgucacuugag

SEQ ID NO: 5419 - RNA, 17 nt, Human herpesvirus 5
gcgcgcggggcugcccu

SEQ ID NO: 5420 - RNA, 24 nt, Vaccinia virus
ucuuuuaccaacacaaagggugga

SEQ ID NO: 5421 - RNA, 24 nt, Human herpesvirus 5
cucucgucucgggggaccacaggg

SEQ ID NO: 5422 - RNA, 24 nt, Vaccinia virus
acgcgugucgauucaucaagguau

SEQ ID NO: 5423 - RNA, 24 nt, Gallid herpesvirus 2
agucagccgcgaacggaaauaacg

SEQ ID NO: 5424 - RNA, 24 nt, Clover yellow mosaic virus
uuagaaggcacgggagacgccgag

SEQ ID NO: 5425 - RNA, 24 nt, Melanoplus sanguinipes entomopoxvirus
uaauucuauuaauguugaugguaa

SEQ ID NO: 5426 - RNA, 24 nt, Human herpesvirus 5
uguagcaguuaacgucgccggccu

SEQ ID NO: 5427 - RNA, 24 nt, Spleen focus-forming virus
uauaauauuuauucaauauuuuuu

SEQ ID NO: 5428 - RNA, 24 nt, Spleen focus-forming virus
acguugggccaaacaagauaucug

SEQ ID NO: 5429 - RNA, 24 nt, Rice stripe virus
ugcguagcaccauuuucauaacau

SEQ ID NO: 5430 - RNA, 24 nt, Rice stripe virus
caagauguuagcauacuccggaac

SEQ ID NO: 5431 - RNA, 24 nt, Cowpox virus
ucgauuccguccaagaugauaaaa

SEQ ID NO: 5432 - RNA, 24 nt, Monkeypox virus
aaugguacaaauuuuauccucgcu

SEQ ID NO: 5433 - RNA, 24 nt, Monkeypox virus
uuccuaauuuuaacaucaaaacuu

SEQ ID NO: 5434 - RNA, 20 nt, Avian carcinoma virus
ucccccgguuacccccuuuc

SEQ ID NO: 5435 - RNA, 24 nt, Avian carcinoma virus
ucccugacgacuacgagcacaugc

SEQ ID NO: 5436 - RNA, 19 nt, Avian carcinoma virus
uacccuaccgagaacucag

SEQ ID NO: 5437 - RNA, 22 nt, Hendra virus
uugcauugcauaaacucguuag

SEQ ID NO: 5438 - RNA, 24 nt, Spleen focus-forming virus
uuaguccugacucaacaauaccac

SEQ ID NO: 5439 - RNA, 24 nt, Rice stripe virus
gggcugcggcccuaacccuaaccc

SEQ ID NO: 5440 - RNA, 24 nt, Rice stripe virus
ccccacuggcagccaaugucuugu

SEQ ID NO: 5441 - RNA, 24 nt, Spleen focus-forming virus
uauguuuugauauauauaaccaau

SEQ ID NO: 5442 - RNA, 24 nt, A-2 plaque virus
uagaaaacacuauaccaugucuac

SEQ ID NO: 5443 - RNA, 24 nt, Ectromelia virus
ucacaacuuuauuguuuuugaacu

SEQ ID NO: 5444 - RNA, 24 nt, Ectromelia virus
ugagaaauacguuuagccgccuuu

SEQ ID NO: 5445 - RNA, 24 nt, Macaca mulatta rhadinovirus
uuagugcgauugcgauuauguccg

SEQ ID NO: 5446 - RNA, 24 nt, Macaca mulatta rhadinovirus
uaauaggcaggagauagauauccg

SEQ ID NO: 5447 - RNA, 21 nt, Reston Ebola virus
cauuucuuaucuucaucuucu

SEQ ID NO: 5448 - RNA, 24 nt, Macaca mulatta rhadinovirus
ugauauguuucagugacccucgga

SEQ ID NO: 5449 - RNA, 24 nt, Fowlpox virus
aaauauuucauaucgguuauaaag

SEQ ID NO: 5450 - RNA, 22 nt, Human papillomavirus type 47
uacuaacugcuauuaacaacca

SEQ ID NO: 5451 - RNA, 24 nt, Human herpesvirus 7
aguuguauuuuuagaagucgaauc

SEQ ID NO: 5452 - RNA, 24 nt, Human papillomavirus type 47
uagcauugagcgucuaggcagguc

SEQ ID NO: 5453 - RNA, 21 nt, Gallid herpesvirus 2
ccacgccccaugcacgugccc

SEQ ID NO: 5454 - RNA, 24 nt, African swine fever virus
uuaauaaauggcucauggaaugug

SEQ ID NO: 5455 - RNA, 24 nt, Paramecium bursaria Chlorella virus 1
uagcuggcugcauauaucuacuga

SEQ ID NO: 5456 - RNA, 24 nt, Tupaia herpesvirus
uccccgggguuuuuuuaccgcuuu

SEQ ID NO: 5457 - RNA, 24 nt, Tupaia herpesvirus
cacgagcacgggcgagcgagcaua

SEQ ID NO: 5458 - RNA, 24 nt, Tupaia herpesvirus
ugaagaaacgggcgggcgggcggg

SEQ ID NO: 5459 - RNA, 24 nt, Ectromelia virus
uacaauaauuaauuucucguaaaa

SEQ ID NO: 5460 - RNA, 24 nt, Potato virus Y
uuacuggcagauaggggugguaua

SEQ ID NO: 5461 - RNA, 17 nt, Potato virus Y
ugucuggauuuaguuac

SEQ ID NO: 5462 - RNA, 24 nt, Ectromelia virus
uacagcaaugcuauaccuaauacu

SEQ ID NO: 5463 - RNA, 24 nt, Ectromelia virus
uaauacggacuucaugauuuaaua

SEQ ID NO: 5464 - RNA, 24 nt, Chimpanzee cytomegalovirus
aagcauauauacacggcucgggga

SEQ ID NO: 5465 - RNA, 23 nt, Molluscum contagiosum virus
gcggagcgcgcacggcagcggcg

SEQ ID NO: 5466 - RNA, 24 nt, Molluscum contagiosum virus
gugcagcugccgcagagccgcgaa

SEQ ID NO: 5467 - RNA, 24 nt, Human herpesvirus 6B
aggcaguguugauuuuuuuucauu

SEQ ID NO: 5468 - RNA, 24 nt, Tupaia herpesvirus
gguugaggcugcugcugcggcugc

SEQ ID NO: 5469 - RNA, 24 nt, Bovine papillomavirus
uucacaguugcugacaacggugcu

SEQ ID NO: 5470 - RNA, 24 nt, Bovine herpesvirus 4
uauacaguuaagaguaucuagagg

SEQ ID NO: 5471 - RNA, 24 nt, Rana tigrina ranavirus
ugagggcugcguguucuacuagag

SEQ ID NO: 5472 - RNA, 24 nt, Alcelaphine herpesvirus 1
uaugacacacaguucuggaaacug

SEQ ID NO: 5473 - RNA, 24 nt, Chimpanzee cytomegalovirus
ucuaaaaaaaaaaaagcacacgcu

SEQ ID NO: 5474 - RNA, 24 nt, Human herpesvirus 1
ucuaaccaauccccaggggccaag

SEQ ID NO: 5475 - RNA, 24 nt, Human herpesvirus 6B
uuuuaaaaguagucuguuaagaug

SEQ ID NO: 5476 - RNA, 24 nt, Vaccinia virus
augcaucgguaaauauagcuguau

SEQ ID NO: 5477 - RNA, 24 nt, Rana tigrina ranavirus
uguaaauguuuagacuuggagugu

SEQ ID NO: 5478 - RNA, 24 nt, African swine fever virus
uguuaagauaguaguucuguuaag

SEQ ID NO: 5479 - RNA, 24 nt, Porcine adenovirus C
ugauugauaaaugauaugcaaaau

SEQ ID NO: 5480 - RNA, 24 nt, Human papillomavirus type 36
uucguccuacaaucagagaaggga

SEQ ID NO: 5481 - RNA, 17 nt, Pea early browning virus
uguggaaaagaaguugc

SEQ ID NO: 5482 - RNA, 24 nt, Oat golden stripe virus
uguggaaauucaaaauuguugucc

SEQ ID NO: 5483 - RNA, 24 nt, Cowpox virus
uaagguacuuuuucucauaauaaa

SEQ ID NO: 5484 - RNA, 24 nt, Cowpox virus
uaacuuuaaacauggauuuuugau

SEQ ID NO: 5485 - RNA, 24 nt, Human papillomavirus type 32
ugaagaugaugaagacgaugacca

SEQ ID NO: 5486 - RNA, 24 nt, Fowlpox virus
acuuuuguaucuauggugaaugua

SEQ ID NO: 5487 - RNA, 24 nt, Human papillomavirus type 60
uguacauauacauuuggaacauua

SEQ ID NO: 5488 - RNA, 24 nt, Vaccinia virus
uagcgugaaggauaugauaaaaaa

SEQ ID NO: 5489 - RNA, 24 nt, Peanut bud necrosis virus
gaucaggaaaagagcauaauguca

SEQ ID NO: 5490 - RNA, 17 nt, Paramecium bursaria Chlorella virus 1
ucauaugguuuaugcgc

SEQ ID NO: 5491 - RNA, 24 nt, Paramecium bursaria Chlorella virus 1
ucuuucuaaaauugucauuuauca

SEQ ID NO: 5492 - RNA, 24 nt, Human herpesvirus 6B
ugugaaacuaugaggaacugauga

SEQ ID NO: 5493 - RNA, 17 nt, Gallid herpesvirus 3
uacauucucggguucgu

SEQ ID NO: 5494 - RNA, 24 nt, Macaca mulatta rhadinovirus
accaagccauccaaacauaaaaac

SEQ ID NO: 5495 - RNA, 23 nt, Rabbit oral papillomavirus
uuuguugggaacuucuuuggcuu

SEQ ID NO: 5496 - RNA, 24 nt, Human papillomavirus type 28
cgacuggugguagagugcagccac

SEQ ID NO: 5497 - RNA, 21 nt, Human papillomavirus type 70
cauuggauagggggcaaggga

SEQ ID NO: 5498 - RNA, 24 nt, Human herpesvirus 8
uaaguuaaaccaaaauucgcaggg

SEQ ID NO: 5499 - RNA, 17 nt, Human herpesvirus 5
uguugcuauacaccgag

SEQ ID NO: 5500 - RNA, 24 nt, Human herpesvirus 5
ugugcagggcaugcggggaaucag

SEQ ID NO: 5501 - RNA, 24 nt, Potato virus A
uauauagacccaccacauagugag

SEQ ID NO: 5502 - RNA, 24 nt, Monkeypox virus
agacguugucagaaaauccuguaa

SEQ ID NO: 5503 - RNA, 22 nt, Influenza A virus
gagugccaaagucuaugaggga

SEQ ID NO: 5504 - RNA, 24 nt, Chimpanzee cytomegalovirus
uuguauauauaacguaccaugauc

SEQ ID NO: 5505 - RNA, 24 nt, Rabbit oral papillomavirus
uagauaauagcagcacaugcagag

SEQ ID NO: 5506 - RNA, 24 nt, Bovine herpesvirus 1
ucugcgcugcggcggcgcucuuua

SEQ ID NO: 5507 - RNA, 24 nt, Human papillomavirus type 10
uaagggcacuggaacagcugcuac

SEQ ID NO: 5508 - RNA, 24 nt, Human herpesvirus 1
ccccugugguguuuuugguuauuu

SEQ ID NO: 5509 - RNA, 24 nt, Chimpanzee cytomegalovirus
ucacagcgcucgucgcgcggccgg

SEQ ID NO: 5510 - RNA, 24 nt, Rat cytomegalovirus
gugcuuuucgugucucggggcggu

SEQ ID NO: 5511 - RNA, 24 nt, Grapevine fanleaf virus
ucuacauauuuuacuguguuauuu

SEQ ID NO: 5512 - RNA, 24 nt, Bean common mosaic necrosis virus
uccaacaccggagcugccagcgug

SEQ ID NO: 5513 - RNA, 23 nt, Rat cytomegalovirus
uccuucaccaaauaucgcagaag

SEQ ID NO: 5514 - RNA, 18 nt, Ectromelia virus
uuucuagacguugccaga

SEQ ID NO: 5515 - RNA, 24 nt, Equine herpesvirus 1
uguagcaagccaaccuuuggagag

SEQ ID NO: 5516 - RNA, 24 nt, Bean common mosaic necrosis virus
uauuagauaguacgcuuucaauuc

SEQ ID NO: 5517 - RNA, 24 nt, Infectious spleen and kidney necrosis virus
cgucacagccauauagguuacguu

SEQ ID NO: 5518 - RNA, 19 nt, Human herpesvirus 2
cugcaugccgucggauggg

SEQ ID NO: 5519 - RNA, 20 nt, Human papillomavirus type 50
ugcauggaagugguugggcc

SEQ ID NO: 5520 - RNA, 24 nt, Human papillomavirus type 48
ugaaauguuggagaaaucgcugua

SEQ ID NO: 5521 - RNA, 24 nt, Human herpesvirus 3
gaccgugcacuacucccgccgacc

SEQ ID NO: 5522 - RNA, 24 nt, Paramecium bursaria Chlorella virus 1
ucuuuguucuuuuauguuuauuuu

SEQ ID NO: 5523 - RNA, 24 nt, Frog adenovirus 1
uuuacauuggcuuacuauaucuuu

SEQ ID NO: 5524 - RNA, 24 nt, Fowlpox virus
uccguaagucuuuuuaguucauuu

SEQ ID NO: 5525 - RNA, 24 nt, Macaca mulatta rhadinovirus
ugugggcuauggccggaauauugg

SEQ ID NO: 5526 - RNA, 24 nt, Melanoplus sanguinipes entomopoxvirus
augauauugauaaauauaaaaaaa

SEQ ID NO: 5527 - RNA, 24 nt, Gallid herpesvirus 2
uauaauaucauuuaaguauaguuu

SEQ ID NO: 5528 - RNA, 18 nt, Infectious spleen and kidney necrosis virus
gcagugccgucauuggug

SEQ ID NO: 5529 - RNA, 24 nt, Human herpesvirus 7
ucuaauuggauuuaacaacgaucu

SEQ ID NO: 5530 - RNA, 17 nt, Gallid herpesvirus 3
uacguagcguguuuuac

SEQ ID NO: 5531 - RNA, 23 nt, Infectious flacherie virus
uuaauauuauauuguuuaucagg

SEQ ID NO: 5532 - RNA, 24 nt, Infectious flacherie virus
uaggacaccggaaguggaacgccu

SEQ ID NO: 5533 - RNA, 24 nt, Gallid herpesvirus 3
uagaagagacgcagucaacuugcc

SEQ ID NO: 5534 - RNA, 21 nt, Sorghum mosaic virus
uaguguaauauauauuuacuu

SEQ ID NO: 5535 - RNA, 24 nt, Sorghum mosaic virus
ucugcaagggagugaggacgcauc

SEQ ID NO: 5536 - RNA, 24 nt, Equine herpesvirus 4
uuggucgcuaaguuuaucccuaau

SEQ ID NO: 5537 - RNA, 24 nt, Meleagrid herpesvirus 1
ucuaaugguggaagcguggcacug

SEQ ID NO: 5538 - RNA, 24 nt, Meleagrid herpesvirus 1
uuugacagaccuggaauuguuauu

SEQ ID NO: 5539 - RNA, 24 nt, Infectious flacherie virus
uagcugggcacacuugcgguuucc

SEQ ID NO: 5540 - RNA, 24 nt, Meleagrid herpesvirus 1
uaaugugcaugcgaaaccacuuuu

SEQ ID NO: 5541 - RNA, 24 nt, Lumpy skin disease virus
uggaagccaauuaaguagaagcca

SEQ ID NO: 5542 - RNA, 24 nt, Barley yellow mosaic virus
uauguucgugacgucuuuguauca

SEQ ID NO: 5543 - RNA, 24 nt, Rabbit fibroma virus
uaccggaguccuccguaauauagu

SEQ ID NO: 5544 - RNA, 24 nt, Barmah Forest virus
agagauccguuuuacaaaauugca

SEQ ID NO: 5545 - RNA, 24 nt, Chimpanzee cytomegalovirus
uuucucugcuguccggucgccugc

SEQ ID NO: 5546 - RNA, 24 nt, Human herpesvirus 5
uuacuagccgugaccuugacggug

SEQ ID NO: 5547 - RNA, 24 nt, Alcelaphine herpesvirus 1
uccaguaaauaaaacuuuuaugaa

SEQ ID NO: 5548 - RNA, 24 nt, Lumpy skin disease virus
uaauuggcuucuacuuaauuggcu

SEQ ID NO: 5549 - RNA, 24 nt, Indian citrus ringspot virus
uagcauugggacucgcuguuacug

SEQ ID NO: 5550 - RNA, 24 nt, Vaccinia virus
uaacuugauuucgaaauuacccau

SEQ ID NO: 5551 - RNA, 24 nt, Equine herpesvirus 4
uagcccucuuaguggguauuguua

SEQ ID NO: 5552 - RNA, 24 nt, Fowlpox virus
ucuauuuugauuuaugucuaucca

SEQ ID NO: 5553 - RNA, 24 nt, Strawberry mild yellow edge virus
uacucuggucccggaccuaccccu

SEQ ID NO: 5554 - RNA, 24 nt, Equine herpesvirus 4
ugggaaaaaaaggugggcauacaa

SEQ ID NO: 5555 - RNA, 24 nt, Swinepox virus
ucuaaugaacauguauaguuccau

SEQ ID NO: 5556 - RNA, 23 nt, Bovine respiratory syncytial virus
ugagcuaaauuuacuaauacauu

SEQ ID NO: 5557 - RNA, 24 nt, Human herpesvirus 6B
uauguuuuuugagaugcuuuccgu

SEQ ID NO: 5558 - RNA, 24 nt, Myxoma virus
uaauuuacaaaaaguguuuacagc

SEQ ID NO: 5559 - RNA, 24 nt, Rat cytomegalovirus
ucccgcucgggcugucggcguccg

SEQ ID NO: 5560 - RNA, 24 nt, Gallid herpesvirus 2
ucacaauauaaaagucagagucug

SEQ ID NO: 5561 - RNA, 22 nt, Human herpesvirus 3
uaacucgaacccccgugacucc

SEQ ID NO: 5562 - RNA, 24 nt, Ateline herpesvirus 3
ugucagagauucaagagguguguc

SEQ ID NO: 5563 - RNA, 24 nt, Molluscum contagiosum virus
aagaggccggagggaggagaucuu

SEQ ID NO: 5564 - RNA, 24 nt, Rice yellow stunt virus
uucauauuuuaaaaacccaacucc

SEQ ID NO: 5565 - RNA, 19 nt, Rice yellow stunt virus
gagcagguguaucuggggu

SEQ ID NO: 5566 - RNA, 24 nt, Myxoma virus
aggaaguaccaaccgugaccacuc

SEQ ID NO: 5567 - RNA, 19 nt, Tupaia herpesvirus
cgucgucgggcgaucgagc

SEQ ID NO: 5568 - RNA, 24 nt, Fowlpox virus
gauaauauagauuuugauucacuc

SEQ ID NO: 5569 - RNA, 19 nt, Equine herpesvirus 1
uaaguggcugugaccugga

SEQ ID NO: 5570 - RNA, 24 nt, Cercopithecine herpesvirus 7
ucguuuguugugggugggauuaua

SEQ ID NO: 5571 - RNA, 24 nt, Bovine polyomavirus
cauccgcaggagucccucaggaca

SEQ ID NO: 5572 - RNA, 24 nt, Taura syndrome virus
gugcauuuaucucaacaguuuucc

SEQ ID NO: 5573 - RNA, 24 nt, African swine fever virus
uaugaugauuuaagauugagucca

SEQ ID NO: 5574 - RNA, 21 nt, Human herpesvirus 1
uccguccccguuccaaggccg

SEQ ID NO: 5575 - RNA, 24 nt, Human papillomavirus type 49
uacuuggcaguuacaaguucaccu

SEQ ID NO: 5576 - RNA, 24 nt, Equine herpesvirus 4
uuuacauuauucgugauugggacg

SEQ ID NO: 5577 - RNA, 24 nt, Rabbit fibroma virus
uaaugguucauucguucguauauu

SEQ ID NO: 5578 - RNA, 24 nt, Rabbit fibroma virus
cgacaacaagugcaugaaauuaga

SEQ ID NO: 5579 - RNA, 24 nt, Rice yellow stunt virus
acacagccgcacaacccgcccccc

SEQ ID NO: 5580 - RNA, 24 nt, Respiratory syncytial virus
uauaaaccaucucacuuacauuau

SEQ ID NO: 5581 - RNA, 20 nt, Human herpesvirus 3
uacauugccugucacgugaa

SEQ ID NO: 5582 - RNA, 24 nt, Melanoplus sanguinipes entomopoxvirus
uaaaaauuucauaaauucauauaa

SEQ ID NO: 5583 - RNA, 24 nt, Porcine epidemic diarrhea virus
uagcgcaguuuauacaccuauagg

SEQ ID NO: 5584 - RNA, 24 nt, Plum pox virus
agcaguacauucagugagguuuua

SEQ ID NO: 5585 - RNA, 24 nt, Melanoplus sanguinipes entomopoxvirus
uguuugaagaaagaaugccauaau

SEQ ID NO: 5586 - RNA, 24 nt, Rat cytomegalovirus
cacccggaaaggagaaccgcggcc

SEQ ID NO: 5587 - RNA, 24 nt, Porcine adenovirus A
cacccggaguacuuuugcaucacc

SEQ ID NO: 5588 - RNA, 24 nt, Amsacta moorei entomopoxvirus
uacaauauaauaaaauauauuuaa

SEQ ID NO: 5589 - RNA, 24 nt, Human herpesvirus 4
ucuaacaucuccccuuuaaagcca

SEQ ID NO: 5590 - RNA, 24 nt, Lettuce mosaic virus
uucuaguuuccgcugugagguuuu

SEQ ID NO: 5591 - RNA, 24 nt, Sulfolobus virus SIRV-2
aguuguagaaacuacaguuaaaau

SEQ ID NO: 5592 - RNA, 24 nt, Turnip mosaic virus
uuaaagcagccagugugacuuugu

SEQ ID NO: 5593 - RNA, 24 nt, Bovine parvovirus
uaacuaagaauacaacuaaaagau

SEQ ID NO: 5594 - RNA, 24 nt, Paramecium bursaria Chlorella virus 1
uaaauuuuuaaacauuccuuaaaa

SEQ ID NO: 5595 - RNA, 24 nt, Human adenovirus C
uccgccgugauccaugcgguuacc

SEQ ID NO: 5596 - RNA, 21 nt, Human herpesvirus 6
uaauaucguuuuuucuuugug

SEQ ID NO: 5597 - RNA, 24 nt, Ictalurid herpesvirus 1
uacauuaucaacucaucaagcuua

SEQ ID NO: 5598 - RNA, 24 nt, Zucchini yellow mosaic virus
ugccguaguccugucggaagcuuu

SEQ ID NO: 5599 - RNA, 24 nt, Paramecium bursaria Chlorella virus 1
uacagggucugugggaacugcuuu

SEQ ID NO: 5600 - RNA, 24 nt, Fowl adenovirus D
agguugucgcugucccaucuuaug

SEQ ID NO: 5601 - RNA, 24 nt, Black queen cell virus
aacaaugugaucuugcuugcggag

SEQ ID NO: 5602 - RNA, 24 nt, Molluscum contagiosum virus
uucgcgccgcgggcacauggacgg

SEQ ID NO: 5603 - RNA, 24 nt, Yam mosaic virus
uuuaagaaugaaugagaugagggu

SEQ ID NO: 5604 - RNA, 24 nt, Yam mosaic virus
uucacauuugauuaugagauagag

SEQ ID NO: 5605 - RNA, 24 nt, Scallion mosaic virus
ucgaacacccuaacuuuugauaau

SEQ ID NO: 5606 - RNA, 24 nt, Camelpox virus
accgguuuaucauuaauuaauaca

SEQ ID NO: 5607 - RNA, 24 nt, Chinese wheat mosaic virus
aacuguauacuaagccaaguuuag

SEQ ID NO: 5608 - RNA, 20 nt, Taura syndrome virus
uuucauggagugguuugcua

SEQ ID NO: 5609 - RNA, 24 nt, Papaya ringspot virus
uagaauacagaguggcugcgccac

SEQ ID NO: 5610 - RNA, 24 nt, Newcastle disease virus
uagucugucaguucggagaguuaa

SEQ ID NO: 5611 - RNA, 20 nt, Chimpanzee cytomegalovirus
uagcgugucgacguccaugc

SEQ ID NO: 5612 - RNA, 17 nt, Paramecium bursaria Chlorella virus 1
uuagugcauuugcagcc

SEQ ID NO: 5613 - RNA, 24 nt, Human herpesvirus 5
uccgcgugucgggugacguaguuu

SEQ ID NO: 5614 - RNA, 20 nt, Ictalurid herpesvirus 1
ugacgaguuucuacgaggua

SEQ ID NO: 5615 - RNA, 20 nt, Rat cytomegalovirus
ucgcugcgugaucgccccac

SEQ ID NO: 5616 - RNA, 24 nt, Periplaneta fuliginosa densovirus
uccaugguguggugguggugguug

SEQ ID NO: 5617 - RNA, 24 nt, Human herpesvirus 5
uaaacgcgaguuagccuuucccgu

SEQ ID NO: 5618 - RNA, 24 nt, Equine herpesvirus 2
gacagguagagaucccgggaggua

SEQ ID NO: 5619 - RNA, 24 nt, Sulfolobus virus SIRV-2
uugaaauuaguauuauggaaagaa

SEQ ID NO: 5620 - RNA, 24 nt, Tobacco necrosis virus D
uuggaucauagucaucauaauuau

SEQ ID NO: 5621 - RNA, 24 nt, Sulfolobus virus SIRV-2
uuuaucgauaauuuuucuccuuuu

SEQ ID NO: 5622 - RNA, 24 nt, Human herpesvirus 5
guuugcuuccuauauaguggacgu

SEQ ID NO: 5623 - RNA, 24 nt, Sulfolobus virus SIRV-2
ugaaaaaugaaaaaaauuaaagau

SEQ ID NO: 5624 - RNA, 24 nt, Tupaia herpesvirus
cacacguucgaauuaccgacacac

SEQ ID NO: 5625 - RNA, 24 nt, Human adenovirus F
ucggugccguaaccuucgcugcuu

SEQ ID NO: 5626 - RNA, 24 nt, Mice minute virus
gaacugaccaaccauguucacgua

SEQ ID NO: 5627 - RNA, 17 nt, Bovine adenovirus D
uccauuguaaagcuuca

SEQ ID NO: 5628 - RNA, 24 nt, Fowl adenovirus D
ucuaucggauuaccaaaaauuuag

SEQ ID NO: 5629 - RNA, 24 nt, Ateline herpesvirus 3
aagaauguuucauacaacugaaga

SEQ ID NO: 5630 - RNA, 24 nt, Rat cytomegalovirus
ucccgcgguccgcccgguccccgc

SEQ ID NO: 5631 - RNA, 22 nt, Meleagrid herpesvirus 1
ugccuuagucacggaucggggu

SEQ ID NO: 5632 - RNA, 24 nt, Melanoplus sanguinipes entomopoxvirus
uuuauauauuuaauaauuuuucaa

SEQ ID NO: 5633 - RNA, 24 nt, Paramecium bursaria Chlorella virus 1
uaacuauuuuguucaguuugaaac

SEQ ID NO: 5634 - RNA, 24 nt, Cowpox virus
ucgauuccguccaagaugauaaaa

SEQ ID NO: 5635 - RNA, 22 nt, Bovine herpesvirus 1
cggcgccuacucgcgccgcccg

SEQ ID NO: 5636 - RNA, 24 nt, Sheeppox virus
uacagguuuaauuggcuuuuuuau

SEQ ID NO: 5637 - RNA, 24 nt, Human herpesvirus 6B
uagaggacgcaaagagagaccaau

SEQ ID NO: 5638 - RNA, 24 nt, Macaca mulatta rhadinovirus
uacauuuauuuucauuaaagcgau

SEQ ID NO: 5639 - RNA, 24 nt, Meleagrid herpesvirus 1
uuaaaggcuccagggaaacugaau

SEQ ID NO: 5640 - RNA, 24 nt, Swinepox virus
uauaacguauauauucauuauauu

SEQ ID NO: 5641 - RNA, 22 nt, Molluscum contagiosum virus
cauuucuccuccggggcgcaag

SEQ ID NO: 5642 - RNA, 24 nt, Equine herpesvirus 4
uauaaggccuuuagcuucgaucuu

SEQ ID NO: 5643 - RNA, 24 nt, Paramecium bursaria Chlorella virus 1
uaauauuucgucgauacgugauuu

SEQ ID NO: 5644 - RNA, 24 nt, Human herpesvirus 6
ucucacgucacaguuuuuuuuuuc

SEQ ID NO: 5645 - RNA, 24 nt, Rice ragged stunt virus
ugccuggugggaaagaacggggcc

SEQ ID NO: 5646 - RNA, 24 nt, Bovine herpesvirus 1
aagcacccgcguguagggcugcau

SEQ ID NO: 5647 - RNA, 24 nt, Paramecium bursaria Chlorella virus 1
uaguuuauuucaaucgauuaucag

SEQ ID NO: 5648 - RNA, 24 nt, Ovine adenovirus 7
uggaaauggauuucugcaaauaga

SEQ ID NO: 5649 - RNA, 24 nt, Sonchus yellow net virus
uguaauauugugggacauguguug

SEQ ID NO: 5650 - RNA, 24 nt, Chimpanzee cytomegalovirus
agaaggaggagaaacaagaagaau

SEQ ID NO: 5651 - RNA, 24 nt, Molluscum contagiosum virus
gcguauuuuuucuucacuguuguc

SEQ ID NO: 5652 - RNA, 24 nt, Equine herpesvirus 4
gcgcauggaauuguugcuggcagc

SEQ ID NO: 5653 - RNA, 24 nt, Rat cytomegalovirus
gacugcgcgagacaaaagagaggg

SEQ ID NO: 5654 - RNA, 24 nt, Lettuce infectious yellows virus
aaaguuauacauuuaccguuggac

SEQ ID NO: 5655 - RNA, 24 nt, Human herpesvirus 5
uuugugcgacacguuuuauucugc

SEQ ID NO: 5656 - RNA, 24 nt, Fowlpox virus
uuaguguaauaaauuuaauaaaau

SEQ ID NO: 5657 - RNA, 24 nt, Rat cytomegalovirus
ucccucuugucucggagacggcgg

SEQ ID NO: 5658 - RNA, 24 nt, Molluscum contagiosum virus
aggcaaagcggggcgcgcgccgcu

SEQ ID NO: 5659 - RNA, 24 nt, Murray Valley encephalitis virus
aaggaucauugauuaacgcgguuu

SEQ ID NO: 5660 - RNA, 24 nt, Vaccinia virus
uguaaaauuuuugucgauaaaaau

SEQ ID NO: 5661 - RNA, 24 nt, Paramecium bursaria Chlorella virus 1
uuugaugcguauucaaaaaaauca

SEQ ID NO: 5662 - RNA, 24 nt, Melanoplus sanguinipes entomopoxvirus
uaaaaggugaauuugauuguuauu

SEQ ID NO: 5663 - RNA, 24 nt, Parvovirus H1
ugguagguuaacuguaaaaaauaa

SEQ ID NO: 5664 - RNA, 24 nt, Melanoplus sanguinipes entomopoxvirus
uguacauuuaaauauaaaaauuuu

SEQ ID NO: 5665 - RNA, 24 nt, Human herpesvirus 8
cgccagcaaauuuaaguccuggug

SEQ ID NO: 5666 - RNA, 24 nt, Rabbit fibroma virus
uaauauacaauaaucuuuucugug

SEQ ID NO: 5667 - RNA, 24 nt, Melanoplus sanguinipes entomopoxvirus
uguacauuuaaauauaaaaauuuu

SEQ ID NO: 5668 - RNA, 24 nt, Melanoplus sanguinipes entomopoxvirus
uauuuagcaauacaaauucuauuu

SEQ ID NO: 5669 - RNA, 24 nt, Mouse parvovirus 1
uaaggaccaaaaaaacaauaaaau

SEQ ID NO: 5670 - RNA, 24 nt, Lactate dehydrogenase-elevating virus
aauuguaugagcuggagauauaag

SEQ ID NO: 5671 - RNA, 24 nt, Rhopalosiphum padi virus
aagcagucuuuauaucuucuguau

SEQ ID NO: 5672 - RNA, 24 nt, Zaire Ebola virus
ugacuuggauuggaaauguggaga

SEQ ID NO: 5673 - RNA, 24 nt, Human herpesvirus 8
cagggcacccucccccaccgagug

SEQ ID NO: 5674 - RNA, 24 nt, West Nile virus
uccacguaagcccucagaaccguc

SEQ ID NO: 5675 - RNA, 24 nt, West Nile virus
cgacauagguggcugguggugcua

SEQ ID NO: 5676 - RNA, 24 nt, Human herpesvirus 5
agaguuuaguauacuaauaugaag

SEQ ID NO: 5677 - RNA, 24 nt, Human herpesvirus 1
ucccgguugauuuuugggugggug

SEQ ID NO: 5678 - RNA, 18 nt, Zaire Ebola virus
uucaaauguuaaucuuuc

SEQ ID NO: 5679 - RNA, 24 nt, Zaire Ebola virus
uaagaaaaaaucggcgaugaagau

SEQ ID NO: 5680 - RNA, 24 nt, Human herpesvirus 8
ucagugccacaauuucauuaacaa

SEQ ID NO: 5681 - RNA, 24 nt, Camelpox virus
uauugcgcuaccgauucuucacag

SEQ ID NO: 5682 - RNA, 23 nt, Equine herpesvirus 2
uauaacacaaucuggucucucca

SEQ ID NO: 5683 - RNA, 24 nt, Equine herpesvirus 4
uacacugcaggcguaugcacagcg

SEQ ID NO: 5684 - RNA, 24 nt, Nipah virus
ucuugcucuuaguuagucauugug

SEQ ID NO: 5685 - RNA, 24 nt, Sheeppox virus
uuuauuagcucguuuagugcuaaa

SEQ ID NO: 5686 - RNA, 24 nt, Sheeppox virus
ucaguuuuauaaucuuuuuuuauu

SEQ ID NO: 5687 - RNA, 24 nt, Gallid herpesvirus 3
gcccuuuuuuguaacagauggcga

SEQ ID NO: 5688 - RNA, 24 nt, Gallid herpesvirus 3
uuagaugccgucagggaaagaugg

SEQ ID NO: 5689 - RNA, 24 nt, Amsacta moorei entomopoxvirus
uaaauuauggaauaaccuuaauag

SEQ ID NO: 5690 - RNA, 24 nt, Melanoplus sanguinipes entomopoxvirus
ugaaaauuuuaauauuucuucauu

SEQ ID NO: 5691 - RNA, 24 nt, Langat virus
ucccugagccaccaucaccuagac

SEQ ID NO: 5692 - RNA, 24 nt, Ateline herpesvirus 3
uauuauguucacccugaaucaauc

SEQ ID NO: 5693 - RNA, 24 nt, Molluscum contagiosum virus
gcgccgcgcgcgcaaccgcggccg

SEQ ID NO: 5694 - RNA, 24 nt, Mosquito cell fusing agent
aaugugaaaaaguauggggaaaga

SEQ ID NO: 5695 - RNA, 24 nt, Monkeypox virus
agcaaguagaugaugaggaaccag

SEQ ID NO: 5696 - RNA, 24 nt, Meleagrid herpesvirus 1
uucuucgcggguuuaacaguuugg

SEQ ID NO: 5697 - RNA, 24 nt, Ateline herpesvirus 3
uacaagacaaaccaaaaauacaau

SEQ ID NO: 5698 - RNA, 19 nt, Tupaia herpesvirus
uccguggacggcggccggc

SEQ ID NO: 5699 - RNA, 24 nt, Tupaia herpesvirus
uacugcgcgaccgccucgucguuc

SEQ ID NO: 5700 - RNA, 24 nt, Paramecium bursaria Chlorella virus 1
ugacaaaugacaaaugacaaauga

SEQ ID NO: 5701 - RNA, 24 nt, Himetobi P virus
uaagcuuuuuccucauaaauauuu

SEQ ID NO: 5702 - RNA, 24 nt, Amsacta moorei entomopoxvirus
uaucaaauguuacaauaguuuuuu

SEQ ID NO: 5703 - RNA, 24 nt, Bovine herpesvirus 1
cucgcacuccggcgccguguucgc

SEQ ID NO: 5704 - RNA, 24 nt, Gallid herpesvirus 3
caccgagauccggcaucauaccuu

SEQ ID NO: 5705 - RNA, 24 nt, Equine herpesvirus 4
uggucggagaguuauaagcauacc

SEQ ID NO: 5706 - RNA, 24 nt, Variola virus
uauuauauuuuauauuuuauauuu

SEQ ID NO: 5707 - RNA, 24 nt, Equine herpesvirus 1
aagggguuuuacuuuaugugaauu

SEQ ID NO: 5708 - RNA, 22 nt, Monkeypox virus
uaguauagcauaaacuaaaguc

SEQ ID NO: 5709 - RNA, 21 nt, Sulfolobus virus SIRV-2
ucagagagauaaaaagauaga

SEQ ID NO: 5710 - RNA, 24 nt, Cowpea mottle virus
ucgcauauugcuauuucugcucaa

SEQ ID NO: 5711 - RNA, 24 nt, African swine fever virus
uauagccaauaauuauuccacuaa

SEQ ID NO: 5712 - RNA, 24 nt, Rat cytomegalovirus
aucccguuccgaaaauauacguga

SEQ ID NO: 5713 - RNA, 19 nt, Patchouli mild mosaic virus
uguauaagcuuuaguagua

SEQ ID NO: 5714 - RNA, 23 nt, Molluscum contagiosum virus
aggcaccgcccgcccgcgcucga

SEQ ID NO: 5715 - RNA, 24 nt, Chimpanzee cytomegalovirus
cacgcuguucguccgcgcucgucg

SEQ ID NO: 5716 - RNA, 21 nt, Rat cytomegalovirus
ucaguuagacgaucauugagg

SEQ ID NO: 5717 - RNA, 21 nt, Human herpesvirus 5
uacacugaacuugagcacaaa

SEQ ID NO: 5718 - RNA, 24 nt, Sonchus yellow net virus
aagcacacgauacacauguaucca

SEQ ID NO: 5719 - RNA, 21 nt, Porcine reproductive and respiratory syndrome virus
cacugauugacauugugccuc

SEQ ID NO: 5720 - RNA, 24 nt, Lymphocystis disease virus 1
uauaaaacaguguagcguugaauu

SEQ ID NO: 5721 - RNA, 24 nt, Chimpanzee cytomegalovirus
uaggacauagaucgguacagauac

SEQ ID NO: 5722 - RNA, 24 nt, Human herpesvirus 1
ugccuggcgcccccacccucgggu

SEQ ID NO: 5723 - RNA, 24 nt, Human adenovirus C
uugcauggcguguuaaauggggcg

SEQ ID NO: 5724 - RNA, 24 nt, Sulfolobus virus SIRV-1
ucuaucuuuuuaucucuuuaauuu

SEQ ID NO: 5725 - RNA, 24 nt, Porcine reproductive and respiratory syndrome virus
uggaagaauguguggugaauggca

SEQ ID NO: 5726 - RNA, 24 nt, Tupaia herpesvirus
ugaggaauauaauauagcaacagu

SEQ ID NO: 5727 - RNA, 24 nt, Human herpesvirus 7
ugaaagcucgccaaggucucgcgu

SEQ ID NO: 5728 - RNA, 24 nt, Rice grassy stunt virus
uauaaagauuguguauucuucaac

SEQ ID NO: 5729 - RNA, 24 nt, Simian-Human immunodeficiency virus
uaggggaaggacauggggcagggg

SEQ ID NO: 5730 - RNA, 24 nt, Strawberry mild yellow edge virus
uugccacucgcgagcagauucucg

SEQ ID NO: 5731 - RNA, 24 nt, Human herpesvirus 3
aggaguuuguaaaauaaaaucucu

SEQ ID NO: 5732 - RNA, 24 nt, Equine rhinovirus 3
ccuaaaauucccuccccuuucucu

SEQ ID NO: 5733 - RNA, 24 nt, Paramecium bursaria Chlorella virus 1
gagcuuccaguuguucguaaaugu

SEQ ID NO: 5734 - RNA, 24 nt, Human herpesvirus 1
guggacccaaagcccucagagaca

SEQ ID NO: 5735 - RNA, 24 nt, Human herpesvirus 5
ugacguggauacuaguaaaaggga

SEQ ID NO: 5736 - RNA, 24 nt, Macaca mulatta rhadinovirus
gggcuggcagggacggcacccagc

SEQ ID NO: 5737 - RNA, 24 nt, Pea seed-borne mosaic virus
uaggguucuauuaucaucaauucc

SEQ ID NO: 5738 - RNA, 24 nt, African swine fever virus
acgcaaauggauuuacuacguuuu

SEQ ID NO: 5739 - RNA, 21 nt, Infectious spleen and kidney necrosis virus
uagcagaguacguucgcaugg

SEQ ID NO: 5740 - RNA, 24 nt, Variola virus
uacuugacugacuuaaaacuugau

SEQ ID NO: 5741 - RNA, 24 nt, Murid herpesvirus 4
augagucaugaaaugucccuucaa

SEQ ID NO: 5742 - RNA, 24 nt, Trichomonas vaginalis virus 3
uacaguguuacuguuguguguauc

SEQ ID NO: 5743 - RNA, 24 nt, Satellite virus of maize white line mosaic virus
uugaaaguugcggcugaccaccgu

SEQ ID NO: 5744 - RNA, 22 nt, Infectious spleen and kidney necrosis virus
ugucauggaccaucguggcuac

SEQ ID NO: 5745 - RNA, 24 nt, Trichomonas vaginalis virus 3
ugagggaaggcgugagagcgucag

SEQ ID NO: 5746 - RNA, 24 nt, Cowpox virus
ugaggaaugaggaaugagaguguc

SEQ ID NO: 5747 - RNA, 24 nt, Lumpy skin disease virus
uaaaaaaagaaaaaaaaaggcauu

SEQ ID NO: 5748 - RNA, 24 nt, Amsacta moorei entomopoxvirus
uaauauuaaaauauauauaguuua

SEQ ID NO: 5749 - RNA, 24 nt, Human herpesvirus 1
ucgcaucuuuccuguguguaguug

SEQ ID NO: 5750 - RNA, 24 nt, African swine fever virus
uugacauuaguaacagaaaguauu

SEQ ID NO: 5751 - RNA, 24 nt, Planococcus citri densovirus
uaucaaguacaguucuacuuuugc

SEQ ID NO: 5752 - RNA, 24 nt, Alcelaphine herpesvirus 1
uauaaaauuguaaauaaaaaaaca

SEQ ID NO: 5753 - RNA, 24 nt, Sulfolobus virus SIRV-2
uauuucaaaaagcuuuagaaguug

SEQ ID NO: 5754 - RNA, 24 nt, Phocoena spinipinnis papillomavirus
uauaagacugauuguaaauacuag

SEQ ID NO: 5755 - RNA, 24 nt, Sulfolobus virus SIRV-1
uaaguaggauuaauauuuggaauu

SEQ ID NO: 5756 - RNA, 24 nt, Camelpox virus
uaaaguguaugucuuauguauauu

SEQ ID NO: 5757 - RNA, 24 nt, Ictalurid herpesvirus 1
uaagccgguucgaggcgccacuaa

SEQ ID NO: 5758 - RNA, 24 nt, Lymphocystis disease virus 1
augcauuauaagaucguguaguaa

SEQ ID NO: 5759 - RNA, 24 nt, Cherry mottle leaf virus
ugugugaagaagugauguuuaggg

SEQ ID NO: 5760 - RNA, 24 nt, Little cherry virus
ucgcuacucaaguuaguaagaaac

SEQ ID NO: 5761 - RNA, 24 nt, Human herpesvirus 3
ugguuugaacgucuccauuaaccc

SEQ ID NO: 5762 - RNA, 24 nt, Human herpesvirus 5
ugagaaguagcguguggacugaac

SEQ ID NO: 5763 - RNA, 24 nt, Sida golden mosaic virus
auaaugccuaauugaucuaaguac

SEQ ID NO: 5764 - RNA, 24 nt, Porcine epidemic diarrhea virus
cugcuggaagcuggcguggaauuu

SEQ ID NO: 5765 - RNA, 24 nt, Molluscum contagiosum virus
aguggcguuugccgugacaagaca

SEQ ID NO: 5766 - RNA, 24 nt, Cowpox virus
cacagguauuauuaaaaugaguau

SEQ ID NO: 5767 - RNA, 22 nt, Bovine herpesvirus 4
ugugcuuauauaggaaggccgc

SEQ ID NO: 5768 - RNA, 24 nt, Bovine herpesvirus 4
uaugacacucacacaaccuggaau

SEQ ID NO: 5769 - RNA, 24 nt, Human coronavirus 229E
acgaaauuuuugcuauggccggca

SEQ ID NO: 5770 - RNA, 24 nt, Molluscum contagiosum virus
gagcacgugaacagacccaguggc

SEQ ID NO: 5771 - RNA, 24 nt, Cowpox virus
ucaaugauacguguauuagaauac

SEQ ID NO: 5772 - RNA, 24 nt, Red clover mottle virus
uagcguguggagcgauccuuggug

SEQ ID NO: 5773 - RNA, 24 nt, Paramecium bursaria Chlorella virus 1
aaacgcaaaagacuuggggggucg

SEQ ID NO: 5774 - RNA, 24 nt, Melanoplus sanguinipes entomopoxvirus
uuaauuguccuaaucgugaaugca

SEQ ID NO: 5775 - RNA, 24 nt, Bovine coronavirus
uagcagacuauagauuaauuaguu

SEQ ID NO: 5776 - RNA, 24 nt, Aedes albopictus densovirus
acuccaagauacaguuacuauuag

SEQ ID NO: 5777 - RNA, 24 nt, Helminthosporium victoriae virus 190S
cuuccguugacccaacugauauca

SEQ ID NO: 5778 - RNA, 24 nt, Amsacta moorei entomopoxvirus
uauauuauaauaaauggauaaaau

SEQ ID NO: 5779 - RNA, 24 nt, Paramecium bursaria Chlorella virus 1
gaacguugcugcuuauaccguggg

SEQ ID NO: 5780 - RNA, 24 nt, Cowpox virus
aguggaacaaaauauagcggauga

SEQ ID NO: 5781 - RNA, 24 nt, Human papillomavirus type 13
uggugguggaguguacaggaccug

SEQ ID NO: 5782 - RNA, 24 nt, Fowl adenovirus D
cuagggcuauugaguaggguuugg

SEQ ID NO: 5783 - RNA, 24 nt, Fowl adenovirus D
uuggagcugguaggcgaguucgcc

SEQ ID NO: 5784 - RNA, 24 nt, Equine herpesvirus 1
uaucagguguuuuauuuuuucuau

SEQ ID NO: 5785 - RNA, 24 nt, Molluscum contagiosum virus
uacaacagccguagauucauacug

SEQ ID NO: 5786 - RNA, 19 nt, Murine adenovirus A
cacguggugcgucagguga

SEQ ID NO: 5787 - RNA, 24 nt, Human papillomavirus type 12
ugauacuggcauuaggacccuaca

SEQ ID NO: 5788 - RNA, 24 nt, Paramecium bursaria Chlorella virus 1
ugagacggugaagacugagacggu

SEQ ID NO: 5789 - RNA, 19 nt, Common chimpanzee papillomavirus 1
ugagguggacgaacaagcc

SEQ ID NO: 5790 - RNA, 24 nt, Human papillomavirus type 14
agcaaauaugagccgcgcccgaua

SEQ ID NO: 5791 - RNA, 24 nt, Human papillomavirus type 47
uuuacugugacuaaguguaacucu

SEQ ID NO: 5792 - RNA, 24 nt, Cercopithecine herpesvirus 7
uauaugacauaggaggggccauaa

SEQ ID NO: 5793 - RNA, 24 nt, Paramecium bursaria Chlorella virus 1
ucaauaguuuuuguaucaaauagc

SEQ ID NO: 5794 - RNA, 24 nt, Pepper mottle virus
uaggaggugaucguaguuggcaug

SEQ ID NO: 5795 - RNA, 24 nt, Murid herpesvirus 4
ucugcagucagacagucucaaaca

SEQ ID NO: 5796 - RNA, 24 nt, Tupaia herpesvirus
uccccgacuccucuguacuagacu

SEQ ID NO: 5797 - RNA, 24 nt, Red clover mottle virus
ugcauauuuauuuuauguucauuu

SEQ ID NO: 5798 - RNA, 24 nt, Cowpox virus
uuuauaaagaaucauauucauuag

SEQ ID NO: 5799 - RNA, 24 nt, Cowpox virus
uugcuuuaauuguuuuuguaaacu

SEQ ID NO: 5800 - RNA, 24 nt, Human papillomavirus type 86
aggcagcuacagcagcuuauggug

SEQ ID NO: 5801 - RNA, 24 nt, Ovine pulmonary adenocarcinoma virus
ucccugugcaggugcgacucuugu

SEQ ID NO: 5802 - RNA, 24 nt, Human papillomavirus type 6
uaacaaguguaacaaacacaacug

SEQ ID NO: 5803 - RNA, 24 nt, Cocksfoot streak virus
ugauaugugcaccgugugugauuu

SEQ ID NO: 5804 - RNA, 24 nt, Monkeypox virus
ugucuaaauguaauuaugaucuug

SEQ ID NO: 5805 - RNA, 24 nt, Swinepox virus
uauuuuaauuauaucuguuuuacu

SEQ ID NO: 5806 - RNA, 24 nt, Human papillomavirus type 6
ugguuguuaugugccuuuauugua

SEQ ID NO: 5807 - RNA, 20 nt, Canine oral papillomavirus
ugacaagaccggauucguuc

SEQ ID NO: 5808 - RNA, 24 nt, Human herpesvirus 8
ucuguuuuauauagugaggguuca

SEQ ID NO: 5809 - RNA, 24 nt, Human herpesvirus 8
uccgugggaagacgaugggggaaa

SEQ ID NO: 5810 - RNA, 24 nt, Paramecium bursaria Chlorella virus 1
uauggaaauaaagaaacucgcaug

SEQ ID NO: 5811 - RNA, 24 nt, Reston Ebola virus
uugugcagauuuaaacuuggguuu

SEQ ID NO: 5812 - RNA, 24 nt, Rabbit fibroma virus
uagacuuuguuauggagaaacucu

SEQ ID NO: 5813 - RNA, 24 nt, Amsacta moorei entomopoxvirus
uaaauuaacauuauguuuaauaca

SEQ ID NO: 5814 - RNA, 24 nt, Paramecium bursaria Chlorella virus 1
aaccguaguagccguuguagaguc

SEQ ID NO: 5815 - RNA, 24 nt, Paramecium bursaria Chlorella virus 1
ucaaguauuuauacacguugagug

SEQ ID NO: 5816 - RNA, 24 nt, Cowpox virus
uugauaauuaguauaauuaguaua

SEQ ID NO: 5817 - RNA, 24 nt, Human adenovirus D
ucagcagcaggagcgugccgccaa

SEQ ID NO: 5818 - RNA, 24 nt, Fowlpox virus
uauaauaccuuuacaccacgcaac

SEQ ID NO: 5819 - RNA, 24 nt, Rabbit fibroma virus
uaugaucgacaauagagccagugu

SEQ ID NO: 5820 - RNA, 24 nt, Human herpesvirus 2
ccggaacccaccagaggcggaagc

SEQ ID NO: 5821 - RNA, 23 nt, Human papillomavirus type 57
uaccuggcauaaggugcccgggc

SEQ ID NO: 5822 - RNA, 24 nt, Common chimpanzee papillomavirus 1
uaucacagacuaagggacaugagg

SEQ ID NO: 5823 - RNA, 24 nt, Simian foamy virus
ucaggaccugcagacucuuaguga

SEQ ID NO: 5824 - RNA, 24 nt, African swine fever virus
cagcauacauaaguguauauuauu

SEQ ID NO: 5825 - RNA, 24 nt, Common chimpanzee papillomavirus 1
uauaacacagaaaaggaaauaugg

SEQ ID NO: 5826 - RNA, 24 nt, Rabbit fibroma virus
uacuguucgcuuuuuucuuucgug

SEQ ID NO: 5827 - RNA, 24 nt, Jembrana disease virus
uagguuauuugaugacacccgcag

SEQ ID NO: 5828 - RNA, 24 nt, Tobacco streak virus
aaggaugcagcuucgugcucuagg

SEQ ID NO: 5829 - RNA, 24 nt, Human papillomavirus type 83
gacuauguaagcugggggcacaua

SEQ ID NO: 5830 - RNA, 24 nt, Fowl adenovirus A
uauuagguguggcuucgggcuccg

SEQ ID NO: 5831 - RNA, 24 nt, Rauscher murine leukemia virus
acguugggccaaacaggauaucug

SEQ ID NO: 5832 - RNA, 24 nt, Sheeppox virus
uguaacauauauaacaguacaaca

SEQ ID NO: 5833 - RNA, 18 nt, Human papillomavirus type 48
uggcacaagacugaaggg

SEQ ID NO: 5834 - RNA, 24 nt, Paramecium bursaria Chlorella virus 1
uggaaucgucacgcagaugcucuc

SEQ ID NO: 5835 - RNA, 24 nt, Reston Ebola virus
ucuaauagauagcccugacuagac

SEQ ID NO: 5836 - RNA, 24 nt, Equine herpesvirus 2
acaguauacaagucauuuuaugaa

SEQ ID NO: 5837 - RNA, 24 nt, Fusarium poae virus 1
uacuauugauguacaauuugacac

SEQ ID NO: 5838 - RNA, 24 nt, Human herpesvirus 1
gaggauaugacccccgccgagcug

SEQ ID NO: 5839 - RNA, 24 nt, Cowpea severe mosaic virus
uacagcauuugcuguuguaacggg

SEQ ID NO: 5840 - RNA, 24 nt, Goose parvovirus
uauugggcugaccgcgcgcaugcg

SEQ ID NO: 5841 - RNA, 24 nt, Human herpesvirus 5
caaggaacacuggguccgcugaaa

SEQ ID NO: 5842 - RNA, 24 nt, Camelpox virus
uacaauaucuguauaaguacccuu

SEQ ID NO: 5843 - RNA, 24 nt, Human herpesvirus 5
augauguuuugucccucugucuua

SEQ ID NO: 5844 - RNA, 24 nt, Aura virus
uagaauuuuaaaauuuucuuuauu

SEQ ID NO: 5845 - RNA, 24 nt, Alcelaphine herpesvirus 1
uggccaaauaugagaaaggaugug

SEQ ID NO: 5846 - RNA, 20 nt, Saimiriine herpesvirus 2
ccggacggaugcaguccaga

SEQ ID NO: 5847 - RNA, 24 nt, Murine adenovirus A
uuaaaaauuugauaacuaccauuc

SEQ ID NO: 5848 - RNA, 24 nt, Infectious hypodermal and hematopoietic necrosis virus
uuuaauauuuauuuauuuuuuuac

SEQ ID NO: 5849 - RNA, 24 nt, Infectious hypodermal and hematopoietic necrosis virus
cagccgaggcaauguuuacauagu

SEQ ID NO: 5850 - RNA, 24 nt, Infectious hypodermal and hematopoietic necrosis virus
ucaacgggcccccuuauugugacg

SEQ ID NO: 5851 - RNA, 24 nt, Murine adenovirus A
uaccucaaugucuucuaugggcgu

SEQ ID NO: 5852 - RNA, 24 nt, Infectious hypodermal and hematopoietic necrosis virus
ucacacaucaggaaguugaaacca

SEQ ID NO: 5853 - RNA, 24 nt, Infectious hypodermal and hematopoietic necrosis virus
ucaaggaugucauagacauuguca

SEQ ID NO: 5854 - RNA, 24 nt, Yaba-like disease virus
uauguccuguuugguguccaaaau

SEQ ID NO: 5855 - RNA, 19 nt, Yaba-like disease virus
uggcuugggaauugcuugg

SEQ ID NO: 5856 - RNA, 24 nt, Yaba-like disease virus
ugaaaaugagacagaccguguaac

SEQ ID NO: 5857 - RNA, 24 nt, Infectious hypodermal and hematopoietic necrosis virus
uauaaaauauauaaaacauaaacu

SEQ ID NO: 5858 - RNA, 20 nt, Infectious hypodermal and hematopoietic necrosis virus
uauuuugugauaucagauau

SEQ ID NO: 5859 - RNA, 24 nt, Infectious hypodermal and hematopoietic necrosis virus
uguuuauugucauggcgacagugu

SEQ ID NO: 5860 - RNA, 24 nt, Infectious hypodermal and hematopoietic necrosis virus
uuggauaguaucgcaggaacucgg

SEQ ID NO: 5861 - RNA, 24 nt, Infectious hypodermal and hematopoietic necrosis virus
uauuauauucaucucgcaccacga

SEQ ID NO: 5862 - RNA, 24 nt, Yaba-like disease virus
ucugggcuaccucauuuugacccc

SEQ ID NO: 5863 - RNA, 24 nt, Yaba-like disease virus
uaggacaggaaucggccauuuugg

SEQ ID NO: 5864 - RNA, 24 nt, Yaba-like disease virus
uacagcuuuaaaaggacaauuucc

SEQ ID NO: 5865 - RNA, 24 nt, Molluscum contagiosum virus
uauauguauccacuaauugaugua

SEQ ID NO: 5866 - RNA, 24 nt, Molluscum contagiosum virus
uugguaaaucccaguucggguauu

SEQ ID NO: 5867 - RNA, 24 nt, Bovine herpesvirus 1
uauugcuagugggugugcacugac

SEQ ID NO: 5868 - RNA, 24 nt, Bovine herpesvirus 1
guaaaucccaguucgggaauuuug

SEQ ID NO: 5869 - RNA, 22 nt, Yaba-like disease virus
uauguuguccguggucaaucau

SEQ ID NO: 5870 - RNA, 22 nt, Yaba-like disease virus
uugauggggcuaugccaccugg

SEQ ID NO: 5871 - RNA, 24 nt, Ateline herpesvirus 3
gggaaaacauaagaauaggaagaa

SEQ ID NO: 5872 - RNA, 24 nt, Yaba-like disease virus
ugagaacucggcugcucccagagg

SEQ ID NO: 5873 - RNA, 24 nt, Yaba-like disease virus
uuacacgaucuaaauuaucccauc

SEQ ID NO: 5874 - RNA, 24 nt, Yaba-like disease virus
uucaaguaaaccccucauggauua

SEQ ID NO: 5875 - RNA, 24 nt, Yaba-like disease virus
ugacuaaucuagauauguuaauua

SEQ ID NO: 5876 - RNA, 24 nt, Cucumber green mottle mosaic virus
uggaaaucguaauaccaguuaugu

SEQ ID NO: 5877 - RNA, 24 nt, Nudaurelia capensis beta virus
uaaaacaacuagagaaaaguauaa

SEQ ID NO: 5878 - RNA, 24 nt, Yaba-like disease virus
aaacagaaauaaguuuaacuuuuu

SEQ ID NO: 5879 - RNA, 24 nt, Yaba-like disease virus
uauaaaguccauaucggaguuacu

SEQ ID NO: 5880 - RNA, 24 nt, Nudaurelia capensis beta virus
ugaggaggagaaggagaaugggga

SEQ ID NO: 5881 - RNA, 20 nt, Nudaurelia capensis beta virus
uccguggaguaguggcgggg

SEQ ID NO: 5882 - RNA, 24 nt, Yaba-like disease virus
ucauugguccagagcccucucagc

SEQ ID NO: 5883 - RNA, 24 nt, Saimiriine herpesvirus 2
ucuauuguuaaaaggaaaaaugua

SEQ ID NO: 5884 - RNA, 24 nt, Simian T-lymphotropic virus 1
ucuagguaaguuuagagcucaggu

SEQ ID NO: 5885 - RNA, 24 nt, Ateline herpesvirus 3
cuaaagcuauauaauccguucauc

SEQ ID NO: 5886 - RNA, 24 nt, Ateline herpesvirus 3
cgagaugggcgaggagaugcuggg

SEQ ID NO: 5887 - RNA, 24 nt, Ateline herpesvirus 3
uugaugauauaauuguuuuuacua

SEQ ID NO: 5888 - RNA, 23 nt, Ateline herpesvirus 3
cucuccucggcuaacggccucgu

SEQ ID NO: 5889 - RNA, 24 nt, Human herpesvirus 5
cagcauguaucggggcuccgacgc

SEQ ID NO: 5890 - RNA, 24 nt, Human herpesvirus 5
cacuuuuuugucucgcuucaaugu

SEQ ID NO: 5891 - RNA, 24 nt, Tupaia herpesvirus
ccucuguuuuugcuugacguucaa

SEQ ID NO: 5892 - RNA, 21 nt, Variola virus
aacaccgugaauccacgggga

SEQ ID NO: 5893 - RNA, 24 nt, Variola virus
cgaguccgcggucgccgccuguuc

SEQ ID NO: 5894 - RNA, 24 nt, Gallid herpesvirus 3
uggauguaucuaugcuaccuuggu

SEQ ID NO: 5895 - RNA, 24 nt, Gallid herpesvirus 3
uaguaggaacccgcaauuguguga

SEQ ID NO: 5896 - RNA, 24 nt, Gallid herpesvirus 3
ugccauguugggagaaacaaagca

SEQ ID NO: 5897 - RNA, 24 nt, Chimpanzee cytomegalovirus
aggcggcggggcucgacgacggac

SEQ ID NO: 5898 - RNA, 24 nt, Chimpanzee cytomegalovirus
ucgcguuggguugcagccgcaagc

SEQ ID NO: 5899 - RNA, 24 nt, Chimpanzee cytomegalovirus
ucgccgggcgggggggaagcgccc

SEQ ID NO: 5900 - RNA, 24 nt, Molluscum contagiosum virus
auagaacuaacuugugacacagaa

SEQ ID NO: 5901 - RNA, 24 nt, Aichi virus
uagcgcucagaauaucucauucaa

SEQ ID NO: 5902 - RNA, 24 nt, Aichi virus
ugggaucugagccugggcuaauug

SEQ ID NO: 5903 - RNA, 24 nt, Human papillomavirus type 7
cuaggucaaaguucccugccaaaa

SEQ ID NO: 5904 - RNA, 24 nt, Human papillomavirus type 7
acuugcuuuuaggcacauaguuuu

SEQ ID NO: 5905 - RNA, 24 nt, Human herpesvirus 8
ugcuaguuugggccagcgaaacgg

SEQ ID NO: 5906 - RNA, 24 nt, Aichi virus
uagaugucaaugaagaguacacag

SEQ ID NO: 5907 - RNA, 24 nt, Avian carcinoma virus
cacuggguugauauuggacugggg

SEQ ID NO: 5908 - RNA, 24 nt, Bean leafroll virus
uggcaugcgcuagagauguuuuuu

SEQ ID NO: 5909 - RNA, 21 nt, Bean leafroll virus
uagaauguguugaaaaaauga

SEQ ID NO: 5910 - RNA, 24 nt, Bean leafroll virus
ucucaaaaguuacuugugcuaagu

SEQ ID NO: 5911 - RNA, 22 nt, Reston Ebola virus
cgccggagugggcgacgacccg

SEQ ID NO: 5912 - RNA, 24 nt, Reston Ebola virus
ugaggagccagagcccgccgggga

SEQ ID NO: 5913 - RNA, 24 nt, African swine fever virus
acagguuuagcgcuuuuucucgcc

SEQ ID NO: 5914 - RNA, 24 nt, Parvovirus H1
aacauugucggcucaaaaacuccc

SEQ ID NO: 5915 - RNA, 24 nt, Human papillomavirus type 44
uagaauggggaacaucuacuuacu

SEQ ID NO: 5916 - RNA, 23 nt, Camelpox virus
uugauccgggguauuauauuuuc

SEQ ID NO: 5917 - RNA, 20 nt, Paramecium bursaria Chlorella virus 1
uuuguccuuagaguuuugug

SEQ ID NO: 5918 - RNA, 24 nt, Paramecium bursaria Chlorella virus 1
ugauauacaaaguuugcaagcgca

SEQ ID NO: 5919 - RNA, 24 nt, Camelpox virus
uagaacgaucuuucgaugauaaau

SEQ ID NO: 5920 - RNA, 24 nt, Saimiriine herpesvirus 2
agacaccuuccuucaaguacucug

SEQ ID NO: 5921 - RNA, 24 nt, Ryegrass mottle virus
ucgcuccgccccagaccgcccgac

SEQ ID NO: 5922 - RNA, 24 nt, Bovine adenovirus D
uuuccauugccacccgggcgaaaa

SEQ ID NO: 5923 - RNA, 24 nt, Tupaia herpesvirus
uucgaagugcagauuuuccgcuuu

SEQ ID NO: 5924 - RNA, 24 nt, Melanoplus sanguinipes entomopoxvirus
uaguacgcgccugccgggagaaac

SEQ ID NO: 5925 - RNA, 17 nt, Meleagrid herpesvirus 1
ugauuaugauagaacug

SEQ ID NO: 5926 - RNA, 24 nt, Meleagrid herpesvirus 1
uacguaaacuacuuaaucuuagca

SEQ ID NO: 5927 - RNA, 24 nt, Meleagrid herpesvirus 1
cggaaggugcccagcaggaucucg

SEQ ID NO: 5928 - RNA, 18 nt, Meleagrid herpesvirus 1
ugauguggggauauacca

SEQ ID NO: 5929 - RNA, 24 nt, Murid herpesvirus 4
aggaggauagcugugccggugguc

SEQ ID NO: 5930 - RNA, 23 nt, Murid herpesvirus 4
cgagagcgccgucagagccaugg

SEQ ID NO: 5931 - RNA, 24 nt, Meleagrid herpesvirus 1
ucugucuuuaagggauuuucugac

SEQ ID NO: 5932 - RNA, 19 nt, Meleagrid herpesvirus 1
uaucagugauuauuacaau

SEQ ID NO: 5933 - RNA, 22 nt, Meleagrid herpesvirus 1
uacaauauguuuaucuaagcuu

SEQ ID NO: 5934 - RNA, 24 nt, Meleagrid herpesvirus 1
uauuguuuuaaauuuuaaguuaga

SEQ ID NO: 5935 - RNA, 24 nt, Meleagrid herpesvirus 1
aaggaucaacucuguuuaucuaga

SEQ ID NO: 5936 - RNA, 24 nt, Meleagrid herpesvirus 1
ugcgguagcuguccuggugguaac

SEQ ID NO: 5937 - RNA, 24 nt, Murid herpesvirus 4
cuguucucagcuaauaucgaugcc

SEQ ID NO: 5938 - RNA, 24 nt, Murid herpesvirus 4
gcagugacgauccacgguggcaac

SEQ ID NO: 5939 - RNA, 24 nt, Macaca mulatta rhadinovirus
ugaggaagcaucugguccuaagag

SEQ ID NO: 5940 - RNA, 24 nt, Macaca mulatta rhadinovirus
uagagcuaaauuugugaacucuuu

SEQ ID NO: 5941 - RNA, 24 nt, Macaca mulatta rhadinovirus
uggauugauaacaaagaguuaaag

SEQ ID NO: 5942 - RNA, 24 nt, Meleagrid herpesvirus 1
uagguaaacacgucgaacguguaa

SEQ ID NO: 5943 - RNA, 24 nt, Murid herpesvirus 4
aagcugccgcgauguacccccggg

SEQ ID NO: 5944 - RNA, 24 nt, Murid herpesvirus 4
uggucaggcgggggaucagauguc

SEQ ID NO: 5945 - RNA, 24 nt, Murid herpesvirus 4
uguccaaagaccccauaccuccua

SEQ ID NO: 5946 - RNA, 24 nt, Murid herpesvirus 4
uaugaagucaaccaugggcguggc

SEQ ID NO: 5947 - RNA, 24 nt, Murid herpesvirus 4
ugucucugaugaggaccuugagug

SEQ ID NO: 5948 - RNA, 24 nt, Macaca mulatta rhadinovirus
uaaaugguuuauuagaccuugcug

SEQ ID NO: 5949 - RNA, 19 nt, Bhendi yellow vein mosaic virus satellite DNA beta
aaggagcucauuucauuac

SEQ ID NO: 5950 - RNA, 24 nt, Bhendi yellow vein mosaic virus satellite DNA beta
gagcaaacucgaugaaggccgcua

SEQ ID NO: 5951 - RNA, 24 nt, Melanoplus sanguinipes entomopoxvirus
uccccgugguuaccgugacaagcu

SEQ ID NO: 5952 - RNA, 24 nt, Murid herpesvirus 4
acugcacagaaucgagaucguuuu

SEQ ID NO: 5953 - RNA, 24 nt, Murid herpesvirus 4
cuuuacaagauuaguucaucacca

SEQ ID NO: 5954 - RNA, 24 nt, Murid herpesvirus 4
agaaguuuguaguacaucagacca

SEQ ID NO: 5955 - RNA, 24 nt, Murid herpesvirus 4
uuggccaaccaugcaggggaaugu

SEQ ID NO: 5956 - RNA, 24 nt, Murid herpesvirus 4
acaggacuggcacaugcucacgga

SEQ ID NO: 5957 - RNA, 22 nt, Murid herpesvirus 4
cucguucuuccucaaaugaccc

SEQ ID NO: 5958 - RNA, 24 nt, Murid herpesvirus 4
uaauguacugguguacaaagugcu

SEQ ID NO: 5959 - RNA, 24 nt, Tupaia herpesvirus
uggcacuaguagcauuuaaccccu

SEQ ID NO: 5960 - RNA, 24 nt, Tupaia herpesvirus
cuacaggauuucaaacaggcgguc

SEQ ID NO: 5961 - RNA, 24 nt, Saimiriine herpesvirus 2
acgaaaacaaggaagauguagcaa

SEQ ID NO: 5962 - RNA, 24 nt, Saimiriine herpesvirus 2
aagaugacugggaagcuauccgua

SEQ ID NO: 5963 - RNA, 24 nt, Ateline herpesvirus 3
ucggcccggugcuccccuuugaag

SEQ ID NO: 5964 - RNA, 24 nt, Simian T-lymphotropic virus 2
agcuggugauuaguuccacuagac

SEQ ID NO: 5965 - RNA, 24 nt, Ateline herpesvirus 3
cagcggucguuuuaaccgcagguc

SEQ ID NO: 5966 - RNA, 24 nt, Ateline herpesvirus 3
uggcaguaccuaaugcauacgaag

SEQ ID NO: 5967 - RNA, 22 nt, Ateline herpesvirus 3
augaucgugauuuuguuacggu

SEQ ID NO: 5968 - RNA, 24 nt, Fowl adenovirus A
uguuggguagcucccuuaaguuaa

SEQ ID NO: 5969 - RNA, 24 nt, Fowl adenovirus A
uaagaucgauggugaggacugcuu

SEQ ID NO: 5970 - RNA, 24 nt, Fowl adenovirus A
agagguaaggcuaaacuugguaag

SEQ ID NO: 5971 - RNA, 24 nt, Fowl adenovirus A
cacgguaucuaauuuauaauuaga

SEQ ID NO: 5972 - RNA, 24 nt, Fowl adenovirus A
ucuaacaaaaaacgugugguagcg

SEQ ID NO: 5973 - RNA, 24 nt, Fowl adenovirus A
uuugcauuacaauuacuaaaugua

SEQ ID NO: 5974 - RNA, 21 nt, Human herpesvirus 6
ugggauguugcucugcgcucc

SEQ ID NO: 5975 - RNA, 24 nt, Human herpesvirus 6
uacuugaucaucgauucaauguac

SEQ ID NO: 5976 - RNA, 24 nt, Human herpesvirus 6
uaacaauaauucaauuuuauuuaa

SEQ ID NO: 5977 - RNA, 24 nt, Human herpesvirus 6
uguccaggcuuuccagauggagca

SEQ ID NO: 5978 - RNA, 21 nt, Human herpesvirus 6
ccuuccaucccuaguucucgu

SEQ ID NO: 5979 - RNA, 24 nt, Human herpesvirus 6
uggcaaccucgcccggauggcugu

SEQ ID NO: 5980 - RNA, 24 nt, Human herpesvirus 6
cuuucgggucucuuccagccguuu

SEQ ID NO: 5981 - RNA, 24 nt, Ictalurid herpesvirus 1
uuagugauucgguucauuuugaag

SEQ ID NO: 5982 - RNA, 24 nt, Ictalurid herpesvirus 1
ucaauacuuccugacucccaacuc

SEQ ID NO: 5983 - RNA, 24 nt, Human herpesvirus 6
ugucguagacucuccucacugaag

SEQ ID NO: 5984 - RNA, 24 nt, Human herpesvirus 6
uucgugacguagucggcacauagc

SEQ ID NO: 5985 - RNA, 24 nt, Human herpesvirus 6
cauuccguggggcauggggugggu

SEQ ID NO: 5986 - RNA, 17 nt, Human herpesvirus 6
ugucguacugcuggccc

SEQ ID NO: 5987 - RNA, 24 nt, Variola virus
ucgcuaaggaguuuaagaaucuca

SEQ ID NO: 5988 - RNA, 24 nt, Ictalurid herpesvirus 1
uaccuuuucucguagucgagguuu

SEQ ID NO: 5989 - RNA, 24 nt, Yaba-like disease virus
uucucgguucaagcccgagcccug

SEQ ID NO: 5990 - RNA, 24 nt, Ictalurid herpesvirus 1
cgcaugaaucuuccaucacccaug

SEQ ID NO: 5991 - RNA, 24 nt, Ictalurid herpesvirus 1
cacccgcagccgcacuggcgucua

SEQ ID NO: 5992 - RNA, 24 nt, Ictalurid herpesvirus 1
uguccuaguuuccaacccugugcu

SEQ ID NO: 5993 - RNA, 24 nt, Ictalurid herpesvirus 1
ucauucagcuccacucccaccuca

SEQ ID NO: 5994 - RNA, 24 nt, Ictalurid herpesvirus 1
cacaccgcccccuucuccacuuug

SEQ ID NO: 5995 - RNA, 24 nt, Human herpesvirus 6
ugaguauuuuuacaaaaaugcaua

SEQ ID NO: 5996 - RNA, 24 nt, Fowlpox virus
uguguguauuccccuucucccagu

SEQ ID NO: 5997 - RNA, 24 nt, Fowlpox virus
uacguaguaagaaauaauauguua

SEQ ID NO: 5998 - RNA, 20 nt, Fowlpox virus
ucgaaaguuuuuaguucagg

SEQ ID NO: 5999 - RNA, 19 nt, Molluscum contagiosum virus
uagcauagguuuuauauug

SEQ ID NO: 6000 - RNA, 24 nt, Gallid herpesvirus 3
ugguaugaaugcuacguuacugga

SEQ ID NO: 6001 - RNA, 24 nt, Paramecium bursaria Chlorella virus 1
caccguuuaucagguacgccgagu

SEQ ID NO: 6002 - RNA, 19 nt, Paramecium bursaria Chlorella virus 1
uaccuuuaacaagacgaca

SEQ ID NO: 6003 - RNA, 24 nt, Paramecium bursaria Chlorella virus 1
uuagucuguaauaugucgauaucu

SEQ ID NO: 6004 - RNA, 21 nt, Tupaia herpesvirus
ccagaggggacacguuguguc

SEQ ID NO: 6005 - RNA, 24 nt, Tupaia herpesvirus
uacguggauacgaggaucguuugc

SEQ ID NO: 6006 - RNA, 18 nt, Saimiriine herpesvirus 2
ucugugcguaguguccag

SEQ ID NO: 6007 - RNA, 24 nt, Saimiriine herpesvirus 2
agccgaugggugccgguuuggcgg

SEQ ID NO: 6008 - RNA, 17 nt, Saimiriine herpesvirus 2
gcucucggcgccgcguu

SEQ ID NO: 6009 - RNA, 24 nt, Rabbit fibroma virus
uuagaaaugccaaaucuauaagaa

SEQ ID NO: 6010 - RNA, 18 nt, Human adenovirus F
ucgaauuuaagagauccg

SEQ ID NO: 6011 - RNA, 24 nt, Human adenovirus F
uaacacaguauaugauccuaacuc

SEQ ID NO: 6012 - RNA, 24 nt, Human adenovirus F
uucaugguauccuggcgaauauua

SEQ ID NO: 6013 - RNA, 24 nt, Human adenovirus F
ugugugcauguuguauguuuugua

SEQ ID NO: 6014 - RNA, 24 nt, Bovine enterovirus
cacaaguuuagaugauaccuauag

SEQ ID NO: 6015 - RNA, 21 nt, Human adenovirus F
uucuuuguccuuauuacacau

SEQ ID NO: 6016 - RNA, 21 nt, Rat cytomegalovirus
aggaacugcgguugccccguu

SEQ ID NO: 6017 - RNA, 24 nt, Human herpesvirus 2
aaggacaccucuuuagucgaucca

SEQ ID NO: 6018 - RNA, 24 nt, Bovine enterovirus
cucccgggcaacccuuagcaguuc

SEQ ID NO: 6019 - RNA, 24 nt, Human herpesvirus 2
ucacauuugccuggaccuuuuuug

SEQ ID NO: 6020 - RNA, 24 nt, Monkeypox virus
uauguuaaaaauagguguuuuuuc

SEQ ID NO: 6021 - RNA, 24 nt, Monkeypox virus
uucaugaauuucauuuuuagaacu

SEQ ID NO: 6022 - RNA, 18 nt, Monkeypox virus
uggaaaguguucgggggc

SEQ ID NO: 6023 - RNA, 24 nt, Human herpesvirus 2
cgaaagcugaaagucucuucugcu

SEQ ID NO: 6024 - RNA, 21 nt, Monkeypox virus
uagaugccgccagcuaguuga

SEQ ID NO: 6025 - RNA, 24 nt, Monkeypox virus
ggggguuacaacuaaauucgucag

SEQ ID NO: 6026 - RNA, 24 nt, Fowlpox virus
ugucagcacugaugauuauguguc

SEQ ID NO: 6027 - RNA, 24 nt, Fowlpox virus
acucguauauuuuuacguacaaua

SEQ ID NO: 6028 - RNA, 24 nt, Lumpy skin disease virus
uuaauaguggagguugcccuguag

SEQ ID NO: 6029 - RNA, 24 nt, Lumpy skin disease virus
guacuccaaacgugaccucguacu

SEQ ID NO: 6030 - RNA, 24 nt, Lumpy skin disease virus
ugauuuggcuaucaccccuuggga

SEQ ID NO: 6031 - RNA, 24 nt, Lumpy skin disease virus
ucccagaaagucucccagaaaguc

SEQ ID NO: 6032 - RNA, 24 nt, Encephalomyocarditis virus
caucagaaagagguuuaauauuuu

SEQ ID NO: 6033 - RNA, 24 nt, Lumpy skin disease virus
ucuguacgguaacugauaucuacc

SEQ ID NO: 6034 - RNA, 24 nt, Gallid herpesvirus 3
uaaguuaguaauacauaaauuuua

SEQ ID NO: 6035 - RNA, 24 nt, Gallid herpesvirus 3
uguguuggugacaguccuugcagg

SEQ ID NO: 6036 - RNA, 24 nt, Gallid herpesvirus 3
caagaucaauccaacgguuguuuc

SEQ ID NO: 6037 - RNA, 24 nt, Gallid herpesvirus 3
uacuagaucauuuauauaccaaaa

SEQ ID NO: 6038 - RNA, 24 nt, Encephalomyocarditis virus
caucagaaagagguuuaauauuuu

SEQ ID NO: 6039 - RNA, 24 nt, Gallid herpesvirus 3
agggagcgagcuguugaguuggau

SEQ ID NO: 6040 - RNA, 24 nt, Gallid herpesvirus 3
aauauuuuuguaaaacuuuuuuua

SEQ ID NO: 6041 - RNA, 24 nt, Gallid herpesvirus 3
gaggagagagagaaauaagcaccu

SEQ ID NO: 6042 - RNA, 24 nt, Variola virus
ucccagaacucuagaccgguguuu

SEQ ID NO: 6043 - RNA, 24 nt, Variola virus
auaaaaaaaguuuuacaaaaauau

SEQ ID NO: 6044 - RNA, 24 nt, Variola virus
uuagugguccgugggaagcuaagu

SEQ ID NO: 6045 - RNA, 24 nt, Chimpanzee cytomegalovirus
ucguuguuuuuauauauaaauaua

SEQ ID NO: 6046 - RNA, 24 nt, Chimpanzee cytomegalovirus
uaauaaauauuaauuaaaaugaua

SEQ ID NO: 6047 - RNA, 24 nt, Chimpanzee cytomegalovirus
uauuugauguauuuuagauauaau

SEQ ID NO: 6048 - RNA, 24 nt, Variola virus
uauaugauuauaguuucuauuuuu

SEQ ID NO: 6049 - RNA, 24 nt, Fowlpox virus
uacuucaucgggguaaauaguaaa

SEQ ID NO: 6050 - RNA, 24 nt, Tupaia herpesvirus
uccaaacuggugagauaauuagga

SEQ ID NO: 6051 - RNA, 24 nt, Fowlpox virus
auagaaauuacguuacuaauagau

SEQ ID NO: 6052 - RNA, 24 nt, Tupaia herpesvirus
auacuaaagugaccgagcauccac

SEQ ID NO: 6053 - RNA, 21 nt, Human herpesvirus 2
uaauucugaauggggcccgcu

SEQ ID NO: 6054 - RNA, 24 nt, Human herpesvirus 2
uggcguguacuuuauuacaacgag

SEQ ID NO: 6055 - RNA, 24 nt, Human herpesvirus 4
ucuuuuuugugaaaaaaaaauaau

SEQ ID NO: 6056 - RNA, 24 nt, Fowlpox virus
uuuaaaaucugccgugucuagucu

SEQ ID NO: 6057 - RNA, 24 nt, Fowlpox virus
ugaaagaaccguauaguuuggaac

SEQ ID NO: 6058 - RNA, 24 nt, Tupaia herpesvirus
uaugacaaucuuaagagaccaggu

SEQ ID NO: 6059 - RNA, 20 nt, Human herpesvirus 4
uuguaggcgucaaagauuaa

SEQ ID NO: 6060 - RNA, 24 nt, Fowlpox virus
uggcacaacgaggccuuuguaaca

SEQ ID NO: 6061 - RNA, 24 nt, Human herpesvirus 4
acugcuguaggcguuaaacauuau

SEQ ID NO: 6062 - RNA, 24 nt, Human herpesvirus 4
uaaagugcuauacuauaaccaucu

SEQ ID NO: 6063 - RNA, 24 nt, Fowlpox virus
uacaccacuccauuaucuauuuac

SEQ ID NO: 6064 - RNA, 24 nt, Gallid herpesvirus 2
ucgcagcucuuccccggccuccuc

SEQ ID NO: 6065 - RNA, 24 nt, Monkeypox virus
ucgcgagugacguuguggaugcgg

SEQ ID NO: 6066 - RNA, 24 nt, Monkeypox virus
aagcuuacccgcucuuggcacucc

SEQ ID NO: 6067 - RNA, 24 nt, Monkeypox virus
ugccaauaauaaauuuugcgcgaa

SEQ ID NO: 6068 - RNA, 24 nt, Lumpy skin disease virus
augcaucuuaucaauugccccgua

SEQ ID NO: 6069 - RNA, 24 nt, Murid herpesvirus 4
uuauuggaaacaaaguugucucug

SEQ ID NO: 6070 - RNA, 24 nt, Melanoplus sanguinipes entomopoxvirus
aaggucuuccgacguggcaagucu

SEQ ID NO: 6071 - RNA, 24 nt, Lumpy skin disease virus
cguucaugcccgccucguuccaga

SEQ ID NO: 6072 - RNA, 24 nt, Murid herpesvirus 4
acuuacuuaaaacacuugaauaua

SEQ ID NO: 6073 - RNA, 24 nt, Tobacco mild green mosaic virus
uccaaaguuuuaaguacggaccgc

SEQ ID NO: 6074 - RNA, 24 nt, Tobacco mild green mosaic virus
uauuggggagcacugggccaaggg

SEQ ID NO: 6075 - RNA, 24 nt, Tobacco mild green mosaic virus
uuuguugguuuaaugaguuguuug

SEQ ID NO: 6076 - RNA, 24 nt, Lumpy skin disease virus
cucgauggucucgccgcgccggcg

SEQ ID NO: 6077 - RNA, 24 nt, Lumpy skin disease virus
caggguugcguugcggugugcccc

SEQ ID NO: 6078 - RNA, 24 nt, Rat cytomegalovirus
uucauuuucaguugacggagcgac

SEQ ID NO: 6079 - RNA, 24 nt, Rat cytomegalovirus
aguaaacgcgauaauagauagugc

SEQ ID NO: 6080 - RNA, 24 nt, Murid herpesvirus 4
acugaugucucgugcgagggcuug

SEQ ID NO: 6081 - RNA, 24 nt, Tobacco mild green mosaic virus
guccauuuugaguucagcgaccgg

SEQ ID NO: 6082 - RNA, 24 nt, Rat cytomegalovirus
uaggaucuuucccggccucuacca

SEQ ID NO: 6083 - RNA, 24 nt, Rat cytomegalovirus
cuaguuguuucccauauuuggagu

SEQ ID NO: 6084 - RNA, 24 nt, Tick-borne encephalitis virus
aucagcuucucggcgagcaccuuu

SEQ ID NO: 6085 - RNA, 24 nt, Rat cytomegalovirus
uugcaaacauccucaguucgugcg

SEQ ID NO: 6086 - RNA, 24 nt, Rat cytomegalovirus
uggguagguuguuuguucugugga

SEQ ID NO: 6087 - RNA, 24 nt, Rat cytomegalovirus
ugucaaggauguggcuugcaagca

SEQ ID NO: 6088 - RNA, 24 nt, Tick-borne encephalitis virus
uaccucacugaagcggggauuggc

SEQ ID NO: 6089 - RNA, 24 nt, Cowpox virus
gccacuuuuuuuuacaaaagugaa

SEQ ID NO: 6090 - RNA, 24 nt, Tick-borne encephalitis virus
aucgaguacccaaccuuacaagaa

SEQ ID NO: 6091 - RNA, 24 nt, Cowpox virus
ugaacuacauguuguauucucaaa

SEQ ID NO: 6092 - RNA, 24 nt, Cowpox virus
uaauuuaauaguuccuaauuuaua

SEQ ID NO: 6093 - RNA, 24 nt, Cowpox virus
uguacaauuaauuggaauuuugga

SEQ ID NO: 6094 - RNA, 17 nt, Saccharomyces cerevisiae killer virus M1
cagaaauuaguugagag

SEQ ID NO: 6095 - RNA, 24 nt, Amsacta moorei entomopoxvirus
uaacuaggguuaaagguuuggcag

SEQ ID NO: 6096 - RNA, 24 nt, Amsacta moorei entomopoxvirus
uuagaucaguuuccuuugggccgu

SEQ ID NO: 6097 - RNA, 24 nt, Amsacta moorei entomopoxvirus
cuccuacuccuaguggcucccugg

SEQ ID NO: 6098 - RNA, 24 nt, Encephalomyocarditis virus
caucagaaagagguuuaauauuuu

SEQ ID NO: 6099 - RNA, 24 nt, Encephalomyocarditis virus
caucagaaagagguuuaauauuuu

SEQ ID NO: 6100 - RNA, 24 nt, Variola virus
uaucccuaugguucaguugguugu

SEQ ID NO: 6101 - RNA, 24 nt, Variola virus
cacucuaugcacugcuucgcagcg

SEQ ID NO: 6102 - RNA, 24 nt, Variola virus
uagcuuagagagucucucacggug

SEQ ID NO: 6103 - RNA, 24 nt, Cowpox virus
acuacaucaacguacgaaagaugu

SEQ ID NO: 6104 - RNA, 19 nt, Cowpox virus
ucucucacaaucugcgugg

SEQ ID NO: 6105 - RNA, 24 nt, Cowpox virus
ucaugggggacccagagugcgggc

SEQ ID NO: 6106 - RNA, 24 nt, Cowpox virus
aggggcagauccuccccgccgaac

SEQ ID NO: 6107 - RNA, 24 nt, Cowpox virus
ucuaguaucuacgucucaccucug

SEQ ID NO: 6108 - RNA, 24 nt, Cowpox virus
ugggauccuggaggacagagccag

SEQ ID NO: 6109 - RNA, 23 nt, Ateline herpesvirus 3
ggacgaggaacaccguauaccag

SEQ ID NO: 6110 - RNA, 22 nt, Ateline herpesvirus 3
aggcaucaagguuccugccgcc

SEQ ID NO: 6111 - RNA, 24 nt, Saimiriine herpesvirus 2
ugacggaaagaguuuuggccaggg

SEQ ID NO: 6112 - RNA, 24 nt, Saimiriine herpesvirus 2
uugaagccuggggaguaugaagug

SEQ ID NO: 6113 - RNA, 24 nt, Saimiriine herpesvirus 2
auggaucuauggucaaggguuguc

SEQ ID NO: 6114 - RNA, 24 nt, Saimiriine herpesvirus 2
uacaauauuuauagacuaaggaua

SEQ ID NO: 6115 - RNA, 24 nt, Saimiriine herpesvirus 2
cguucaacuuucgucgauaaccau

SEQ ID NO: 6116 - RNA, 24 nt, Saimiriine herpesvirus 2
ucccugagccuggaccugagaggu

SEQ ID NO: 6117 - RNA, 24 nt, Saimiriine herpesvirus 2
aaacugcagacugcgacguacggc

SEQ ID NO: 6118 - RNA, 24 nt, Saimiriine herpesvirus 2
ucacacggaacgagaacaagugug

SEQ ID NO: 6119 - RNA, 24 nt, Saimiriine herpesvirus 2
ugaggaacacgggcauccaugggc

SEQ ID NO: 6120 - RNA, 24 nt, Saimiriine herpesvirus 2
caugccgaacgcaacuucguacaa

SEQ ID NO: 6121 - RNA, 24 nt, Saimiriine herpesvirus 2
uguggugccuaaggacaucaggga

SEQ ID NO: 6122 - RNA, 24 nt, Rat cytomegalovirus
uuuacgcauagaagcagccuuauu

SEQ ID NO: 6123 - RNA, 24 nt, Tupaia herpesvirus
uguaauguccguauucuucaggua

SEQ ID NO: 6124 - RNA, 24 nt, Rat cytomegalovirus
ugugguuuuuagccacaguguuua

SEQ ID NO: 6125 - RNA, 24 nt, Tupaia herpesvirus
uugagucguaauugcagcaggcag

SEQ ID NO: 6126 - RNA, 24 nt, Tupaia herpesvirus
acugguuuggcgugcguacguacg

SEQ ID NO: 6127 - RNA, 24 nt, African swine fever virus
uggaauauauguugacgcagucgg

SEQ ID NO: 6128 - RNA, 24 nt, Ectromelia virus
uauaauaaaucguguguaucucaa

SEQ ID NO: 6129 - RNA, 24 nt, Ectromelia virus
ucucugcggcucgcguucgcguuc

SEQ ID NO: 6130 - RNA, 24 nt, Equine herpesvirus 2
uaucuuaagauaguagcuuuucug

SEQ ID NO: 6131 - RNA, 24 nt, Equine herpesvirus 2
uaugggucucagaugccuggcggc

SEQ ID NO: 6132 - RNA, 24 nt, Equine herpesvirus 2
uaagaguuuuaucuaaagauuuuu

SEQ ID NO: 6133 - RNA, 24 nt, Equine herpesvirus 2
gucaaguaccuggacgucuuucug

SEQ ID NO: 6134 - RNA, 24 nt, Equine herpesvirus 2
uauuaggagaaauuauaagacaau

SEQ ID NO: 6135 - RNA, 24 nt, Equine herpesvirus 2
ugcacagucucgggccugaaggga

SEQ ID NO: 6136 - RNA, 24 nt, Human herpesvirus 7
acuggucgggguaggcguggagag

SEQ ID NO: 6137 - RNA, 24 nt, Human herpesvirus 7
uccaggacacaaucucugcuagag

SEQ ID NO: 6138 - RNA, 24 nt, Human herpesvirus 7
cugcgcccucaggucccucugcca

SEQ ID NO: 6139 - RNA, 24 nt, Human herpesvirus 7
ucccccagucccuggcccccgccg

SEQ ID NO: 6140 - RNA, 24 nt, Human herpesvirus 7
gcgggccauggucgccuucgacca

SEQ ID NO: 6141 - RNA, 22 nt, Homo sapiens
gaacaggacuccagcaaagcac

SEQ ID NO: 6142 - RNA, 22 nt, Homo sapiens
gcaaagcacuuuucagccuugu

SEQ ID NO: 6143 - RNA, 22 nt, Homo sapiens
caauauuaaauguuuucuagca

SEQ ID NO: 6144 - RNA, 18 nt, Homo sapiens
guuuaggauuuucuucaa

SEQ ID NO: 6145 - RNA, 16 nt, Homo sapiens
uauuugauguuuagga

SEQ ID NO: 6146 - RNA, 21 nt, Homo sapiens
aaccuauguaguuuucuaggu

SEQ ID NO: 6147 - RNA, 21 nt, Homo sapiens
acuccucuggucccgcccacu

SEQ ID NO: 6148 - RNA, 23 nt, Homo sapiens
gcgggguggcagcgguccccggc

SEQ ID NO: 6149 - RNA, 24 nt, Homo sapiens
uaaaaaccaaaccugcuuaagaga

SEQ ID NO: 6150 - RNA, 18 nt, Homo sapiens
uggcucccguuccggcca

SEQ ID NO: 6151 - RNA, 21 nt, Homo sapiens
aggcggagcugccaauggucg

SEQ ID NO: 6152 - RNA, 19 nt, Homo sapiens
ccccagggagcccccgccg

SEQ ID NO: 6153 - RNA, 22 nt, Homo sapiens
ccgggguugggguggaggcccc

SEQ ID NO: 6154 - RNA, 17 nt, Homo sapiens
gccgggguuggggugga

SEQ ID NO: 6155 - RNA, 19 nt, Homo sapiens
aaggggcuucggcuuuggc

SEQ ID NO: 6156 - RNA, 16 nt, Homo sapiens
acgcccgcguccugca

SEQ ID NO: 6157 - RNA, 18 nt, Homo sapiens
cuucgggacaaaccaggg

SEQ ID NO: 6158 - RNA, 19 nt, Homo sapiens
gaacacuaggccccuucgg

SEQ ID NO: 6159 - RNA, 19 nt, Homo sapiens
cacugauuacagcaggccu

SEQ ID NO: 6160 - RNA, 18 nt, Homo sapiens
cagagggcugaguaucgg

SEQ ID NO: 6161 - RNA, 24 nt, Homo sapiens
acggcgggcugggguccggcgcgg

SEQ ID NO: 6162 - RNA, 19 nt, Homo sapiens
ccacugccccccacccccc

SEQ ID NO: 6163 - RNA, 16 nt, Homo sapiens
cggaccgggcuggagc

SEQ ID NO: 6164 - RNA, 19 nt, Homo sapiens
cggcgcggccccggaccgg

SEQ ID NO: 6165 - RNA, 25 nt, Homo sapiens
gccccggaccgggcuggagccgggg

SEQ ID NO: 6166 - RNA, 19 nt, Homo sapiens
ggguccggcgcggccccgg

SEQ ID NO: 6167 - RNA, 20 nt, Homo sapiens
guauuuuuggcugggugggc

SEQ ID NO: 6168 - RNA, 16 nt, Homo sapiens
ucugcggguggcgggg

SEQ ID NO: 6169 - RNA, 18 nt, Homo sapiens
aacaggcuaugguugugu

SEQ ID NO: 6170 - RNA, 18 nt, Homo sapiens
accccaccccacccccuc

SEQ ID NO: 6171 - RNA, 17 nt, Homo sapiens
accccacccccucuccc

SEQ ID NO: 6172 - RNA, 20 nt, Homo sapiens
cucccugcuuguuuagagcc

SEQ ID NO: 6173 - RNA, 23 nt, Homo sapiens
aagaggauggugaaaacccacuu

SEQ ID NO: 6174 - RNA, 21 nt, Homo sapiens
agcaguaauaagggaaccaga

SEQ ID NO: 6175 - RNA, 19 nt, Homo sapiens
aggugagugggaagguaga

SEQ ID NO: 6176 - RNA, 21 nt, Homo sapiens
auaaaaccccaaaucuugguc

SEQ ID NO: 6177 - RNA, 17 nt, Homo sapiens
ccacagccagcccaucc

SEQ ID NO: 6178 - RNA, 17 nt, Homo sapiens
ccugcugcucucagccu

SEQ ID NO: 6179 - RNA, 20 nt, Homo sapiens
gaagauuaggaagaaaagag

SEQ ID NO: 6180 - RNA, 19 nt, Homo sapiens
ugagagaggccacugcuug

SEQ ID NO: 6181 - RNA, 20 nt, Homo sapiens
uggcuaaagugagagaggcc

SEQ ID NO: 6182 - RNA, 21 nt, Homo sapiens
aggaaagcaccaugggaagaa

SEQ ID NO: 6183 - RNA, 20 nt, Homo sapiens
aggaacacuagaugaugaga

SEQ ID NO: 6184 - RNA, 20 nt, Homo sapiens
cguacauguacauuuauuaa

SEQ ID NO: 6185 - RNA, 24 nt, Homo sapiens
cugagaaagcacgcgcacaacuuc

SEQ ID NO: 6186 - RNA, 20 nt, Homo sapiens
uaugaugauuccuuuugggu

SEQ ID NO: 6187 - RNA, 24 nt, Homo sapiens
uguagaguugucauacagagaguu

SEQ ID NO: 6188 - RNA, 18 nt, Homo sapiens
uuaguaaaauuacaguac

SEQ ID NO: 6189 - RNA, 20 nt, Homo sapiens
cugcuggccuuugccucaaa

SEQ ID NO: 6190 - RNA, 18 nt, Homo sapiens
ccuggggcugcacuggcc

SEQ ID NO: 6191 - RNA, 17 nt, Homo sapiens
ugccugguucugccucc

SEQ ID NO: 6192 - RNA, 19 nt, Homo sapiens
acagggcccagucacugug

SEQ ID NO: 6193 - RNA, 16 nt, Homo sapiens
ccacggagauggcuac

SEQ ID NO: 6194 - RNA, 16 nt, Homo sapiens
cccucuccccucuccc

SEQ ID NO: 6195 - RNA, 19 nt, Homo sapiens
ccucuccaccuucuccucc

SEQ ID NO: 6196 - RNA, 22 nt, Homo sapiens
cucggcugcgcugcuguguggc

SEQ ID NO: 6197 - RNA, 16 nt, Homo sapiens
ggccuugagaggucuc

SEQ ID NO: 6198 - RNA, 19 nt, Homo sapiens
ggcggcuggcaguguaggc

SEQ ID NO: 6199 - RNA, 19 nt, Homo sapiens
ggcugcgcugcuguguggc

SEQ ID NO: 6200 - RNA, 17 nt, Homo sapiens
gggagccggggccccac

SEQ ID NO: 6201 - RNA, 21 nt, Homo sapiens
gggcagagggggcgucucuuc

SEQ ID NO: 6202 - RNA, 19 nt, Homo sapiens
ggggcggggcaggggccgg

SEQ ID NO: 6203 - RNA, 21 nt, Homo sapiens
gggguggugcccggcccgagg

SEQ ID NO: 6204 - RNA, 20 nt, Homo sapiens
ggguggugcccggcccgagg

SEQ ID NO: 6205 - RNA, 18 nt, Homo sapiens
gugcgucccucuccccuc

SEQ ID NO: 6206 - RNA, 16 nt, Homo sapiens
ucagggccuugagagg

SEQ ID NO: 6207 - RNA, 30 nt, Homo sapiens
uccccucucccgugggaucuuuggggcucg

SEQ ID NO: 6208 - RNA, 18 nt, Homo sapiens
ucucgggcagagggggcg

SEQ ID NO: 6209 - RNA, 16 nt, Homo sapiens
ugcccuggacagggcc

SEQ ID NO: 6210 - RNA, 20 nt, Homo sapiens
uuuacuggggggacuggggg

SEQ ID NO: 6211 - RNA, 17 nt, Homo sapiens
gaggaggcggccuccuc

SEQ ID NO: 6212 - RNA, 19 nt, Homo sapiens
uccuugauucuaggauagc

SEQ ID NO: 6213 - RNA, 15 nt, Homo sapiens
agcagcuucuugucc

SEQ ID NO: 6214 - RNA, 23 nt, Homo sapiens
aggggggccaggcaugagguggg

SEQ ID NO: 6215 - RNA, 18 nt, Homo sapiens
ugccuggaggggggccag

SEQ ID NO: 6216 - RNA, 21 nt, Homo sapiens
caggaggacggcuggggcggg

SEQ ID NO: 6217 - RNA, 20 nt, Homo sapiens
gcguggggucgcauggcugc

SEQ ID NO: 6218 - RNA, 15 nt, Homo sapiens
gggcggggacagggu

SEQ ID NO: 6219 - RNA, 23 nt, Homo sapiens
aggaggaugggaaggaagccucg

SEQ ID NO: 6220 - RNA, 21 nt, Homo sapiens
aggcagcuccgccugggcagc

SEQ ID NO: 6221 - RNA, 14 nt, Homo sapiens
guucuuuagguggu

SEQ ID NO: 6222 - RNA, 17 nt, Homo sapiens
uaaggagaaucuuaaau

SEQ ID NO: 6223 - RNA, 22 nt, Homo sapiens
uaucugcuucaguuuauaacua

SEQ ID NO: 6224 - RNA, 25 nt, Homo sapiens
uauugaacauuuucggggguggggg

SEQ ID NO: 6225 - RNA, 17 nt, Homo sapiens
ucucuagaauuaucaga

SEQ ID NO: 6226 - RNA, 19 nt, Homo sapiens
aggaggagguggagagaga

SEQ ID NO: 6227 - RNA, 21 nt, Homo sapiens
aggagguggagagagaguggg

SEQ ID NO: 6228 - RNA, 28 nt, Homo sapiens
agggggggaaggcaggguggggggaggc

SEQ ID NO: 6229 - RNA, 19 nt, Homo sapiens
aggguggggggaggcgggg

SEQ ID NO: 6230 - RNA, 19 nt, Homo sapiens
ccggaccgucccgcucucc

SEQ ID NO: 6231 - RNA, 17 nt, Homo sapiens
cgggggcgggggggcgg

SEQ ID NO: 6232 - RNA, 23 nt, Homo sapiens
gagggggggaaggcagggugggg

SEQ ID NO: 6233 - RNA, 17 nt, Homo sapiens
gcgggggggcggguggg

SEQ ID NO: 6234 - RNA, 18 nt, Homo sapiens
ggagaggaggaggacaaa

SEQ ID NO: 6235 - RNA, 22 nt, Homo sapiens
ggagggggggaaggcagggugg

SEQ ID NO: 6236 - RNA, 18 nt, Homo sapiens
ggcgggggggcggguggg

SEQ ID NO: 6237 - RNA, 21 nt, Homo sapiens
ggcggguggggagaagggugg

SEQ ID NO: 6238 - RNA, 18 nt, Homo sapiens
gggcgggggggcgggugg

SEQ ID NO: 6239 - RNA, 19 nt, Homo sapiens
ggggaaggcaggguggggg

SEQ ID NO: 6240 - RNA, 16 nt, Homo sapiens
ggggagggggggaagg

SEQ ID NO: 6241 - RNA, 20 nt, Homo sapiens
ggggcgggggggcggguggg

SEQ ID NO: 6242 - RNA, 20 nt, Homo sapiens
ggggggcggguggggagaag

SEQ ID NO: 6243 - RNA, 21 nt, Homo sapiens
ggggggcggguggggagaagg

SEQ ID NO: 6244 - RNA, 22 nt, Homo sapiens
ggggggcggguggggagaaggg

SEQ ID NO: 6245 - RNA, 20 nt, Homo sapiens
gguggggggaggcggggugg

SEQ ID NO: 6246 - RNA, 23 nt, Homo sapiens
ucuaaacuucccguggcauaaga

SEQ ID NO: 6247 - RNA, 17 nt, Homo sapiens
ugcgggaagcuccagag

SEQ ID NO: 6248 - RNA, 25 nt, Homo sapiens
uguagaguuuauacuaauuggaaaa

SEQ ID NO: 6249 - RNA, 16 nt, Homo sapiens
cagauuuuaucagcuu

SEQ ID NO: 6250 - RNA, 17 nt, Homo sapiens
cccgccgccuccgaccc

SEQ ID NO: 6251 - RNA, 18 nt, Homo sapiens
gagcaagagaagggccaa

SEQ ID NO: 6252 - RNA, 20 nt, Homo sapiens
gugcaggcauuuugcuguug

SEQ ID NO: 6253 - RNA, 20 nt, Homo sapiens
uccccggcaauuaaauuugc

SEQ ID NO: 6254 - RNA, 22 nt, Homo sapiens
uaagacaccguguaagauguaa

SEQ ID NO: 6255 - RNA, 24 nt, Homo sapiens
uaugauaucuuuaaagauauauua

SEQ ID NO: 6256 - RNA, 21 nt, Homo sapiens
aaaagauauuuuugccaacag

SEQ ID NO: 6257 - RNA, 23 nt, Homo sapiens
aaacugaaagcauggaggauggc

SEQ ID NO: 6258 - RNA, 17 nt, Homo sapiens
cacccagagaaaaaaac

SEQ ID NO: 6259 - RNA, 17 nt, Homo sapiens
caccugauuuuaagacu

SEQ ID NO: 6260 - RNA, 24 nt, Homo sapiens
cugaaauuaucucuuugauuauuu

SEQ ID NO: 6261 - RNA, 18 nt, Homo sapiens
cuuugcuucugguaaugg

SEQ ID NO: 6262 - RNA, 21 nt, Homo sapiens
gggagggagaaggaggcaugc

SEQ ID NO: 6263 - RNA, 22 nt, Homo sapiens
uaaaacuagauguuuuauacac

SEQ ID NO: 6264 - RNA, 27 nt, Homo sapiens
uacauauauauguguguauauauauau

SEQ ID NO: 6265 - RNA, 26 nt, Homo sapiens
uauauauauguaugugaauacacaga

SEQ ID NO: 6266 - RNA, 18 nt, Homo sapiens
ugaaagcauggaggaugg

SEQ ID NO: 6267 - RNA, 23 nt, Homo sapiens
ugaguucaaaagcaugaauaucu

SEQ ID NO: 6268 - RNA, 18 nt, Homo sapiens
ugggagggagaaggaggc

SEQ ID NO: 6269 - RNA, 22 nt, Homo sapiens
uuaaaguuuuggaaacaucuug

SEQ ID NO: 6270 - RNA, 18 nt, Homo sapiens
uuccugguuucucuaucc

SEQ ID NO: 6271 - RNA, 17 nt, Homo sapiens
uugggaggccaaggcgg

SEQ ID NO: 6272 - RNA, 19 nt, Homo sapiens
uuguaaacuuugcaugugu

SEQ ID NO: 6273 - RNA, 19 nt, Homo sapiens
uuugccaacagauaaacgc

SEQ ID NO: 6274 - RNA, 20 nt, Homo sapiens
aauguggacaguaauagcua

SEQ ID NO: 6275 - RNA, 15 nt, Homo sapiens
ccguucugcugcucu

SEQ ID NO: 6276 - RNA, 21 nt, Homo sapiens
cuccuuuucugaagccccugg

SEQ ID NO: 6277 - RNA, 19 nt, Homo sapiens
ggagagcgugguguuaaag

SEQ ID NO: 6278 - RNA, 20 nt, Homo sapiens
gggcuggagucggggggcug

SEQ ID NO: 6279 - RNA, 19 nt, Homo sapiens
ucggcgcggcgcggcucgg

SEQ ID NO: 6280 - RNA, 24 nt, Homo sapiens
ucuaauauugcaugaaauguuuuu

SEQ ID NO: 6281 - RNA, 20 nt, Homo sapiens
ucuacuaguuugcucccaaa

SEQ ID NO: 6282 - RNA, 18 nt, Homo sapiens
ugaugcacacagacaggc

SEQ ID NO: 6283 - RNA, 20 nt, Homo sapiens
aagcucuccucauacagcug

SEQ ID NO: 6284 - RNA, 22 nt, Homo sapiens
aguggcucccaggaccagcccc

SEQ ID NO: 6285 - RNA, 14 nt, Homo sapiens
gagcuucucaaagc

SEQ ID NO: 6286 - RNA, 18 nt, Homo sapiens
gcagaugccuguuggcgu

SEQ ID NO: 6287 - RNA, 17 nt, Homo sapiens
gccuggaggugaugugc

SEQ ID NO: 6288 - RNA, 21 nt, Homo sapiens
ggcagguguucugagggccug

SEQ ID NO: 6289 - RNA, 16 nt, Homo sapiens
ggccucugcugcagcc

SEQ ID NO: 6290 - RNA, 18 nt, Homo sapiens
uauguucuauaaagggua

SEQ ID NO: 6291 - RNA, 17 nt, Homo sapiens
uaucacacacauaauau

SEQ ID NO: 6292 - RNA, 23 nt, Homo sapiens
cccuuuuuuuuuuucuucguaaa

SEQ ID NO: 6293 - RNA, 20 nt, Homo sapiens
uccccuuuuuuuuuuucuuc

SEQ ID NO: 6294 - RNA, 19 nt, Homo sapiens
agggaaucaaagaagaggu

SEQ ID NO: 6295 - RNA, 18 nt, Homo sapiens
cgcagcagacacuggccc

SEQ ID NO: 6296 - RNA, 18 nt, Homo sapiens
uuaaugcagguagcuucc

SEQ ID NO: 6297 - RNA, 23 nt, Homo sapiens
cgggagguggggcagcgaggcag

SEQ ID NO: 6298 - RNA, 17 nt, Homo sapiens
uucccagcuugugugcg

SEQ ID NO: 6299 - RNA, 20 nt, Homo sapiens
agccagccagggggcggggc

SEQ ID NO: 6300 - RNA, 18 nt, Homo sapiens
aggaguggggggcaggag

SEQ ID NO: 6301 - RNA, 21 nt, Homo sapiens
agggggcggggcaggaguggg

SEQ ID NO: 6302 - RNA, 18 nt, Homo sapiens
cccugcugagccagccag

SEQ ID NO: 6303 - RNA, 17 nt, Homo sapiens
gccuggagauuuuaaug

SEQ ID NO: 6304 - RNA, 17 nt, Homo sapiens
uccugcaggugggagug

SEQ ID NO: 6305 - RNA, 17 nt, Homo sapiens
aaauguccagaacaggg

SEQ ID NO: 6306 - RNA, 17 nt, Homo sapiens
cuccccgccccuuccug

SEQ ID NO: 6307 - RNA, 19 nt, Homo sapiens
guccagaacagggaaaacc

SEQ ID NO: 6308 - RNA, 18 nt, Homo sapiens
uaacgaggggagacggau

SEQ ID NO: 6309 - RNA, 19 nt, Homo sapiens
uccuggacucuucucucuu

SEQ ID NO: 6310 - RNA, 20 nt, Homo sapiens
ugaaacgugcguccuggccc

SEQ ID NO: 6311 - RNA, 19 nt, Homo sapiens
ugccaggccaggcaguuac

SEQ ID NO: 6312 - RNA, 19 nt, Homo sapiens
ugucaugggauccuggugu

SEQ ID NO: 6313 - RNA, 22 nt, Homo sapiens
cuuuggcacagugcuuuauugu

SEQ ID NO: 6314 - RNA, 18 nt, Homo sapiens
uauugugcuauuguuaca

SEQ ID NO: 6315 - RNA, 18 nt, Homo sapiens
gcugaaagucucucugcu

SEQ ID NO: 6316 - RNA, 18 nt, Homo sapiens
gggaacugaauaggagga

SEQ ID NO: 6317 - RNA, 21 nt, Homo sapiens
agagagacugaaagagagaga

SEQ ID NO: 6318 - RNA, 25 nt, Homo sapiens
agagagacugggggagggaagagac

SEQ ID NO: 6319 - RNA, 21 nt, Homo sapiens
agagagauggagagagagaga

SEQ ID NO: 6320 - RNA, 19 nt, Homo sapiens
agagagauugagaaagaga

SEQ ID NO: 6321 - RNA, 20 nt, Homo sapiens
agagagauuggaagaaagag

SEQ ID NO: 6322 - RNA, 20 nt, Homo sapiens
caguuaacagggggugggcu

SEQ ID NO: 6323 - RNA, 21 nt, Homo sapiens
cugugugugugugugugugua

SEQ ID NO: 6324 - RNA, 17 nt, Homo sapiens
gagauggagagagagag

SEQ ID NO: 6325 - RNA, 16 nt, Homo sapiens
gaggguggcggggggg

SEQ ID NO: 6326 - RNA, 16 nt, Homo sapiens
gagguugagagagaga

SEQ ID NO: 6327 - RNA, 19 nt, Homo sapiens
gcggggggggggggggggg

SEQ ID NO: 6328 - RNA, 14 nt, Homo sapiens
gggggggggggggg

SEQ ID NO: 6329 - RNA, 15 nt, Homo sapiens
ggggggggggggggg

SEQ ID NO: 6330 - RNA, 16 nt, Homo sapiens
gggggggggggggggg

SEQ ID NO: 6331 - RNA, 21 nt, Homo sapiens
ggggggggggggggguuucgg

SEQ ID NO: 6332 - RNA, 17 nt, Homo sapiens
gguggcggggggggggg

SEQ ID NO: 6333 - RNA, 17 nt, Homo sapiens
ugggggagggaagagac

SEQ ID NO: 6334 - RNA, 18 nt, Homo sapiens
ugggggagggaagagacu

SEQ ID NO: 6335 - RNA, 18 nt, Homo sapiens
ugugugugugugugugug

SEQ ID NO: 6336 - RNA, 24 nt, Homo sapiens
ugggaggggaaugucauuaaggca

SEQ ID NO: 6337 - RNA, 20 nt, Homo sapiens
gugguggacucuucugcguc

SEQ ID NO: 6338 - RNA, 19 nt, Homo sapiens
ugccccggcagguucccuc

SEQ ID NO: 6339 - RNA, 19 nt, Homo sapiens
uugcacaguuuucaaaauu

SEQ ID NO: 6340 - RNA, 19 nt, Homo sapiens
cccgagccguucagccugg

SEQ ID NO: 6341 - RNA, 18 nt, Homo sapiens
ccugcccuucucugcucu

SEQ ID NO: 6342 - RNA, 22 nt, Homo sapiens
ccccccucuccucuucuagccc

SEQ ID NO: 6343 - RNA, 15 nt, Homo sapiens
cccuccccccucccc

SEQ ID NO: 6344 - RNA, 20 nt, Homo sapiens
cuugcuuucuggaagacugg

SEQ ID NO: 6345 - RNA, 15 nt, Homo sapiens
gaugggcagugcugg

SEQ ID NO: 6346 - RNA, 17 nt, Homo sapiens
uccaggguggggaagaa

SEQ ID NO: 6347 - RNA, 14 nt, Homo sapiens
ugguucccacccgc

SEQ ID NO: 6348 - RNA, 17 nt, Homo sapiens
gccgcgucgacgcggcc

SEQ ID NO: 6349 - RNA, 21 nt, Homo sapiens
ccuccacuugcugauccucug

SEQ ID NO: 6350 - RNA, 17 nt, Homo sapiens
gaagaaagaauaaaaua

SEQ ID NO: 6351 - RNA, 18 nt, Homo sapiens
ccaggccuuggccugcuu

SEQ ID NO: 6352 - RNA, 22 nt, Homo sapiens
cuuuaugaggaggucgugggag

SEQ ID NO: 6353 - RNA, 24 nt, Homo sapiens
gccuuggccugcuugccccugucc

SEQ ID NO: 6354 - RNA, 19 nt, Homo sapiens
uuuaugaggaggucguggg

SEQ ID NO: 6355 - RNA, 20 nt, Homo sapiens
aaaggauuuaugaaacaaaa

SEQ ID NO: 6356 - RNA, 23 nt, Homo sapiens
agacaggaguugaugugcaaugg

SEQ ID NO: 6357 - RNA, 18 nt, Homo sapiens
gaagggagacaaaagggu

SEQ ID NO: 6358 - RNA, 21 nt, Homo sapiens
accugcguccugaggaucccg

SEQ ID NO: 6359 - RNA, 18 nt, Homo sapiens
ccggucccagcuccggcu

SEQ ID NO: 6360 - RNA, 23 nt, Homo sapiens
aaguugguugggugggagggagc

SEQ ID NO: 6361 - RNA, 26 nt, Homo sapiens
aggaguggaggggaggccaagggggg

SEQ ID NO: 6362 - RNA, 22 nt, Homo sapiens
aggggagauguugcaagagcca

SEQ ID NO: 6363 - RNA, 18 nt, Homo sapiens
aguggaggggaggccaag

SEQ ID NO: 6364 - RNA, 23 nt, Homo sapiens
aguggaggggaggccaagggggg

SEQ ID NO: 6365 - RNA, 19 nt, Homo sapiens
cagcgggcugggcuggagc

SEQ ID NO: 6366 - RNA, 16 nt, Homo sapiens
cauaacccaacgggca

SEQ ID NO: 6367 - RNA, 20 nt, Homo sapiens
ccacuuggguguuugagcau

SEQ ID NO: 6368 - RNA, 22 nt, Homo sapiens
ccagggccugggggugcugggc

SEQ ID NO: 6369 - RNA, 19 nt, Homo sapiens
cccaacgggcagaaaggga

SEQ ID NO: 6370 - RNA, 24 nt, Homo sapiens
ccuccgaacccagugaggggcugg

SEQ ID NO: 6371 - RNA, 28 nt, Homo sapiens
cgggcugagggugggggccacuugggug

SEQ ID NO: 6372 - RNA, 18 nt, Homo sapiens
cuccugcuccgaccccga

SEQ ID NO: 6373 - RNA, 23 nt, Homo sapiens
cugagggugggggccacuugggu

SEQ ID NO: 6374 - RNA, 16 nt, Homo sapiens
cuguuuccggguuggg

SEQ ID NO: 6375 - RNA, 20 nt, Homo sapiens
gcccuuccugacucuccucc

SEQ ID NO: 6376 - RNA, 18 nt, Homo sapiens
ggagagaggucggagagc

SEQ ID NO: 6377 - RNA, 19 nt, Homo sapiens
gggcaggagcgggcugagg

SEQ ID NO: 6378 - RNA, 24 nt, Homo sapiens
gggcaggagcgggcugaggguggg

SEQ ID NO: 6379 - RNA, 17 nt, Homo sapiens
ggggaggccaagggggg

SEQ ID NO: 6380 - RNA, 18 nt, Homo sapiens
gguuuuuggucauguucg

SEQ ID NO: 6381 - RNA, 17 nt, Homo sapiens
ucguggcccuuccugac

SEQ ID NO: 6382 - RNA, 17 nt, Homo sapiens
ugggagcgccagauggc

SEQ ID NO: 6383 - RNA, 25 nt, Homo sapiens
agaagaaauggcaaagagaaaguuu

SEQ ID NO: 6384 - RNA, 17 nt, Homo sapiens
agcaaguagaugugcag

SEQ ID NO: 6385 - RNA, 26 nt, Homo sapiens
cagaagaaauggaaggauucagcuuu

SEQ ID NO: 6386 - RNA, 18 nt, Homo sapiens
cauacuuuuaauugggaa

SEQ ID NO: 6387 - RNA, 17 nt, Homo sapiens
ugggaaaguguuuugag

SEQ ID NO: 6388 - RNA, 16 nt, Homo sapiens
ugggggagcgggggaa

SEQ ID NO: 6389 - RNA, 22 nt, Homo sapiens
uucuuuuucucuuuugcccaca

SEQ ID NO: 6390 - RNA, 19 nt, Homo sapiens
ucuuucugaugggagacau

SEQ ID NO: 6391 - RNA, 23 nt, Homo sapiens
ugugcaaaaaggagaaaagaaaa

SEQ ID NO: 6392 - RNA, 17 nt, Homo sapiens
cagcgcgcucugggagc

SEQ ID NO: 6393 - RNA, 19 nt, Homo sapiens
gaggaagcuacuguauaug

SEQ ID NO: 6394 - RNA, 20 nt, Homo sapiens
auaaagcuuuuugggaagga

SEQ ID NO: 6395 - RNA, 22 nt, Homo sapiens
ccgcaaguuggaggcgggcugg

SEQ ID NO: 6396 - RNA, 16 nt, Homo sapiens
ccgccgcgggcgcggg

SEQ ID NO: 6397 - RNA, 18 nt, Homo sapiens
ccgcugccucuucgcggc

SEQ ID NO: 6398 - RNA, 15 nt, Homo sapiens
cggggaacgcggacc

SEQ ID NO: 6399 - RNA, 18 nt, Homo sapiens
cucaguaaaauaagagua

SEQ ID NO: 6400 - RNA, 19 nt, Homo sapiens
cucccgcuuaaucugggca

SEQ ID NO: 6401 - RNA, 21 nt, Homo sapiens
cuggauccgcgcccaccugcc

SEQ ID NO: 6402 - RNA, 16 nt, Homo sapiens
ggauccgcgcccaccu

SEQ ID NO: 6403 - RNA, 14 nt, Homo sapiens
gggaaggagaaagg

SEQ ID NO: 6404 - RNA, 18 nt, Homo sapiens
uaagugcacggaaacaaa

SEQ ID NO: 6405 - RNA, 26 nt, Homo sapiens
uaauguuuuauauucaucugugaugu

SEQ ID NO: 6406 - RNA, 18 nt, Homo sapiens
uaguacuuaaaaaauauu

SEQ ID NO: 6407 - RNA, 20 nt, Homo sapiens
ucaaacuguugccuugguac

SEQ ID NO: 6408 - RNA, 24 nt, Homo sapiens
ugaacagguugaacuuuuaggagg

SEQ ID NO: 6409 - RNA, 18 nt, Homo sapiens
ugagugcaagaagcugug

SEQ ID NO: 6410 - RNA, 21 nt, Homo sapiens
uggaggcgggcuggaggcggg

SEQ ID NO: 6411 - RNA, 25 nt, Homo sapiens
ugugauguguuuaugcuaacgucgc

SEQ ID NO: 6412 - RNA, 18 nt, Homo sapiens
uucaauuguuugagauac

SEQ ID NO: 6413 - RNA, 15 nt, Homo sapiens
accucggcacccccc

SEQ ID NO: 6414 - RNA, 22 nt, Homo sapiens
ccguucuucuuuguggcggcgg

SEQ ID NO: 6415 - RNA, 18 nt, Homo sapiens
cguagaugaagucaggug

SEQ ID NO: 6416 - RNA, 15 nt, Homo sapiens
gagcccgggcucggc

SEQ ID NO: 6417 - RNA, 16 nt, Homo sapiens
gcgcgggucacggccc

SEQ ID NO: 6418 - RNA, 22 nt, Homo sapiens
ggagguuguuaaaaacggaggc

SEQ ID NO: 6419 - RNA, 19 nt, Homo sapiens
ggcgcgcucgcccacgggc

SEQ ID NO: 6420 - RNA, 16 nt, Homo sapiens
ucgccuccuccuccuc

SEQ ID NO: 6421 - RNA, 20 nt, Homo sapiens
uggggaccucggcacccccc

SEQ ID NO: 6422 - RNA, 25 nt, Homo sapiens
ugggucgggcgagcuggggggcugg

SEQ ID NO: 6423 - RNA, 17 nt, Homo sapiens
cacucgcacgcucacgu

SEQ ID NO: 6424 - RNA, 20 nt, Homo sapiens
ccgccucugucccuugcucc

SEQ ID NO: 6425 - RNA, 19 nt, Homo sapiens
gccucugucccuugcuccc

SEQ ID NO: 6426 - RNA, 22 nt, Homo sapiens
ucaucacaggcuugggucaagg

SEQ ID NO: 6427 - RNA, 20 nt, Homo sapiens
aggauuauucuuagucucaa

SEQ ID NO: 6428 - RNA, 19 nt, Homo sapiens
uuguggcacaaaugaaaac

SEQ ID NO: 6429 - RNA, 18 nt, Homo sapiens
aaccucuauuuccucacc

SEQ ID NO: 6430 - RNA, 18 nt, Homo sapiens
agcuuuucaucugcccag

SEQ ID NO: 6431 - RNA, 17 nt, Homo sapiens
caagccuguagcuggcu

SEQ ID NO: 6432 - RNA, 22 nt, Homo sapiens
ugaugaggaagugaugguagcu

SEQ ID NO: 6433 - RNA, 17 nt, Homo sapiens
ugcucgucucccuuccc

SEQ ID NO: 6434 - RNA, 19 nt, Homo sapiens
aaggccgccugcugccuuc

SEQ ID NO: 6435 - RNA, 23 nt, Homo sapiens
aggaagagaaaugcaaaagcagc

SEQ ID NO: 6436 - RNA, 18 nt, Homo sapiens
caaaagcagcugcagaau

SEQ ID NO: 6437 - RNA, 16 nt, Homo sapiens
gaggaugacuuuguca

SEQ ID NO: 6438 - RNA, 23 nt, Homo sapiens
cagcaguggaguagaagagcugu

SEQ ID NO: 6439 - RNA, 18 nt, Homo sapiens
ggagaagggugggggguu

SEQ ID NO: 6440 - RNA, 19 nt, Homo sapiens
guuguggggccacauaggg

SEQ ID NO: 6441 - RNA, 24 nt, Homo sapiens
acuuuuuuaauagccuauuugaga

SEQ ID NO: 6442 - RNA, 18 nt, Homo sapiens
agcaauuugcuuauagag

SEQ ID NO: 6443 - RNA, 23 nt, Homo sapiens
aggcaaaaggauaaauccaccca

SEQ ID NO: 6444 - RNA, 20 nt, Homo sapiens
auuuugguaaugguguccca

SEQ ID NO: 6445 - RNA, 20 nt, Homo sapiens
caacuaugcacuguagcuau

SEQ ID NO: 6446 - RNA, 21 nt, Homo sapiens
cacauuucucaaucuaaaaaa

SEQ ID NO: 6447 - RNA, 26 nt, Homo sapiens
cgccgagccccgcugcccuuggggac

SEQ ID NO: 6448 - RNA, 19 nt, Homo sapiens
cgucgucagugccaggagc

SEQ ID NO: 6449 - RNA, 17 nt, Homo sapiens
gcccuuggggaccuggc

SEQ ID NO: 6450 - RNA, 16 nt, Homo sapiens
ggacaccugcugcccu

SEQ ID NO: 6451 - RNA, 19 nt, Homo sapiens
ggucacauaauuuaaagcu

SEQ ID NO: 6452 - RNA, 22 nt, Homo sapiens
gucaguuguaaugggaguucug

SEQ ID NO: 6453 - RNA, 16 nt, Homo sapiens
ucacacaguuguguca

SEQ ID NO: 6454 - RNA, 19 nt, Homo sapiens
ucaguguuucucucuuuuc

SEQ ID NO: 6455 - RNA, 21 nt, Homo sapiens
ucuuuccuucuuuucaguguu

SEQ ID NO: 6456 - RNA, 19 nt, Homo sapiens
uguuauaaaaauaagaaca

SEQ ID NO: 6457 - RNA, 24 nt, Homo sapiens
uuaaagcuuggcuggcuuuuuuuu

SEQ ID NO: 6458 - RNA, 22 nt, Homo sapiens
uuccaugucaaaaauagguggu

SEQ ID NO: 6459 - RNA, 22 nt, Homo sapiens
cacugagaggagaaaagucauu

SEQ ID NO: 6460 - RNA, 19 nt, Homo sapiens
cccucugcuaccacccacu

SEQ ID NO: 6461 - RNA, 17 nt, Homo sapiens
cugcuugaucccucugc

SEQ ID NO: 6462 - RNA, 21 nt, Homo sapiens
gccucuggggagaaacaaggc

SEQ ID NO: 6463 - RNA, 18 nt, Homo sapiens
ggaggauugagaggccuc

SEQ ID NO: 6464 - RNA, 14 nt, Homo sapiens
ugccccagguccca

SEQ ID NO: 6465 - RNA, 18 nt, Homo sapiens
agcugugagaauauccug

SEQ ID NO: 6466 - RNA, 19 nt, Homo sapiens
gguuaaauaaaacaaguga

SEQ ID NO: 6467 - RNA, 16 nt, Homo sapiens
ucaggaaugugacuuc

SEQ ID NO: 6468 - RNA, 20 nt, Homo sapiens
ugaaugacugacuuguuucc

SEQ ID NO: 6469 - RNA, 21 nt, Homo sapiens
ugaaugcccacguauuugagu

SEQ ID NO: 6470 - RNA, 23 nt, Homo sapiens
aaaacuacugccaucuggggagc

SEQ ID NO: 6471 - RNA, 18 nt, Homo sapiens
ucuuuuugacucugucca

SEQ ID NO: 6472 - RNA, 19 nt, Homo sapiens
caccuuuugcaaaacggag

SEQ ID NO: 6473 - RNA, 21 nt, Homo sapiens
cacuuggaauuaaaacauaau

SEQ ID NO: 6474 - RNA, 19 nt, Homo sapiens
cagaaacacuuggaauuaa

SEQ ID NO: 6475 - RNA, 18 nt, Homo sapiens
ggacccgcgccacccugc

SEQ ID NO: 6476 - RNA, 21 nt, Homo sapiens
gguggaaguguggaaggacug

SEQ ID NO: 6477 - RNA, 20 nt, Homo sapiens
uacuuuucuuucaaaagacu

SEQ ID NO: 6478 - RNA, 22 nt, Homo sapiens
ucuauguaauaaugaugagaac

SEQ ID NO: 6479 - RNA, 19 nt, Homo sapiens
ugcuugggcucauuuccag

SEQ ID NO: 6480 - RNA, 16 nt, Homo sapiens
aagggcacuggggccg

SEQ ID NO: 6481 - RNA, 16 nt, Homo sapiens
agccuugagcuggggc

SEQ ID NO: 6482 - RNA, 26 nt, Homo sapiens
gagcuggggcugucuuugggggaucc

SEQ ID NO: 6483 - RNA, 18 nt, Homo sapiens
ggggguucgaggccggcc

SEQ ID NO: 6484 - RNA, 16 nt, Homo sapiens
ucucucuacggggccc

SEQ ID NO: 6485 - RNA, 16 nt, Homo sapiens
uguaucggccuggugu

SEQ ID NO: 6486 - RNA, 18 nt, Homo sapiens
uguucgugacuuauuuug

SEQ ID NO: 6487 - RNA, 18 nt, Homo sapiens
cccccugcuccccuagcc

SEQ ID NO: 6488 - RNA, 18 nt, Homo sapiens
ccuggcggcggcccgggc

SEQ ID NO: 6489 - RNA, 19 nt, Homo sapiens
acggcgucccugcuccagc

SEQ ID NO: 6490 - RNA, 20 nt, Homo sapiens
agcgggggcaggggcggagg

SEQ ID NO: 6491 - RNA, 21 nt, Homo sapiens
cagcggggaggugcuguuggc

SEQ ID NO: 6492 - RNA, 18 nt, Homo sapiens
caggguccugccagggcc

SEQ ID NO: 6493 - RNA, 20 nt, Homo sapiens
ccgaggaggccggggcagcc

SEQ ID NO: 6494 - RNA, 18 nt, Homo sapiens
cgugggcucgcacgggga

SEQ ID NO: 6495 - RNA, 16 nt, Homo sapiens
cugggcccucuucucu

SEQ ID NO: 6496 - RNA, 21 nt, Homo sapiens
cugggcgagcgcggggggccg

SEQ ID NO: 6497 - RNA, 20 nt, Homo sapiens
gaaggguaggcgcggagagc

SEQ ID NO: 6498 - RNA, 17 nt, Homo sapiens
gccggggcagccaccgc

SEQ ID NO: 6499 - RNA, 20 nt, Homo sapiens
gcucccggcucauccagccc

SEQ ID NO: 6500 - RNA, 20 nt, Homo sapiens
gcugugguaugaccggcagc

SEQ ID NO: 6501 - RNA, 22 nt, Homo sapiens
ggagcgggggcaggggcggagg

SEQ ID NO: 6502 - RNA, 23 nt, Homo sapiens
ggcgagcgcggggggccggggcu

SEQ ID NO: 6503 - RNA, 21 nt, Homo sapiens
gggcggggagggggugcuggg

SEQ ID NO: 6504 - RNA, 20 nt, Homo sapiens
gguucugugggguggaggga

SEQ ID NO: 6505 - RNA, 19 nt, Homo sapiens
gucgaguggaggacuggcu

SEQ ID NO: 6506 - RNA, 18 nt, Homo sapiens
ucugggcugggcccucuu

SEQ ID NO: 6507 - RNA, 22 nt, Homo sapiens
ugacagcagcaguccuggcccc

SEQ ID NO: 6508 - RNA, 19 nt, Homo sapiens
ugccaugcugcugguggag

SEQ ID NO: 6509 - RNA, 22 nt, Homo sapiens
ugggcggggagggggugcuggg

SEQ ID NO: 6510 - RNA, 21 nt, Homo sapiens
uggguugaagguucugugggg

SEQ ID NO: 6511 - RNA, 17 nt, Homo sapiens
ugguaugaccggcagca

SEQ ID NO: 6512 - RNA, 22 nt, Homo sapiens
uugcuguccgaaggaugggcgg

SEQ ID NO: 6513 - RNA, 20 nt, Homo sapiens
aggguuggcaggagaguggu

SEQ ID NO: 6514 - RNA, 19 nt, Homo sapiens
aucuccuggaccaguuacu

SEQ ID NO: 6515 - RNA, 22 nt, Homo sapiens
ggcuuucugucuuccagacaga

SEQ ID NO: 6516 - RNA, 22 nt, Homo sapiens
uagaacaaggguuggcaggaga

SEQ ID NO: 6517 - RNA, 15 nt, Homo sapiens
ucugggcuccuucug

SEQ ID NO: 6518 - RNA, 23 nt, Homo sapiens
gggguuggggagugagcuuggag

SEQ ID NO: 6519 - RNA, 16 nt, Homo sapiens
ugagggggugagcgug

SEQ ID NO: 6520 - RNA, 18 nt, Homo sapiens
gcuccugccccuccgucc

SEQ ID NO: 6521 - RNA, 17 nt, Homo sapiens
ugcuccugagagaggcc

SEQ ID NO: 6522 - RNA, 17 nt, Homo sapiens
uggccaacgcuggaggg

SEQ ID NO: 6523 - RNA, 22 nt, Homo sapiens
acgacggacugcaccgccgccu

SEQ ID NO: 6524 - RNA, 14 nt, Homo sapiens
aggcaugaauuaac

SEQ ID NO: 6525 - RNA, 17 nt, Homo sapiens
aucauguuccuacaccc

SEQ ID NO: 6526 - RNA, 18 nt, Homo sapiens
caucaaacacaauuuggc

SEQ ID NO: 6527 - RNA, 18 nt, Homo sapiens
caucaugcaucaccacag

SEQ ID NO: 6528 - RNA, 18 nt, Homo sapiens
cccuuauuuguucagccc

SEQ ID NO: 6529 - RNA, 21 nt, Homo sapiens
gcuaccugggucauuggcuaa

SEQ ID NO: 6530 - RNA, 18 nt, Homo sapiens
ggaggcgguagggaacgg

SEQ ID NO: 6531 - RNA, 20 nt, Homo sapiens
ggcugugcucagaacuguau

SEQ ID NO: 6532 - RNA, 16 nt, Homo sapiens
gugcccacuggaacag

SEQ ID NO: 6533 - RNA, 18 nt, Homo sapiens
guucuuucuucucuagaa

SEQ ID NO: 6534 - RNA, 16 nt, Homo sapiens
uaaauggagcuaguug

SEQ ID NO: 6535 - RNA, 22 nt, Homo sapiens
uaauagaggcagcaauuacuua

SEQ ID NO: 6536 - RNA, 18 nt, Homo sapiens
uagaaauggcuguaaaug

SEQ ID NO: 6537 - RNA, 18 nt, Homo sapiens
uauaaccaaugaccucuc

SEQ ID NO: 6538 - RNA, 20 nt, Homo sapiens
ugaagugccauaauagaggc

SEQ ID NO: 6539 - RNA, 18 nt, Homo sapiens
ugcaguuggaaacagagc

SEQ ID NO: 6540 - RNA, 19 nt, Homo sapiens
ugccauuuuagaaauggcu

SEQ ID NO: 6541 - RNA, 19 nt, Homo sapiens
uggaacauggcagcauuua

SEQ ID NO: 6542 - RNA, 18 nt, Homo sapiens
uuggaacauggcagcauu

SEQ ID NO: 6543 - RNA, 17 nt, Homo sapiens
uuuccaaaguugcugga

SEQ ID NO: 6544 - RNA, 14 nt, Homo sapiens
uuuugcccucccag

SEQ ID NO: 6545 - RNA, 19 nt, Homo sapiens
uauagauuuuaguacagaa

SEQ ID NO: 6546 - RNA, 21 nt, Homo sapiens
uuucuuuuuaaggcaugaucc

SEQ ID NO: 6547 - RNA, 19 nt, Homo sapiens
acccagggcgggcgagcag

SEQ ID NO: 6548 - RNA, 16 nt, Homo sapiens
ccagggcgggcgagca

SEQ ID NO: 6549 - RNA, 22 nt, Homo sapiens
cccuucuugcuuccccuccccc

SEQ ID NO: 6550 - RNA, 17 nt, Homo sapiens
ggguggcggcggcggcg

SEQ ID NO: 6551 - RNA, 17 nt, Homo sapiens
guggcggcggcggcgcg

SEQ ID NO: 6552 - RNA, 21 nt, Homo sapiens
cagcguguuacuguggaggaa

SEQ ID NO: 6553 - RNA, 18 nt, Homo sapiens
ugaaugagcuuguguagg

SEQ ID NO: 6554 - RNA, 22 nt, Homo sapiens
uguaacauucucucucaguaca

SEQ ID NO: 6555 - RNA, 19 nt, Homo sapiens
uaaccacacuccgggcugu

SEQ ID NO: 6556 - RNA, 27 nt, Homo sapiens
accaucugugugugcauccgugugugu

SEQ ID NO: 6557 - RNA, 18 nt, Homo sapiens
cgugcagguggggcuugg

SEQ ID NO: 6558 - RNA, 21 nt, Homo sapiens
gcauaucugugugugcgcaca

SEQ ID NO: 6559 - RNA, 22 nt, Homo sapiens
gugugcgcacuuggugugugug

SEQ ID NO: 6560 - RNA, 18 nt, Homo sapiens
uccauguguauaucugug

SEQ ID NO: 6561 - RNA, 18 nt, Homo sapiens
aauuucuuugcagagcau

SEQ ID NO: 6562 - RNA, 16 nt, Homo sapiens
aucuccuguuuuccau

SEQ ID NO: 6563 - RNA, 19 nt, Homo sapiens
caucaucauuuucuuucuu

SEQ ID NO: 6564 - RNA, 19 nt, Homo sapiens
ccuccaacugcucuauaac

SEQ ID NO: 6565 - RNA, 21 nt, Homo sapiens
cuguaguaguuauuguauucu

SEQ ID NO: 6566 - RNA, 21 nt, Homo sapiens
uacauuuuuguuguguuauuu

SEQ ID NO: 6567 - RNA, 19 nt, Homo sapiens
uacuguaguaguuauugua

SEQ ID NO: 6568 - RNA, 18 nt, Homo sapiens
uaguuaauucaggaggcu

SEQ ID NO: 6569 - RNA, 20 nt, Homo sapiens
uauguuauaguuuccaaaga

SEQ ID NO: 6570 - RNA, 15 nt, Homo sapiens
ucaagaagacauugu

SEQ ID NO: 6571 - RNA, 17 nt, Homo sapiens
uuguguuauuuucagca

SEQ ID NO: 6572 - RNA, 18 nt, Homo sapiens
aguuagugagaggcccug

SEQ ID NO: 6573 - RNA, 19 nt, Homo sapiens
ccauggugaacacgaaacc

SEQ ID NO: 6574 - RNA, 20 nt, Homo sapiens
cuugcuuggcucugaacacu

SEQ ID NO: 6575 - RNA, 19 nt, Homo sapiens
ggagagagggaguaagaaa

SEQ ID NO: 6576 - RNA, 20 nt, Homo sapiens
ggguaaaagggagagaggga

SEQ ID NO: 6577 - RNA, 23 nt, Homo sapiens
uaaacauugauguuuugguugga

SEQ ID NO: 6578 - RNA, 19 nt, Homo sapiens
uagaagauucaagauagaa

SEQ ID NO: 6579 - RNA, 19 nt, Homo sapiens
uauauauauauuauauaua

SEQ ID NO: 6580 - RNA, 20 nt, Homo sapiens
uauauauauauuauauauau

SEQ ID NO: 6581 - RNA, 21 nt, Homo sapiens
uauauauauauuauauauaua

SEQ ID NO: 6582 - RNA, 19 nt, Homo sapiens
uauauauauuauauauaua

SEQ ID NO: 6583 - RNA, 19 nt, Homo sapiens
uguguguaugcgugugugu

SEQ ID NO: 6584 - RNA, 23 nt, Homo sapiens
agggguucaagaccagccugggc

SEQ ID NO: 6585 - RNA, 19 nt, Homo sapiens
ccuccaacucuuccaaguc

SEQ ID NO: 6586 - RNA, 20 nt, Homo sapiens
gagaggcugaggcaggagga

SEQ ID NO: 6587 - RNA, 17 nt, Homo sapiens
ugaauggaaauauacca

SEQ ID NO: 6588 - RNA, 14 nt, Homo sapiens
ugagcccuggaaaa

SEQ ID NO: 6589 - RNA, 16 nt, Homo sapiens
uucacaaccaguucaa

SEQ ID NO: 6590 - RNA, 22 nt, Homo sapiens
uuuucuggcugagcauauauua

SEQ ID NO: 6591 - RNA, 15 nt, Homo sapiens
caguguggccggcgg

SEQ ID NO: 6592 - RNA, 20 nt, Homo sapiens
gcgccuacagccccggcggc

SEQ ID NO: 6593 - RNA, 22 nt, Homo sapiens
uggcggaccaggccuacagccc

SEQ ID NO: 6594 - RNA, 20 nt, Homo sapiens
uguuuccagaagagcagaga

SEQ ID NO: 6595 - RNA, 20 nt, Homo sapiens
accagaacucauguauugga

SEQ ID NO: 6596 - RNA, 22 nt, Homo sapiens
acccuuuuuaucauucuaucaa

SEQ ID NO: 6597 - RNA, 23 nt, Homo sapiens
ccucggccucccaaagggcuggg

SEQ ID NO: 6598 - RNA, 21 nt, Homo sapiens
gacuggugguaaaauauuugc

SEQ ID NO: 6599 - RNA, 18 nt, Homo sapiens
gcacuggugcgaucucgg

SEQ ID NO: 6600 - RNA, 20 nt, Homo sapiens
gccuucuggauccuuggcug

SEQ ID NO: 6601 - RNA, 21 nt, Homo sapiens
uaaacuaucuuuuccuucuuu

SEQ ID NO: 6602 - RNA, 17 nt, Homo sapiens
uccacgucacuuuauuu

SEQ ID NO: 6603 - RNA, 17 nt, Homo sapiens
ugacugugacugugugg

SEQ ID NO: 6604 - RNA, 19 nt, Homo sapiens
ugugacugugacugugugg

SEQ ID NO: 6605 - RNA, 18 nt, Homo sapiens
uuaaugauacaauacugc

SEQ ID NO: 6606 - RNA, 19 nt, Homo sapiens
uuaucuuuaccagaacuca

SEQ ID NO: 6607 - RNA, 16 nt, Homo sapiens
caaggucccgggagga

SEQ ID NO: 6608 - RNA, 21 nt, Homo sapiens
ucacacugccagcccacagag

SEQ ID NO: 6609 - RNA, 21 nt, Homo sapiens
uggagaggcuugcaagguccc

SEQ ID NO: 6610 - RNA, 20 nt, Homo sapiens
acagguccaguuuuaaaaca

SEQ ID NO: 6611 - RNA, 24 nt, Homo sapiens
agccaugucgggcccagcucccug

SEQ ID NO: 6612 - RNA, 22 nt, Homo sapiens
cauauauguuauauauauauau

SEQ ID NO: 6613 - RNA, 21 nt, Homo sapiens
ccguggugcaaaggcagaggc

SEQ ID NO: 6614 - RNA, 19 nt, Homo sapiens
cggccccucccuggaaacc

SEQ ID NO: 6615 - RNA, 18 nt, Homo sapiens
cuuugggugugggagggg

SEQ ID NO: 6616 - RNA, 16 nt, Homo sapiens
ggcgggggccgcggcg

SEQ ID NO: 6617 - RNA, 19 nt, Homo sapiens
uauauauauagauauauau

SEQ ID NO: 6618 - RNA, 20 nt, Homo sapiens
uauauauauagauauauaua

SEQ ID NO: 6619 - RNA, 18 nt, Homo sapiens
uauauauauauauguaua

SEQ ID NO: 6620 - RNA, 22 nt, Homo sapiens
uauauauauauauguauauaua

SEQ ID NO: 6621 - RNA, 23 nt, Homo sapiens
uauauauauauauguauauauau

SEQ ID NO: 6622 - RNA, 21 nt, Homo sapiens
uauauauauauguauauauac

SEQ ID NO: 6623 - RNA, 19 nt, Homo sapiens
uauauauauguauauauac

SEQ ID NO: 6624 - RNA, 25 nt, Homo sapiens
uauauauauguauauauaccauaua

SEQ ID NO: 6625 - RNA, 19 nt, Homo sapiens
uuuuuuaaauuuuauacau

SEQ ID NO: 6626 - RNA, 18 nt, Homo sapiens
uaucaugugagggaggaa

SEQ ID NO: 6627 - RNA, 22 nt, Homo sapiens
ugauuucuuucugcauuugcag

SEQ ID NO: 6628 - RNA, 19 nt, Homo sapiens
agaggaaaucggagggcgg

SEQ ID NO: 6629 - RNA, 21 nt, Homo sapiens
cuguuccguccaaacacuguu

SEQ ID NO: 6630 - RNA, 18 nt, Homo sapiens
uccccggaucuguuccgu

SEQ ID NO: 6631 - RNA, 21 nt, Homo sapiens
acagguggaugacaaggucag

SEQ ID NO: 6632 - RNA, 18 nt, Homo sapiens
cuucuagaguagaccaga

SEQ ID NO: 6633 - RNA, 18 nt, Homo sapiens
gaacacaggaggcggaag

SEQ ID NO: 6634 - RNA, 17 nt, Homo sapiens
gcgugguggcgggcgcc

SEQ ID NO: 6635 - RNA, 20 nt, Homo sapiens
ugggaagagcaggugggcac

SEQ ID NO: 6636 - RNA, 16 nt, Homo sapiens
ugggaggccgaggugg

SEQ ID NO: 6637 - RNA, 20 nt, Homo sapiens
uuggaggacccaggggagaa

SEQ ID NO: 6638 - RNA, 16 nt, Homo sapiens
aggaggccauggcagg

SEQ ID NO: 6639 - RNA, 17 nt, Homo sapiens
cucccggguggggcccc

SEQ ID NO: 6640 - RNA, 22 nt, Homo sapiens
gagguucccggcagcccaggca

SEQ ID NO: 6641 - RNA, 19 nt, Homo sapiens
ggaggggagaggcuccugg

SEQ ID NO: 6642 - RNA, 22 nt, Homo sapiens
ugagguucccggcagcccaggc

SEQ ID NO: 6643 - RNA, 19 nt, Homo sapiens
uggcaaggucucugggagc

SEQ ID NO: 6644 - RNA, 21 nt, Homo sapiens
uggccacaaaggacuccagca

SEQ ID NO: 6645 - RNA, 18 nt, Homo sapiens
acacugggggggccagug

SEQ ID NO: 6646 - RNA, 19 nt, Homo sapiens
aguacaaagugaaaaggcu

SEQ ID NO: 6647 - RNA, 21 nt, Homo sapiens
aucccgucuggaugcccguga

SEQ ID NO: 6648 - RNA, 15 nt, Homo sapiens
augcccgugacacug

SEQ ID NO: 6649 - RNA, 22 nt, Homo sapiens
auguugaggaacugcaggagga

SEQ ID NO: 6650 - RNA, 17 nt, Homo sapiens
caccugucaucagguga

SEQ ID NO: 6651 - RNA, 16 nt, Homo sapiens
ccagggagcuaugcaa

SEQ ID NO: 6652 - RNA, 16 nt, Homo sapiens
gccaagggaucuugca

SEQ ID NO: 6653 - RNA, 18 nt, Homo sapiens
gggugccaguucccaggg

SEQ ID NO: 6654 - RNA, 22 nt, Homo sapiens
ggucucgaucuccugaccuugu

SEQ ID NO: 6655 - RNA, 18 nt, Homo sapiens
uggccaggauggucucga

SEQ ID NO: 6656 - RNA, 18 nt, Homo sapiens
aaggagggcccggugcgg

SEQ ID NO: 6657 - RNA, 19 nt, Homo sapiens
aagucuugcuuuuguauau

SEQ ID NO: 6658 - RNA, 23 nt, Homo sapiens
agagguugcagugagccaagauc

SEQ ID NO: 6659 - RNA, 19 nt, Homo sapiens
caaaaaaagaaaaaaaaag

SEQ ID NO: 6660 - RNA, 16 nt, Homo sapiens
cagccugggcaacaua

SEQ ID NO: 6661 - RNA, 20 nt, Homo sapiens
gagcuggcccuaccuggaag

SEQ ID NO: 6662 - RNA, 19 nt, Homo sapiens
ucacacaugggaauaagcc

SEQ ID NO: 6663 - RNA, 20 nt, Homo sapiens
uguuaugagcaggaugguug

SEQ ID NO: 6664 - RNA, 15 nt, Homo sapiens
cgcggggcggggccg

SEQ ID NO: 6665 - RNA, 17 nt, Homo sapiens
ggcagccgggaagcggc

SEQ ID NO: 6666 - RNA, 16 nt, Homo sapiens
ggcggggccgcggugg

SEQ ID NO: 6667 - RNA, 16 nt, Homo sapiens
uccuagacacguuggg

SEQ ID NO: 6668 - RNA, 18 nt, Homo sapiens
ugggggccagagccccgg

SEQ ID NO: 6669 - RNA, 19 nt, Homo sapiens
acuuuaaaaaguaaguaca

SEQ ID NO: 6670 - RNA, 18 nt, Homo sapiens
cacaacauggaccaaucu

SEQ ID NO: 6671 - RNA, 18 nt, Homo sapiens
cauaacagguugaagugg

SEQ ID NO: 6672 - RNA, 18 nt, Homo sapiens
ccagccaccuggaaaaac

SEQ ID NO: 6673 - RNA, 17 nt, Homo sapiens
gaggaaacaaauugugg

SEQ ID NO: 6674 - RNA, 18 nt, Homo sapiens
gaggaaacgacuacaaca

SEQ ID NO: 6675 - RNA, 18 nt, Homo sapiens
ggcguugccaggaagccg

SEQ ID NO: 6676 - RNA, 17 nt, Homo sapiens
gucccgucgccgccacg

SEQ ID NO: 6677 - RNA, 19 nt, Homo sapiens
uguagacaguuuuaauugu

SEQ ID NO: 6678 - RNA, 21 nt, Homo sapiens
ccccgucggcgcgggaugcuc

SEQ ID NO: 6679 - RNA, 23 nt, Homo sapiens
ugagcacccggauauggaagaug

SEQ ID NO: 6680 - RNA, 20 nt, Homo sapiens
cgacacccuggacucccggc

SEQ ID NO: 6681 - RNA, 19 nt, Homo sapiens
cgcccgggcccgcucccug

SEQ ID NO: 6682 - RNA, 21 nt, Homo sapiens
ggccaggaaggcacggaggag

SEQ ID NO: 6683 - RNA, 17 nt, Homo sapiens
gggcuugugggccgggg

SEQ ID NO: 6684 - RNA, 19 nt, Homo sapiens
guggccgggccgggguggg

SEQ ID NO: 6685 - RNA, 22 nt, Homo sapiens
agacauuuucugaaaugcuaca

SEQ ID NO: 6686 - RNA, 15 nt, Homo sapiens
agcgggcgcuggagc

SEQ ID NO: 6687 - RNA, 21 nt, Homo sapiens
agggucgaguggggccugagc

SEQ ID NO: 6688 - RNA, 19 nt, Homo sapiens
gcuguauuugcauaaacca

SEQ ID NO: 6689 - RNA, 21 nt, Homo sapiens
ugagaguuucgggccccugau

SEQ ID NO: 6690 - RNA, 14 nt, Homo sapiens
acacuggcacgcag

SEQ ID NO: 6691 - RNA, 15 nt, Homo sapiens
cagcccuagcugggg

SEQ ID NO: 6692 - RNA, 20 nt, Homo sapiens
cagggcccgcgcggcgcugc

SEQ ID NO: 6693 - RNA, 18 nt, Homo sapiens
gcgcucgggucgggcgcc

SEQ ID NO: 6694 - RNA, 21 nt, Homo sapiens
gcugaguggcagagcagcaga

SEQ ID NO: 6695 - RNA, 16 nt, Homo sapiens
ggggugggggguaggg

SEQ ID NO: 6696 - RNA, 21 nt, Homo sapiens
ggggugggggguagguggggg

SEQ ID NO: 6697 - RNA, 18 nt, Homo sapiens
uggcacgcaguucacggc

SEQ ID NO: 6698 - RNA, 18 nt, Homo sapiens
uguguguguacgcuccuc

SEQ ID NO: 6699 - RNA, 24 nt, Homo sapiens
aacaugaccaaagugaagucuguu

SEQ ID NO: 6700 - RNA, 17 nt, Homo sapiens
caaaaguaucuacacuc

SEQ ID NO: 6701 - RNA, 20 nt, Homo sapiens
cuuaucaaggcacagagagu

SEQ ID NO: 6702 - RNA, 20 nt, Homo sapiens
gccgcagccgcugccguucg

SEQ ID NO: 6703 - RNA, 18 nt, Homo sapiens
ggcaguacgaucggcaac

SEQ ID NO: 6704 - RNA, 24 nt, Homo sapiens
gggcuguggccggagucaccugag

SEQ ID NO: 6705 - RNA, 19 nt, Homo sapiens
uaaaaaaaagaagaagaag

SEQ ID NO: 6706 - RNA, 18 nt, Homo sapiens
ucacagagcaauaccgca

SEQ ID NO: 6707 - RNA, 22 nt, Homo sapiens
uggaagcuaugguucugcagac

SEQ ID NO: 6708 - RNA, 19 nt, Homo sapiens
ugguuaucuggcagugguu

SEQ ID NO: 6709 - RNA, 18 nt, Homo sapiens
uuuaaauaggaccaacuu

SEQ ID NO: 6710 - RNA, 16 nt, Homo sapiens
aaagcuaacuucaaag

SEQ ID NO: 6711 - RNA, 18 nt, Homo sapiens
aaguauucuucacugaga

SEQ ID NO: 6712 - RNA, 22 nt, Homo sapiens
ccugaaccugugggagguggag

SEQ ID NO: 6713 - RNA, 19 nt, Homo sapiens
gcuaugguuugcauucaau

SEQ ID NO: 6714 - RNA, 21 nt, Homo sapiens
ggugccugguaaguugaucug

SEQ ID NO: 6715 - RNA, 20 nt, Homo sapiens
guagcaaaaccaaguugggu

SEQ ID NO: 6716 - RNA, 20 nt, Homo sapiens
guggaucacgaggucaggag

SEQ ID NO: 6717 - RNA, 19 nt, Homo sapiens
uacaaaaugcuucuuguac

SEQ ID NO: 6718 - RNA, 22 nt, Homo sapiens
ucuacuucucuuagcauguauu

SEQ ID NO: 6719 - RNA, 23 nt, Homo sapiens
ugaguaugugucugguuauaggc

SEQ ID NO: 6720 - RNA, 17 nt, Homo sapiens
uggcaucaaccaagauu

SEQ ID NO: 6721 - RNA, 17 nt, Homo sapiens
ugggaaaccaaagaaag

SEQ ID NO: 6722 - RNA, 21 nt, Homo sapiens
uguuuuggcuuaaacguuauu

SEQ ID NO: 6723 - RNA, 19 nt, Homo sapiens
cuuccgccuagaauccugu

SEQ ID NO: 6724 - RNA, 18 nt, Homo sapiens
gccuaugcuaucgcuucc

SEQ ID NO: 6725 - RNA, 17 nt, Homo sapiens
gcguguguggaacuuga

SEQ ID NO: 6726 - RNA, 18 nt, Homo sapiens
ggcggcgaagggucuggu

SEQ ID NO: 6727 - RNA, 18 nt, Homo sapiens
aaaacccaagaauaccag

SEQ ID NO: 6728 - RNA, 20 nt, Homo sapiens
aacugguagaugucuucaac

SEQ ID NO: 6729 - RNA, 19 nt, Homo sapiens
caggccuagaaagcuuacc

SEQ ID NO: 6730 - RNA, 20 nt, Homo sapiens
gcugauaccucguaaaagcu

SEQ ID NO: 6731 - RNA, 17 nt, Homo sapiens
ucucucacauuaaugac

SEQ ID NO: 6732 - RNA, 16 nt, Homo sapiens
ugacaugcaugcaaga

SEQ ID NO: 6733 - RNA, 20 nt, Homo sapiens
uggaauguuuuagcagggac

SEQ ID NO: 6734 - RNA, 18 nt, Homo sapiens
ugugaguuuauacuguau

SEQ ID NO: 6735 - RNA, 23 nt, Homo sapiens
uucaggucggccggcgauugcgg

SEQ ID NO: 6736 - RNA, 18 nt, Homo sapiens
ucuucgaccaaaaaugcc

SEQ ID NO: 6737 - RNA, 20 nt, Homo sapiens
gggaggcggggaacaggggc

SEQ ID NO: 6738 - RNA, 19 nt, Homo sapiens
ccccagaaccuggccuccc

SEQ ID NO: 6739 - RNA, 18 nt, Homo sapiens
cuccuuguccccgacugc

SEQ ID NO: 6740 - RNA, 17 nt, Homo sapiens
gccagacggaagcuccu

SEQ ID NO: 6741 - RNA, 20 nt, Homo sapiens
gugccccggccuugccagac

SEQ ID NO: 6742 - RNA, 21 nt, Homo sapiens
ucccaggcacccuucuggccc

SEQ ID NO: 6743 - RNA, 22 nt, Homo sapiens
aucacccuguguuccuuacccc

SEQ ID NO: 6744 - RNA, 19 nt, Homo sapiens
cauuaccccuucugcuuug

SEQ ID NO: 6745 - RNA, 22 nt, Homo sapiens
uuuggcugggacugaaauugug

SEQ ID NO: 6746 - RNA, 22 nt, Homo sapiens
cccccuggcuggagccagguuc

SEQ ID NO: 6747 - RNA, 19 nt, Homo sapiens
ggacaccguagaaggccgg

SEQ ID NO: 6748 - RNA, 23 nt, Homo sapiens
gcgaggcgcgugggcgcgcggcg

SEQ ID NO: 6749 - RNA, 15 nt, Homo sapiens
gcgccggcagcgcgc

SEQ ID NO: 6750 - RNA, 20 nt, Homo sapiens
gggcuggggguuaggcuggg

SEQ ID NO: 6751 - RNA, 15 nt, Homo sapiens
ugggcgcgcggcggc

SEQ ID NO: 6752 - RNA, 24 nt, Homo sapiens
aggacuguuaauuugcacaaccua

SEQ ID NO: 6753 - RNA, 15 nt, Homo sapiens
cugcugggggagggc

SEQ ID NO: 6754 - RNA, 15 nt, Homo sapiens
guggcuuaguaaaua

SEQ ID NO: 6755 - RNA, 16 nt, Homo sapiens
uacagcuucuauuuug

SEQ ID NO: 6756 - RNA, 17 nt, Homo sapiens
ugacagacucacuguug

SEQ ID NO: 6757 - RNA, 19 nt, Homo sapiens
ugcucgcucuaaggccucu

SEQ ID NO: 6758 - RNA, 17 nt, Homo sapiens
ggcgucuagaucucauc

SEQ ID NO: 6759 - RNA, 21 nt, Homo sapiens
ugacaggaguggggcaggguu

SEQ ID NO: 6760 - RNA, 16 nt, Homo sapiens
uggaaagcugggggaa

SEQ ID NO: 6761 - RNA, 16 nt, Homo sapiens
gccggcaaggcccaac

SEQ ID NO: 6762 - RNA, 18 nt, Homo sapiens
aaggggggugccuggggu

SEQ ID NO: 6763 - RNA, 17 nt, Homo sapiens
ugucacaaaucccugcc

SEQ ID NO: 6764 - RNA, 18 nt, Homo sapiens
acaccguggugagaagcc

SEQ ID NO: 6765 - RNA, 20 nt, Homo sapiens
gcacagggcuuucuuccaga

SEQ ID NO: 6766 - RNA, 21 nt, Homo sapiens
uuagugcacugacugagcgag

SEQ ID NO: 6767 - RNA, 19 nt, Homo sapiens
augugagauucugguggcu

SEQ ID NO: 6768 - RNA, 21 nt, Homo sapiens
uaggacacagauaagaacaag

SEQ ID NO: 6769 - RNA, 19 nt, Homo sapiens
uauguaucuaaacauuuuu

SEQ ID NO: 6770 - RNA, 18 nt, Homo sapiens
uccaaaucucaguugacc

SEQ ID NO: 6771 - RNA, 17 nt, Homo sapiens
agugacagagucaggug

SEQ ID NO: 6772 - RNA, 20 nt, Homo sapiens
aucauggauuugaaagguca

SEQ ID NO: 6773 - RNA, 21 nt, Homo sapiens
gagcuuacagcaugggcuauu

SEQ ID NO: 6774 - RNA, 18 nt, Homo sapiens
ggacaucaagaauggugc

SEQ ID NO: 6775 - RNA, 19 nt, Homo sapiens
ucaccggagcgggaggugc

SEQ ID NO: 6776 - RNA, 19 nt, Homo sapiens
uccaacaagccucucuucu

SEQ ID NO: 6777 - RNA, 21 nt, Homo sapiens
ugagcuuacagcaugggcuau

SEQ ID NO: 6778 - RNA, 19 nt, Homo sapiens
aaaacaauacauaaaaaau

SEQ ID NO: 6779 - RNA, 18 nt, Homo sapiens
caguucuccucuuccaag

SEQ ID NO: 6780 - RNA, 18 nt, Homo sapiens
ucuguucacaacguccag

SEQ ID NO: 6781 - RNA, 19 nt, Homo sapiens
gugaauuuucauuuuaacc

SEQ ID NO: 6782 - RNA, 17 nt, Homo sapiens
uucacugcgcuucacug

SEQ ID NO: 6783 - RNA, 18 nt, Homo sapiens
acauaacaaauuaacaua

SEQ ID NO: 6784 - RNA, 18 nt, Homo sapiens
accggcgagggugcgccc

SEQ ID NO: 6785 - RNA, 18 nt, Homo sapiens
cacaucuauauacauaac

SEQ ID NO: 6786 - RNA, 18 nt, Homo sapiens
cgcccggcuggcggaggg

SEQ ID NO: 6787 - RNA, 22 nt, Homo sapiens
cggcgagggugcgcccggcugg

SEQ ID NO: 6788 - RNA, 17 nt, Homo sapiens
gagacgcgagaggggag

SEQ ID NO: 6789 - RNA, 18 nt, Homo sapiens
agcaagggccccacggcc

SEQ ID NO: 6790 - RNA, 15 nt, Homo sapiens
caggagguccuucug

SEQ ID NO: 6791 - RNA, 23 nt, Homo sapiens
cugggcaggagguccuucugcca

SEQ ID NO: 6792 - RNA, 19 nt, Homo sapiens
ugcuaaguagggaacgggg

SEQ ID NO: 6793 - RNA, 15 nt, Homo sapiens
cccgcgccccucccc

SEQ ID NO: 6794 - RNA, 16 nt, Homo sapiens
cgcccccucccgcgcc

SEQ ID NO: 6795 - RNA, 25 nt, Homo sapiens
gcccccucccgcgccccucccccgg

SEQ ID NO: 6796 - RNA, 19 nt, Homo sapiens
gcgcggcgggugugugcgu

SEQ ID NO: 6797 - RNA, 14 nt, Homo sapiens
acuuuucuaacaca

SEQ ID NO: 6798 - RNA, 18 nt, Homo sapiens
ggaggaggcggaggcgca

SEQ ID NO: 6799 - RNA, 20 nt, Homo sapiens
acaggaggcucucgucaugg

SEQ ID NO: 6800 - RNA, 20 nt, Homo sapiens
agagagcuugcugggugggc

SEQ ID NO: 6801 - RNA, 19 nt, Homo sapiens
ccugugcugcaguggacgc

SEQ ID NO: 6802 - RNA, 22 nt, Homo sapiens
cucacaccacccugggacggag

SEQ ID NO: 6803 - RNA, 16 nt, Homo sapiens
gacaggaacuucucgg

SEQ ID NO: 6804 - RNA, 22 nt, Homo sapiens
ggggcuuccuccccaucuccca

SEQ ID NO: 6805 - RNA, 21 nt, Homo sapiens
ucucaggguuuagaccaacau

SEQ ID NO: 6806 - RNA, 18 nt, Homo sapiens
gggcgggggccgggccgg

SEQ ID NO: 6807 - RNA, 26 nt, Homo sapiens
ggggcggggcggggcgggggccgggc

SEQ ID NO: 6808 - RNA, 18 nt, Homo sapiens
accccagcccccuccauc

SEQ ID NO: 6809 - RNA, 17 nt, Homo sapiens
cugcuccucugguccuc

SEQ ID NO: 6810 - RNA, 15 nt, Homo sapiens
uucuaugccucugug

SEQ ID NO: 6811 - RNA, 16 nt, Homo sapiens
acaaaugagaauacac

SEQ ID NO: 6812 - RNA, 15 nt, Homo sapiens
augggcacagugcag

SEQ ID NO: 6813 - RNA, 19 nt, Homo sapiens
gcucggggacugcggggcu

SEQ ID NO: 6814 - RNA, 18 nt, Homo sapiens
ugggagggcagcaugggc

SEQ ID NO: 6815 - RNA, 21 nt, Homo sapiens
agaaaaagaauagaaugaaga

SEQ ID NO: 6816 - RNA, 18 nt, Homo sapiens
agagggagggaggaagaa

SEQ ID NO: 6817 - RNA, 24 nt, Homo sapiens
ugagggagaagaaaaacauguucg

SEQ ID NO: 6818 - RNA, 18 nt, Homo sapiens
aggaggcggcgggugggg

SEQ ID NO: 6819 - RNA, 19 nt, Homo sapiens
aggaggcggcggguggggg

SEQ ID NO: 6820 - RNA, 16 nt, Homo sapiens
caucucucucggugca

SEQ ID NO: 6821 - RNA, 14 nt, Homo sapiens
gcaggaggcggcgg

SEQ ID NO: 6822 - RNA, 16 nt, Homo sapiens
ggugcaggaggcggcg

SEQ ID NO: 6823 - RNA, 18 nt, Homo sapiens
cgggagcuggagccgggg

SEQ ID NO: 6824 - RNA, 18 nt, Homo sapiens
ugagagagcggguuuucc

SEQ ID NO: 6825 - RNA, 17 nt, Homo sapiens
acacauuagggacacaa

SEQ ID NO: 6826 - RNA, 16 nt, Homo sapiens
acagcuaacgugaugg

SEQ ID NO: 6827 - RNA, 19 nt, Homo sapiens
agugcaggugaguguaggu

SEQ ID NO: 6828 - RNA, 21 nt, Homo sapiens
cuaaucaugaaauaauuuuac

SEQ ID NO: 6829 - RNA, 18 nt, Homo sapiens
cucccaacacccuuuucc

SEQ ID NO: 6830 - RNA, 18 nt, Homo sapiens
gauggacgucugcgcagc

SEQ ID NO: 6831 - RNA, 18 nt, Homo sapiens
ggacgcacggggagggga

SEQ ID NO: 6832 - RNA, 25 nt, Homo sapiens
ggaggggagcggggaccugcagcgg

SEQ ID NO: 6833 - RNA, 21 nt, Homo sapiens
uaggugccuccucagcuacac

SEQ ID NO: 6834 - RNA, 18 nt, Homo sapiens
aguuuuauuuuuuuuucu

SEQ ID NO: 6835 - RNA, 18 nt, Homo sapiens
caagagcuguggccaagc

SEQ ID NO: 6836 - RNA, 18 nt, Homo sapiens
caccuuuaaucagacuga

SEQ ID NO: 6837 - RNA, 18 nt, Homo sapiens
agagaaccauagcugggu

SEQ ID NO: 6838 - RNA, 17 nt, Homo sapiens
agccccaaaucccuccc

SEQ ID NO: 6839 - RNA, 17 nt, Homo sapiens
gcaaaugucuacagcag

SEQ ID NO: 6840 - RNA, 24 nt, Homo sapiens
guggaggugcuauggaugagggac

SEQ ID NO: 6841 - RNA, 19 nt, Homo sapiens
ugcacuguggccucucaga

SEQ ID NO: 6842 - RNA, 19 nt, Homo sapiens
uucuugggcauuugggggu

SEQ ID NO: 6843 - RNA, 19 nt, Homo sapiens
acaaaggcuggguccuugu

SEQ ID NO: 6844 - RNA, 18 nt, Homo sapiens
ccgagggcgggcgcgggg

SEQ ID NO: 6845 - RNA, 18 nt, Homo sapiens
ggcgcgggggguuggggg

SEQ ID NO: 6846 - RNA, 20 nt, Homo sapiens
ggcgcgggggguuggggggu

SEQ ID NO: 6847 - RNA, 17 nt, Homo sapiens
gggguuggggggugggg

SEQ ID NO: 6848 - RNA, 18 nt, Homo sapiens
ugcugcucccagcucuuu

SEQ ID NO: 6849 - RNA, 15 nt, Homo sapiens
aagccuuuuugaucu

SEQ ID NO: 6850 - RNA, 17 nt, Homo sapiens
caaguauucaacuagcu

SEQ ID NO: 6851 - RNA, 18 nt, Homo sapiens
caucaccauuaggacauc

SEQ ID NO: 6852 - RNA, 20 nt, Homo sapiens
cucaacuuguucccuuacug

SEQ ID NO: 6853 - RNA, 20 nt, Homo sapiens
cuuguucccuuacugcucug

SEQ ID NO: 6854 - RNA, 19 nt, Homo sapiens
cuuuucaagucuaaagcag

SEQ ID NO: 6855 - RNA, 18 nt, Homo sapiens
gaucguugcugugguucu

SEQ ID NO: 6856 - RNA, 23 nt, Homo sapiens
gcaggcaguguacucuauggcaa

SEQ ID NO: 6857 - RNA, 21 nt, Homo sapiens
gcauggaaaaaggggggaggg

SEQ ID NO: 6858 - RNA, 16 nt, Homo sapiens
gcgccgcgcgccgcgg

SEQ ID NO: 6859 - RNA, 19 nt, Homo sapiens
gcgcuggugcugccgccgg

SEQ ID NO: 6860 - RNA, 18 nt, Homo sapiens
ucaaacaccuuaauuuug

SEQ ID NO: 6861 - RNA, 14 nt, Homo sapiens
uugaauaacaaggg

SEQ ID NO: 6862 - RNA, 22 nt, Homo sapiens
aaccucaucucuauuaaaaaua

SEQ ID NO: 6863 - RNA, 23 nt, Homo sapiens
gggccagggcuuaagggguuggg

SEQ ID NO: 6864 - RNA, 17 nt, Homo sapiens
ugccuggggcacagaga

SEQ ID NO: 6865 - RNA, 17 nt, Homo sapiens
aauaucuauuaucaggu

SEQ ID NO: 6866 - RNA, 19 nt, Homo sapiens
agaguccgggccucugagc

SEQ ID NO: 6867 - RNA, 22 nt, Homo sapiens
aggauaaaaaugaucuuaggaa

SEQ ID NO: 6868 - RNA, 22 nt, Homo sapiens
aguugauuuuucauaucgaauc

SEQ ID NO: 6869 - RNA, 18 nt, Homo sapiens
auuagcagcuuauuucau

SEQ ID NO: 6870 - RNA, 18 nt, Homo sapiens
cgggucgagggcgagggc

SEQ ID NO: 6871 - RNA, 16 nt, Homo sapiens
ggagaaaguguggaug

SEQ ID NO: 6872 - RNA, 19 nt, Homo sapiens
uaaucuuaguugauuuuuc

SEQ ID NO: 6873 - RNA, 24 nt, Homo sapiens
uauauacauguauauguacauaua

SEQ ID NO: 6874 - RNA, 29 nt, Homo sapiens
uauauguacauauauuugcauauauauau

SEQ ID NO: 6875 - RNA, 19 nt, Homo sapiens
ugauuagcagcuuauuuca

SEQ ID NO: 6876 - RNA, 17 nt, Homo sapiens
ugcaugucucguggccg

SEQ ID NO: 6877 - RNA, 23 nt, Homo sapiens
ugucuguguguauauacauguau

SEQ ID NO: 6878 - RNA, 21 nt, Homo sapiens
uucauguauaugcaugugucu

SEQ ID NO: 6879 - RNA, 18 nt, Homo sapiens
uuuacaagauuacuucuc

SEQ ID NO: 6880 - RNA, 20 nt, Homo sapiens
uuuauuauugaaccaguaug

SEQ ID NO: 6881 - RNA, 17 nt, Homo sapiens
aggaaaagcuugcacaa

SEQ ID NO: 6882 - RNA, 19 nt, Homo sapiens
cagcagcuggcaaggggag

SEQ ID NO: 6883 - RNA, 21 nt, Homo sapiens
cagcgugggcugguccugccc

SEQ ID NO: 6884 - RNA, 18 nt, Homo sapiens
ccacucaaccacgugccc

SEQ ID NO: 6885 - RNA, 21 nt, Homo sapiens
gcuggcugcugggacugggcg

SEQ ID NO: 6886 - RNA, 22 nt, Homo sapiens
ggcgcuugggguaacaacucag

SEQ ID NO: 6887 - RNA, 20 nt, Homo sapiens
uccaaaucaccacaaauuau

SEQ ID NO: 6888 - RNA, 21 nt, Homo sapiens
gagauugucccuggugucugg

SEQ ID NO: 6889 - RNA, 21 nt, Homo sapiens
uaauaugcucaguuuuuaggu

SEQ ID NO: 6890 - RNA, 22 nt, Homo sapiens
ugauaguggagucgugugauuu

SEQ ID NO: 6891 - RNA, 14 nt, Homo sapiens
uggauuggguucca

SEQ ID NO: 6892 - RNA, 24 nt, Homo sapiens
uggcauuuacugaagguguuuuuu

SEQ ID NO: 6893 - RNA, 17 nt, Homo sapiens
uuagagaaugcaaugau

SEQ ID NO: 6894 - RNA, 19 nt, Homo sapiens
gugggcagggcagaggagg

SEQ ID NO: 6895 - RNA, 24 nt, Homo sapiens
acucugccauguacacauuugccu

SEQ ID NO: 6896 - RNA, 18 nt, Homo sapiens
caaaugguuacuuccaga

SEQ ID NO: 6897 - RNA, 21 nt, Homo sapiens
gcaaguugaaagaaaagaaaa

SEQ ID NO: 6898 - RNA, 18 nt, Homo sapiens
uauggcaagacaaaacuc

SEQ ID NO: 6899 - RNA, 19 nt, Homo sapiens
ucaacaauuggacaacaua

SEQ ID NO: 6900 - RNA, 18 nt, Homo sapiens
uggaaaggacucuggccc

SEQ ID NO: 6901 - RNA, 18 nt, Homo sapiens
uggaaaggugcgagagca

SEQ ID NO: 6902 - RNA, 18 nt, Homo sapiens
uucaucuuuuauuacaau

SEQ ID NO: 6903 - RNA, 19 nt, Homo sapiens
uguccggggagagagaaag

SEQ ID NO: 6904 - RNA, 23 nt, Homo sapiens
gugcauuggguaaucagugcuuu

SEQ ID NO: 6905 - RNA, 21 nt, Homo sapiens
caccaggggugguccaggcug

SEQ ID NO: 6906 - RNA, 21 nt, Homo sapiens
gagcucuuaguuucaauggca

SEQ ID NO: 6907 - RNA, 18 nt, Homo sapiens
accuuggugggaauccca

SEQ ID NO: 6908 - RNA, 18 nt, Homo sapiens
agggaaauugacagaguc

SEQ ID NO: 6909 - RNA, 20 nt, Homo sapiens
aguccugguccugccaccug

SEQ ID NO: 6910 - RNA, 18 nt, Homo sapiens
caaagugcaagcaggguu

SEQ ID NO: 6911 - RNA, 22 nt, Homo sapiens
ccccucugcccucucugaaauc

SEQ ID NO: 6912 - RNA, 18 nt, Homo sapiens
cccucaccuccuucaaac

SEQ ID NO: 6913 - RNA, 19 nt, Homo sapiens
cggccaaacuuuuuuuuuu

SEQ ID NO: 6914 - RNA, 20 nt, Homo sapiens
cucacguaaugcucugggua

SEQ ID NO: 6915 - RNA, 15 nt, Homo sapiens
ggaaccuuguucugg

SEQ ID NO: 6916 - RNA, 18 nt, Homo sapiens
ggcagaccccaaaccucc

SEQ ID NO: 6917 - RNA, 21 nt, Homo sapiens
gucucuucuuucucugccucu

SEQ ID NO: 6918 - RNA, 19 nt, Homo sapiens
ucuuuggggucagccaggg

SEQ ID NO: 6919 - RNA, 17 nt, Homo sapiens
ugaagcaaagcaucagc

SEQ ID NO: 6920 - RNA, 21 nt, Homo sapiens
uggaauucucagagggaaccu

SEQ ID NO: 6921 - RNA, 18 nt, Homo sapiens
uggcuuucagcccuuugc

SEQ ID NO: 6922 - RNA, 21 nt, Homo sapiens
ugggaagggcauccugguggc

SEQ ID NO: 6923 - RNA, 16 nt, Homo sapiens
agcugcucccugggug

SEQ ID NO: 6924 - RNA, 21 nt, Homo sapiens
agguuuuuauugcuuauugac

SEQ ID NO: 6925 - RNA, 20 nt, Homo sapiens
ugcauuuugagaucauguag

SEQ ID NO: 6926 - RNA, 21 nt, Homo sapiens
aaaaaaaaaaaaaaaggaauu

SEQ ID NO: 6927 - RNA, 24 nt, Homo sapiens
ccgccgccgccgagcuccccgccc

SEQ ID NO: 6928 - RNA, 17 nt, Homo sapiens
uaggcucucugagaaga

SEQ ID NO: 6929 - RNA, 22 nt, Homo sapiens
ugagaauuggggauauaaacau

SEQ ID NO: 6930 - RNA, 18 nt, Homo sapiens
uugcaggguuguggugag

SEQ ID NO: 6931 - RNA, 17 nt, Homo sapiens
auagaacagauagaacu

SEQ ID NO: 6932 - RNA, 20 nt, Homo sapiens
ugaaaaaaagauaugcaaaa

SEQ ID NO: 6933 - RNA, 15 nt, Homo sapiens
ugcacugagacaggg

SEQ ID NO: 6934 - RNA, 21 nt, Homo sapiens
ggucccgcgcgccgcugcccg

SEQ ID NO: 6935 - RNA, 20 nt, Homo sapiens
aaaguuaucauuuucuugga

SEQ ID NO: 6936 - RNA, 19 nt, Homo sapiens
cgggccgcugucucgaguc

SEQ ID NO: 6937 - RNA, 25 nt, Homo sapiens
gaaaaaauagugguauagucuccac

SEQ ID NO: 6938 - RNA, 19 nt, Homo sapiens
uaagacacaaaaugaaucc

SEQ ID NO: 6939 - RNA, 20 nt, Homo sapiens
ugugaucaauaacgacagua

SEQ ID NO: 6940 - RNA, 20 nt, Homo sapiens
cgucccucuccaaguuacau

SEQ ID NO: 6941 - RNA, 19 nt, Homo sapiens
uaagccuaaaacugaagag

SEQ ID NO: 6942 - RNA, 21 nt, Homo sapiens
uacguuucuuucuuguuuugu

SEQ ID NO: 6943 - RNA, 19 nt, Homo sapiens
ucuaaaacaucauucauac

SEQ ID NO: 6944 - RNA, 25 nt, Homo sapiens
ugagacaaaaaagaagggggagaga

SEQ ID NO: 6945 - RNA, 19 nt, Homo sapiens
ugaggaggaggaagagggg

SEQ ID NO: 6946 - RNA, 20 nt, Homo sapiens
ccgaccggccgcuggaggcc

SEQ ID NO: 6947 - RNA, 21 nt, Homo sapiens
ccucagggcaguggggggacc

SEQ ID NO: 6948 - RNA, 17 nt, Homo sapiens
gccccucucacuggggc

SEQ ID NO: 6949 - RNA, 18 nt, Homo sapiens
uccucuccccuuccacgg

SEQ ID NO: 6950 - RNA, 19 nt, Homo sapiens
ugccccucucacuggggcc

SEQ ID NO: 6951 - RNA, 18 nt, Homo sapiens
aaagaacggaauguacug

SEQ ID NO: 6952 - RNA, 23 nt, Homo sapiens
caagauuaagucuggguuauuuc

SEQ ID NO: 6953 - RNA, 21 nt, Homo sapiens
gcgugaacccgggagguggag

SEQ ID NO: 6954 - RNA, 17 nt, Homo sapiens
gcgugguggcgggcgcc

SEQ ID NO: 6955 - RNA, 20 nt, Homo sapiens
guggaucacaaggucaggag

SEQ ID NO: 6956 - RNA, 17 nt, Homo sapiens
uugggaggccgaggugg

SEQ ID NO: 6957 - RNA, 23 nt, Homo sapiens
aaguugccaguucugcauaaguu

SEQ ID NO: 6958 - RNA, 17 nt, Homo sapiens
augaacauugauuagag

SEQ ID NO: 6959 - RNA, 20 nt, Homo sapiens
cagagcacagguguuuguug

SEQ ID NO: 6960 - RNA, 17 nt, Homo sapiens
ccucauccucuaccagu

SEQ ID NO: 6961 - RNA, 19 nt, Homo sapiens
cuuauuacauguuggggaa

SEQ ID NO: 6962 - RNA, 24 nt, Homo sapiens
gccugacuggagcacuucauuaua

SEQ ID NO: 6963 - RNA, 19 nt, Homo sapiens
uacauggcaaugaaaagga

SEQ ID NO: 6964 - RNA, 23 nt, Homo sapiens
ucauccucuaccaguuccacucc

SEQ ID NO: 6965 - RNA, 20 nt, Homo sapiens
ugaaauaagaaugauuauuu

SEQ ID NO: 6966 - RNA, 21 nt, Homo sapiens
ugacacaagcaucaacaaaua

SEQ ID NO: 6967 - RNA, 19 nt, Homo sapiens
uggaagccacuuaagugcc

SEQ ID NO: 6968 - RNA, 21 nt, Homo sapiens
uuaagaaauaaacuuauugag

SEQ ID NO: 6969 - RNA, 17 nt, Homo sapiens
gagguugcagugagcca

SEQ ID NO: 6970 - RNA, 21 nt, Homo sapiens
gcagugagcugagaucgugcc

SEQ ID NO: 6971 - RNA, 21 nt, Homo sapiens
uacuucuaucccaauccaguc

SEQ ID NO: 6972 - RNA, 23 nt, Homo sapiens
ugccuguaaucccagcacuuugg

SEQ ID NO: 6973 - RNA, 23 nt, Homo sapiens
ugccuguaaucccugcacuuugg

SEQ ID NO: 6974 - RNA, 24 nt, Homo sapiens
ugggguucugagggaaaaugaggg

SEQ ID NO: 6975 - RNA, 17 nt, Homo sapiens
uugggaggcugaggcgg

SEQ ID NO: 6976 - RNA, 17 nt, Homo sapiens
uugggaggcugaggugg

SEQ ID NO: 6977 - RNA, 19 nt, Homo sapiens
aagaguucgagaccagccc

SEQ ID NO: 6978 - RNA, 17 nt, Homo sapiens
acgugcacacacgugca

SEQ ID NO: 6979 - RNA, 20 nt, Homo sapiens
agagaaggccucggggcucc

SEQ ID NO: 6980 - RNA, 24 nt, Homo sapiens
cagcgugguuaguguccucagaga

SEQ ID NO: 6981 - RNA, 18 nt, Homo sapiens
cuggugugugcacgcgug

SEQ ID NO: 6982 - RNA, 16 nt, Homo sapiens
gaacccaagaggcgga

SEQ ID NO: 6983 - RNA, 22 nt, Homo sapiens
gagguugcagugaacccagauc

SEQ ID NO: 6984 - RNA, 17 nt, Homo sapiens
gccaacaaugucagugc

SEQ ID NO: 6985 - RNA, 14 nt, Homo sapiens
gccaggaugcugag

SEQ ID NO: 6986 - RNA, 20 nt, Homo sapiens
ggagagcaggguggagaagc

SEQ ID NO: 6987 - RNA, 18 nt, Homo sapiens
gucaaggugucuggucgg

SEQ ID NO: 6988 - RNA, 21 nt, Homo sapiens
ugagacccugucuaaaaauaa

SEQ ID NO: 6989 - RNA, 18 nt, Homo sapiens
ugagcagaauaaauguga

SEQ ID NO: 6990 - RNA, 18 nt, Homo sapiens
ugaggaagcccaacuagc

SEQ ID NO: 6991 - RNA, 19 nt, Homo sapiens
ugcaguggcgugaucucgg

SEQ ID NO: 6992 - RNA, 20 nt, Homo sapiens
ugucacgauuuucauuuagc

SEQ ID NO: 6993 - RNA, 17 nt, Homo sapiens
uguguguaugugugugu

SEQ ID NO: 6994 - RNA, 15 nt, Homo sapiens
uuccagacugggggc

SEQ ID NO: 6995 - RNA, 17 nt, Homo sapiens
uugggaggcugaggugg

SEQ ID NO: 6996 - RNA, 18 nt, Homo sapiens
uuucuauaauuccaauuu

SEQ ID NO: 6997 - RNA, 18 nt, Homo sapiens
cacuuauguugguacacu

SEQ ID NO: 6998 - RNA, 19 nt, Homo sapiens
aaacacuccccauguucag

SEQ ID NO: 6999 - RNA, 17 nt, Homo sapiens
caacaggcccaguuccu

SEQ ID NO: 7000 - RNA, 18 nt, Homo sapiens
cagcacaaacacacacuc

SEQ ID NO: 7001 - RNA, 20 nt, Homo sapiens
cagcggugccuuuauuauca

SEQ ID NO: 7002 - RNA, 18 nt, Homo sapiens
cccagcugcagcuggcgc

SEQ ID NO: 7003 - RNA, 16 nt, Homo sapiens
gcucaucuagggcaag

SEQ ID NO: 7004 - RNA, 22 nt, Homo sapiens
gcaaacaguccucaguuacagc

SEQ ID NO: 7005 - RNA, 18 nt, Homo sapiens
gccacaacccgaaaacca

SEQ ID NO: 7006 - RNA, 20 nt, Homo sapiens
uaaugcggugccaggguccc

SEQ ID NO: 7007 - RNA, 22 nt, Homo sapiens
uaauuuaugaaauauuuacagc

SEQ ID NO: 7008 - RNA, 24 nt, Homo sapiens
uucacauuuggauucaucuuagag

SEQ ID NO: 7009 - RNA, 17 nt, Homo sapiens
uuugucuuucaaaaacu

SEQ ID NO: 7010 - RNA, 21 nt, Homo sapiens
caaaaaaagagaaaaaaaugg

SEQ ID NO: 7011 - RNA, 19 nt, Homo sapiens
aaaaaccaaaacaaaacaa

SEQ ID NO: 7012 - RNA, 22 nt, Homo sapiens
caccuguagucccagcuacucu

SEQ ID NO: 7013 - RNA, 18 nt, Homo sapiens
cgcggcaacugcuggagc

SEQ ID NO: 7014 - RNA, 21 nt, Homo sapiens
cuucuucgucuucauccuucg

SEQ ID NO: 7015 - RNA, 17 nt, Homo sapiens
cuugacaauaaaacuug

SEQ ID NO: 7016 - RNA, 19 nt, Homo sapiens
gaugaguguauauuuugca

SEQ ID NO: 7017 - RNA, 20 nt, Homo sapiens
gcaaucauccaagaaaaaga

SEQ ID NO: 7018 - RNA, 19 nt, Homo sapiens
ggaacuuaucaccagguaa

SEQ ID NO: 7019 - RNA, 15 nt, Homo sapiens
ucugcaccaugacac

SEQ ID NO: 7020 - RNA, 24 nt, Homo sapiens
ugaguuucuaggcccuuauuuugu

SEQ ID NO: 7021 - RNA, 17 nt, Homo sapiens
uugggaggcugaggugg

SEQ ID NO: 7022 - RNA, 24 nt, Homo sapiens
acaauguaaugcuaaacugagaaa

SEQ ID NO: 7023 - RNA, 23 nt, Homo sapiens
uuaauuaauauauggauuuuauu

SEQ ID NO: 7024 - RNA, 20 nt, Homo sapiens
augaggaaaggggccaaggc

SEQ ID NO: 7025 - RNA, 15 nt, Homo sapiens
aggaaguugcauggu

SEQ ID NO: 7026 - RNA, 17 nt, Homo sapiens
cacagcaaacuaggauu

SEQ ID NO: 7027 - RNA, 23 nt, Homo sapiens
cagccugguacagcugccaccug

SEQ ID NO: 7028 - RNA, 18 nt, Homo sapiens
gagcuagauuguccucuu

SEQ ID NO: 7029 - RNA, 23 nt, Homo sapiens
uccccucuuccucugucuggcuc

SEQ ID NO: 7030 - RNA, 16 nt, Homo sapiens
ccagaggagcuauucu

SEQ ID NO: 7031 - RNA, 23 nt, Homo sapiens
gcccuggcuggcuggcucucccu

SEQ ID NO: 7032 - RNA, 25 nt, Homo sapiens
uggcuugugguaaccauguaacaug

SEQ ID NO: 7033 - RNA, 17 nt, Homo sapiens
uuuggguaagaaaauuu

SEQ ID NO: 7034 - RNA, 23 nt, Homo sapiens
agguuuguggacacaucugggga

SEQ ID NO: 7035 - RNA, 18 nt, Homo sapiens
cagccugucacauguccc

SEQ ID NO: 7036 - RNA, 20 nt, Homo sapiens
cgguccccaaguugcccgcc

SEQ ID NO: 7037 - RNA, 17 nt, Homo sapiens
cuuuggaaaaggagggg

SEQ ID NO: 7038 - RNA, 20 nt, Homo sapiens
gccgugagauugcacuuugg

SEQ ID NO: 7039 - RNA, 23 nt, Homo sapiens
gccuacgggcgccuucggccccg

SEQ ID NO: 7040 - RNA, 17 nt, Homo sapiens
ggaggggcggggcugcg

SEQ ID NO: 7041 - RNA, 22 nt, Homo sapiens
ggguccggguucccgcccuggg

SEQ ID NO: 7042 - RNA, 22 nt, Homo sapiens
uauacagcaaguaaagacaugu

SEQ ID NO: 7043 - RNA, 21 nt, Homo sapiens
uauuacaacuacuugauuaaa

SEQ ID NO: 7044 - RNA, 23 nt, Homo sapiens
uccagccggguccggguucccgc

SEQ ID NO: 7045 - RNA, 17 nt, Homo sapiens
uccugagacuauuccau

SEQ ID NO: 7046 - RNA, 16 nt, Homo sapiens
ugggagucccgagggc

SEQ ID NO: 7047 - RNA, 21 nt, Homo sapiens
cagcugccgccuccggccacg

SEQ ID NO: 7048 - RNA, 20 nt, Homo sapiens
ccaggagucgcggcuuccgg

SEQ ID NO: 7049 - RNA, 17 nt, Homo sapiens
ccagggccgaaggggac

SEQ ID NO: 7050 - RNA, 18 nt, Homo sapiens
cccgaaggcuaagcccgg

SEQ ID NO: 7051 - RNA, 19 nt, Homo sapiens
cugccgccuccggccacgu

SEQ ID NO: 7052 - RNA, 16 nt, Homo sapiens
gagcgugugaccccgg

SEQ ID NO: 7053 - RNA, 24 nt, Homo sapiens
ugaaaucgguaaccuuuagcagca

SEQ ID NO: 7054 - RNA, 18 nt, Homo sapiens
ugcauccuuuuuugccuu

SEQ ID NO: 7055 - RNA, 21 nt, Homo sapiens
cggccggggggcggcggaggg

SEQ ID NO: 7056 - RNA, 25 nt, Homo sapiens
gcccugggccgggaagagggcgggg

SEQ ID NO: 7057 - RNA, 16 nt, Homo sapiens
gccggggggcggcgga

SEQ ID NO: 7058 - RNA, 18 nt, Homo sapiens
gggagagggaaagggggc

SEQ ID NO: 7059 - RNA, 21 nt, Homo sapiens
gggagggggagagggaaaggg

SEQ ID NO: 7060 - RNA, 22 nt, Homo sapiens
ggggcguuggcaaggaggcugg

SEQ ID NO: 7061 - RNA, 20 nt, Homo sapiens
uggcaaaccggauggguuca

SEQ ID NO: 7062 - RNA, 26 nt, Homo sapiens
acgccaugagagaaaucucuacaggg

SEQ ID NO: 7063 - RNA, 18 nt, Homo sapiens
agcggaaaggggaguugg

SEQ ID NO: 7064 - RNA, 20 nt, Homo sapiens
agcggaaaggggaguugggg

SEQ ID NO: 7065 - RNA, 17 nt, Homo sapiens
ccucagggccaccaugg

SEQ ID NO: 7066 - RNA, 17 nt, Homo sapiens
gaggacccugccugagc

SEQ ID NO: 7067 - RNA, 21 nt, Homo sapiens
gcagguccugggguggcuggg

SEQ ID NO: 7068 - RNA, 19 nt, Homo sapiens
gccggcuggccggcccggg

SEQ ID NO: 7069 - RNA, 15 nt, Homo sapiens
ggcagguccuggggu

SEQ ID NO: 7070 - RNA, 16 nt, Homo sapiens
uccugggguggcuggg

SEQ ID NO: 7071 - RNA, 21 nt, Homo sapiens
gcugcagccgccagcacccga

SEQ ID NO: 7072 - RNA, 17 nt, Homo sapiens
gcuuagguuugaacucc

SEQ ID NO: 7073 - RNA, 19 nt, Homo sapiens
uccggcugcagccgccagc

SEQ ID NO: 7074 - RNA, 19 nt, Homo sapiens
acaggaaucuuuuccuuuc

SEQ ID NO: 7075 - RNA, 23 nt, Homo sapiens
aggugaaggacaggaaucuuuuc

SEQ ID NO: 7076 - RNA, 19 nt, Homo sapiens
agcaccccgcgcaggagga

SEQ ID NO: 7077 - RNA, 20 nt, Homo sapiens
uaaaaauaugguauagaacu

SEQ ID NO: 7078 - RNA, 21 nt, Homo sapiens
uacagagugucagugagcgga

SEQ ID NO: 7079 - RNA, 20 nt, Homo sapiens
uugcuuuuuucaaacagauu

SEQ ID NO: 7080 - RNA, 21 nt, Homo sapiens
uugcuuuuuucaaacagauuu

SEQ ID NO: 7081 - RNA, 22 nt, Homo sapiens
acaagaauuguugagucugagg

SEQ ID NO: 7082 - RNA, 22 nt, Homo sapiens
gagcaagguuugggggccgcua

SEQ ID NO: 7083 - RNA, 19 nt, Homo sapiens
uggggucuggacccccagc

SEQ ID NO: 7084 - RNA, 18 nt, Homo sapiens
aacggcagguucauaaac

SEQ ID NO: 7085 - RNA, 24 nt, Homo sapiens
auauauucaaaaaaaaaguuuuug

SEQ ID NO: 7086 - RNA, 22 nt, Homo sapiens
uagaugccauuacauuauuuag

SEQ ID NO: 7087 - RNA, 20 nt, Homo sapiens
ugaaggacuugauuuagagg

SEQ ID NO: 7088 - RNA, 18 nt, Homo sapiens
accacagagcuugaauaa

SEQ ID NO: 7089 - RNA, 16 nt, Homo sapiens
ucacagagucaaugcc

SEQ ID NO: 7090 - RNA, 18 nt, Homo sapiens
uuacacaacacuggauau

SEQ ID NO: 7091 - RNA, 21 nt, Homo sapiens
augaagcuugaaugaagcagg

SEQ ID NO: 7092 - RNA, 19 nt, Homo sapiens
cggaggggaggggcugagg

SEQ ID NO: 7093 - RNA, 16 nt, Homo sapiens
gcuuuucaauaaugua

SEQ ID NO: 7094 - RNA, 20 nt, Homo sapiens
gggcugagggaggguguggg

SEQ ID NO: 7095 - RNA, 18 nt, Homo sapiens
gggugugggggacgcagg

SEQ ID NO: 7096 - RNA, 18 nt, Homo sapiens
uauacagauuugcuuuuc

SEQ ID NO: 7097 - RNA, 24 nt, Homo sapiens
uugacuuauuuguuguuucuccau

SEQ ID NO: 7098 - RNA, 17 nt, Homo sapiens
ucaaguguguuaaugug

SEQ ID NO: 7099 - RNA, 21 nt, Homo sapiens
ggaguggugggaggguaaggg

SEQ ID NO: 7100 - RNA, 16 nt, Homo sapiens
ggggaguggugggagg

SEQ ID NO: 7101 - RNA, 22 nt, Homo sapiens
ugcugggaaguugcaaagaaag

SEQ ID NO: 7102 - RNA, 21 nt, Homo sapiens
gcagugagcugagaucgugcc

SEQ ID NO: 7103 - RNA, 19 nt, Homo sapiens
ugagaucgugccacggcac

SEQ ID NO: 7104 - RNA, 18 nt, Homo sapiens
uggaugagaaacggccug

SEQ ID NO: 7105 - RNA, 17 nt, Homo sapiens
aguggcggcagcggcgc

SEQ ID NO: 7106 - RNA, 14 nt, Homo sapiens
gcaguggcggcagc

SEQ ID NO: 7107 - RNA, 18 nt, Homo sapiens
ccccagaacccaaggccc

SEQ ID NO: 7108 - RNA, 17 nt, Homo sapiens
gaaggaggggcaaguag

SEQ ID NO: 7109 - RNA, 17 nt, Homo sapiens
cccgccgcccccggccc

SEQ ID NO: 7110 - RNA, 23 nt, Homo sapiens
ccgcccgccgcccccggcccucg

SEQ ID NO: 7111 - RNA, 21 nt, Homo sapiens
ccggcccucgcugccccggcc

SEQ ID NO: 7112 - RNA, 18 nt, Homo sapiens
aagaugagcugagaugcu

SEQ ID NO: 7113 - RNA, 17 nt, Homo sapiens
gggcugugcacaggaac

SEQ ID NO: 7114 - RNA, 18 nt, Homo sapiens
ucuagaaugcacaauggu

SEQ ID NO: 7115 - RNA, 19 nt, Homo sapiens
uuuagcuaaugccaagugg

SEQ ID NO: 7116 - RNA, 22 nt, Homo sapiens
agacacaaguguucuauuuggu

SEQ ID NO: 7117 - RNA, 25 nt, Homo sapiens
cacgugacagauugagagugugauc

SEQ ID NO: 7118 - RNA, 23 nt, Homo sapiens
ucggggcuguggccuccaagcgg

SEQ ID NO: 7119 - RNA, 20 nt, Homo sapiens
ugggacaugcuuuccugaua

SEQ ID NO: 7120 - RNA, 18 nt, Homo sapiens
uuuuucuagauuccagaa

SEQ ID NO: 7121 - RNA, 23 nt, Homo sapiens
aaauguuugauaagguacagauu

SEQ ID NO: 7122 - RNA, 21 nt, Homo sapiens
gaacuccuaaccucaagugau

SEQ ID NO: 7123 - RNA, 21 nt, Homo sapiens
guggcauucaccuccccagca

SEQ ID NO: 7124 - RNA, 17 nt, Homo sapiens
uaucuuuugauuuccag

SEQ ID NO: 7125 - RNA, 16 nt, Homo sapiens
uuagcaugacaauacc

SEQ ID NO: 7126 - RNA, 19 nt, Homo sapiens
uuggcauaaucaugagaac

SEQ ID NO: 7127 - RNA, 20 nt, Homo sapiens
aggccagagcccagaggagc

SEQ ID NO: 7128 - RNA, 22 nt, Homo sapiens
agggggcaggcagaggagccag

SEQ ID NO: 7129 - RNA, 18 nt, Homo sapiens
agggucgacgcgagcugc

SEQ ID NO: 7130 - RNA, 21 nt, Homo sapiens
ggagagagguaccgggcuggu

SEQ ID NO: 7131 - RNA, 18 nt, Homo sapiens
ggcaggcagaggagccag

SEQ ID NO: 7132 - RNA, 16 nt, Homo sapiens
ggccagagcccagagg

SEQ ID NO: 7133 - RNA, 15 nt, Homo sapiens
ugaaggaggcggggg

SEQ ID NO: 7134 - RNA, 21 nt, Homo sapiens
cagcaggccugggcgcugcuc

SEQ ID NO: 7135 - RNA, 22 nt, Homo sapiens
ccugccugcucucuggggaacc

SEQ ID NO: 7136 - RNA, 19 nt, Homo sapiens
cugcgcggccgcgaccugc

SEQ ID NO: 7137 - RNA, 22 nt, Homo sapiens
gagcuggggaggggacccuggg

SEQ ID NO: 7138 - RNA, 21 nt, Homo sapiens
gcccgcccgcgcgcggagacc

SEQ ID NO: 7139 - RNA, 22 nt, Homo sapiens
gcgcggggcuggauggggcugc

SEQ ID NO: 7140 - RNA, 20 nt, Homo sapiens
gcucggccgcccgcucggac

SEQ ID NO: 7141 - RNA, 20 nt, Homo sapiens
uacugagcgguguccacucc

SEQ ID NO: 7142 - RNA, 18 nt, Homo sapiens
uaggggcaggguggcggc

SEQ ID NO: 7143 - RNA, 23 nt, Homo sapiens
ugagacggugcagggaguacggu

SEQ ID NO: 7144 - RNA, 18 nt, Homo sapiens
uggggugaugagagugcc

SEQ ID NO: 7145 - RNA, 20 nt, Homo sapiens
auggagauggggaaggggcc

SEQ ID NO: 7146 - RNA, 20 nt, Homo sapiens
cuuagggccugcugagcaga

SEQ ID NO: 7147 - RNA, 21 nt, Homo sapiens
cuuagggccugcugagcagau

SEQ ID NO: 7148 - RNA, 18 nt, Homo sapiens
uggugcuguuggguggcc

SEQ ID NO: 7149 - RNA, 19 nt, Homo sapiens
uguacaauuggugcuguug

SEQ ID NO: 7150 - RNA, 19 nt, Homo sapiens
ccuggcgcuuccacccugg

SEQ ID NO: 7151 - RNA, 23 nt, Homo sapiens
ggaggcggguggcgcgcggccgg

SEQ ID NO: 7152 - RNA, 17 nt, Homo sapiens
uggcgcgcggccggggc

SEQ ID NO: 7153 - RNA, 20 nt, Homo sapiens
gggguaggugaggcacaagg

SEQ ID NO: 7154 - RNA, 20 nt, Homo sapiens
ugccccggccgucgcucccc

SEQ ID NO: 7155 - RNA, 19 nt, Homo sapiens
ugcucccucugggagguug

SEQ ID NO: 7156 - RNA, 18 nt, Homo sapiens
acgguuugcucucaugac

SEQ ID NO: 7157 - RNA, 18 nt, Homo sapiens
gaaucucuuugauuggug

SEQ ID NO: 7158 - RNA, 18 nt, Homo sapiens
gaggcugcugggcagugg

SEQ ID NO: 7159 - RNA, 19 nt, Homo sapiens
ucggccgcggggugaaccu

SEQ ID NO: 7160 - RNA, 16 nt, Homo sapiens
ccuuggaggcacagaa

SEQ ID NO: 7161 - RNA, 20 nt, Homo sapiens
ccuuggaggcacagaacagc

SEQ ID NO: 7162 - RNA, 19 nt, Homo sapiens
gggaaggggcgacauggag

SEQ ID NO: 7163 - RNA, 22 nt, Homo sapiens
ugaaagggaaggggcgacaugg

SEQ ID NO: 7164 - RNA, 19 nt, Homo sapiens
uacacaugccauacauuuc

SEQ ID NO: 7165 - RNA, 17 nt, Homo sapiens
uuggaaggcaaagguga

SEQ ID NO: 7166 - RNA, 23 nt, Homo sapiens
gggagaaaaaggcuauuauacaa

SEQ ID NO: 7167 - RNA, 18 nt, Homo sapiens
aaagggaaaaaaaggaaa

SEQ ID NO: 7168 - RNA, 20 nt, Homo sapiens
aaagggaaagaaaaaggaaa

SEQ ID NO: 7169 - RNA, 20 nt, Homo sapiens
cuagaaugaaaggaaagaga

SEQ ID NO: 7170 - RNA, 19 nt, Homo sapiens
gagugagagagaaaggaaa

SEQ ID NO: 7171 - RNA, 21 nt, Homo sapiens
ggaaagaaaaaggggaaaggg

SEQ ID NO: 7172 - RNA, 15 nt, Homo sapiens
ggaagggaagggaag

SEQ ID NO: 7173 - RNA, 19 nt, Homo sapiens
uguuuccuuugucaacaga

SEQ ID NO: 7174 - RNA, 15 nt, Homo sapiens
ggagcugguugcugg

SEQ ID NO: 7175 - RNA, 18 nt, Homo sapiens
gggagaggcugggagggg

SEQ ID NO: 7176 - RNA, 22 nt, Homo sapiens
gggcaguccuggcggcagaacc

SEQ ID NO: 7177 - RNA, 17 nt, Homo sapiens
uucaggaacugcugcgg

SEQ ID NO: 7178 - RNA, 22 nt, Homo sapiens
ccccagccuuuucggucucucc

SEQ ID NO: 7179 - RNA, 19 nt, Homo sapiens
ccuuuucggucucuccuac

SEQ ID NO: 7180 - RNA, 20 nt, Homo sapiens
cggcccucgcagggcucggg

SEQ ID NO: 7181 - RNA, 17 nt, Homo sapiens
gcggcgggcaguacgcc

SEQ ID NO: 7182 - RNA, 26 nt, Homo sapiens
ggccacacccucgcuauguggccucc

SEQ ID NO: 7183 - RNA, 24 nt, Homo sapiens
ugagagaaaaugagggagaaggag

SEQ ID NO: 7184 - RNA, 20 nt, Homo sapiens
acaauauuuacucuuguuga

SEQ ID NO: 7185 - RNA, 17 nt, Homo sapiens
gugcccaucagugccaa

SEQ ID NO: 7186 - RNA, 20 nt, Homo sapiens
uccagguaaauggacaaagg

SEQ ID NO: 7187 - RNA, 23 nt, Homo sapiens
uggccuggcauuagcaacggcuc

SEQ ID NO: 7188 - RNA, 15 nt, Homo sapiens
ccgccaugacagccc

SEQ ID NO: 7189 - RNA, 20 nt, Homo sapiens
gaacagcaggccggugugcu

SEQ ID NO: 7190 - RNA, 21 nt, Homo sapiens
gcagggggggggggcgggggg

SEQ ID NO: 7191 - RNA, 23 nt, Homo sapiens
gcagggggggggggcgggggggg

SEQ ID NO: 7192 - RNA, 14 nt, Homo sapiens
ggggggcggggggg

SEQ ID NO: 7193 - RNA, 17 nt, Homo sapiens
ggggggggcgggggggg

SEQ ID NO: 7194 - RNA, 18 nt, Homo sapiens
gggggggggcgggggggg

SEQ ID NO: 7195 - RNA, 22 nt, Homo sapiens
acacaaccuuuuuucaacugga

SEQ ID NO: 7196 - RNA, 18 nt, Homo sapiens
acauauuuaauaaaucau

SEQ ID NO: 7197 - RNA, 22 nt, Homo sapiens
agcaaaaccuuucggaaaccuc

SEQ ID NO: 7198 - RNA, 17 nt, Homo sapiens
agccgccgcggccgccg

SEQ ID NO: 7199 - RNA, 15 nt, Homo sapiens
agcugcagccgccgc

SEQ ID NO: 7200 - RNA, 24 nt, Homo sapiens
aggaugugaaccaguauaucacaa

SEQ ID NO: 7201 - RNA, 16 nt, Homo sapiens
aggcaguagaagggga

SEQ ID NO: 7202 - RNA, 18 nt, Homo sapiens
augguguuuuaucccucu

SEQ ID NO: 7203 - RNA, 20 nt, Homo sapiens
caccgcccgccggccugccc

SEQ ID NO: 7204 - RNA, 20 nt, Homo sapiens
caugguguuuuaucccucuu

SEQ ID NO: 7205 - RNA, 20 nt, Homo sapiens
ccgccgcggccgccgccgcc

SEQ ID NO: 7206 - RNA, 16 nt, Homo sapiens
ccggcguucccagccc

SEQ ID NO: 7207 - RNA, 17 nt, Homo sapiens
ccugcuucuccucagca

SEQ ID NO: 7208 - RNA, 19 nt, Homo sapiens
cgccgcugccgccgccgca

SEQ ID NO: 7209 - RNA, 21 nt, Homo sapiens
cucgcucugccgccgcuuggc

SEQ ID NO: 7210 - RNA, 20 nt, Homo sapiens
gagaugguauaugguccaga

SEQ ID NO: 7211 - RNA, 14 nt, Homo sapiens
gcagcggcggcagc

SEQ ID NO: 7212 - RNA, 19 nt, Homo sapiens
gcccgccggccugcccgcc

SEQ ID NO: 7213 - RNA, 18 nt, Homo sapiens
gccggccugcccgccccc

SEQ ID NO: 7214 - RNA, 19 nt, Homo sapiens
gccugcccgcccccuccgc

SEQ ID NO: 7215 - RNA, 20 nt, Homo sapiens
gcgccgggagcccgggcgcc

SEQ ID NO: 7216 - RNA, 20 nt, Homo sapiens
gcggcggcggcggacgggag

SEQ ID NO: 7217 - RNA, 19 nt, Homo sapiens
gcgggaggcgagcgagagg

SEQ ID NO: 7218 - RNA, 19 nt, Homo sapiens
gcuccgggccgcggccgcc

SEQ ID NO: 7219 - RNA, 20 nt, Homo sapiens
gggucccuggaugugccgcc

SEQ ID NO: 7220 - RNA, 22 nt, Homo sapiens
ugccgccgcuuggcucuggacc

SEQ ID NO: 7221 - RNA, 22 nt, Homo sapiens
ugguugcagcgacugggccugc

SEQ ID NO: 7222 - RNA, 20 nt, Homo sapiens
uguguguaaauagcuggaga

SEQ ID NO: 7223 - RNA, 19 nt, Homo sapiens
gaauuuuauucuuuuauaa

SEQ ID NO: 7224 - RNA, 19 nt, Homo sapiens
ccgcgcggccggugccucc

SEQ ID NO: 7225 - RNA, 23 nt, Homo sapiens
cguacaacaaucacguguugacc

SEQ ID NO: 7226 - RNA, 20 nt, Homo sapiens
cugucugcggugcucggccg

SEQ ID NO: 7227 - RNA, 20 nt, Homo sapiens
acaaaagcuguccauuauuc

SEQ ID NO: 7228 - RNA, 23 nt, Homo sapiens
ccuggaaaggagaagacaguggc

SEQ ID NO: 7229 - RNA, 21 nt, Homo sapiens
cugcagcucccucaagacugg

SEQ ID NO: 7230 - RNA, 19 nt, Homo sapiens
uacuugccagaagcucaga

SEQ ID NO: 7231 - RNA, 16 nt, Homo sapiens
acgcguccgcccacgc

SEQ ID NO: 7232 - RNA, 21 nt, Homo sapiens
caugaugagcagagagaucug

SEQ ID NO: 7233 - RNA, 14 nt, Homo sapiens
ccccgcucccaccc

SEQ ID NO: 7234 - RNA, 18 nt, Homo sapiens
gaugagcagagagaucug

SEQ ID NO: 7235 - RNA, 16 nt, Homo sapiens
uggacacucacagggc

SEQ ID NO: 7236 - RNA, 21 nt, Homo sapiens
aggggcaaccacacaggaaaa

SEQ ID NO: 7237 - RNA, 18 nt, Homo sapiens
cucgcauugucuuacuuc

SEQ ID NO: 7238 - RNA, 21 nt, Homo sapiens
gacaacaagugcauuuauuag

SEQ ID NO: 7239 - RNA, 25 nt, Homo sapiens
uaccacaaaaggaguuaaggcaguu

SEQ ID NO: 7240 - RNA, 15 nt, Homo sapiens
acggaagaagcuccc

SEQ ID NO: 7241 - RNA, 26 nt, Homo sapiens
aggagggcauauccuagggcagcggg

SEQ ID NO: 7242 - RNA, 16 nt, Homo sapiens
cagcgggccugaaggg

SEQ ID NO: 7243 - RNA, 23 nt, Homo sapiens
ccugucaaucuuggcauuaaaaa

SEQ ID NO: 7244 - RNA, 20 nt, Homo sapiens
gcaccaagugacacuuugga

SEQ ID NO: 7245 - RNA, 16 nt, Homo sapiens
ggagauucagacuuuc

SEQ ID NO: 7246 - RNA, 19 nt, Homo sapiens
ucaaagaaucuccuuugau

SEQ ID NO: 7247 - RNA, 21 nt, Homo sapiens
ugugauggccaccuguguggg

SEQ ID NO: 7248 - RNA, 21 nt, Homo sapiens
uguggacaauuaguguugucc

SEQ ID NO: 7249 - RNA, 20 nt, Homo sapiens
uuaacagcauaguuacacuu

SEQ ID NO: 7250 - RNA, 23 nt, Homo sapiens
auucagugguuuccuuuucucua

SEQ ID NO: 7251 - RNA, 16 nt, Homo sapiens
gugauauuagaucccc

SEQ ID NO: 7252 - RNA, 20 nt, Homo sapiens
uacgaaauguuauacacagg

SEQ ID NO: 7253 - RNA, 19 nt, Homo sapiens
ucauauccagucaaacauu

SEQ ID NO: 7254 - RNA, 20 nt, Homo sapiens
uccccgcugcggggagagcc

SEQ ID NO: 7255 - RNA, 19 nt, Homo sapiens
ucccggcgcugugggugcg

SEQ ID NO: 7256 - RNA, 17 nt, Homo sapiens
acuuccugucaggacca

SEQ ID NO: 7257 - RNA, 21 nt, Homo sapiens
cuugccuguuuucacagacuc

SEQ ID NO: 7258 - RNA, 23 nt, Homo sapiens
ucucaagcagcccuuuccuagcc

SEQ ID NO: 7259 - RNA, 16 nt, Homo sapiens
ccccaguccagcucgc

SEQ ID NO: 7260 - RNA, 15 nt, Homo sapiens
cccggcccggcuuga

SEQ ID NO: 7261 - RNA, 14 nt, Homo sapiens
cgauccccccaacc

SEQ ID NO: 7262 - RNA, 15 nt, Homo sapiens
gcuggggcaggaugc

SEQ ID NO: 7263 - RNA, 15 nt, Homo sapiens
ucagcccggcccggc

SEQ ID NO: 7264 - RNA, 18 nt, Homo sapiens
aaaauugaacagaauuug

SEQ ID NO: 7265 - RNA, 20 nt, Homo sapiens
ccucaguugauuaaacauag

SEQ ID NO: 7266 - RNA, 19 nt, Homo sapiens
ugcuuucaagcauaaaaca

SEQ ID NO: 7267 - RNA, 21 nt, Homo sapiens
aaagguuuaaaaacuaugaaa

SEQ ID NO: 7268 - RNA, 15 nt, Homo sapiens
aacagaccagucugu

SEQ ID NO: 7269 - RNA, 20 nt, Homo sapiens
aaggacacagaccccgagga

SEQ ID NO: 7270 - RNA, 18 nt, Homo sapiens
aaguggacauaguacaga

SEQ ID NO: 7271 - RNA, 16 nt, Homo sapiens
aaugagcccacccagc

SEQ ID NO: 7272 - RNA, 18 nt, Homo sapiens
agaggugugaaagguucc

SEQ ID NO: 7273 - RNA, 20 nt, Homo sapiens
aggcacugugaagccccguu

SEQ ID NO: 7274 - RNA, 16 nt, Homo sapiens
aggcucauuggccauc

SEQ ID NO: 7275 - RNA, 21 nt, Homo sapiens
ccccuuaccccauguggggcc

SEQ ID NO: 7276 - RNA, 16 nt, Homo sapiens
ccuugcagcagaucuu

SEQ ID NO: 7277 - RNA, 20 nt, Homo sapiens
cugaaauccacucuuucucu

SEQ ID NO: 7278 - RNA, 20 nt, Homo sapiens
cuugcagaaaagaccgugga

SEQ ID NO: 7279 - RNA, 17 nt, Homo sapiens
gaagccuccaauguauc

SEQ ID NO: 7280 - RNA, 18 nt, Homo sapiens
gccuagaguuuaggcagg

SEQ ID NO: 7281 - RNA, 17 nt, Homo sapiens
gcggcagacgcacgggg

SEQ ID NO: 7282 - RNA, 23 nt, Homo sapiens
gcucuggcuguugcuccacgggg

SEQ ID NO: 7283 - RNA, 21 nt, Homo sapiens
ggggagaaggagggaugcugc

SEQ ID NO: 7284 - RNA, 15 nt, Homo sapiens
guuuagaguugagca

SEQ ID NO: 7285 - RNA, 16 nt, Homo sapiens
uaccccauguggggcc

SEQ ID NO: 7286 - RNA, 19 nt, Homo sapiens
ucacauuugauuucuguag

SEQ ID NO: 7287 - RNA, 22 nt, Homo sapiens
uccauuuuuuaauauuuguuua

SEQ ID NO: 7288 - RNA, 20 nt, Homo sapiens
ucccuguccaccacaacacc

SEQ ID NO: 7289 - RNA, 17 nt, Homo sapiens
uccguguggugacaggg

SEQ ID NO: 7290 - RNA, 22 nt, Homo sapiens
uccuugcagcagaucuuuucac

SEQ ID NO: 7291 - RNA, 18 nt, Homo sapiens
ucuuucucacgaagaaaa

SEQ ID NO: 7292 - RNA, 21 nt, Homo sapiens
ucuuuggguuuauaggaacag

SEQ ID NO: 7293 - RNA, 20 nt, Homo sapiens
ugaaacgaagaaaguacuau

SEQ ID NO: 7294 - RNA, 18 nt, Homo sapiens
ugaaauagaaccacaaaa

SEQ ID NO: 7295 - RNA, 15 nt, Homo sapiens
ugaacaguauucuca

SEQ ID NO: 7296 - RNA, 17 nt, Homo sapiens
ugaguccacaugaguug

SEQ ID NO: 7297 - RNA, 20 nt, Homo sapiens
ugcagcugcuguugcucugg

SEQ ID NO: 7298 - RNA, 20 nt, Homo sapiens
ugcuugugguucaugaaaca

SEQ ID NO: 7299 - RNA, 22 nt, Homo sapiens
uuagaaaauagaauaugaauuc

SEQ ID NO: 7300 - RNA, 18 nt, Homo sapiens
uuccuauugcuccaaacc

SEQ ID NO: 7301 - RNA, 17 nt, Homo sapiens
uucuguugcucucacug

SEQ ID NO: 7302 - RNA, 22 nt, Homo sapiens
uuuaagaauuguaagugggggu

SEQ ID NO: 7303 - RNA, 18 nt, Homo sapiens
uuuaauacaguugaacca

SEQ ID NO: 7304 - RNA, 19 nt, Homo sapiens
uuucgcccugacuaauuuc

SEQ ID NO: 7305 - RNA, 22 nt, Homo sapiens
cagccaaucuaacuugaagagu

SEQ ID NO: 7306 - RNA, 21 nt, Homo sapiens
cugggcuauuuugucauggug

SEQ ID NO: 7307 - RNA, 20 nt, Homo sapiens
gacucugugguggaauuggg

SEQ ID NO: 7308 - RNA, 14 nt, Homo sapiens
gagacacgauccug

SEQ ID NO: 7309 - RNA, 20 nt, Homo sapiens
ucaaaaugagacacgauccu

SEQ ID NO: 7310 - RNA, 19 nt, Homo sapiens
ucaccaccuaaacgugcca

SEQ ID NO: 7311 - RNA, 15 nt, Homo sapiens
uuccgcuccuuuucu

SEQ ID NO: 7312 - RNA, 17 nt, Homo sapiens
aaagagacggggcgugg

SEQ ID NO: 7313 - RNA, 18 nt, Homo sapiens
aaaggaggggcgacaggg

SEQ ID NO: 7314 - RNA, 16 nt, Homo sapiens
aagcacacauacaugu

SEQ ID NO: 7315 - RNA, 20 nt, Homo sapiens
acagucccagauucaaagcc

SEQ ID NO: 7316 - RNA, 21 nt, Homo sapiens
agacaucuuugucugggcugg

SEQ ID NO: 7317 - RNA, 17 nt, Homo sapiens
aggucccugacucccgc

SEQ ID NO: 7318 - RNA, 18 nt, Homo sapiens
caauucccauuucccaug

SEQ ID NO: 7319 - RNA, 17 nt, Homo sapiens
caggacccagccugucu

SEQ ID NO: 7320 - RNA, 17 nt, Homo sapiens
gaaaggugagaaagaga

SEQ ID NO: 7321 - RNA, 14 nt, Homo sapiens
gcaggccagcuccu

SEQ ID NO: 7322 - RNA, 19 nt, Homo sapiens
gcucgggccugggugucag

SEQ ID NO: 7323 - RNA, 19 nt, Homo sapiens
gcugcacgccccagggucg

SEQ ID NO: 7324 - RNA, 19 nt, Homo sapiens
ggaaaggugagaaagagac

SEQ ID NO: 7325 - RNA, 16 nt, Homo sapiens
ggcagugcccuggggu

SEQ ID NO: 7326 - RNA, 25 nt, Homo sapiens
gggaggagaggggagugugcuucug

SEQ ID NO: 7327 - RNA, 16 nt, Homo sapiens
ggggaggagaggggag

SEQ ID NO: 7328 - RNA, 19 nt, Homo sapiens
ucugcaggggaggggccac

SEQ ID NO: 7329 - RNA, 17 nt, Homo sapiens
ucugggaacgcaggcgc

SEQ ID NO: 7330 - RNA, 20 nt, Homo sapiens
ucugggaacgcaggcgcucg

SEQ ID NO: 7331 - RNA, 24 nt, Homo sapiens
ugucuuguuuugaagguuuugcug

SEQ ID NO: 7332 - RNA, 19 nt, Homo sapiens
agcggggacacggaggaug

SEQ ID NO: 7333 - RNA, 18 nt, Homo sapiens
agugaguuucacccaccc

SEQ ID NO: 7334 - RNA, 15 nt, Homo sapiens
cagggucccuacacc

SEQ ID NO: 7335 - RNA, 21 nt, Homo sapiens
cccuuccaucucuccaccacc

SEQ ID NO: 7336 - RNA, 19 nt, Homo sapiens
gacagguagggacgagggu

SEQ ID NO: 7337 - RNA, 18 nt, Homo sapiens
gcccacccgccuguuccu

SEQ ID NO: 7338 - RNA, 22 nt, Homo sapiens
gcgcgcugucggcgguggcgga

SEQ ID NO: 7339 - RNA, 18 nt, Homo sapiens
ggugcgcgccaagcuggc

SEQ ID NO: 7340 - RNA, 23 nt, Homo sapiens
auauauauauuuauuuauauaua

SEQ ID NO: 7341 - RNA, 22 nt, Homo sapiens
auauauauuuauuuauauauau

SEQ ID NO: 7342 - RNA, 19 nt, Homo sapiens
uauauauauuuauauauau

SEQ ID NO: 7343 - RNA, 24 nt, Homo sapiens
uauauauauuuauauauauuuaua

SEQ ID NO: 7344 - RNA, 22 nt, Homo sapiens
uauuuauauauauuuauauaua

SEQ ID NO: 7345 - RNA, 19 nt, Homo sapiens
aggaggaggagcaaggaga

SEQ ID NO: 7346 - RNA, 18 nt, Homo sapiens
cgcuauaugaucagguga

SEQ ID NO: 7347 - RNA, 20 nt, Homo sapiens
cugaaagauuuugauaagcc

SEQ ID NO: 7348 - RNA, 17 nt, Homo sapiens
cugacucaugauuguuu

SEQ ID NO: 7349 - RNA, 20 nt, Homo sapiens
guaaaggcagauagauagug

SEQ ID NO: 7350 - RNA, 18 nt, Homo sapiens
ucuguuuaaucaucugug

SEQ ID NO: 7351 - RNA, 18 nt, Homo sapiens
ugcauccucagguuucua

SEQ ID NO: 7352 - RNA, 21 nt, Homo sapiens
uuuagaagaaccuuguuauaa

SEQ ID NO: 7353 - RNA, 17 nt, Homo sapiens
cccgcucacccaccucc

SEQ ID NO: 7354 - RNA, 22 nt, Homo sapiens
gaagagggagggcucagaucua

SEQ ID NO: 7355 - RNA, 18 nt, Homo sapiens
gacacgccuuccuucccc

SEQ ID NO: 7356 - RNA, 19 nt, Homo sapiens
gccuuugcuucuaccccug

SEQ ID NO: 7357 - RNA, 19 nt, Homo sapiens
gggucccugcucacgagcc

SEQ ID NO: 7358 - RNA, 20 nt, Homo sapiens
ucugcuuuuccuuggaaggu

SEQ ID NO: 7359 - RNA, 18 nt, Homo sapiens
ugagcccccagcauaacc

SEQ ID NO: 7360 - RNA, 24 nt, Homo sapiens
uggugggggagggucuagggccug

SEQ ID NO: 7361 - RNA, 22 nt, Homo sapiens
cuccaguagguacagauggcug

SEQ ID NO: 7362 - RNA, 17 nt, Homo sapiens
gcuucugauucuuaguc

SEQ ID NO: 7363 - RNA, 21 nt, Homo sapiens
ggaggaggacggacaggaaaa

SEQ ID NO: 7364 - RNA, 21 nt, Homo sapiens
uggggaggaggacggacagga

SEQ ID NO: 7365 - RNA, 22 nt, Homo sapiens
ccuuuuuucuuucccaacacuu

SEQ ID NO: 7366 - RNA, 19 nt, Homo sapiens
uaagacacucuaacacuuc

SEQ ID NO: 7367 - RNA, 17 nt, Homo sapiens
cuaaaauuccuccuucu

SEQ ID NO: 7368 - RNA, 22 nt, Homo sapiens
uuccauuuucucuaccucuucu

SEQ ID NO: 7369 - RNA, 26 nt, Homo sapiens
aaaaaagggauggacaaaaaggcauu

SEQ ID NO: 7370 - RNA, 22 nt, Homo sapiens
acaauauaaggcagcccaaagg

SEQ ID NO: 7371 - RNA, 24 nt, Homo sapiens
aggaggaggggaggaaaaagagca

SEQ ID NO: 7372 - RNA, 17 nt, Homo sapiens
auauaucauaaagcuua

SEQ ID NO: 7373 - RNA, 19 nt, Homo sapiens
cccuucucuucuccuccug

SEQ ID NO: 7374 - RNA, 18 nt, Homo sapiens
gaggaggaggaggggagg

SEQ ID NO: 7375 - RNA, 18 nt, Homo sapiens
ugccuuccacauggggcc

SEQ ID NO: 7376 - RNA, 24 nt, Homo sapiens
uggaaugucuugaagguuaacugc

SEQ ID NO: 7377 - RNA, 20 nt, Homo sapiens
uugcuugccuuuuaccucuu

SEQ ID NO: 7378 - RNA, 21 nt, Homo sapiens
uuuuaaggcucaagguguuuu

SEQ ID NO: 7379 - RNA, 19 nt, Homo sapiens
gccuguuuccucugcgcug

SEQ ID NO: 7380 - RNA, 17 nt, Homo sapiens
ggagguggcugcaggga

SEQ ID NO: 7381 - RNA, 19 nt, Homo sapiens
ggcggggcugcgcagcuca

SEQ ID NO: 7382 - RNA, 16 nt, Homo sapiens
gggaggauggagggcg

SEQ ID NO: 7383 - RNA, 18 nt, Homo sapiens
ggggaggaguggaggagg

SEQ ID NO: 7384 - RNA, 18 nt, Homo sapiens
ggggaggauggagggcgg

SEQ ID NO: 7385 - RNA, 23 nt, Homo sapiens
accccacccaucccacugucacc

SEQ ID NO: 7386 - RNA, 19 nt, Homo sapiens
augaguuuugucuuuuucc

SEQ ID NO: 7387 - RNA, 24 nt, Homo sapiens
cugcugccucuucuaccacaggcg

SEQ ID NO: 7388 - RNA, 16 nt, Homo sapiens
gacuauauuucuggaa

SEQ ID NO: 7389 - RNA, 14 nt, Homo sapiens
gcagcggccgggag

SEQ ID NO: 7390 - RNA, 14 nt, Homo sapiens
gcagcugggcacag

SEQ ID NO: 7391 - RNA, 16 nt, Homo sapiens
ggggucgcugccgcug

SEQ ID NO: 7392 - RNA, 21 nt, Homo sapiens
uucugcuuugugcacauguac

SEQ ID NO: 7393 - RNA, 16 nt, Homo sapiens
uuugugcacauguacu

SEQ ID NO: 7394 - RNA, 17 nt, Homo sapiens
gaagcaggccaauccua

SEQ ID NO: 7395 - RNA, 16 nt, Homo sapiens
uucauccucuguucau

SEQ ID NO: 7396 - RNA, 19 nt, Homo sapiens
auuuacaagugauuuacag

SEQ ID NO: 7397 - RNA, 18 nt, Homo sapiens
ccgccgcccggcccggcc

SEQ ID NO: 7398 - RNA, 17 nt, Homo sapiens
ccgcuggcuccgcgcgc

SEQ ID NO: 7399 - RNA, 23 nt, Homo sapiens
ccggcccggccgucaggcccccg

SEQ ID NO: 7400 - RNA, 15 nt, Homo sapiens
caggagaauggaugc

SEQ ID NO: 7401 - RNA, 17 nt, Homo sapiens
ugccuggagagagcgug

SEQ ID NO: 7402 - RNA, 22 nt, Homo sapiens
ugugaaugaggaggaucugagu

SEQ ID NO: 7403 - RNA, 16 nt, Homo sapiens
uguguaaagugaggua

SEQ ID NO: 7404 - RNA, 18 nt, Homo sapiens
cgcuccgagagacgcagc

SEQ ID NO: 7405 - RNA, 23 nt, Homo sapiens
gcacaggagguggcagcaggguc

SEQ ID NO: 7406 - RNA, 17 nt, Homo sapiens
gcggacuccguuuuuug

SEQ ID NO: 7407 - RNA, 17 nt, Homo sapiens
gcuggcccugcugaggc

SEQ ID NO: 7408 - RNA, 20 nt, Homo sapiens
ccccgccuuaguccccgccc

SEQ ID NO: 7409 - RNA, 22 nt, Homo sapiens
cgggaucagccagagaccgagc

SEQ ID NO: 7410 - RNA, 21 nt, Homo sapiens
uccuguguugggggagugggg

SEQ ID NO: 7411 - RNA, 19 nt, Homo sapiens
agagaaauuggcggagagc

SEQ ID NO: 7412 - RNA, 20 nt, Homo sapiens
cauuucuccagcugugcaag

SEQ ID NO: 7413 - RNA, 22 nt, Homo sapiens
uccaaguuucugcaugcagugg

SEQ ID NO: 7414 - RNA, 19 nt, Homo sapiens
ugccguggugcauuccucc

SEQ ID NO: 7415 - RNA, 23 nt, Homo sapiens
uggugcggcccauguacauuaaa

SEQ ID NO: 7416 - RNA, 19 nt, Homo sapiens
uuaaagugugauacuuggu

SEQ ID NO: 7417 - RNA, 16 nt, Homo sapiens
uccuggggagcugcuc

SEQ ID NO: 7418 - RNA, 21 nt, Homo sapiens
aagcaaggauuuugccugugu

SEQ ID NO: 7419 - RNA, 24 nt, Homo sapiens
acuggaugggguggagccuaggau

SEQ ID NO: 7420 - RNA, 20 nt, Homo sapiens
agagagagagaccggagagc

SEQ ID NO: 7421 - RNA, 18 nt, Homo sapiens
auguagggguucugucug

SEQ ID NO: 7422 - RNA, 16 nt, Homo sapiens
caagcucccaauucca

SEQ ID NO: 7423 - RNA, 20 nt, Homo sapiens
cauccuccaggauccauucc

SEQ ID NO: 7424 - RNA, 19 nt, Homo sapiens
cgaguuuauaagugcccgg

SEQ ID NO: 7425 - RNA, 24 nt, Homo sapiens
gacgccgauggcgacagccucucc

SEQ ID NO: 7426 - RNA, 18 nt, Homo sapiens
gcgccgcgugcaggcgcc

SEQ ID NO: 7427 - RNA, 20 nt, Homo sapiens
ggcccccacgcgugcagccc

SEQ ID NO: 7428 - RNA, 16 nt, Homo sapiens
gggugcggggaggguc

SEQ ID NO: 7429 - RNA, 17 nt, Homo sapiens
ucauacauguuacagcc

SEQ ID NO: 7430 - RNA, 24 nt, Homo sapiens
uccuccuuucuuucuuuucauaca

SEQ ID NO: 7431 - RNA, 19 nt, Homo sapiens
ucuaaccagcucccauggg

SEQ ID NO: 7432 - RNA, 20 nt, Homo sapiens
ucucuugguccuccuggggc

SEQ ID NO: 7433 - RNA, 18 nt, Homo sapiens
ugccgugcgcgcagcccc

SEQ ID NO: 7434 - RNA, 16 nt, Homo sapiens
ugccuggugggaaggg

SEQ ID NO: 7435 - RNA, 23 nt, Homo sapiens
ugugcaaaguggauacuggagac

SEQ ID NO: 7436 - RNA, 15 nt, Homo sapiens
uguguaccuagccuu

SEQ ID NO: 7437 - RNA, 25 nt, Homo sapiens
aagacacugauguccacuuguggga

SEQ ID NO: 7438 - RNA, 19 nt, Homo sapiens
aagggaagcucagcgggaa

SEQ ID NO: 7439 - RNA, 15 nt, Homo sapiens
agaggugucccucca

SEQ ID NO: 7440 - RNA, 18 nt, Homo sapiens
agaggugucccuccagcc

SEQ ID NO: 7441 - RNA, 19 nt, Homo sapiens
agggaggaggcuggaggag

SEQ ID NO: 7442 - RNA, 19 nt, Homo sapiens
agucucaguuacuaguucc

SEQ ID NO: 7443 - RNA, 18 nt, Homo sapiens
aguguaugguguguguau

SEQ ID NO: 7444 - RNA, 17 nt, Homo sapiens
caggucuggaacgaggg

SEQ ID NO: 7445 - RNA, 19 nt, Homo sapiens
cccagagcaaacgggguuc

SEQ ID NO: 7446 - RNA, 19 nt, Homo sapiens
ccgccgccugccugcugcc

SEQ ID NO: 7447 - RNA, 15 nt, Homo sapiens
cgccggcggggcugc

SEQ ID NO: 7448 - RNA, 19 nt, Homo sapiens
cggcgcgcugcccuccgag

SEQ ID NO: 7449 - RNA, 23 nt, Homo sapiens
cggcgggcggccucccggcgaag

SEQ ID NO: 7450 - RNA, 17 nt, Homo sapiens
cugcagcucucccuccu

SEQ ID NO: 7451 - RNA, 21 nt, Homo sapiens
cugcaucaucuccgacucucu

SEQ ID NO: 7452 - RNA, 21 nt, Homo sapiens
cuggguuggacaugacugggg

SEQ ID NO: 7453 - RNA, 17 nt, Homo sapiens
gaggcuggaggagucuc

SEQ ID NO: 7454 - RNA, 18 nt, Homo sapiens
gcccggcgggacgggaug

SEQ ID NO: 7455 - RNA, 18 nt, Homo sapiens
gccgcuggguccucggag

SEQ ID NO: 7456 - RNA, 19 nt, Homo sapiens
gccggggcugcugcucgcc

SEQ ID NO: 7457 - RNA, 21 nt, Homo sapiens
gccugcugcccgcucugcgcc

SEQ ID NO: 7458 - RNA, 18 nt, Homo sapiens
gcgcgccgccggcggggc

SEQ ID NO: 7459 - RNA, 20 nt, Homo sapiens
gcucgcucgcccgccgggcc

SEQ ID NO: 7460 - RNA, 20 nt, Homo sapiens
gcugcccgcucugcgccgcu

SEQ ID NO: 7461 - RNA, 19 nt, Homo sapiens
ggcugcugcagcccgagcu

SEQ ID NO: 7462 - RNA, 19 nt, Homo sapiens
gggaagggagggaagugag

SEQ ID NO: 7463 - RNA, 15 nt, Homo sapiens
gggcuggggcgcgcc

SEQ ID NO: 7464 - RNA, 18 nt, Homo sapiens
ggugggcuggggcgcgcc

SEQ ID NO: 7465 - RNA, 18 nt, Homo sapiens
guggggccaggaggauag

SEQ ID NO: 7466 - RNA, 21 nt, Homo sapiens
uacccagggccgagugacaca

SEQ ID NO: 7467 - RNA, 19 nt, Homo sapiens
ucacauccaccuccccuac

SEQ ID NO: 7468 - RNA, 20 nt, Homo sapiens
uccaccuccccuacuuucca

SEQ ID NO: 7469 - RNA, 20 nt, Homo sapiens
ugauauaugauagaagacug

SEQ ID NO: 7470 - RNA, 18 nt, Homo sapiens
ugccugggcacuugugug

SEQ ID NO: 7471 - RNA, 21 nt, Homo sapiens
ugcuaccccuccaguuucucu

SEQ ID NO: 7472 - RNA, 21 nt, Homo sapiens
uggggcauggaaggguagugu

SEQ ID NO: 7473 - RNA, 23 nt, Homo sapiens
ggggguggcggguacugaguggg

SEQ ID NO: 7474 - RNA, 19 nt, Homo sapiens
gggguggggguggcgggua

SEQ ID NO: 7475 - RNA, 20 nt, Homo sapiens
ccugccuucugaggggaucu

SEQ ID NO: 7476 - RNA, 21 nt, Homo sapiens
gugggcguggagccggcagcc

SEQ ID NO: 7477 - RNA, 21 nt, Homo sapiens
uaaaaaaaaaaaaaaaaaaac

SEQ ID NO: 7478 - RNA, 16 nt, Homo sapiens
ucccucacaugggugg

SEQ ID NO: 7479 - RNA, 23 nt, Homo sapiens
ugauucaccgcaagacugugggc

SEQ ID NO: 7480 - RNA, 21 nt, Homo sapiens
uguaagaagggagaggauggu

SEQ ID NO: 7481 - RNA, 18 nt, Homo sapiens
accacagggggaccuuuu

SEQ ID NO: 7482 - RNA, 14 nt, Homo sapiens
agcaccaauccaca

SEQ ID NO: 7483 - RNA, 16 nt, Homo sapiens
cgcugacuaagcacac

SEQ ID NO: 7484 - RNA, 18 nt, Homo sapiens
cggcggggcgagcgcgcg

SEQ ID NO: 7485 - RNA, 18 nt, Homo sapiens
gcaccaauccacaccuga

SEQ ID NO: 7486 - RNA, 17 nt, Homo sapiens
gcgagcgcgcggucggc

SEQ ID NO: 7487 - RNA, 15 nt, Homo sapiens
gcggggcgagcgcgc

SEQ ID NO: 7488 - RNA, 23 nt, Homo sapiens
ugaacaaaagaccacagggggac

SEQ ID NO: 7489 - RNA, 20 nt, Homo sapiens
uuucugugacagugguaaaa

SEQ ID NO: 7490 - RNA, 19 nt, Homo sapiens
agaagcaagaaucacugug

SEQ ID NO: 7491 - RNA, 22 nt, Homo sapiens
agaaguuuguacaugcaggcca

SEQ ID NO: 7492 - RNA, 18 nt, Homo sapiens
agccauuuuuaguaaaga

SEQ ID NO: 7493 - RNA, 17 nt, Homo sapiens
caauggcucauaccugu

SEQ ID NO: 7494 - RNA, 22 nt, Homo sapiens
cugaguaaaagacaaggguuua

SEQ ID NO: 7495 - RNA, 17 nt, Homo sapiens
uugggaggccgaggugg

SEQ ID NO: 7496 - RNA, 17 nt, Homo sapiens
cacaggaauguuuuauu

SEQ ID NO: 7497 - RNA, 22 nt, Homo sapiens
aagagcacuuuaauucacauac

SEQ ID NO: 7498 - RNA, 18 nt, Homo sapiens
acauuacuuugaguuaga

SEQ ID NO: 7499 - RNA, 16 nt, Homo sapiens
ucucuuuccagcuacu

SEQ ID NO: 7500 - RNA, 19 nt, Homo sapiens
aggaguugagaccagccug

SEQ ID NO: 7501 - RNA, 18 nt, Homo sapiens
cggcguccggcgccccga

SEQ ID NO: 7502 - RNA, 20 nt, Homo sapiens
gagagacugaggcaggagga

SEQ ID NO: 7503 - RNA, 18 nt, Homo sapiens
gccccggcguccggcgcc

SEQ ID NO: 7504 - RNA, 21 nt, Homo sapiens
ugagagacugaggcaggagga

SEQ ID NO: 7505 - RNA, 22 nt, Homo sapiens
aggccagccccaggucaggucc

SEQ ID NO: 7506 - RNA, 17 nt, Homo sapiens
cacccgcgcugggcccc

SEQ ID NO: 7507 - RNA, 23 nt, Homo sapiens
aaaguuuuacauuuacaaauguc

SEQ ID NO: 7508 - RNA, 14 nt, Homo sapiens
acaaagacccaccu

SEQ ID NO: 7509 - RNA, 23 nt, Homo sapiens
accaugcccggcuauuuuuuuuu

SEQ ID NO: 7510 - RNA, 24 nt, Homo sapiens
agcggggccugcaguggggggagg

SEQ ID NO: 7511 - RNA, 20 nt, Homo sapiens
aggggagguggcagaggagg

SEQ ID NO: 7512 - RNA, 18 nt, Homo sapiens
aguggggggaggugcagg

SEQ ID NO: 7513 - RNA, 16 nt, Homo sapiens
cacccgagacugcccc

SEQ ID NO: 7514 - RNA, 20 nt, Homo sapiens
cagaaguuucacaauguaag

SEQ ID NO: 7515 - RNA, 21 nt, Homo sapiens
caucguggugggguagggucu

SEQ ID NO: 7516 - RNA, 21 nt, Homo sapiens
ccagcugggcugggcucgacc

SEQ ID NO: 7517 - RNA, 18 nt, Homo sapiens
cgaggaacugugagcuug

SEQ ID NO: 7518 - RNA, 20 nt, Homo sapiens
cucugucccugaggaaugga

SEQ ID NO: 7519 - RNA, 19 nt, Homo sapiens
gauuacaggcuugcgccac

SEQ ID NO: 7520 - RNA, 16 nt, Homo sapiens
gcccuggaggagcagc

SEQ ID NO: 7521 - RNA, 18 nt, Homo sapiens
ggagguggcagaggaggg

SEQ ID NO: 7522 - RNA, 19 nt, Homo sapiens
ggagguggcagaggagggg

SEQ ID NO: 7523 - RNA, 17 nt, Homo sapiens
ggcagggggaggacgag

SEQ ID NO: 7524 - RNA, 22 nt, Homo sapiens
ggggagguggcagaggaggggc

SEQ ID NO: 7525 - RNA, 17 nt, Homo sapiens
ggggugggagcuguggg

SEQ ID NO: 7526 - RNA, 17 nt, Homo sapiens
ggugucucugucccuga

SEQ ID NO: 7527 - RNA, 21 nt, Homo sapiens
uaaggaacguggcuuucagau

SEQ ID NO: 7528 - RNA, 18 nt, Homo sapiens
ucccacugacuuuaacau

SEQ ID NO: 7529 - RNA, 23 nt, Homo sapiens
ucucuggguuuucagggaacuac

SEQ ID NO: 7530 - RNA, 23 nt, Homo sapiens
ugaugggaagaaaacccaccuca

SEQ ID NO: 7531 - RNA, 23 nt, Homo sapiens
ugucuguuuuuccuccuuggguc

SEQ ID NO: 7532 - RNA, 21 nt, Homo sapiens
uuccaggaguuggggcaguca

SEQ ID NO: 7533 - RNA, 19 nt, Homo sapiens
uuccucucuggguuuucag

SEQ ID NO: 7534 - RNA, 17 nt, Homo sapiens
uuggugggcacugaagg

SEQ ID NO: 7535 - RNA, 17 nt, Homo sapiens
gcccuugucuucucugg

SEQ ID NO: 7536 - RNA, 17 nt, Homo sapiens
ugagugaagagaacuga

SEQ ID NO: 7537 - RNA, 20 nt, Homo sapiens
accuaccacuucugcaccua

SEQ ID NO: 7538 - RNA, 19 nt, Homo sapiens
cucaaauuuguagcugacc

SEQ ID NO: 7539 - RNA, 18 nt, Homo sapiens
ccugcagcccuaguucua

SEQ ID NO: 7540 - RNA, 24 nt, Homo sapiens
ucacaaccuuucuuuccaacauua

SEQ ID NO: 7541 - RNA, 22 nt, Homo sapiens
gucccgggacacuggcagcccc

SEQ ID NO: 7542 - RNA, 20 nt, Homo sapiens
cagguccaguucauaugugc

SEQ ID NO: 7543 - RNA, 20 nt, Homo sapiens
ugaauuuuuucugugcuaug

SEQ ID NO: 7544 - RNA, 14 nt, Homo sapiens
accccuccccuccc

SEQ ID NO: 7545 - RNA, 17 nt, Homo sapiens
agcgggucaggggcuug

SEQ ID NO: 7546 - RNA, 20 nt, Homo sapiens
aggggcuugggagcaagcag

SEQ ID NO: 7547 - RNA, 21 nt, Homo sapiens
cauuuuccuuuauuuucuuaa

SEQ ID NO: 7548 - RNA, 23 nt, Homo sapiens
ggccuguagagcucugccggucc

SEQ ID NO: 7549 - RNA, 16 nt, Homo sapiens
ugaggggcgacuagca

SEQ ID NO: 7550 - RNA, 21 nt, Homo sapiens
caggguccuugggcgagcgcc

SEQ ID NO: 7551 - RNA, 17 nt, Homo sapiens
ucugaagagguuccugg

SEQ ID NO: 7552 - RNA, 18 nt, Homo sapiens
ugugucuauuaucccuuc

SEQ ID NO: 7553 - RNA, 22 nt, Homo sapiens
caacggucuuggaaaggaaggc

SEQ ID NO: 7554 - RNA, 20 nt, Homo sapiens
cagggaaucaaaacauucac

SEQ ID NO: 7555 - RNA, 22 nt, Homo sapiens
ggccauuguuucuggaugucag

SEQ ID NO: 7556 - RNA, 19 nt, Homo sapiens
ggggagggaggaggaaaaa

SEQ ID NO: 7557 - RNA, 22 nt, Homo sapiens
guaguagcaguggggauauaag

SEQ ID NO: 7558 - RNA, 25 nt, Homo sapiens
uacuugggaaauauaauuggaagga

SEQ ID NO: 7559 - RNA, 21 nt, Homo sapiens
uauagcccuaaacuaagguag

SEQ ID NO: 7560 - RNA, 18 nt, Homo sapiens
uucaagagaauauagccc

SEQ ID NO: 7561 - RNA, 18 nt, Homo sapiens
uugaaaagagaaagauga

SEQ ID NO: 7562 - RNA, 18 nt, Homo sapiens
ccuuuuuuaaaacguaca

SEQ ID NO: 7563 - RNA, 19 nt, Homo sapiens
ugacauuuauuuucuuaac

SEQ ID NO: 7564 - RNA, 16 nt, Homo sapiens
gggcccgccgcggagg

SEQ ID NO: 7565 - RNA, 18 nt, Homo sapiens
gggucugggacacccuga

SEQ ID NO: 7566 - RNA, 19 nt, Homo sapiens
ggguuggaggaagacgguc

SEQ ID NO: 7567 - RNA, 18 nt, Homo sapiens
auaaugcagaaccuacaa

SEQ ID NO: 7568 - RNA, 22 nt, Homo sapiens
ccucuccauccccuugccuguc

SEQ ID NO: 7569 - RNA, 17 nt, Homo sapiens
gcgggagggaaggcaag

SEQ ID NO: 7570 - RNA, 19 nt, Homo sapiens
uacgugugugugugugugu

SEQ ID NO: 7571 - RNA, 18 nt, Homo sapiens
uccccuugccugucuagg

SEQ ID NO: 7572 - RNA, 21 nt, Homo sapiens
uguacgugugugugugugugu

SEQ ID NO: 7573 - RNA, 19 nt, Homo sapiens
ugugcauguacgugugugu

SEQ ID NO: 7574 - RNA, 23 nt, Homo sapiens
ugugcauguacgugugugugugu

SEQ ID NO: 7575 - RNA, 19 nt, Homo sapiens
ugugugugugugugucugu

SEQ ID NO: 7576 - RNA, 18 nt, Homo sapiens
ggaagaaauggaagagca

SEQ ID NO: 7577 - RNA, 25 nt, Homo sapiens
ggguggagagaagcaaaguaggaag

SEQ ID NO: 7578 - RNA, 17 nt, Homo sapiens
uacacugcaccaucgug

SEQ ID NO: 7579 - RNA, 21 nt, Homo sapiens
ugauggaaaucuguugucugg

SEQ ID NO: 7580 - RNA, 23 nt, Homo sapiens
uggaagaaauggaagagcaggau

SEQ ID NO: 7581 - RNA, 20 nt, Homo sapiens
cccaaccuauuguagaaaac

SEQ ID NO: 7582 - RNA, 22 nt, Homo sapiens
gggacaggaaagggugguagug

SEQ ID NO: 7583 - RNA, 20 nt, Homo sapiens
uagagaacaguguggguaca

SEQ ID NO: 7584 - RNA, 21 nt, Homo sapiens
uguagaaaacgucuuagauca

SEQ ID NO: 7585 - RNA, 14 nt, Homo sapiens
cacaagcccagcac

SEQ ID NO: 7586 - RNA, 19 nt, Homo sapiens
cagucuuccuguccgugaa

SEQ ID NO: 7587 - RNA, 23 nt, Homo sapiens
cggccccgagcuuggucaccggc

SEQ ID NO: 7588 - RNA, 16 nt, Homo sapiens
gcauagcucgaggugc

SEQ ID NO: 7589 - RNA, 18 nt, Homo sapiens
gcucggccccgagcuugg

SEQ ID NO: 7590 - RNA, 22 nt, Homo sapiens
ucugaguagcucuauaacauua

SEQ ID NO: 7591 - RNA, 18 nt, Homo sapiens
ugacucagcggcuggugc

SEQ ID NO: 7592 - RNA, 18 nt, Homo sapiens
ugauguaaauaacuaaaa

SEQ ID NO: 7593 - RNA, 16 nt, Homo sapiens
ugauuuaaauauacca

SEQ ID NO: 7594 - RNA, 19 nt, Homo sapiens
acucggggucgggcggcgg

SEQ ID NO: 7595 - RNA, 25 nt, Homo sapiens
aggugcgcgcgcaucccaggccagc

SEQ ID NO: 7596 - RNA, 20 nt, Homo sapiens
aucggcgggggcgggggcgg

SEQ ID NO: 7597 - RNA, 23 nt, Homo sapiens
cccggccccgccccuacuguccg

SEQ ID NO: 7598 - RNA, 21 nt, Homo sapiens
ccggcugccugccauacccgc

SEQ ID NO: 7599 - RNA, 17 nt, Homo sapiens
ccgguuuccccgccugc

SEQ ID NO: 7600 - RNA, 19 nt, Homo sapiens
cgagggcaggugcgcgcgc

SEQ ID NO: 7601 - RNA, 23 nt, Homo sapiens
cggccucgcgcgcucgcggaggg

SEQ ID NO: 7602 - RNA, 17 nt, Homo sapiens
cguggcggggguggagg

SEQ ID NO: 7603 - RNA, 20 nt, Homo sapiens
cucgccccuuuccucccccu

SEQ ID NO: 7604 - RNA, 20 nt, Homo sapiens
gccccggcggccucgcgcgc

SEQ ID NO: 7605 - RNA, 16 nt, Homo sapiens
gccugccccggcggcc

SEQ ID NO: 7606 - RNA, 24 nt, Homo sapiens
ggaggguggccguggcgggggugg

SEQ ID NO: 7607 - RNA, 18 nt, Homo sapiens
ggccucggccaccacccc

SEQ ID NO: 7608 - RNA, 17 nt, Homo sapiens
ggcgcccuccuccuucc

SEQ ID NO: 7609 - RNA, 17 nt, Homo sapiens
ggcgggcgccugggcug

SEQ ID NO: 7610 - RNA, 20 nt, Homo sapiens
guggaggugggugcccaggg

SEQ ID NO: 7611 - RNA, 17 nt, Homo sapiens
ucggccaccaccccucg

SEQ ID NO: 7612 - RNA, 16 nt, Homo sapiens
uggcagggcauugagg

SEQ ID NO: 7613 - RNA, 18 nt, Homo sapiens
ugggcugagcggacccgc

SEQ ID NO: 7614 - RNA, 19 nt, Homo sapiens
uguugcuggugacaaggaa

SEQ ID NO: 7615 - RNA, 16 nt, Homo sapiens
uuggcagcugaggaau

SEQ ID NO: 7616 - RNA, 20 nt, Homo sapiens
guuacugugcugucagcccc

SEQ ID NO: 7617 - RNA, 17 nt, Homo sapiens
uaagugaagaaggauag

SEQ ID NO: 7618 - RNA, 23 nt, Homo sapiens
uguuauuacacauuaaugcauaa

SEQ ID NO: 7619 - RNA, 26 nt, Homo sapiens
uguuuuguguauugguaauccaacag

SEQ ID NO: 7620 - RNA, 16 nt, Homo sapiens
uuucauggugagugcu

SEQ ID NO: 7621 - RNA, 23 nt, Homo sapiens
uuugcauauacaucaugucaguu

SEQ ID NO: 7622 - RNA, 18 nt, Homo sapiens
aggcggggaccgguccag

SEQ ID NO: 7623 - RNA, 17 nt, Homo sapiens
ccgguccagguuggcgc

SEQ ID NO: 7624 - RNA, 17 nt, Homo sapiens
gaggaggcggggaccgg

SEQ ID NO: 7625 - RNA, 19 nt, Homo sapiens
gcaggcccguguugcccag

SEQ ID NO: 7626 - RNA, 22 nt, Homo sapiens
gcggaggaggcggggaccgguc

SEQ ID NO: 7627 - RNA, 15 nt, Homo sapiens
gccucggcccggguc

SEQ ID NO: 7628 - RNA, 16 nt, Homo sapiens
uuaaaagcuagacuga

SEQ ID NO: 7629 - RNA, 20 nt, Homo sapiens
uuaaaguuuuggaauguuuu

SEQ ID NO: 7630 - RNA, 21 nt, Homo sapiens
aacuggcuuaaaagcuccaaa

SEQ ID NO: 7631 - RNA, 22 nt, Homo sapiens
acagguggaucacgaggucagg

SEQ ID NO: 7632 - RNA, 16 nt, Homo sapiens
acgcagaagacgcggc

SEQ ID NO: 7633 - RNA, 21 nt, Homo sapiens
agaaaauaucugaauuuuccc

SEQ ID NO: 7634 - RNA, 17 nt, Homo sapiens
agcugcacagucuugca

SEQ ID NO: 7635 - RNA, 20 nt, Homo sapiens
aggcagagguuguggugagc

SEQ ID NO: 7636 - RNA, 22 nt, Homo sapiens
agguggaucacgaggucaggag

SEQ ID NO: 7637 - RNA, 17 nt, Homo sapiens
caacaacccacugguac

SEQ ID NO: 7638 - RNA, 20 nt, Homo sapiens
cccuuuuccaucugaagcag

SEQ ID NO: 7639 - RNA, 15 nt, Homo sapiens
cugccuguuaagagc

SEQ ID NO: 7640 - RNA, 20 nt, Homo sapiens
cuuaaaagcuccaaauccuc

SEQ ID NO: 7641 - RNA, 17 nt, Homo sapiens
ggaacccaguaggcaga

SEQ ID NO: 7642 - RNA, 25 nt, Homo sapiens
ggagugaaagaccccaggugccuug

SEQ ID NO: 7643 - RNA, 18 nt, Homo sapiens
gggccaggcgcgguggcu

SEQ ID NO: 7644 - RNA, 20 nt, Homo sapiens
ggggacccccagagcugcgc

SEQ ID NO: 7645 - RNA, 21 nt, Homo sapiens
gguggggguggggacaggaag

SEQ ID NO: 7646 - RNA, 20 nt, Homo sapiens
uauucugcagaugcccucuc

SEQ ID NO: 7647 - RNA, 19 nt, Homo sapiens
ucacugauacgucguccag

SEQ ID NO: 7648 - RNA, 22 nt, Homo sapiens
ucugaagcagugcggggaggcu

SEQ ID NO: 7649 - RNA, 19 nt, Homo sapiens
ugacuggguaagaccugga

SEQ ID NO: 7650 - RNA, 21 nt, Homo sapiens
ugggguggggguggggacagg

SEQ ID NO: 7651 - RNA, 25 nt, Homo sapiens
uucccauugucauuuccauguaaaa

SEQ ID NO: 7652 - RNA, 19 nt, Homo sapiens
uccauuugaucucucuucu

SEQ ID NO: 7653 - RNA, 20 nt, Homo sapiens
uguaguggugagugacagaa

SEQ ID NO: 7654 - RNA, 19 nt, Homo sapiens
ugucucaagugauguagug

SEQ ID NO: 7655 - RNA, 22 nt, Homo sapiens
caaggauaagccuuccugcggg

SEQ ID NO: 7656 - RNA, 21 nt, Homo sapiens
ccagagggugacguaacccca

SEQ ID NO: 7657 - RNA, 19 nt, Homo sapiens
cccaaaggacaggguucgg

SEQ ID NO: 7658 - RNA, 19 nt, Homo sapiens
gaccuucuccuguccucuu

SEQ ID NO: 7659 - RNA, 17 nt, Homo sapiens
gggagacagcggcugag

SEQ ID NO: 7660 - RNA, 21 nt, Homo sapiens
ggggagaggcuggggcucugg

SEQ ID NO: 7661 - RNA, 15 nt, Homo sapiens
gggucccuggcccgc

SEQ ID NO: 7662 - RNA, 18 nt, Homo sapiens
ucucucugaccuucuccu

SEQ ID NO: 7663 - RNA, 19 nt, Homo sapiens
cucgaacuccugaccuugu

SEQ ID NO: 7664 - RNA, 15 nt, Homo sapiens
uaauagaagcucacu

SEQ ID NO: 7665 - RNA, 21 nt, Homo sapiens
ucgaacuccugaccuugugau

SEQ ID NO: 7666 - RNA, 23 nt, Homo sapiens
ucuguggucuuuuaauugaagac

SEQ ID NO: 7667 - RNA, 18 nt, Homo sapiens
uuucauuuuaaaagauac

SEQ ID NO: 7668 - RNA, 21 nt, Homo sapiens
acgcagacaauguccaguugu

SEQ ID NO: 7669 - RNA, 21 nt, Homo sapiens
caggaucuugcucuguugccc

SEQ ID NO: 7670 - RNA, 22 nt, Homo sapiens
ccucuguuuuuuagaaauucaa

SEQ ID NO: 7671 - RNA, 20 nt, Homo sapiens
gagcuuccaaaacgcaggca

SEQ ID NO: 7672 - RNA, 20 nt, Homo sapiens
ggucuccuagggagcugggg

SEQ ID NO: 7673 - RNA, 24 nt, Homo sapiens
ucuuuauacuacauauagggugga

SEQ ID NO: 7674 - RNA, 20 nt, Homo sapiens
ugggaugggaagaucggucc

SEQ ID NO: 7675 - RNA, 20 nt, Homo sapiens
uuccuucuuucuuuccuucc

SEQ ID NO: 7676 - RNA, 25 nt, Homo sapiens
ucaauuucucaucgauuucccaagg

SEQ ID NO: 7677 - RNA, 22 nt, Homo sapiens
acaggacuggccucugggugga

SEQ ID NO: 7678 - RNA, 22 nt, Homo sapiens
ccuggagaaggggcacuucugc

SEQ ID NO: 7679 - RNA, 16 nt, Homo sapiens
cuuccugguuccacuc

SEQ ID NO: 7680 - RNA, 20 nt, Homo sapiens
ucugcugcucuuucgccuug

SEQ ID NO: 7681 - RNA, 19 nt, Homo sapiens
uuucuugguuucugauuca

SEQ ID NO: 7682 - RNA, 21 nt, Homo sapiens
cugaagcagggggcugaggcu

SEQ ID NO: 7683 - RNA, 22 nt, Homo sapiens
ggggaagggacugaagcagggg

SEQ ID NO: 7684 - RNA, 15 nt, Homo sapiens
agagacaggcuucua

SEQ ID NO: 7685 - RNA, 23 nt, Homo sapiens
gggaaugggcauggcuagaagca

SEQ ID NO: 7686 - RNA, 22 nt, Homo sapiens
uaacuugcugccaguuagaggu

SEQ ID NO: 7687 - RNA, 20 nt, Homo sapiens
uccagggaggaaagucacag

SEQ ID NO: 7688 - RNA, 19 nt, Homo sapiens
gauugggguggggauucug

SEQ ID NO: 7689 - RNA, 19 nt, Homo sapiens
gcacuaguggguugggagg

SEQ ID NO: 7690 - RNA, 16 nt, Homo sapiens
ggcuuggucuagacua

SEQ ID NO: 7691 - RNA, 16 nt, Homo sapiens
ggcuuguuccuggugg

SEQ ID NO: 7692 - RNA, 18 nt, Homo sapiens
uggguugggaggugcugg

SEQ ID NO: 7693 - RNA, 15 nt, Homo sapiens
ccuugcuucucugag

SEQ ID NO: 7694 - RNA, 17 nt, Homo sapiens
cgggcuguucucccggc

SEQ ID NO: 7695 - RNA, 19 nt, Homo sapiens
ggcggcuggagaguggugc

SEQ ID NO: 7696 - RNA, 19 nt, Homo sapiens
ugggaggguggaugagggc

SEQ ID NO: 7697 - RNA, 15 nt, Homo sapiens
uguuuauguaauaga

SEQ ID NO: 7698 - RNA, 17 nt, Homo sapiens
agggggaggggagggga

SEQ ID NO: 7699 - RNA, 19 nt, Homo sapiens
aggggggaggauggcgcgc

SEQ ID NO: 7700 - RNA, 17 nt, Homo sapiens
cagcggggaggcggggc

SEQ ID NO: 7701 - RNA, 25 nt, Homo sapiens
cagugucagacagcagugcaggaaa

SEQ ID NO: 7702 - RNA, 19 nt, Homo sapiens
caugacaaaaauuccaaug

SEQ ID NO: 7703 - RNA, 22 nt, Homo sapiens
ccgagcgcuccccuccuucucc

SEQ ID NO: 7704 - RNA, 21 nt, Homo sapiens
ccgccccgccgcuccagcucc

SEQ ID NO: 7705 - RNA, 21 nt, Homo sapiens
cgagagcaauauuauauacau

SEQ ID NO: 7706 - RNA, 17 nt, Homo sapiens
cuuacuguaaaacacga

SEQ ID NO: 7707 - RNA, 21 nt, Homo sapiens
gaaggaggggggaggauggcg

SEQ ID NO: 7708 - RNA, 16 nt, Homo sapiens
gaccuguaaauccagc

SEQ ID NO: 7709 - RNA, 22 nt, Homo sapiens
gcacuggaaugucuguuuucac

SEQ ID NO: 7710 - RNA, 18 nt, Homo sapiens
gcccgagcgcuccccucc

SEQ ID NO: 7711 - RNA, 14 nt, Homo sapiens
gcgggggaggggga

SEQ ID NO: 7712 - RNA, 22 nt, Homo sapiens
gggaaggaggggggaggauggc

SEQ ID NO: 7713 - RNA, 19 nt, Homo sapiens
gggcccgggcccggggagg

SEQ ID NO: 7714 - RNA, 19 nt, Homo sapiens
gggcccggggagggggagg

SEQ ID NO: 7715 - RNA, 17 nt, Homo sapiens
gggggaggggaggggag

SEQ ID NO: 7716 - RNA, 18 nt, Homo sapiens
gggggaggggaggggagc

SEQ ID NO: 7717 - RNA, 19 nt, Homo sapiens
gggggaggggaggggagcg

SEQ ID NO: 7718 - RNA, 21 nt, Homo sapiens
gggggaggggaggggagcggg

SEQ ID NO: 7719 - RNA, 20 nt, Homo sapiens
uacagucauuuucuuacaua

SEQ ID NO: 7720 - RNA, 19 nt, Homo sapiens
uacagugggaagauaaaaa

SEQ ID NO: 7721 - RNA, 20 nt, Homo sapiens
uacagugggaagauaaaaag

SEQ ID NO: 7722 - RNA, 21 nt, Homo sapiens
uccagaggaaaagagggagga

SEQ ID NO: 7723 - RNA, 18 nt, Homo sapiens
ucccaggcaaggcacagg

SEQ ID NO: 7724 - RNA, 23 nt, Homo sapiens
ucuccuucucgcucccuagacuc

SEQ ID NO: 7725 - RNA, 16 nt, Homo sapiens
ugagaguagugcucug

SEQ ID NO: 7726 - RNA, 21 nt, Homo sapiens
uggcuuacccuuaaacaauuc

SEQ ID NO: 7727 - RNA, 21 nt, Homo sapiens
ggugcuaaaucuuacaaacaa

SEQ ID NO: 7728 - RNA, 21 nt, Homo sapiens
gaguucacauugauucaauuc

SEQ ID NO: 7729 - RNA, 19 nt, Homo sapiens
gccccggucuggaggcccc

SEQ ID NO: 7730 - RNA, 22 nt, Homo sapiens
gggugguggggccacacuuagc

SEQ ID NO: 7731 - RNA, 20 nt, Homo sapiens
ugaaggcagaauaccccugu

SEQ ID NO: 7732 - RNA, 18 nt, Homo sapiens
uuuaaagcgcagauguca

SEQ ID NO: 7733 - RNA, 16 nt, Homo sapiens
auaaggcugggccaga

SEQ ID NO: 7734 - RNA, 17 nt, Homo sapiens
cccccgaccccuggccc

SEQ ID NO: 7735 - RNA, 21 nt, Homo sapiens
gccgcgacccuccccuccucc

SEQ ID NO: 7736 - RNA, 16 nt, Homo sapiens
gcuggggcagagggag

SEQ ID NO: 7737 - RNA, 24 nt, Homo sapiens
ggcuauggaacauguccaaucugg

SEQ ID NO: 7738 - RNA, 18 nt, Homo sapiens
ggugaggggagugggggg

SEQ ID NO: 7739 - RNA, 16 nt, Homo sapiens
ggugggguggggagga

SEQ ID NO: 7740 - RNA, 18 nt, Homo sapiens
uacucgguacacgggauc

SEQ ID NO: 7741 - RNA, 17 nt, Homo sapiens
ugagggagguggggugg

SEQ ID NO: 7742 - RNA, 20 nt, Homo sapiens
ugcccuggcucccauuuccc

SEQ ID NO: 7743 - RNA, 19 nt, Homo sapiens
ugggggguucacaggggga

SEQ ID NO: 7744 - RNA, 22 nt, Homo sapiens
aggaggaggcugcggguuggag

SEQ ID NO: 7745 - RNA, 14 nt, Homo sapiens
ggcaucuguuuaaa

SEQ ID NO: 7746 - RNA, 19 nt, Homo sapiens
ucccccacaagaggcauuc

SEQ ID NO: 7747 - RNA, 19 nt, Homo sapiens
ugagaggagguacaguaca

SEQ ID NO: 7748 - RNA, 17 nt, Homo sapiens
ccgagcugggcuuggcu

SEQ ID NO: 7749 - RNA, 21 nt, Homo sapiens
acucagugggagaaagccagc

SEQ ID NO: 7750 - RNA, 18 nt, Homo sapiens
agcgcucagugaagcgcu

SEQ ID NO: 7751 - RNA, 19 nt, Homo sapiens
caguguucuaauguagugu

SEQ ID NO: 7752 - RNA, 19 nt, Homo sapiens
gcuaacuguugccaugagc

SEQ ID NO: 7753 - RNA, 17 nt, Homo sapiens
uaugaucaauucuggaa

SEQ ID NO: 7754 - RNA, 23 nt, Homo sapiens
ucccccuucccacccucgggcuc

SEQ ID NO: 7755 - RNA, 18 nt, Homo sapiens
ugacaaaacaaccacuuc

SEQ ID NO: 7756 - RNA, 19 nt, Homo sapiens
ugaguauuuuucuauuauu

SEQ ID NO: 7757 - RNA, 17 nt, Homo sapiens
ugccaagucccaagugu

SEQ ID NO: 7758 - RNA, 17 nt, Homo sapiens
uuaccaaccauacuuca

SEQ ID NO: 7759 - RNA, 17 nt, Homo sapiens
ucccaggaaaggguggu

SEQ ID NO: 7760 - RNA, 23 nt, Homo sapiens
ccuaccccuccugcauucuuccc

SEQ ID NO: 7761 - RNA, 18 nt, Homo sapiens
ccuggccuacauucacuc

SEQ ID NO: 7762 - RNA, 20 nt, Homo sapiens
gagacggagucuugcucugu

SEQ ID NO: 7763 - RNA, 23 nt, Homo sapiens
ucuuucagaaauagacacauugu

SEQ ID NO: 7764 - RNA, 22 nt, Homo sapiens
ugaaaaugaggcagcauuauaa

SEQ ID NO: 7765 - RNA, 17 nt, Homo sapiens
ugaacagagauaugcca

SEQ ID NO: 7766 - RNA, 23 nt, Homo sapiens
ugcacaaauuuugguaaaugcag

SEQ ID NO: 7767 - RNA, 19 nt, Homo sapiens
uggugaucagugcagcuca

SEQ ID NO: 7768 - RNA, 20 nt, Homo sapiens
cacauuaugcuccuugggga

SEQ ID NO: 7769 - RNA, 20 nt, Homo sapiens
cucaaauucuguucuuuuac

SEQ ID NO: 7770 - RNA, 19 nt, Homo sapiens
cuuugcccugcaccuccag

SEQ ID NO: 7771 - RNA, 19 nt, Homo sapiens
uauuuuaccugacaaauuc

SEQ ID NO: 7772 - RNA, 18 nt, Homo sapiens
ucuccaaggacggcgaga

SEQ ID NO: 7773 - RNA, 22 nt, Homo sapiens
ugacaguuucuucagucucugc

SEQ ID NO: 7774 - RNA, 19 nt, Homo sapiens
ugcuccugauccuuucccc

SEQ ID NO: 7775 - RNA, 18 nt, Homo sapiens
ugccauaaaccagcgucc

SEQ ID NO: 7776 - RNA, 21 nt, Homo sapiens
aagaacacuggguccucggaa

SEQ ID NO: 7777 - RNA, 18 nt, Homo sapiens
agugagaaggauuuuuau

SEQ ID NO: 7778 - RNA, 19 nt, Homo sapiens
guuuaccuuucuauuauuu

SEQ ID NO: 7779 - RNA, 23 nt, Homo sapiens
ugauuugauaguguauucucaaa

SEQ ID NO: 7780 - RNA, 18 nt, Homo sapiens
uuuuaggguaaguacuuu

SEQ ID NO: 7781 - RNA, 18 nt, Homo sapiens
aaaaagcucuuuugaauc

SEQ ID NO: 7782 - RNA, 20 nt, Homo sapiens
acuccaaccuaccaccucuu

SEQ ID NO: 7783 - RNA, 17 nt, Homo sapiens
acuguguaugaagagua

SEQ ID NO: 7784 - RNA, 20 nt, Homo sapiens
cauucaaaauaguuccuaca

SEQ ID NO: 7785 - RNA, 24 nt, Homo sapiens
cucugguccccugcaguuacuccu

SEQ ID NO: 7786 - RNA, 21 nt, Homo sapiens
gaaaaauccaugacagcagau

SEQ ID NO: 7787 - RNA, 18 nt, Homo sapiens
uaaaaagcaaggaaaacu

SEQ ID NO: 7788 - RNA, 19 nt, Homo sapiens
uacaauauacaacaaaaug

SEQ ID NO: 7789 - RNA, 23 nt, Homo sapiens
ugauuaguugugaauccuaaaaa

SEQ ID NO: 7790 - RNA, 18 nt, Homo sapiens
uuuguaagaaaauaaacu

SEQ ID NO: 7791 - RNA, 16 nt, Homo sapiens
aggcugcagcuuguau

SEQ ID NO: 7792 - RNA, 20 nt, Homo sapiens
agguagaaaaaaagggacua

SEQ ID NO: 7793 - RNA, 23 nt, Homo sapiens
cccugcuccuaguuuccacuugg

SEQ ID NO: 7794 - RNA, 14 nt, Homo sapiens
gauacagaauagau

SEQ ID NO: 7795 - RNA, 22 nt, Homo sapiens
gcaagacugaggagaaaagaaa

SEQ ID NO: 7796 - RNA, 17 nt, Homo sapiens
ggcuucccucuccuucc

SEQ ID NO: 7797 - RNA, 18 nt, Homo sapiens
ucugaaaaggucagaggc

SEQ ID NO: 7798 - RNA, 21 nt, Homo sapiens
ugcugagauuucugguacaaa

SEQ ID NO: 7799 - RNA, 21 nt, Homo sapiens
uugaauuagguuuucugugau

SEQ ID NO: 7800 - RNA, 20 nt, Homo sapiens
aaaaacacucagaacuuuau

SEQ ID NO: 7801 - RNA, 18 nt, Homo sapiens
acagaagaaaacaaauag

SEQ ID NO: 7802 - RNA, 14 nt, Homo sapiens
cacauuuauuguca

SEQ ID NO: 7803 - RNA, 18 nt, Homo sapiens
ccuugccugcuggacuuu

SEQ ID NO: 7804 - RNA, 18 nt, Homo sapiens
cguccuugccugcuggac

SEQ ID NO: 7805 - RNA, 18 nt, Homo sapiens
ggcaaaagaaagaaagcc

SEQ ID NO: 7806 - RNA, 22 nt, Homo sapiens
uguuuugacuguuggcuuuguc

SEQ ID NO: 7807 - RNA, 21 nt, Homo sapiens
uucaacaucugucauuuuuuu

SEQ ID NO: 7808 - RNA, 19 nt, Homo sapiens
ccgcguucucuccguggcc

SEQ ID NO: 7809 - RNA, 17 nt, Homo sapiens
gggcugcugcguccugg

SEQ ID NO: 7810 - RNA, 22 nt, Homo sapiens
uggcguccguacaccuuggugc

SEQ ID NO: 7811 - RNA, 17 nt, Homo sapiens
aagagcuaaguugaguu

SEQ ID NO: 7812 - RNA, 21 nt, Homo sapiens
agagcuaucauuuuagaaagc

SEQ ID NO: 7813 - RNA, 21 nt, Homo sapiens
aguuauuuuccccuggcagcc

SEQ ID NO: 7814 - RNA, 20 nt, Homo sapiens
ccuaucuugccucaccuguc

SEQ ID NO: 7815 - RNA, 22 nt, Homo sapiens
cugccaccucccugaccauggu

SEQ ID NO: 7816 - RNA, 15 nt, Homo sapiens
gcuugcugcagcugc

SEQ ID NO: 7817 - RNA, 21 nt, Homo sapiens
ggggcccuucugacuuuuggg

SEQ ID NO: 7818 - RNA, 26 nt, Homo sapiens
uacauauauaaaacauauacauauau

SEQ ID NO: 7819 - RNA, 24 nt, Homo sapiens
uauaugaguauacauacauauaua

SEQ ID NO: 7820 - RNA, 22 nt, Homo sapiens
ugaagagcucuuugccaaauac

SEQ ID NO: 7821 - RNA, 19 nt, Homo sapiens
uggugucucuuuugaaagc

SEQ ID NO: 7822 - RNA, 18 nt, Homo sapiens
uuucugauugaugggaaa

SEQ ID NO: 7823 - RNA, 22 nt, Homo sapiens
uuugcccauguuauauuacaaa

SEQ ID NO: 7824 - RNA, 16 nt, Homo sapiens
aggggccggggcuccc

SEQ ID NO: 7825 - RNA, 17 nt, Homo sapiens
cgcugucugucucugcg

SEQ ID NO: 7826 - RNA, 18 nt, Homo sapiens
gcugucugucuguccugc

SEQ ID NO: 7827 - RNA, 21 nt, Homo sapiens
ggaagcggcgagaggggccgg

SEQ ID NO: 7828 - RNA, 18 nt, Homo sapiens
ucuguccugccaccuccc

SEQ ID NO: 7829 - RNA, 19 nt, Homo sapiens
cacccgccagcuggucugc

SEQ ID NO: 7830 - RNA, 23 nt, Homo sapiens
caggguccuggagucccgccgcc

SEQ ID NO: 7831 - RNA, 19 nt, Homo sapiens
ccagcagcucccaaacacc

SEQ ID NO: 7832 - RNA, 23 nt, Homo sapiens
cuccggccgggccgccaaagcgg

SEQ ID NO: 7833 - RNA, 18 nt, Homo sapiens
cuggucuccacacccgcc

SEQ ID NO: 7834 - RNA, 22 nt, Homo sapiens
gcccggcccugcagggcgcucc

SEQ ID NO: 7835 - RNA, 21 nt, Homo sapiens
gcgggcggaaccggcaggaag

SEQ ID NO: 7836 - RNA, 18 nt, Homo sapiens
aagugaggagucuugaga

SEQ ID NO: 7837 - RNA, 21 nt, Homo sapiens
acuuaaacagggauaaaaaag

SEQ ID NO: 7838 - RNA, 20 nt, Homo sapiens
aggcuggggcgcuggggcug

SEQ ID NO: 7839 - RNA, 17 nt, Homo sapiens
ggaaagggguggaggug

SEQ ID NO: 7840 - RNA, 20 nt, Homo sapiens
ugaggaccacagcucugugc

SEQ ID NO: 7841 - RNA, 16 nt, Homo sapiens
agcagcagaaggagga

SEQ ID NO: 7842 - RNA, 19 nt, Homo sapiens
ggaggcagcagaggugggg

SEQ ID NO: 7843 - RNA, 16 nt, Homo sapiens
gguguuggagaagacg

SEQ ID NO: 7844 - RNA, 18 nt, Homo sapiens
caucugcagcugguucug

SEQ ID NO: 7845 - RNA, 21 nt, Homo sapiens
gaggcugcuacacuuuguggu

SEQ ID NO: 7846 - RNA, 14 nt, Homo sapiens
uaucgggaaaggug

SEQ ID NO: 7847 - RNA, 21 nt, Homo sapiens
uggcuuccaggcucccugacu

SEQ ID NO: 7848 - RNA, 18 nt, Homo sapiens
uguuaagagucauaauga

SEQ ID NO: 7849 - RNA, 18 nt, Homo sapiens
agauguuagcauccugga

SEQ ID NO: 7850 - RNA, 17 nt, Homo sapiens
agugaaagggaaacaga

SEQ ID NO: 7851 - RNA, 21 nt, Homo sapiens
ugaguaggcaagacauuuauu

SEQ ID NO: 7852 - RNA, 18 nt, Homo sapiens
gagaaucagugaguugca

SEQ ID NO: 7853 - RNA, 19 nt, Homo sapiens
ggggugucuggcuggcgug

SEQ ID NO: 7854 - RNA, 21 nt, Homo sapiens
ugggcagaguaggguggggca

SEQ ID NO: 7855 - RNA, 21 nt, Homo sapiens
uucccuuuucaguccugugua

SEQ ID NO: 7856 - RNA, 16 nt, Homo sapiens
ccuggagccgguuggg

SEQ ID NO: 7857 - RNA, 19 nt, Homo sapiens
gagcaggaggucucuuuuc

SEQ ID NO: 7858 - RNA, 21 nt, Homo sapiens
acgaaggucccuuucaucaag

SEQ ID NO: 7859 - RNA, 16 nt, Homo sapiens
cccgccgccuccgccc

SEQ ID NO: 7860 - RNA, 20 nt, Homo sapiens
ccggggccgccgaaaucccg

SEQ ID NO: 7861 - RNA, 19 nt, Homo sapiens
cgagcgcgccgggucggca

SEQ ID NO: 7862 - RNA, 16 nt, Homo sapiens
ggcuacgcggcggagg

SEQ ID NO: 7863 - RNA, 20 nt, Homo sapiens
uaaaggauuuguucauauau

SEQ ID NO: 7864 - RNA, 25 nt, Homo sapiens
auuaaaacugccauuugcaguaggg

SEQ ID NO: 7865 - RNA, 19 nt, Homo sapiens
caucauucuuuuuccccaa

SEQ ID NO: 7866 - RNA, 15 nt, Homo sapiens
gggaccaccuuugaa

SEQ ID NO: 7867 - RNA, 19 nt, Homo sapiens
uaaacacacaagguggcac

SEQ ID NO: 7868 - RNA, 15 nt, Homo sapiens
ugcaguaggggcagc

SEQ ID NO: 7869 - RNA, 21 nt, Homo sapiens
ugaacauuaaaaacaguacaa

SEQ ID NO: 7870 - RNA, 17 nt, Homo sapiens
aagaagaaauucauaga

SEQ ID NO: 7871 - RNA, 21 nt, Homo sapiens
caguggcugauuggcacgacc

SEQ ID NO: 7872 - RNA, 21 nt, Homo sapiens
ugcugaggggguggggggcuc

SEQ ID NO: 7873 - RNA, 19 nt, Homo sapiens
ccucagccucaugaguagc

SEQ ID NO: 7874 - RNA, 17 nt, Homo sapiens
cgcaggaaggguucucc

SEQ ID NO: 7875 - RNA, 20 nt, Homo sapiens
gagacggagucuugcucugu

SEQ ID NO: 7876 - RNA, 21 nt, Homo sapiens
gaggugggggugagggggaca

SEQ ID NO: 7877 - RNA, 21 nt, Homo sapiens
ggcaggguggaggcgcugcgc

SEQ ID NO: 7878 - RNA, 23 nt, Homo sapiens
ucgaacuccugaccucaggugau

SEQ ID NO: 7879 - RNA, 19 nt, Homo sapiens
ugaggugggggugaggggg

SEQ ID NO: 7880 - RNA, 20 nt, Homo sapiens
ugcccuuuucagacccucag

SEQ ID NO: 7881 - RNA, 19 nt, Homo sapiens
uggccaggcugcucucgaa

SEQ ID NO: 7882 - RNA, 17 nt, Homo sapiens
ugguaggcugagaugcu

SEQ ID NO: 7883 - RNA, 17 nt, Homo sapiens
aggggagcgaggugggc

SEQ ID NO: 7884 - RNA, 19 nt, Homo sapiens
cagguggcucuucccggcc

SEQ ID NO: 7885 - RNA, 17 nt, Homo sapiens
ccagaggggagcgaggu

SEQ ID NO: 7886 - RNA, 22 nt, Homo sapiens
cgggcgcggaguggcgggagcg

SEQ ID NO: 7887 - RNA, 20 nt, Homo sapiens
gagggggugggcuggcagug

SEQ ID NO: 7888 - RNA, 15 nt, Homo sapiens
gcgggcgcggagugg

SEQ ID NO: 7889 - RNA, 20 nt, Homo sapiens
gcggggagggagcaaaggcu

SEQ ID NO: 7890 - RNA, 23 nt, Homo sapiens
gcuggaggccagaaguggguuug

SEQ ID NO: 7891 - RNA, 19 nt, Homo sapiens
gcuuccugggacccuggug

SEQ ID NO: 7892 - RNA, 18 nt, Homo sapiens
guucagagcccaggagug

SEQ ID NO: 7893 - RNA, 19 nt, Homo sapiens
ugcccggcgcccccacucc

SEQ ID NO: 7894 - RNA, 20 nt, Homo sapiens
cagccgcgugcagcccccgu

SEQ ID NO: 7895 - RNA, 21 nt, Homo sapiens
cgcccgggccgcggcgccaac

SEQ ID NO: 7896 - RNA, 24 nt, Homo sapiens
cgcgggggccgggcguucagaggg

SEQ ID NO: 7897 - RNA, 18 nt, Homo sapiens
cggccgcagggcuggagc

SEQ ID NO: 7898 - RNA, 16 nt, Homo sapiens
gcccgggccgcggcgc

SEQ ID NO: 7899 - RNA, 23 nt, Homo sapiens
gcgcagcgcugcggauccccggc

SEQ ID NO: 7900 - RNA, 22 nt, Homo sapiens
ggcagagcggagcggggcugcu

SEQ ID NO: 7901 - RNA, 19 nt, Homo sapiens
ggccagccgcgugcagccc

SEQ ID NO: 7902 - RNA, 18 nt, Homo sapiens
uccuaguucggaaucuug

SEQ ID NO: 7903 - RNA, 21 nt, Homo sapiens
ucuaggugaagaaaccaagac

SEQ ID NO: 7904 - RNA, 18 nt, Homo sapiens
acaagacauugugugagc

SEQ ID NO: 7905 - RNA, 18 nt, Homo sapiens
agugaguucugccucagc

SEQ ID NO: 7906 - RNA, 28 nt, Homo sapiens
aucagccuccaccuuaacugcccacccc

SEQ ID NO: 7907 - RNA, 19 nt, Homo sapiens
gaagggggcgugggcagcc

SEQ ID NO: 7908 - RNA, 19 nt, Homo sapiens
gcagacggcgcacagaggc

SEQ ID NO: 7909 - RNA, 14 nt, Homo sapiens
uuccugacuugcag

SEQ ID NO: 7910 - RNA, 18 nt, Homo sapiens
agacagacagguggcagg

SEQ ID NO: 7911 - RNA, 20 nt, Homo sapiens
ccccuuguccagucuggcug

SEQ ID NO: 7912 - RNA, 19 nt, Homo sapiens
augugauaaauaaucagga

SEQ ID NO: 7913 - RNA, 23 nt, Homo sapiens
ccuccgcgugcucucgccuaccg

SEQ ID NO: 7914 - RNA, 19 nt, Homo sapiens
cgccaccgccgccgucucc

SEQ ID NO: 7915 - RNA, 20 nt, Homo sapiens
cgcgccgccaccgccgccgu

SEQ ID NO: 7916 - RNA, 14 nt, Homo sapiens
gaggcugcuguggc

SEQ ID NO: 7917 - RNA, 18 nt, Homo sapiens
gagugcgcugcugugcga

SEQ ID NO: 7918 - RNA, 20 nt, Homo sapiens
gcgcggggcaccgagugcgc

SEQ ID NO: 7919 - RNA, 18 nt, Homo sapiens
uaucaaagacccaaagau

SEQ ID NO: 7920 - RNA, 22 nt, Homo sapiens
uccgcgugcucucgccuaccgc

SEQ ID NO: 7921 - RNA, 20 nt, Homo sapiens
ucgauucuuaaagcauaugu

SEQ ID NO: 7922 - RNA, 18 nt, Homo sapiens
ugaacagggauucuuuuc

SEQ ID NO: 7923 - RNA, 17 nt, Homo sapiens
ugaagcaaugguuuugc

SEQ ID NO: 7924 - RNA, 16 nt, Homo sapiens
uguagaaagcgaucau

SEQ ID NO: 7925 - RNA, 19 nt, Homo sapiens
ugugugcacauaaaacagg

SEQ ID NO: 7926 - RNA, 17 nt, Homo sapiens
uugcuguccaacuucag

SEQ ID NO: 7927 - RNA, 19 nt, Homo sapiens
cagcuggagauguugggcu

SEQ ID NO: 7928 - RNA, 22 nt, Homo sapiens
gcgcggggacgggcgggaccgc

SEQ ID NO: 7929 - RNA, 16 nt, Homo sapiens
gggcagccggugcccc

SEQ ID NO: 7930 - RNA, 18 nt, Homo sapiens
accacccaccugccuccc

SEQ ID NO: 7931 - RNA, 23 nt, Homo sapiens
aggcucaggcuccuccggcagcc

SEQ ID NO: 7932 - RNA, 17 nt, Homo sapiens
cggggcuggcccagcug

SEQ ID NO: 7933 - RNA, 18 nt, Homo sapiens
gcccuucccugagacccg

SEQ ID NO: 7934 - RNA, 20 nt, Homo sapiens
agugggggagaggggcgugg

SEQ ID NO: 7935 - RNA, 18 nt, Homo sapiens
cguggaggcgagacgcgg

SEQ ID NO: 7936 - RNA, 19 nt, Homo sapiens
gaggacaggggcugcacca

SEQ ID NO: 7937 - RNA, 20 nt, Homo sapiens
gcuccccaggagcccacggc

SEQ ID NO: 7938 - RNA, 21 nt, Homo sapiens
gcugccucugcuggcugccua

SEQ ID NO: 7939 - RNA, 18 nt, Homo sapiens
gggcaggggacagccagg

SEQ ID NO: 7940 - RNA, 19 nt, Homo sapiens
uaggagcuguggggcaggg

SEQ ID NO: 7941 - RNA, 16 nt, Homo sapiens
ucaggcaucuggggac

SEQ ID NO: 7942 - RNA, 22 nt, Homo sapiens
uggugcacacagguggaccccg

SEQ ID NO: 7943 - RNA, 15 nt, Homo sapiens
ugucaugggccgcgg

SEQ ID NO: 7944 - RNA, 17 nt, Homo sapiens
cauuggcugggcaaggg

SEQ ID NO: 7945 - RNA, 21 nt, Homo sapiens
gcccuacuguguccauuggcu

SEQ ID NO: 7946 - RNA, 26 nt, Homo sapiens
ugugagagguuaccaccguggugauc

SEQ ID NO: 7947 - RNA, 22 nt, Homo sapiens
aaaacuaauucaugauuggugc

SEQ ID NO: 7948 - RNA, 25 nt, Homo sapiens
aucacccuagguucuccccuguccc

SEQ ID NO: 7949 - RNA, 15 nt, Homo sapiens
cgagcuccaauucca

SEQ ID NO: 7950 - RNA, 20 nt, Homo sapiens
cgcuggggucccugcuaggg

SEQ ID NO: 7951 - RNA, 16 nt, Homo sapiens
cucugaccugcuguga

SEQ ID NO: 7952 - RNA, 19 nt, Homo sapiens
gaggagagaaaaaggaaua

SEQ ID NO: 7953 - RNA, 16 nt, Homo sapiens
gaucuggaaguucucu

SEQ ID NO: 7954 - RNA, 18 nt, Homo sapiens
gcuugcaaaacacaagug

SEQ ID NO: 7955 - RNA, 18 nt, Homo sapiens
gggucccugcuagggccg

SEQ ID NO: 7956 - RNA, 21 nt, Homo sapiens
uaagaggcugugucuggcugg

SEQ ID NO: 7957 - RNA, 21 nt, Homo sapiens
ucucucgggcgcugggguccc

SEQ ID NO: 7958 - RNA, 19 nt, Homo sapiens
uggaaagaagggcuguccu

SEQ ID NO: 7959 - RNA, 23 nt, Homo sapiens
uguaauauauguuugaaacauua

SEQ ID NO: 7960 - RNA, 19 nt, Homo sapiens
ugucccaugucaacauuua

SEQ ID NO: 7961 - RNA, 18 nt, Homo sapiens
agauggugccuuggcagc

SEQ ID NO: 7962 - RNA, 18 nt, Homo sapiens
cauuuuguaggguggggu

SEQ ID NO: 7963 - RNA, 19 nt, Homo sapiens
gaaaagccuugaaagaaug

SEQ ID NO: 7964 - RNA, 17 nt, Homo sapiens
ggugggguagaguuaga

SEQ ID NO: 7965 - RNA, 20 nt, Homo sapiens
ucugcaaucauagaaaaguu

SEQ ID NO: 7966 - RNA, 22 nt, Homo sapiens
uucacauacguuuuuacguugc

SEQ ID NO: 7967 - RNA, 22 nt, Homo sapiens
uuuauugugucguaaauaagga

SEQ ID NO: 7968 - RNA, 14 nt, Homo sapiens
ucaggagaugauag

SEQ ID NO: 7969 - RNA, 19 nt, Homo sapiens
aaugugauguucccaggaa

SEQ ID NO: 7970 - RNA, 20 nt, Homo sapiens
caaugcaggcuagaauagaa

SEQ ID NO: 7971 - RNA, 17 nt, Homo sapiens
cagaggccuaaggaccu

SEQ ID NO: 7972 - RNA, 18 nt, Homo sapiens
cagaucagugucuaugag

SEQ ID NO: 7973 - RNA, 18 nt, Homo sapiens
caucagcaucuauguggc

SEQ ID NO: 7974 - RNA, 21 nt, Homo sapiens
ccuaaggaccuccuaacccua

SEQ ID NO: 7975 - RNA, 19 nt, Homo sapiens
ggguggacucuuggagccu

SEQ ID NO: 7976 - RNA, 18 nt, Homo sapiens
uagaauagaaggauuguu

SEQ ID NO: 7977 - RNA, 17 nt, Homo sapiens
uagagaagggagaccaa

SEQ ID NO: 7978 - RNA, 18 nt, Homo sapiens
ucccaauugucaaagauu

SEQ ID NO: 7979 - RNA, 15 nt, Homo sapiens
agccccagccauccc

SEQ ID NO: 7980 - RNA, 18 nt, Homo sapiens
agccccagccaucccucc

SEQ ID NO: 7981 - RNA, 19 nt, Homo sapiens
caccacccagccgcuggag

SEQ ID NO: 7982 - RNA, 23 nt, Homo sapiens
cccggcuggcaucgguccugccc

SEQ ID NO: 7983 - RNA, 19 nt, Homo sapiens
gagcagaugggacauccgg

SEQ ID NO: 7984 - RNA, 16 nt, Homo sapiens
ggggggaggggagggg

SEQ ID NO: 7985 - RNA, 18 nt, Homo sapiens
ucaggaagggagcucugc

SEQ ID NO: 7986 - RNA, 23 nt, Homo sapiens
uuaagccucaauccucugcagcg

SEQ ID NO: 7987 - RNA, 20 nt, Homo sapiens
aggcgccuggccgcugccgc

SEQ ID NO: 7988 - RNA, 18 nt, Homo sapiens
ccuuguaggucugcccau

SEQ ID NO: 7989 - RNA, 23 nt, Homo sapiens
gcugauuuccggauuagcaucgu

SEQ ID NO: 7990 - RNA, 17 nt, Homo sapiens
ggcucgggcugccgagc

SEQ ID NO: 7991 - RNA, 21 nt, Homo sapiens
ucaauugugaauuuaaacaau

SEQ ID NO: 7992 - RNA, 20 nt, Homo sapiens
ugcccauggagccucggggc

SEQ ID NO: 7993 - RNA, 21 nt, Homo sapiens
uuaauaaaauauaucuacuau

SEQ ID NO: 7994 - RNA, 20 nt, Homo sapiens
uuacauauaauacauuagug

SEQ ID NO: 7995 - RNA, 21 nt, Homo sapiens
uuagucuccgauucaugaacc

SEQ ID NO: 7996 - RNA, 18 nt, Homo sapiens
acacaaucuugccuucca

SEQ ID NO: 7997 - RNA, 19 nt, Homo sapiens
agagcgcggggcugcaggu

SEQ ID NO: 7998 - RNA, 18 nt, Homo sapiens
aggaauguaaggugcaca

SEQ ID NO: 7999 - RNA, 17 nt, Homo sapiens
caaaauauaucuuaaca

SEQ ID NO: 8000 - RNA, 21 nt, Homo sapiens
caggugcgggcggcaggugcg

SEQ ID NO: 8001 - RNA, 19 nt, Homo sapiens
cgggcggcaggugcgggcc

SEQ ID NO: 8002 - RNA, 21 nt, Homo sapiens
cugcucucuaggaauguaagg

SEQ ID NO: 8003 - RNA, 17 nt, Homo sapiens
gcugugugagacaaaag

SEQ ID NO: 8004 - RNA, 19 nt, Homo sapiens
ggaccuggcgggaggacug

SEQ ID NO: 8005 - RNA, 18 nt, Homo sapiens
uaucuuaacaccaguggc

SEQ ID NO: 8006 - RNA, 22 nt, Homo sapiens
uagaaagaaauugguuacuccu

SEQ ID NO: 8007 - RNA, 18 nt, Homo sapiens
uuuguauuuucucuccac

SEQ ID NO: 8008 - RNA, 18 nt, Homo sapiens
ccagccaccucgggcacc

SEQ ID NO: 8009 - RNA, 19 nt, Homo sapiens
ccuguugucaggaccuccu

SEQ ID NO: 8010 - RNA, 16 nt, Homo sapiens
gguugggggaggaccg

SEQ ID NO: 8011 - RNA, 18 nt, Homo sapiens
gaagccacagcugcccuc

SEQ ID NO: 8012 - RNA, 18 nt, Homo sapiens
ggagaggcacuggggagg

SEQ ID NO: 8013 - RNA, 19 nt, Homo sapiens
ccuacagccagcacccucc

SEQ ID NO: 8014 - RNA, 17 nt, Homo sapiens
gcucuuuugugaccagg

SEQ ID NO: 8015 - RNA, 19 nt, Homo sapiens
ugcgagcgccagcaccggc

SEQ ID NO: 8016 - RNA, 21 nt, Homo sapiens
gcuguggccuuuuuccccucc

SEQ ID NO: 8017 - RNA, 24 nt, Homo sapiens
ccggccccggcccuggcccuggcc

SEQ ID NO: 8018 - RNA, 22 nt, Homo sapiens
gcgcgccuccucccuccucucc

SEQ ID NO: 8019 - RNA, 20 nt, Homo sapiens
ggaggugagcgagcgagcag

SEQ ID NO: 8020 - RNA, 17 nt, Homo sapiens
aaguggaagcacuaggu

SEQ ID NO: 8021 - RNA, 23 nt, Homo sapiens
agccacaccugggugcaggccac

SEQ ID NO: 8022 - RNA, 18 nt, Homo sapiens
ccuagcuggaaacccugg

SEQ ID NO: 8023 - RNA, 21 nt, Homo sapiens
ccucugggaaguggcaucauu

SEQ ID NO: 8024 - RNA, 18 nt, Homo sapiens
ccugguccccccgggccu

SEQ ID NO: 8025 - RNA, 17 nt, Homo sapiens
gaaguggaagcacuagg

SEQ ID NO: 8026 - RNA, 20 nt, Homo sapiens
gagacggagucucgcucugu

SEQ ID NO: 8027 - RNA, 19 nt, Homo sapiens
gaucacaggcacgugccac

SEQ ID NO: 8028 - RNA, 17 nt, Homo sapiens
ucauuuggugaaugagu

SEQ ID NO: 8029 - RNA, 20 nt, Homo sapiens
ucgauauucacgaucacggc

SEQ ID NO: 8030 - RNA, 20 nt, Homo sapiens
ccccggcccuggaaaggccg

SEQ ID NO: 8031 - RNA, 18 nt, Homo sapiens
ccucagggcacugguugg

SEQ ID NO: 8032 - RNA, 16 nt, Homo sapiens
cuuccuccugggguuc

SEQ ID NO: 8033 - RNA, 17 nt, Homo sapiens
gagcagaagugcuuuuc

SEQ ID NO: 8034 - RNA, 18 nt, Homo sapiens
gcuguagcccugggcaau

SEQ ID NO: 8035 - RNA, 16 nt, Homo sapiens
cagcaggccggagcuc

SEQ ID NO: 8036 - RNA, 15 nt, Homo sapiens
ggcagggccuggggu

SEQ ID NO: 8037 - RNA, 15 nt, Homo sapiens
ggcugcagugcagcc

SEQ ID NO: 8038 - RNA, 23 nt, Homo sapiens
ucauuugcccccucccccacucc

SEQ ID NO: 8039 - RNA, 15 nt, Homo sapiens
ugggguugagaaagu

SEQ ID NO: 8040 - RNA, 24 nt, Homo sapiens
uugguuguuuaaaaaccauuucuu

SEQ ID NO: 8041 - RNA, 19 nt, Homo sapiens
agccagcgggggccaccua

SEQ ID NO: 8042 - RNA, 16 nt, Homo sapiens
aguaaaaauaucucag

SEQ ID NO: 8043 - RNA, 19 nt, Homo sapiens
auaguaaaaauaucucagu

SEQ ID NO: 8044 - RNA, 22 nt, Homo sapiens
ggggugcaagaugauagagaag

SEQ ID NO: 8045 - RNA, 18 nt, Homo sapiens
uggaagcuauuuuggggg

SEQ ID NO: 8046 - RNA, 19 nt, Homo sapiens
uucucuucucuuuucccca

SEQ ID NO: 8047 - RNA, 21 nt, Homo sapiens
gaaaaaaugggcgaccaugaa

SEQ ID NO: 8048 - RNA, 20 nt, Homo sapiens
cuucccucagucuggggcuc

SEQ ID NO: 8049 - RNA, 18 nt, Homo sapiens
aauguuuauguucuacag

SEQ ID NO: 8050 - RNA, 21 nt, Homo sapiens
auccagauuacuuaucauuuu

SEQ ID NO: 8051 - RNA, 16 nt, Homo sapiens
caaacaagaaaugucu

SEQ ID NO: 8052 - RNA, 20 nt, Homo sapiens
cuaguaagaauaaacuaaag

SEQ ID NO: 8053 - RNA, 16 nt, Homo sapiens
gucuuggcauuggugg

SEQ ID NO: 8054 - RNA, 19 nt, Homo sapiens
uaacuuuaugacuuccaca

SEQ ID NO: 8055 - RNA, 20 nt, Homo sapiens
uccagauuacuuaucauuuu

SEQ ID NO: 8056 - RNA, 20 nt, Homo sapiens
ucuucaaacucacaguaauc

SEQ ID NO: 8057 - RNA, 16 nt, Homo sapiens
ugagcuagaugaguca

SEQ ID NO: 8058 - RNA, 18 nt, Homo sapiens
uguuaaaaguguuuugaa

SEQ ID NO: 8059 - RNA, 18 nt, Homo sapiens
uucauucagcucucacug

SEQ ID NO: 8060 - RNA, 20 nt, Homo sapiens
uuuaaaguuuuaaaguuuuc

SEQ ID NO: 8061 - RNA, 21 nt, Homo sapiens
cugucucuccauaggccacau

SEQ ID NO: 8062 - RNA, 14 nt, Homo sapiens
gcugaagaugggcu

SEQ ID NO: 8063 - RNA, 22 nt, Homo sapiens
gcugcuccuggugggauggcug

SEQ ID NO: 8064 - RNA, 19 nt, Homo sapiens
ggauuuccauuuuauagga

SEQ ID NO: 8065 - RNA, 20 nt, Homo sapiens
uuacauuaauugauguuauu

SEQ ID NO: 8066 - RNA, 15 nt, Homo sapiens
ccuuagggggagggg

SEQ ID NO: 8067 - RNA, 18 nt, Homo sapiens
gagggcugggggcgggcu

SEQ ID NO: 8068 - RNA, 21 nt, Homo sapiens
gagguggggguggagggccag

SEQ ID NO: 8069 - RNA, 16 nt, Homo sapiens
gggagggcugggggcg

SEQ ID NO: 8070 - RNA, 16 nt, Homo sapiens
gggcgggagggcuggg

SEQ ID NO: 8071 - RNA, 19 nt, Homo sapiens
gggcugggcgggagggcug

SEQ ID NO: 8072 - RNA, 19 nt, Homo sapiens
gggcugggggcgggcuggg

SEQ ID NO: 8073 - RNA, 21 nt, Homo sapiens
ggggguggagggccagcuggg

SEQ ID NO: 8074 - RNA, 18 nt, Homo sapiens
ugaggucggggaacagag

SEQ ID NO: 8075 - RNA, 20 nt, Homo sapiens
ugccuuagggggaggggcuu

SEQ ID NO: 8076 - RNA, 21 nt, Homo sapiens
ucaccaaccaggugggaaggg

SEQ ID NO: 8077 - RNA, 18 nt, Homo sapiens
ugggaagggccggguggc

SEQ ID NO: 8078 - RNA, 20 nt, Homo sapiens
aggggaaggggcuggggaag

SEQ ID NO: 8079 - RNA, 21 nt, Homo sapiens
caaaauagcaacuaugguuau

SEQ ID NO: 8080 - RNA, 23 nt, Homo sapiens
ccagguagcagauauaaagcuua

SEQ ID NO: 8081 - RNA, 20 nt, Homo sapiens
ccauaugcaaaggcacaaag

SEQ ID NO: 8082 - RNA, 22 nt, Homo sapiens
ccuggaagaccugaacccugag

SEQ ID NO: 8083 - RNA, 20 nt, Homo sapiens
gagacagaugggcuggaaca

SEQ ID NO: 8084 - RNA, 17 nt, Homo sapiens
ggauaaugauuaaaaac

SEQ ID NO: 8085 - RNA, 16 nt, Homo sapiens
agccuucccaguagag

SEQ ID NO: 8086 - RNA, 25 nt, Homo sapiens
agcuggaaggaguuggggcaggaag

SEQ ID NO: 8087 - RNA, 21 nt, Homo sapiens
ccacgguugcucggcaggcuc

SEQ ID NO: 8088 - RNA, 19 nt, Homo sapiens
ccaggcuggccucagaggc

SEQ ID NO: 8089 - RNA, 20 nt, Homo sapiens
ccuccacggguuggggcgcc

SEQ ID NO: 8090 - RNA, 18 nt, Homo sapiens
gcuucggccucccugggc

SEQ ID NO: 8091 - RNA, 18 nt, Homo sapiens
ucaggaccucagacuccu

SEQ ID NO: 8092 - RNA, 25 nt, Homo sapiens
ucaggaccucagacuccucagggug

SEQ ID NO: 8093 - RNA, 17 nt, Homo sapiens
ucauggggccugggaga

SEQ ID NO: 8094 - RNA, 27 nt, Homo sapiens
agaugggggugggaggcugucaguggg

SEQ ID NO: 8095 - RNA, 16 nt, Homo sapiens
gaguuugagaccagcc

SEQ ID NO: 8096 - RNA, 19 nt, Homo sapiens
gcaagcaaggguucaaaga

SEQ ID NO: 8097 - RNA, 17 nt, Homo sapiens
ggagaaggaggggaagg

SEQ ID NO: 8098 - RNA, 14 nt, Homo sapiens
ucacggcuguaacu

SEQ ID NO: 8099 - RNA, 18 nt, Homo sapiens
ugauuuccgauuugccug

SEQ ID NO: 8100 - RNA, 19 nt, Homo sapiens
ugggaacaugaagcuguuc

SEQ ID NO: 8101 - RNA, 19 nt, Homo sapiens
aaaaugcuuccuacaaaaa

SEQ ID NO: 8102 - RNA, 18 nt, Homo sapiens
aacaguacaaucucaacu

SEQ ID NO: 8103 - RNA, 20 nt, Homo sapiens
aaugugauuguauuuaagaa

SEQ ID NO: 8104 - RNA, 17 nt, Homo sapiens
acgcggggcggagcugc

SEQ ID NO: 8105 - RNA, 16 nt, Homo sapiens
agaggcagaaccucua

SEQ ID NO: 8106 - RNA, 23 nt, Homo sapiens
agggagacuauacuaauguuugu

SEQ ID NO: 8107 - RNA, 18 nt, Homo sapiens
ccggguucaagagauucg

SEQ ID NO: 8108 - RNA, 20 nt, Homo sapiens
gagacggagucucacucugu

SEQ ID NO: 8109 - RNA, 18 nt, Homo sapiens
gagugucucauucacuuc

SEQ ID NO: 8110 - RNA, 19 nt, Homo sapiens
gauuacagaugugugccgc

SEQ ID NO: 8111 - RNA, 19 nt, Homo sapiens
gauuacaggcaugcgccac

SEQ ID NO: 8112 - RNA, 18 nt, Homo sapiens
gcagcggcauacucauga

SEQ ID NO: 8113 - RNA, 15 nt, Homo sapiens
ggaccagaggcugga

SEQ ID NO: 8114 - RNA, 14 nt, Homo sapiens
ggggcggagcugcg

SEQ ID NO: 8115 - RNA, 23 nt, Homo sapiens
guaguguguaauuuuuuauagug

SEQ ID NO: 8116 - RNA, 20 nt, Homo sapiens
guggaucacaaggucaggag

SEQ ID NO: 8117 - RNA, 15 nt, Homo sapiens
uccaccugguccugc

SEQ ID NO: 8118 - RNA, 18 nt, Homo sapiens
uccauuaauacuauaauc

SEQ ID NO: 8119 - RNA, 23 nt, Homo sapiens
ucgaacuccugaccucaggugau

SEQ ID NO: 8120 - RNA, 19 nt, Homo sapiens
ugaucugccugcccuggcc

SEQ ID NO: 8121 - RNA, 21 nt, Homo sapiens
uggaauuucacucuuguuucc

SEQ ID NO: 8122 - RNA, 21 nt, Homo sapiens
uguagaaugucaauccuaguu

SEQ ID NO: 8123 - RNA, 24 nt, Homo sapiens
uugaaacuaaggaaggaaccaguc

SEQ ID NO: 8124 - RNA, 17 nt, Homo sapiens
uugggaggcugaggugg

SEQ ID NO: 8125 - RNA, 22 nt, Homo sapiens
uuucccaggcuggagugcaaug

SEQ ID NO: 8126 - RNA, 16 nt, Homo sapiens
agggcugcggcuaucu

SEQ ID NO: 8127 - RNA, 24 nt, Homo sapiens
aggggcuguggaguccccacugcu

SEQ ID NO: 8128 - RNA, 21 nt, Homo sapiens
ccaaggucccugggaaacuca

SEQ ID NO: 8129 - RNA, 18 nt, Homo sapiens
aauauaugaauauuuuau

SEQ ID NO: 8130 - RNA, 18 nt, Homo sapiens
accuacccgacccgcccc

SEQ ID NO: 8131 - RNA, 16 nt, Homo sapiens
caccgcccgccccccg

SEQ ID NO: 8132 - RNA, 16 nt, Homo sapiens
ccaccgcccgcccccc

SEQ ID NO: 8133 - RNA, 20 nt, Homo sapiens
ccccgcccagcgcgccgcgg

SEQ ID NO: 8134 - RNA, 22 nt, Homo sapiens
ccgaguacaagccggcgccucc

SEQ ID NO: 8135 - RNA, 18 nt, Homo sapiens
ccgccgucgcucuccccg

SEQ ID NO: 8136 - RNA, 21 nt, Homo sapiens
ccggcccggcucgccuuucuc

SEQ ID NO: 8137 - RNA, 18 nt, Homo sapiens
ccuuuccccgcccccggc

SEQ ID NO: 8138 - RNA, 20 nt, Homo sapiens
cuagugcaauuggucuccau

SEQ ID NO: 8139 - RNA, 15 nt, Homo sapiens
cuccccuucccuccc

SEQ ID NO: 8140 - RNA, 23 nt, Homo sapiens
gagcggagacccccucuuccccu

SEQ ID NO: 8141 - RNA, 22 nt, Homo sapiens
ugcgguuucauuuucacugccc

SEQ ID NO: 8142 - RNA, 21 nt, Homo sapiens
aagcagucuuugcauuucagu

SEQ ID NO: 8143 - RNA, 17 nt, Homo sapiens
uacaaugacuaugaagg

SEQ ID NO: 8144 - RNA, 19 nt, Homo sapiens
ccagccgcugaaugacacc

SEQ ID NO: 8145 - RNA, 19 nt, Homo sapiens
guggcaccuguggcucucc

SEQ ID NO: 8146 - RNA, 17 nt, Homo sapiens
guguguguuuguaucca

SEQ ID NO: 8147 - RNA, 18 nt, Homo sapiens
uccucuucucucccacuc

SEQ ID NO: 8148 - RNA, 18 nt, Homo sapiens
ucuucucucccacucuug

SEQ ID NO: 8149 - RNA, 17 nt, Homo sapiens
uuccugaccccucugug

SEQ ID NO: 8150 - RNA, 25 nt, Homo sapiens
aggggcuggggggaggcccaagggg

SEQ ID NO: 8151 - RNA, 20 nt, Homo sapiens
gcaggaaggggaggaggggc

SEQ ID NO: 8152 - RNA, 19 nt, Homo sapiens
gggugcaggaaggggagga

SEQ ID NO: 8153 - RNA, 14 nt, Homo sapiens
aagggaaaggaugg

SEQ ID NO: 8154 - RNA, 17 nt, Homo sapiens
agagagauaauaccaga

SEQ ID NO: 8155 - RNA, 21 nt, Homo sapiens
uggcugcugccgucagugagu

SEQ ID NO: 8156 - RNA, 14 nt, Homo sapiens
uuaguuucaccacu

SEQ ID NO: 8157 - RNA, 19 nt, Homo sapiens
augauccaaagugcuguaa

SEQ ID NO: 8158 - RNA, 16 nt, Homo sapiens
gcaucuucucuuaguu

SEQ ID NO: 8159 - RNA, 24 nt, Homo sapiens
uaacauccuguaaguucucccugg

SEQ ID NO: 8160 - RNA, 19 nt, Homo sapiens
acaagacuggugugucugg

SEQ ID NO: 8161 - RNA, 17 nt, Homo sapiens
acccuguacggcauggg

SEQ ID NO: 8162 - RNA, 21 nt, Homo sapiens
uccaaguucaugguucacucc

SEQ ID NO: 8163 - RNA, 23 nt, Homo sapiens
ucuguagccugucuacagacgau

SEQ ID NO: 8164 - RNA, 17 nt, Homo sapiens
ugucuaugcucguggcu

SEQ ID NO: 8165 - RNA, 21 nt, Homo sapiens
aggggcggggcggggcggugg

SEQ ID NO: 8166 - RNA, 18 nt, Homo sapiens
agggguggcaggggcggg

SEQ ID NO: 8167 - RNA, 17 nt, Homo sapiens
cagccgcuucuccacac

SEQ ID NO: 8168 - RNA, 18 nt, Homo sapiens
cagcugaacagcuggagc

SEQ ID NO: 8169 - RNA, 15 nt, Homo sapiens
caggguccaggcugc

SEQ ID NO: 8170 - RNA, 19 nt, Homo sapiens
ccagccgcuucuccacacc

SEQ ID NO: 8171 - RNA, 22 nt, Homo sapiens
ccgcagaggcggacaggcuaau

SEQ ID NO: 8172 - RNA, 16 nt, Homo sapiens
ccucggccccgcgccg

SEQ ID NO: 8173 - RNA, 22 nt, Homo sapiens
ccucggccccgcgccgcgcucg

SEQ ID NO: 8174 - RNA, 20 nt, Homo sapiens
cggggcggugggcgggcagg

SEQ ID NO: 8175 - RNA, 17 nt, Homo sapiens
gaucucagaaauggcag

SEQ ID NO: 8176 - RNA, 19 nt, Homo sapiens
gcggcagggguggcagggg

SEQ ID NO: 8177 - RNA, 23 nt, Homo sapiens
gcucaggccccgggggcagcccc

SEQ ID NO: 8178 - RNA, 24 nt, Homo sapiens
ggaggagagagcuucuucccccag

SEQ ID NO: 8179 - RNA, 19 nt, Homo sapiens
ggaggaggcuuuggcugga

SEQ ID NO: 8180 - RNA, 18 nt, Homo sapiens
ggcaggggcggggcgggg

SEQ ID NO: 8181 - RNA, 26 nt, Homo sapiens
ggccaggagcauggcggcuggaggag

SEQ ID NO: 8182 - RNA, 20 nt, Homo sapiens
ggcggugggcgggcaggcgg

SEQ ID NO: 8183 - RNA, 17 nt, Homo sapiens
gggcggcagggguggca

SEQ ID NO: 8184 - RNA, 18 nt, Homo sapiens
gguccaggcugcuggugc

SEQ ID NO: 8185 - RNA, 25 nt, Homo sapiens
uauuuuuucucuuccuccuuuuuca

SEQ ID NO: 8186 - RNA, 16 nt, Homo sapiens
ucagagcggcggacgg

SEQ ID NO: 8187 - RNA, 15 nt, Homo sapiens
ucggcuccucucccc

SEQ ID NO: 8188 - RNA, 15 nt, Homo sapiens
ugagguccugcaacc

SEQ ID NO: 8189 - RNA, 14 nt, Homo sapiens
uuuugucauccaca

SEQ ID NO: 8190 - RNA, 17 nt, Homo sapiens
ugggacagaaaaagugu

SEQ ID NO: 8191 - RNA, 19 nt, Homo sapiens
aaggggcucccugguuucu

SEQ ID NO: 8192 - RNA, 20 nt, Homo sapiens
acaggugcgcgccaccaugc

SEQ ID NO: 8193 - RNA, 14 nt, Homo sapiens
accauaguguguca

SEQ ID NO: 8194 - RNA, 18 nt, Homo sapiens
caggcuuggaauggaagc

SEQ ID NO: 8195 - RNA, 19 nt, Homo sapiens
gauuacaggugcgcgccac

SEQ ID NO: 8196 - RNA, 16 nt, Homo sapiens
uauuuuuuugagacag

SEQ ID NO: 8197 - RNA, 19 nt, Homo sapiens
uuggggaaugagguuaggg

SEQ ID NO: 8198 - RNA, 21 nt, Homo sapiens
caaaauauuaggagugguuau

SEQ ID NO: 8199 - RNA, 20 nt, Homo sapiens
cagggaaggggcagcaucuu

SEQ ID NO: 8200 - RNA, 20 nt, Homo sapiens
guggaucacgaggucaggag

SEQ ID NO: 8201 - RNA, 21 nt, Homo sapiens
ucaaagacuuuaugaagcuca

SEQ ID NO: 8202 - RNA, 21 nt, Homo sapiens
uccaaacuauuuucuaucucc

SEQ ID NO: 8203 - RNA, 22 nt, Homo sapiens
ucgaaagcggccaggcgcggug

SEQ ID NO: 8204 - RNA, 17 nt, Homo sapiens
uugggaggccgaggcgg

SEQ ID NO: 8205 - RNA, 18 nt, Homo sapiens
acacuuuuaggaaaggaa

SEQ ID NO: 8206 - RNA, 17 nt, Homo sapiens
caaggacgcgccgccgg

SEQ ID NO: 8207 - RNA, 21 nt, Homo sapiens
guucuauuuucaagaggugua

SEQ ID NO: 8208 - RNA, 17 nt, Homo sapiens
uguguguauuuucuucu

SEQ ID NO: 8209 - RNA, 18 nt, Homo sapiens
uuuucauuuuuuauuucc

SEQ ID NO: 8210 - RNA, 19 nt, Homo sapiens
cuuagaaccaaauguggcc

SEQ ID NO: 8211 - RNA, 18 nt, Homo sapiens
aggcaguggcaagaggag

SEQ ID NO: 8212 - RNA, 17 nt, Homo sapiens
caagugccagaagcucu

SEQ ID NO: 8213 - RNA, 22 nt, Homo sapiens
ggcagucccugcagucggcuug

SEQ ID NO: 8214 - RNA, 17 nt, Homo sapiens
gggcagguggucggggu

SEQ ID NO: 8215 - RNA, 16 nt, Homo sapiens
uauuguaaaacagagc

SEQ ID NO: 8216 - RNA, 18 nt, Homo sapiens
ucacacauuagaaagacc

SEQ ID NO: 8217 - RNA, 18 nt, Homo sapiens
uggagauggagcuuggag

SEQ ID NO: 8218 - RNA, 21 nt, Homo sapiens
uuggcccugcagggaccugag

SEQ ID NO: 8219 - RNA, 18 nt, Homo sapiens
uuugauccugaaugcaga

SEQ ID NO: 8220 - RNA, 21 nt, Homo sapiens
cacguggcacaggcaguuuuc

SEQ ID NO: 8221 - RNA, 24 nt, Homo sapiens
aauauuaaaauacagugauaguuu

SEQ ID NO: 8222 - RNA, 22 nt, Homo sapiens
cacauggccauauauuggaaug

SEQ ID NO: 8223 - RNA, 18 nt, Homo sapiens
cagccgggagggugcggc

SEQ ID NO: 8224 - RNA, 19 nt, Homo sapiens
caguucccucccggggggc

SEQ ID NO: 8225 - RNA, 22 nt, Homo sapiens
gagggugcggccacccaguucc

SEQ ID NO: 8226 - RNA, 22 nt, Homo sapiens
gccacccaguucccucccgggg

SEQ ID NO: 8227 - RNA, 18 nt, Homo sapiens
aaagagaaauaaggaaua

SEQ ID NO: 8228 - RNA, 15 nt, Homo sapiens
aggaaaaccacccuc

SEQ ID NO: 8229 - RNA, 16 nt, Homo sapiens
gacucuauaggaugaa

SEQ ID NO: 8230 - RNA, 20 nt, Homo sapiens
guauccacagaauagggaaa

SEQ ID NO: 8231 - RNA, 20 nt, Homo sapiens
ucgauucagauuugggagaa

SEQ ID NO: 8232 - RNA, 24 nt, Homo sapiens
ugauaggccugaauggagcauuca

SEQ ID NO: 8233 - RNA, 19 nt, Homo sapiens
cgauuugcagugacaaugu

SEQ ID NO: 8234 - RNA, 22 nt, Homo sapiens
aaauuguagcaacuuaaagaga

SEQ ID NO: 8235 - RNA, 14 nt, Homo sapiens
cccagguucagguu

SEQ ID NO: 8236 - RNA, 15 nt, Homo sapiens
guucagguuccuccc

SEQ ID NO: 8237 - RNA, 21 nt, Homo sapiens
aggcaggcuugaaauccucag

SEQ ID NO: 8238 - RNA, 20 nt, Homo sapiens
ccggugacuugaucagggaa

SEQ ID NO: 8239 - RNA, 19 nt, Homo sapiens
cguguggggcucuggucgg

SEQ ID NO: 8240 - RNA, 16 nt, Homo sapiens
ggaucuaggccccacc

SEQ ID NO: 8241 - RNA, 19 nt, Homo sapiens
ugugguccccugggaugcc

SEQ ID NO: 8242 - RNA, 18 nt, Homo sapiens
acgcaggagcuuuggaag

SEQ ID NO: 8243 - RNA, 19 nt, Homo sapiens
cagcagacaggggccgaug

SEQ ID NO: 8244 - RNA, 20 nt, Homo sapiens
cgguggcccaaacucugggc

SEQ ID NO: 8245 - RNA, 20 nt, Homo sapiens
gguggcggcgggcgguggcc

SEQ ID NO: 8246 - RNA, 24 nt, Homo sapiens
uauauacauauacauauauauaua

SEQ ID NO: 8247 - RNA, 24 nt, Homo sapiens
uauauauacauauacauauauaua

SEQ ID NO: 8248 - RNA, 24 nt, Homo sapiens
uauauauauacauauacauauaua

SEQ ID NO: 8249 - RNA, 18 nt, Homo sapiens
uauauauauauacauaua

SEQ ID NO: 8250 - RNA, 18 nt, Homo sapiens
ugggaggguggcggcggc

SEQ ID NO: 8251 - RNA, 18 nt, Homo sapiens
uuacuauauauauauaca

SEQ ID NO: 8252 - RNA, 17 nt, Homo sapiens
accccagcuccccgacc

SEQ ID NO: 8253 - RNA, 18 nt, Homo sapiens
aggggcggggggcagggg

SEQ ID NO: 8254 - RNA, 19 nt, Homo sapiens
caccacccaagcacucucc

SEQ ID NO: 8255 - RNA, 24 nt, Homo sapiens
cgcuucuuccuccucccucgcccc

SEQ ID NO: 8256 - RNA, 16 nt, Homo sapiens
cggcagcgcggcgcgg

SEQ ID NO: 8257 - RNA, 19 nt, Homo sapiens
gagaggggcggggggcagg

SEQ ID NO: 8258 - RNA, 17 nt, Homo sapiens
gcggggggcaggggcgc

SEQ ID NO: 8259 - RNA, 21 nt, Homo sapiens
gcggggggcaggggcgccagg

SEQ ID NO: 8260 - RNA, 20 nt, Homo sapiens
ggagaggggcggggggcagg

SEQ ID NO: 8261 - RNA, 23 nt, Homo sapiens
ggagaggggcggggggcaggggc

SEQ ID NO: 8262 - RNA, 14 nt, Homo sapiens
gucagaacuggaaa

SEQ ID NO: 8263 - RNA, 23 nt, Homo sapiens
aagguuuuccuauucucgauaaa

SEQ ID NO: 8264 - RNA, 17 nt, Homo sapiens
gccugacuuugccagac

SEQ ID NO: 8265 - RNA, 18 nt, Homo sapiens
ucucugggcgugagcucc

SEQ ID NO: 8266 - RNA, 19 nt, Homo sapiens
aacccuaacaccucuuuuc

SEQ ID NO: 8267 - RNA, 20 nt, Homo sapiens
gagagguggagggcuggggu

SEQ ID NO: 8268 - RNA, 17 nt, Homo sapiens
gaguggcguccuggggu

SEQ ID NO: 8269 - RNA, 19 nt, Homo sapiens
gcagcucuuuccuagcucu

SEQ ID NO: 8270 - RNA, 18 nt, Homo sapiens
gccagcggugcgcggcgc

SEQ ID NO: 8271 - RNA, 15 nt, Homo sapiens
gcccccggagauuuu

SEQ ID NO: 8272 - RNA, 22 nt, Homo sapiens
ggaagcagggcagcgccaggug

SEQ ID NO: 8273 - RNA, 23 nt, Homo sapiens
gggagagaaaaauggauuuaucu

SEQ ID NO: 8274 - RNA, 18 nt, Homo sapiens
guggagauggcguugggg

SEQ ID NO: 8275 - RNA, 23 nt, Homo sapiens
guggagauggcguuggggguggg

SEQ ID NO: 8276 - RNA, 17 nt, Homo sapiens
ucucccacuuugccacc

SEQ ID NO: 8277 - RNA, 18 nt, Homo sapiens
ugggggugggagggggug

SEQ ID NO: 8278 - RNA, 21 nt, Homo sapiens
cuccauagagaacaacauaag

SEQ ID NO: 8279 - RNA, 26 nt, Homo sapiens
uuuaaaaauauguauaaguuagccau

SEQ ID NO: 8280 - RNA, 18 nt, Homo sapiens
aaauauuaucuaagguag

SEQ ID NO: 8281 - RNA, 21 nt, Homo sapiens
agcaccccuguacuggggagg

SEQ ID NO: 8282 - RNA, 23 nt, Homo sapiens
aggggcgcggggggcgcgggggg

SEQ ID NO: 8283 - RNA, 21 nt, Homo sapiens
auauauauauauauuuaaaga

SEQ ID NO: 8284 - RNA, 16 nt, Homo sapiens
caaggagaggccaagg

SEQ ID NO: 8285 - RNA, 18 nt, Homo sapiens
cacccuguaauuggggaa

SEQ ID NO: 8286 - RNA, 21 nt, Homo sapiens
cccagaugaaggcgucuuucc

SEQ ID NO: 8287 - RNA, 20 nt, Homo sapiens
cucccgccuuggccucccaa

SEQ ID NO: 8288 - RNA, 20 nt, Homo sapiens
cuucaaacuucucucccagg

SEQ ID NO: 8289 - RNA, 20 nt, Homo sapiens
gcaggcaguacaagagugau

SEQ ID NO: 8290 - RNA, 22 nt, Homo sapiens
ggagaccuuaagggaguugugc

SEQ ID NO: 8291 - RNA, 17 nt, Homo sapiens
ggagaguugggccacau

SEQ ID NO: 8292 - RNA, 17 nt, Homo sapiens
gggggcgcggggggcgc

SEQ ID NO: 8293 - RNA, 19 nt, Homo sapiens
uguccccccacuccguccu

SEQ ID NO: 8294 - RNA, 16 nt, Homo sapiens
gucauggucauagcag

SEQ ID NO: 8295 - RNA, 20 nt, Homo sapiens
uuacuuauaucuugaauaua

SEQ ID NO: 8296 - RNA, 22 nt, Homo sapiens
acguggagccaggcagugcugg

SEQ ID NO: 8297 - RNA, 15 nt, Homo sapiens
cugguggcugcaggg

SEQ ID NO: 8298 - RNA, 24 nt, Homo sapiens
cugguggcugcagggugcagucac

SEQ ID NO: 8299 - RNA, 18 nt, Homo sapiens
ucuguccugauccaaggc

SEQ ID NO: 8300 - RNA, 19 nt, Homo sapiens
ggaaagguuggcgaucagg

SEQ ID NO: 8301 - RNA, 17 nt, Homo sapiens
ugggaaauguccuuagc

SEQ ID NO: 8302 - RNA, 19 nt, Homo sapiens
aaagacagaggaaaaacuc

SEQ ID NO: 8303 - RNA, 21 nt, Homo sapiens
aggaugcucauauacuccugc

SEQ ID NO: 8304 - RNA, 24 nt, Homo sapiens
auaagcaaguuucuauuuuccuau

SEQ ID NO: 8305 - RNA, 17 nt, Homo sapiens
auaccugaacugccuuu

SEQ ID NO: 8306 - RNA, 19 nt, Homo sapiens
uguaacuguguguggcaaa

SEQ ID NO: 8307 - RNA, 23 nt, Homo sapiens
agcugggggggacgggagggagc

SEQ ID NO: 8308 - RNA, 19 nt, Homo sapiens
aggggggcagagauagugg

SEQ ID NO: 8309 - RNA, 21 nt, Homo sapiens
agggggggagggagucggagg

SEQ ID NO: 8310 - RNA, 16 nt, Homo sapiens
gcgagggggagagagg

SEQ ID NO: 8311 - RNA, 17 nt, Homo sapiens
gggcacggggacugggu

SEQ ID NO: 8312 - RNA, 22 nt, Homo sapiens
gggcagagcggggggauggcuu

SEQ ID NO: 8313 - RNA, 16 nt, Homo sapiens
ggggaggcggggcacg

SEQ ID NO: 8314 - RNA, 19 nt, Homo sapiens
gggggggacgggagggagc

SEQ ID NO: 8315 - RNA, 24 nt, Homo sapiens
gguucggcgaaggcgagagggcgg

SEQ ID NO: 8316 - RNA, 17 nt, Homo sapiens
cacgcgccaugguaccc

SEQ ID NO: 8317 - RNA, 20 nt, Homo sapiens
cuagaauugugugugugugu

SEQ ID NO: 8318 - RNA, 18 nt, Homo sapiens
gugugugugcgugugugu

SEQ ID NO: 8319 - RNA, 16 nt, Homo sapiens
ucacuaagcuguaacu

SEQ ID NO: 8320 - RNA, 19 nt, Homo sapiens
ugugugugugcgugugugu

SEQ ID NO: 8321 - RNA, 22 nt, Homo sapiens
uuuuauuuugaucuuugcucgg

SEQ ID NO: 8322 - RNA, 17 nt, Homo sapiens
acccaaaaguacacauu

SEQ ID NO: 8323 - RNA, 22 nt, Homo sapiens
aguaagcaaauggggagcccca

SEQ ID NO: 8324 - RNA, 24 nt, Homo sapiens
caccacuagccacuggugagagcc

SEQ ID NO: 8325 - RNA, 25 nt, Homo sapiens
ccagaggggcuguugacacaacgug

SEQ ID NO: 8326 - RNA, 21 nt, Homo sapiens
cccccucucccagcaaagcuc

SEQ ID NO: 8327 - RNA, 23 nt, Homo sapiens
cuugacuggcuuggcugugugau

SEQ ID NO: 8328 - RNA, 17 nt, Homo sapiens
gagguucugcacagggu

SEQ ID NO: 8329 - RNA, 21 nt, Homo sapiens
ugagagaagggcuaggcuuga

SEQ ID NO: 8330 - RNA, 20 nt, Homo sapiens
uuuguccucugguaacagau

SEQ ID NO: 8331 - RNA, 22 nt, Homo sapiens
aaaaacaaaaccaagaaacaaa

SEQ ID NO: 8332 - RNA, 18 nt, Homo sapiens
aaaaauccaaaaaauuag

SEQ ID NO: 8333 - RNA, 17 nt, Homo sapiens
agaggauuauguguugg

SEQ ID NO: 8334 - RNA, 25 nt, Homo sapiens
aucagauuuaucuuuugaaaauauu

SEQ ID NO: 8335 - RNA, 21 nt, Homo sapiens
caacaauuucucauaaauucu

SEQ ID NO: 8336 - RNA, 15 nt, Homo sapiens
cagagcaaaggaucc

SEQ ID NO: 8337 - RNA, 21 nt, Homo sapiens
ccgggcauaguggugggugcc

SEQ ID NO: 8338 - RNA, 16 nt, Homo sapiens
cuuugcaagggagggg

SEQ ID NO: 8339 - RNA, 18 nt, Homo sapiens
gaacucuuuugaguugaa

SEQ ID NO: 8340 - RNA, 19 nt, Homo sapiens
gcagagcaaaggauccugc

SEQ ID NO: 8341 - RNA, 17 nt, Homo sapiens
gcuccuuucuaugaaau

SEQ ID NO: 8342 - RNA, 22 nt, Homo sapiens
gcuugaaagggauuuuagagcu

SEQ ID NO: 8343 - RNA, 23 nt, Homo sapiens
gcuugagguuucagagucccucc

SEQ ID NO: 8344 - RNA, 20 nt, Homo sapiens
guaugucuggaaaacaggca

SEQ ID NO: 8345 - RNA, 18 nt, Homo sapiens
guauuuuuucucuuuguu

SEQ ID NO: 8346 - RNA, 20 nt, Homo sapiens
gugaaugugugugugugugu

SEQ ID NO: 8347 - RNA, 17 nt, Homo sapiens
uaaaugaugccauugca

SEQ ID NO: 8348 - RNA, 20 nt, Homo sapiens
uaaauucuuucuuuaucagu

SEQ ID NO: 8349 - RNA, 22 nt, Homo sapiens
uaagauauauauauauauauau

SEQ ID NO: 8350 - RNA, 19 nt, Homo sapiens
uauuagauauuauuuuaau

SEQ ID NO: 8351 - RNA, 21 nt, Homo sapiens
ucagugagguuccuuuaauuc

SEQ ID NO: 8352 - RNA, 19 nt, Homo sapiens
ucaguggacuuuugugucu

SEQ ID NO: 8353 - RNA, 19 nt, Homo sapiens
ucugacagucuucucucuu

SEQ ID NO: 8354 - RNA, 26 nt, Homo sapiens
ugaaagguuuugauauuuugaauaga

SEQ ID NO: 8355 - RNA, 19 nt, Homo sapiens
ugacaugguauuuggggcc

SEQ ID NO: 8356 - RNA, 18 nt, Homo sapiens
ugacauuuugguugcucc

SEQ ID NO: 8357 - RNA, 20 nt, Homo sapiens
ugcugaauaucuguuuuaga

SEQ ID NO: 8358 - RNA, 24 nt, Homo sapiens
uggugugcuucuugacgacuugcu

SEQ ID NO: 8359 - RNA, 17 nt, Homo sapiens
ugucuuaucugugagag

SEQ ID NO: 8360 - RNA, 18 nt, Homo sapiens
ugugugugugugugugug

SEQ ID NO: 8361 - RNA, 19 nt, Homo sapiens
ugugugugugugugugugu

SEQ ID NO: 8362 - RNA, 18 nt, Homo sapiens
uuccagauaggaauuggu

SEQ ID NO: 8363 - RNA, 17 nt, Homo sapiens
uugggaggcugaggcgg

SEQ ID NO: 8364 - RNA, 18 nt, Homo sapiens
uuugguacaaaugccaca

SEQ ID NO: 8365 - RNA, 18 nt, Homo sapiens
uuuuacuuuaaaaaagcu

SEQ ID NO: 8366 - RNA, 18 nt, Homo sapiens
ccaaagaaguugaaauca

SEQ ID NO: 8367 - RNA, 17 nt, Homo sapiens
aacugaggacaagugac

SEQ ID NO: 8368 - RNA, 15 nt, Homo sapiens
aagcaguggcaaucu

SEQ ID NO: 8369 - RNA, 14 nt, Homo sapiens
agcuggaaaugggu

SEQ ID NO: 8370 - RNA, 20 nt, Homo sapiens
augagcccguccgcucggcc

SEQ ID NO: 8371 - RNA, 15 nt, Homo sapiens
caggaggcagagcga

SEQ ID NO: 8372 - RNA, 21 nt, Homo sapiens
ccgcugcucgcugcccggccg

SEQ ID NO: 8373 - RNA, 22 nt, Homo sapiens
cguuucuuggcauugagggucu

SEQ ID NO: 8374 - RNA, 21 nt, Homo sapiens
cucugcucacugguaucaaaa

SEQ ID NO: 8375 - RNA, 20 nt, Homo sapiens
gcagagcaaggugagucaua

SEQ ID NO: 8376 - RNA, 19 nt, Homo sapiens
uacuugauauuguuuccag

SEQ ID NO: 8377 - RNA, 16 nt, Homo sapiens
uagcagacacccaaac

SEQ ID NO: 8378 - RNA, 22 nt, Homo sapiens
ucaggauuagaaggggugagug

SEQ ID NO: 8379 - RNA, 22 nt, Homo sapiens
ucggccgcugcucgcugcccgg

SEQ ID NO: 8380 - RNA, 19 nt, Homo sapiens
ugccuuuucacuuuaacag

SEQ ID NO: 8381 - RNA, 19 nt, Homo sapiens
ugggagacagccccuuuaa

SEQ ID NO: 8382 - RNA, 19 nt, Homo sapiens
uggguguggggagggagac

SEQ ID NO: 8383 - RNA, 18 nt, Homo sapiens
uucuguauagcaagacac

SEQ ID NO: 8384 - RNA, 18 nt, Homo sapiens
uuguucuuuauaucugug

SEQ ID NO: 8385 - RNA, 18 nt, Homo sapiens
agauuuacuuagggcuuc

SEQ ID NO: 8386 - RNA, 22 nt, Homo sapiens
augaucguugguuccacuagac

SEQ ID NO: 8387 - RNA, 16 nt, Homo sapiens
cagaugagguguagaa

SEQ ID NO: 8388 - RNA, 21 nt, Homo sapiens
gaaccccgcuuuucauugaca

SEQ ID NO: 8389 - RNA, 25 nt, Homo sapiens
ugaaaacuugcucagugugccuucc

SEQ ID NO: 8390 - RNA, 21 nt, Homo sapiens
ugaaaugcagcaaaugccagc

SEQ ID NO: 8391 - RNA, 20 nt, Homo sapiens
uuguuuuaauuauuuuuaua

SEQ ID NO: 8392 - RNA, 18 nt, Homo sapiens
aaccucauccauuuauua

SEQ ID NO: 8393 - RNA, 22 nt, Homo sapiens
acauguuuacaugauuuucucg

SEQ ID NO: 8394 - RNA, 14 nt, Homo sapiens
acccuuugcuuuuc

SEQ ID NO: 8395 - RNA, 19 nt, Homo sapiens
aguuauugguugagcugga

SEQ ID NO: 8396 - RNA, 16 nt, Homo sapiens
cacccugcucgaccgc

SEQ ID NO: 8397 - RNA, 18 nt, Homo sapiens
caccgucaggaccguccc

SEQ ID NO: 8398 - RNA, 19 nt, Homo sapiens
caccuguuuucuuccucca

SEQ ID NO: 8399 - RNA, 21 nt, Homo sapiens
cagauuccagcccuccagguu

SEQ ID NO: 8400 - RNA, 18 nt, Homo sapiens
cagcacugugauccucug

SEQ ID NO: 8401 - RNA, 19 nt, Homo sapiens
ccugccggguucuggagcc

SEQ ID NO: 8402 - RNA, 21 nt, Homo sapiens
cguccccaccccuccucggag

SEQ ID NO: 8403 - RNA, 23 nt, Homo sapiens
gauguccccaccgucaggaccgu

SEQ ID NO: 8404 - RNA, 17 nt, Homo sapiens
gggagccauaaaauccu

SEQ ID NO: 8405 - RNA, 21 nt, Homo sapiens
gggcagccugauguccccacc

SEQ ID NO: 8406 - RNA, 15 nt, Homo sapiens
guggugggaaugaca

SEQ ID NO: 8407 - RNA, 23 nt, Homo sapiens
uauacagcaagugcucaauaugu

SEQ ID NO: 8408 - RNA, 16 nt, Homo sapiens
ugggcagggcaggaau

SEQ ID NO: 8409 - RNA, 22 nt, Homo sapiens
uggggggucucagcacugugau

SEQ ID NO: 8410 - RNA, 21 nt, Homo sapiens
cacagcaagaaucugauccuu

SEQ ID NO: 8411 - RNA, 17 nt, Homo sapiens
ccagagagggaaagugu

SEQ ID NO: 8412 - RNA, 17 nt, Homo sapiens
ccagccucucuggaucu

SEQ ID NO: 8413 - RNA, 19 nt, Homo sapiens
cccauuccaacauuuuucc

SEQ ID NO: 8414 - RNA, 19 nt, Homo sapiens
cgggggacccacucaccuc

SEQ ID NO: 8415 - RNA, 19 nt, Homo sapiens
guggaagcaaucaucauag

SEQ ID NO: 8416 - RNA, 17 nt, Homo sapiens
auaagacuugaggcugg

SEQ ID NO: 8417 - RNA, 18 nt, Homo sapiens
caucuuucacccacuugc

SEQ ID NO: 8418 - RNA, 21 nt, Homo sapiens
gugcuacuuguuaggagguca

SEQ ID NO: 8419 - RNA, 20 nt, Homo sapiens
acaccguuuauuccacgggg

SEQ ID NO: 8420 - RNA, 24 nt, Homo sapiens
accagucucugccucccccauccc

SEQ ID NO: 8421 - RNA, 14 nt, Homo sapiens
ccucccccauccca

SEQ ID NO: 8422 - RNA, 17 nt, Homo sapiens
gucacugcucugucccc

SEQ ID NO: 8423 - RNA, 23 nt, Homo sapiens
guccaggaaagggguugggccau

SEQ ID NO: 8424 - RNA, 20 nt, Homo sapiens
uagcacccccagaaggcugg

SEQ ID NO: 8425 - RNA, 18 nt, Homo sapiens
cucccuuuuccuuuacac

SEQ ID NO: 8426 - RNA, 22 nt, Homo sapiens
ucgaagacuuuuucauuugaga

SEQ ID NO: 8427 - RNA, 16 nt, Homo sapiens
aacagacagguguggc

SEQ ID NO: 8428 - RNA, 16 nt, Homo sapiens
agccgccgcagauccc

SEQ ID NO: 8429 - RNA, 23 nt, Homo sapiens
aggugugagccaccgugcccggg

SEQ ID NO: 8430 - RNA, 20 nt, Homo sapiens
cagccgccaucgccccgucc

SEQ ID NO: 8431 - RNA, 21 nt, Homo sapiens
cgaacagacagguguggcaca

SEQ ID NO: 8432 - RNA, 16 nt, Homo sapiens
uacuugacacaguuca

SEQ ID NO: 8433 - RNA, 15 nt, Homo sapiens
ugcaguagccagcag

SEQ ID NO: 8434 - RNA, 19 nt, Homo sapiens
ugcaguggcgugaucucgg

SEQ ID NO: 8435 - RNA, 17 nt, Homo sapiens
uuuaggaccuaugaucu

SEQ ID NO: 8436 - RNA, 17 nt, Homo sapiens
ccuccagccacccugcg

SEQ ID NO: 8437 - RNA, 21 nt, Homo sapiens
gcuucugggaggggaggccac

SEQ ID NO: 8438 - RNA, 18 nt, Homo sapiens
cacuggaaacgaggguga

SEQ ID NO: 8439 - RNA, 19 nt, Homo sapiens
gucccauaauaauuuaaaa

SEQ ID NO: 8440 - RNA, 19 nt, Homo sapiens
aggugccuucuuaggaggu

SEQ ID NO: 8441 - RNA, 17 nt, Homo sapiens
cauacagugaacaaacc

SEQ ID NO: 8442 - RNA, 19 nt, Homo sapiens
gugccuguccagagccaga

SEQ ID NO: 8443 - RNA, 15 nt, Homo sapiens
ucuccagcagacacg

SEQ ID NO: 8444 - RNA, 22 nt, Homo sapiens
uggaaagcauuuggggagggac

SEQ ID NO: 8445 - RNA, 19 nt, Homo sapiens
ugugacguucaacgggaau

SEQ ID NO: 8446 - RNA, 16 nt, Homo sapiens
aggaggcgccggccgg

SEQ ID NO: 8447 - RNA, 17 nt, Homo sapiens
cagcggcucccgcggcg

SEQ ID NO: 8448 - RNA, 19 nt, Homo sapiens
cagcggcugcugcguguug

SEQ ID NO: 8449 - RNA, 20 nt, Homo sapiens
cagggaccuggggacccaga

SEQ ID NO: 8450 - RNA, 24 nt, Homo sapiens
cggcggcggcagcggcugcugcgu

SEQ ID NO: 8451 - RNA, 19 nt, Homo sapiens
gcccagcugggucccuccc

SEQ ID NO: 8452 - RNA, 16 nt, Homo sapiens
gcggcggcggcagcgg

SEQ ID NO: 8453 - RNA, 21 nt, Homo sapiens
ggagugaggaaaagccgggca

SEQ ID NO: 8454 - RNA, 18 nt, Homo sapiens
ggcggcggcggccgcucc

SEQ ID NO: 8455 - RNA, 25 nt, Homo sapiens
ggcggcggcgguggcggcggcggcc

SEQ ID NO: 8456 - RNA, 16 nt, Homo sapiens
ggcugcugcguguugg

SEQ ID NO: 8457 - RNA, 19 nt, Homo sapiens
ggggcccugguggcugcgc

SEQ ID NO: 8458 - RNA, 19 nt, Homo sapiens
guccagaauaaggaaccca

SEQ ID NO: 8459 - RNA, 20 nt, Homo sapiens
guggcugcgcagggaccugg

SEQ ID NO: 8460 - RNA, 20 nt, Homo sapiens
uccguggagcgggacgcagg

SEQ ID NO: 8461 - RNA, 20 nt, Homo sapiens
uccguuaacugugagcuuca

SEQ ID NO: 8462 - RNA, 21 nt, Homo sapiens
ucuggaguucgggccgggagu

SEQ ID NO: 8463 - RNA, 18 nt, Homo sapiens
uggagauggguuccugca

SEQ ID NO: 8464 - RNA, 18 nt, Homo sapiens
uggcugcgcagggaccug

SEQ ID NO: 8465 - RNA, 21 nt, Homo sapiens
caaguccccaaaguauaugga

SEQ ID NO: 8466 - RNA, 15 nt, Homo sapiens
agucuuaguucauuu

SEQ ID NO: 8467 - RNA, 18 nt, Homo sapiens
auugggcugggggaagga

SEQ ID NO: 8468 - RNA, 17 nt, Homo sapiens
cagcggcugcugcagca

SEQ ID NO: 8469 - RNA, 18 nt, Homo sapiens
ggggaaggagaugggagg

SEQ ID NO: 8470 - RNA, 19 nt, Homo sapiens
ugaggaagggagggagagg

SEQ ID NO: 8471 - RNA, 19 nt, Homo sapiens
ugccugaggaagggaggga

SEQ ID NO: 8472 - RNA, 20 nt, Homo sapiens
ugcucaaccuccagcccauc

SEQ ID NO: 8473 - RNA, 17 nt, Homo sapiens
caggcacuaagaugagu

SEQ ID NO: 8474 - RNA, 19 nt, Homo sapiens
ggcagcuggugagucaggc

SEQ ID NO: 8475 - RNA, 21 nt, Homo sapiens
ucagccucuuuagcuuauuau

SEQ ID NO: 8476 - RNA, 21 nt, Homo sapiens
caauaccaugucucuugauau

SEQ ID NO: 8477 - RNA, 18 nt, Homo sapiens
uggaaacuguugagucaa

SEQ ID NO: 8478 - RNA, 17 nt, Homo sapiens
agccaccaugccuggcc

SEQ ID NO: 8479 - RNA, 26 nt, Homo sapiens
aggccggucucaaacucuuggacuuc

SEQ ID NO: 8480 - RNA, 22 nt, Homo sapiens
gccugcuguuucaugucaggac

SEQ ID NO: 8481 - RNA, 19 nt, Homo sapiens
ugccaugucucgcaggccg

SEQ ID NO: 8482 - RNA, 23 nt, Homo sapiens
ugggaucacagcaugcagugguu

SEQ ID NO: 8483 - RNA, 17 nt, Homo sapiens
aaccuugauuuuucaau

SEQ ID NO: 8484 - RNA, 23 nt, Homo sapiens
aagagggucuuuuccaguuucuc

SEQ ID NO: 8485 - RNA, 14 nt, Homo sapiens
aaugcuguauuaca

SEQ ID NO: 8486 - RNA, 19 nt, Homo sapiens
auauuauaauaaaugagau

SEQ ID NO: 8487 - RNA, 19 nt, Homo sapiens
auuacugucacaacugucc

SEQ ID NO: 8488 - RNA, 18 nt, Homo sapiens
cggggggaggggacgggg

SEQ ID NO: 8489 - RNA, 18 nt, Homo sapiens
guauguauuguuacugaa

SEQ ID NO: 8490 - RNA, 18 nt, Homo sapiens
uacuauaguacguggugu

SEQ ID NO: 8491 - RNA, 19 nt, Homo sapiens
ucaauauuauaauaaauga

SEQ ID NO: 8492 - RNA, 19 nt, Homo sapiens
ucggggggaggggacgggg

SEQ ID NO: 8493 - RNA, 20 nt, Homo sapiens
uuuuauuuucuuaacacaca

SEQ ID NO: 8494 - RNA, 17 nt, Homo sapiens
cauauagcauuuacaua

SEQ ID NO: 8495 - RNA, 18 nt, Homo sapiens
cggggggaggggacgggg

SEQ ID NO: 8496 - RNA, 24 nt, Homo sapiens
gaaaguucugcucuguccccacuu

SEQ ID NO: 8497 - RNA, 30 nt, Homo sapiens
cacguggcagauggggcuaaggucuuccga

SEQ ID NO: 8498 - RNA, 22 nt, Homo sapiens
ccugguucuagaagcccagugu

SEQ ID NO: 8499 - RNA, 21 nt, Homo sapiens
gauuauucccugagcacaugu

SEQ ID NO: 8500 - RNA, 17 nt, Homo sapiens
gauuuaggaguucccac

SEQ ID NO: 8501 - RNA, 19 nt, Homo sapiens
ucacacaucugugaagcca

SEQ ID NO: 8502 - RNA, 18 nt, Homo sapiens
ugaacucuaugccuguau

SEQ ID NO: 8503 - RNA, 19 nt, Homo sapiens
ugagugaagaaauuaugaa

SEQ ID NO: 8504 - RNA, 16 nt, Homo sapiens
ugauuuccaaagcaga

SEQ ID NO: 8505 - RNA, 17 nt, Homo sapiens
uucaccuccagcuggcc

SEQ ID NO: 8506 - RNA, 19 nt, Homo sapiens
uuguuguuauauacagauu

SEQ ID NO: 8507 - RNA, 22 nt, Homo sapiens
aaguggugggguugagggaggc

SEQ ID NO: 8508 - RNA, 19 nt, Homo sapiens
aggaacuguuggucaggua

SEQ ID NO: 8509 - RNA, 18 nt, Homo sapiens
aguucuucugcagcccau

SEQ ID NO: 8510 - RNA, 19 nt, Homo sapiens
caacugaaaaagagaggug

SEQ ID NO: 8511 - RNA, 22 nt, Homo sapiens
gaaaaagagagguggcugaaga

SEQ ID NO: 8512 - RNA, 18 nt, Homo sapiens
uaaaagaagugguggggu

SEQ ID NO: 8513 - RNA, 19 nt, Homo sapiens
ugcuagguguggaagucgg

SEQ ID NO: 8514 - RNA, 19 nt, Homo sapiens
aaacagccugcagcuuugu

SEQ ID NO: 8515 - RNA, 19 nt, Homo sapiens
aagcccccgcggaaggagg

SEQ ID NO: 8516 - RNA, 19 nt, Homo sapiens
aagguugucauuaaauauc

SEQ ID NO: 8517 - RNA, 27 nt, Homo sapiens
acuguuaauuguugugugugugugugu

SEQ ID NO: 8518 - RNA, 19 nt, Homo sapiens
cauuaaaaugauuuuggca

SEQ ID NO: 8519 - RNA, 20 nt, Homo sapiens
ccuuuccauccuccaccagu

SEQ ID NO: 8520 - RNA, 18 nt, Homo sapiens
gacccugaaggacagcca

SEQ ID NO: 8521 - RNA, 17 nt, Homo sapiens
gagggcaggagggcucu

SEQ ID NO: 8522 - RNA, 18 nt, Homo sapiens
gcugcaaaagacaccaca

SEQ ID NO: 8523 - RNA, 18 nt, Homo sapiens
ggcacuuguggcggccug

SEQ ID NO: 8524 - RNA, 17 nt, Homo sapiens
uccacguucuucauugu

SEQ ID NO: 8525 - RNA, 16 nt, Homo sapiens
uccucccucccacccc

SEQ ID NO: 8526 - RNA, 22 nt, Homo sapiens
ucucuugcggaguauuugugca

SEQ ID NO: 8527 - RNA, 18 nt, Homo sapiens
uggcuucauaccacaggu

SEQ ID NO: 8528 - RNA, 14 nt, Homo sapiens
ugugugugucuguc

SEQ ID NO: 8529 - RNA, 19 nt, Homo sapiens
ugugugugugugugucugu

SEQ ID NO: 8530 - RNA, 15 nt, Homo sapiens
cccggcccacccacg

SEQ ID NO: 8531 - RNA, 19 nt, Homo sapiens
uuuuguuuuugagacggag

SEQ ID NO: 8532 - RNA, 19 nt, Homo sapiens
accagaagguggguggucu

SEQ ID NO: 8533 - RNA, 19 nt, Homo sapiens
aggaggaggcagagaggga

SEQ ID NO: 8534 - RNA, 18 nt, Homo sapiens
cacugguccccugugccu

SEQ ID NO: 8535 - RNA, 17 nt, Homo sapiens
cccccggccggggcccc

SEQ ID NO: 8536 - RNA, 20 nt, Homo sapiens
cccccggccggggcccucgc

SEQ ID NO: 8537 - RNA, 17 nt, Homo sapiens
ccuccucccccuccucc

SEQ ID NO: 8538 - RNA, 22 nt, Homo sapiens
cgggggcggcggcggcucgucu

SEQ ID NO: 8539 - RNA, 16 nt, Homo sapiens
cucccuuaaccucucu

SEQ ID NO: 8540 - RNA, 21 nt, Homo sapiens
gagagcgcgaacagggcuggu

SEQ ID NO: 8541 - RNA, 20 nt, Homo sapiens
gcaguggcgggggcggcggc

SEQ ID NO: 8542 - RNA, 19 nt, Homo sapiens
ggaaugggggcgccugagg

SEQ ID NO: 8543 - RNA, 17 nt, Homo sapiens
ggcggggcggggugggg

SEQ ID NO: 8544 - RNA, 21 nt, Homo sapiens
ggcggggcgggguggggccgg

SEQ ID NO: 8545 - RNA, 18 nt, Homo sapiens
ggcgggggcggcggcggc

SEQ ID NO: 8546 - RNA, 19 nt, Homo sapiens
ggggcggggcggggugggg

SEQ ID NO: 8547 - RNA, 18 nt, Homo sapiens
ggggcgggguggggccgg

SEQ ID NO: 8548 - RNA, 20 nt, Homo sapiens
ggggcgggguggggccgggc

SEQ ID NO: 8549 - RNA, 19 nt, Homo sapiens
gggggcggggcgggguggg

SEQ ID NO: 8550 - RNA, 18 nt, Homo sapiens
ggguccccaaguccugcc

SEQ ID NO: 8551 - RNA, 17 nt, Homo sapiens
gucuugaauaggggauc

SEQ ID NO: 8552 - RNA, 21 nt, Homo sapiens
uauggugacugaaugaguuca

SEQ ID NO: 8553 - RNA, 20 nt, Homo sapiens
uccuccccgcaguggcgggg

SEQ ID NO: 8554 - RNA, 24 nt, Homo sapiens
ucggagagagauccgucuccugga

SEQ ID NO: 8555 - RNA, 19 nt, Homo sapiens
ugucugguuugggggaacc

SEQ ID NO: 8556 - RNA, 17 nt, Homo sapiens
acgucgggguggggugg

SEQ ID NO: 8557 - RNA, 20 nt, Homo sapiens
agaggaggggccccuguggc

SEQ ID NO: 8558 - RNA, 20 nt, Homo sapiens
agaggggacaggagggggag

SEQ ID NO: 8559 - RNA, 22 nt, Homo sapiens
aggcggccgauguuccccggcg

SEQ ID NO: 8560 - RNA, 18 nt, Homo sapiens
aggcggcgucugaggcgg

SEQ ID NO: 8561 - RNA, 20 nt, Homo sapiens
ccugaguggggcccuucccc

SEQ ID NO: 8562 - RNA, 15 nt, Homo sapiens
gauguuccccggcgc

SEQ ID NO: 8563 - RNA, 17 nt, Homo sapiens
gcgggaggggaggacgg

SEQ ID NO: 8564 - RNA, 20 nt, Homo sapiens
ggagcuggaggcggccgaug

SEQ ID NO: 8565 - RNA, 22 nt, Homo sapiens
ggagggggagguugggggaaaa

SEQ ID NO: 8566 - RNA, 22 nt, Homo sapiens
ugaggaggaagggagcacuagg

SEQ ID NO: 8567 - RNA, 17 nt, Homo sapiens
ugggguggggaugggca

SEQ ID NO: 8568 - RNA, 18 nt, Homo sapiens
uguaggagcuccagcggu

SEQ ID NO: 8569 - RNA, 16 nt, Homo sapiens
uggaagccccaggggc

SEQ ID NO: 8570 - RNA, 23 nt, Homo sapiens
uguccuuguguuaguacuucaga

SEQ ID NO: 8571 - RNA, 18 nt, Homo sapiens
caggagacuggugagucc

SEQ ID NO: 8572 - RNA, 24 nt, Homo sapiens
caaaacguggagagaaaaguauaa

SEQ ID NO: 8573 - RNA, 18 nt, Homo sapiens
ccugaugcucucucucug

SEQ ID NO: 8574 - RNA, 17 nt, Homo sapiens
ccugccggccucuuacc

SEQ ID NO: 8575 - RNA, 20 nt, Homo sapiens
uaccaggucuuauucauucu

SEQ ID NO: 8576 - RNA, 17 nt, Homo sapiens
agcgaggggggcggggc

SEQ ID NO: 8577 - RNA, 18 nt, Homo sapiens
aggggggcggggcguggg

SEQ ID NO: 8578 - RNA, 23 nt, Homo sapiens
auguaguucacuauacuagaaau

SEQ ID NO: 8579 - RNA, 19 nt, Homo sapiens
gcugugaagcucuacgagg

SEQ ID NO: 8580 - RNA, 17 nt, Homo sapiens
ggcggggcguggggggg

SEQ ID NO: 8581 - RNA, 21 nt, Homo sapiens
ggggcggggcguggggggggc

SEQ ID NO: 8582 - RNA, 18 nt, Homo sapiens
ggggggcggggcgugggg

SEQ ID NO: 8583 - RNA, 18 nt, Homo sapiens
gucuuagguaacacgcag

SEQ ID NO: 8584 - RNA, 20 nt, Homo sapiens
uguuuauucugugauacguc

SEQ ID NO: 8585 - RNA, 18 nt, Homo sapiens
caaacauagacuuuuucu

SEQ ID NO: 8586 - RNA, 14 nt, Homo sapiens
agagcuuccaaagc

SEQ ID NO: 8587 - RNA, 21 nt, Homo sapiens
agcagcagagauggggucacc

SEQ ID NO: 8588 - RNA, 17 nt, Homo sapiens
caacacugaguccuuac

SEQ ID NO: 8589 - RNA, 21 nt, Homo sapiens
cagcagagauggggucaccua

SEQ ID NO: 8590 - RNA, 21 nt, Homo sapiens
cccaacacaggggcuccaggc

SEQ ID NO: 8591 - RNA, 22 nt, Homo sapiens
ccgccgcagcgcucccagcccg

SEQ ID NO: 8592 - RNA, 15 nt, Homo sapiens
gccaccuccccuccc

SEQ ID NO: 8593 - RNA, 19 nt, Homo sapiens
gggcaaggagagcaggcac

SEQ ID NO: 8594 - RNA, 20 nt, Homo sapiens
gggguccagaguccucagag

SEQ ID NO: 8595 - RNA, 16 nt, Homo sapiens
uauggccuggggucca

SEQ ID NO: 8596 - RNA, 15 nt, Homo sapiens
uggacaacgcgcggc

SEQ ID NO: 8597 - RNA, 15 nt, Homo sapiens
ugggacagcgggcau

SEQ ID NO: 8598 - RNA, 18 nt, Homo sapiens
aggcaggcucagcacgga

SEQ ID NO: 8599 - RNA, 20 nt, Homo sapiens
caccuggugcaaggccucac

SEQ ID NO: 8600 - RNA, 23 nt, Homo sapiens
cucuguggagacaagguggugcu

SEQ ID NO: 8601 - RNA, 16 nt, Homo sapiens
cugggccucaugcugc

SEQ ID NO: 8602 - RNA, 20 nt, Homo sapiens
gagagugguguguggguggc

SEQ ID NO: 8603 - RNA, 16 nt, Homo sapiens
gccccaaccucucccc

SEQ ID NO: 8604 - RNA, 20 nt, Homo sapiens
gggccugcccagcaaagaug

SEQ ID NO: 8605 - RNA, 21 nt, Homo sapiens
uccuggcacucucucucuucu

SEQ ID NO: 8606 - RNA, 22 nt, Homo sapiens
ucugggcccagcagcuccugaa

SEQ ID NO: 8607 - RNA, 19 nt, Homo sapiens
ugcuccagccuggggcucc

SEQ ID NO: 8608 - RNA, 21 nt, Homo sapiens
uggcucguuuuuauuuuaucu

SEQ ID NO: 8609 - RNA, 15 nt, Homo sapiens
ugguguguggguggc

SEQ ID NO: 8610 - RNA, 21 nt, Homo sapiens
aacuuuuauuuuuccauugcc

SEQ ID NO: 8611 - RNA, 22 nt, Homo sapiens
caccauaaacaaggcagacuuu

SEQ ID NO: 8612 - RNA, 19 nt, Homo sapiens
ccgguccaggcgccgugcc

SEQ ID NO: 8613 - RNA, 20 nt, Homo sapiens
gcccgcgcgcccgcccgucu

SEQ ID NO: 8614 - RNA, 23 nt, Homo sapiens
gggcuggggcgcugguggccggg

SEQ ID NO: 8615 - RNA, 17 nt, Homo sapiens
acuagagccuuuuguca

SEQ ID NO: 8616 - RNA, 17 nt, Homo sapiens
gcccaguuccucaggga

SEQ ID NO: 8617 - RNA, 19 nt, Homo sapiens
gcccgcagccucucccuuc

SEQ ID NO: 8618 - RNA, 22 nt, Homo sapiens
ugcccaguuccucagggauguc

SEQ ID NO: 8619 - RNA, 16 nt, Homo sapiens
ccccccacgauguuuu

SEQ ID NO: 8620 - RNA, 22 nt, Homo sapiens
gcccagcccgcagcacgucucc

SEQ ID NO: 8621 - RNA, 19 nt, Homo sapiens
ucccccguggucuucuucc

SEQ ID NO: 8622 - RNA, 21 nt, Homo sapiens
aaaauggacagaaaucuuuuc

SEQ ID NO: 8623 - RNA, 16 nt, Homo sapiens
agagguuuuaaaguga

SEQ ID NO: 8624 - RNA, 17 nt, Homo sapiens
aggcacaggaaaaaaau

SEQ ID NO: 8625 - RNA, 19 nt, Homo sapiens
agggacagucaccaguugc

SEQ ID NO: 8626 - RNA, 22 nt, Homo sapiens
auauauauacauaucaauaucu

SEQ ID NO: 8627 - RNA, 18 nt, Homo sapiens
cagcucuccaggagccgc

SEQ ID NO: 8628 - RNA, 18 nt, Homo sapiens
cagcugccuuccggcccg

SEQ ID NO: 8629 - RNA, 16 nt, Homo sapiens
cccccauccauuaacc

SEQ ID NO: 8630 - RNA, 18 nt, Homo sapiens
cccgggucccgcgaacug

SEQ ID NO: 8631 - RNA, 19 nt, Homo sapiens
cccguccucaggcgggccg

SEQ ID NO: 8632 - RNA, 18 nt, Homo sapiens
ccggcccggggcuggggc

SEQ ID NO: 8633 - RNA, 15 nt, Homo sapiens
cggcggcggcggcgg

SEQ ID NO: 8634 - RNA, 19 nt, Homo sapiens
cuggagggagagagggaac

SEQ ID NO: 8635 - RNA, 20 nt, Homo sapiens
cuggcggaacaugaacgcgg

SEQ ID NO: 8636 - RNA, 17 nt, Homo sapiens
gagagaguugggaaugg

SEQ ID NO: 8637 - RNA, 18 nt, Homo sapiens
gagcucggggguccuaug

SEQ ID NO: 8638 - RNA, 21 nt, Homo sapiens
gcgcacugugcggagcucggg

SEQ ID NO: 8639 - RNA, 19 nt, Homo sapiens
ggguccuccucuuccuccg

SEQ ID NO: 8640 - RNA, 24 nt, Homo sapiens
gugaaauaagagugcaggccuuaa

SEQ ID NO: 8641 - RNA, 18 nt, Homo sapiens
uauauauacauaucaaua

SEQ ID NO: 8642 - RNA, 21 nt, Homo sapiens
ugaccacuccauucauauuua

SEQ ID NO: 8643 - RNA, 21 nt, Homo sapiens
uggcccuggagggagagaggg

SEQ ID NO: 8644 - RNA, 19 nt, Homo sapiens
aagcacccaccugggggga

SEQ ID NO: 8645 - RNA, 23 nt, Homo sapiens
agaaagggaagcccagacauugg

SEQ ID NO: 8646 - RNA, 19 nt, Homo sapiens
ccagggcgauacucuggcc

SEQ ID NO: 8647 - RNA, 17 nt, Homo sapiens
cccagcuccccaccaca

SEQ ID NO: 8648 - RNA, 17 nt, Homo sapiens
cgggaccgcgagugccu

SEQ ID NO: 8649 - RNA, 19 nt, Homo sapiens
ggccagcagagggucacag

SEQ ID NO: 8650 - RNA, 25 nt, Homo sapiens
uaccccaccugggggcgcugccacc

SEQ ID NO: 8651 - RNA, 20 nt, Homo sapiens
uacucuggccucaacaaccc

SEQ ID NO: 8652 - RNA, 21 nt, Homo sapiens
ucgggguaggaauucacacac

SEQ ID NO: 8653 - RNA, 18 nt, Homo sapiens
ugagaaccaggaagcagg

SEQ ID NO: 8654 - RNA, 18 nt, Homo sapiens
uuuauaucaccauauaau

SEQ ID NO: 8655 - RNA, 22 nt, Homo sapiens
acgaggauugugggcuucgagu

SEQ ID NO: 8656 - RNA, 17 nt, Homo sapiens
cuccucguuccccuggg

SEQ ID NO: 8657 - RNA, 18 nt, Homo sapiens
ggaggccgggggcggggg

SEQ ID NO: 8658 - RNA, 15 nt, Homo sapiens
uggcuuuucucuuug

SEQ ID NO: 8659 - RNA, 21 nt, Homo sapiens
aagcacacagguauaagucca

SEQ ID NO: 8660 - RNA, 18 nt, Homo sapiens
agcuguuccaagaccacu

SEQ ID NO: 8661 - RNA, 16 nt, Homo sapiens
cccuguggcugggacc

SEQ ID NO: 8662 - RNA, 19 nt, Homo sapiens
gcggcgaaggaggcgggca

SEQ ID NO: 8663 - RNA, 20 nt, Homo sapiens
ucuccugguccccacauccc

SEQ ID NO: 8664 - RNA, 20 nt, Homo sapiens
cgaauuugucuuuuuuuauu

SEQ ID NO: 8665 - RNA, 19 nt, Homo sapiens
ggagagccagugagggugg

SEQ ID NO: 8666 - RNA, 22 nt, Homo sapiens
ggucagcaggucagcagaggag

SEQ ID NO: 8667 - RNA, 18 nt, Homo sapiens
agaaggauguuuucaggg

SEQ ID NO: 8668 - RNA, 17 nt, Homo sapiens
auuacuccucuaucccc

SEQ ID NO: 8669 - RNA, 20 nt, Homo sapiens
gcaagcauuggucaaggugg

SEQ ID NO: 8670 - RNA, 20 nt, Homo sapiens
gccaccaagggggcuguggu

SEQ ID NO: 8671 - RNA, 21 nt, Homo sapiens
gccuaguauguauauuucaua

SEQ ID NO: 8672 - RNA, 22 nt, Homo sapiens
ggaauugcuggacugugacugg

SEQ ID NO: 8673 - RNA, 18 nt, Homo sapiens
ugaugucacagcaugugu

SEQ ID NO: 8674 - RNA, 17 nt, Homo sapiens
uugggaggcugaggcgg

SEQ ID NO: 8675 - RNA, 16 nt, Homo sapiens
uuguacaucucucugg

SEQ ID NO: 8676 - RNA, 22 nt, Homo sapiens
uuugccuacuccuucccacaaa

SEQ ID NO: 8677 - RNA, 18 nt, Homo sapiens
agcagcaaagguaaccuc

SEQ ID NO: 8678 - RNA, 16 nt, Homo sapiens
cuugcagaacacacag

SEQ ID NO: 8679 - RNA, 20 nt, Homo sapiens
uacagcagucuuuccaguug

SEQ ID NO: 8680 - RNA, 21 nt, Homo sapiens
acccguuggaggcggguggga

SEQ ID NO: 8681 - RNA, 19 nt, Homo sapiens
cggaacucggccggccgcg

SEQ ID NO: 8682 - RNA, 18 nt, Homo sapiens
gcccuggagcugcgcagc

SEQ ID NO: 8683 - RNA, 17 nt, Homo sapiens
ggauggggcagaggugg

SEQ ID NO: 8684 - RNA, 18 nt, Homo sapiens
gggcaugugugugugagg

SEQ ID NO: 8685 - RNA, 20 nt, Homo sapiens
ugaggacaccuggcauguuc

SEQ ID NO: 8686 - RNA, 17 nt, Homo sapiens
ugugcaguggagugaug

SEQ ID NO: 8687 - RNA, 17 nt, Homo sapiens
cagugacuaugcggucu

SEQ ID NO: 8688 - RNA, 14 nt, Homo sapiens
gccuucaugcugca

SEQ ID NO: 8689 - RNA, 24 nt, Homo sapiens
caguguccuuuccagaaacuauuu

SEQ ID NO: 8690 - RNA, 18 nt, Homo sapiens
aaguggagggagcuaggg

SEQ ID NO: 8691 - RNA, 19 nt, Homo sapiens
acugaaguacacaaagagg

SEQ ID NO: 8692 - RNA, 20 nt, Homo sapiens
ccgccuccucccgccgcugc

SEQ ID NO: 8693 - RNA, 22 nt, Homo sapiens
cgcuguugcugccgccgcccgg

SEQ ID NO: 8694 - RNA, 21 nt, Homo sapiens
cggugcucagugcccggcgcc

SEQ ID NO: 8695 - RNA, 17 nt, Homo sapiens
cugcgccccagccucgu

SEQ ID NO: 8696 - RNA, 17 nt, Homo sapiens
gcccuccccccuccccc

SEQ ID NO: 8697 - RNA, 20 nt, Homo sapiens
ggagggugggagggcggccg

SEQ ID NO: 8698 - RNA, 18 nt, Homo sapiens
ggcgggagggugggaggg

SEQ ID NO: 8699 - RNA, 19 nt, Homo sapiens
gggagggugggagggcggc

SEQ ID NO: 8700 - RNA, 19 nt, Homo sapiens
ucagagagaaaagcacaga

SEQ ID NO: 8701 - RNA, 19 nt, Homo sapiens
ugggagggcggccggcggc

SEQ ID NO: 8702 - RNA, 20 nt, Homo sapiens
aaagauaaacuuuuguccac

SEQ ID NO: 8703 - RNA, 20 nt, Homo sapiens
acagccuuugggaggugguu

SEQ ID NO: 8704 - RNA, 23 nt, Homo sapiens
ccucauuaucucuccccaaaugu

SEQ ID NO: 8705 - RNA, 18 nt, Homo sapiens
gaguguaauggcacgauc

SEQ ID NO: 8706 - RNA, 21 nt, Homo sapiens
gaugggagugggcaggguggg

SEQ ID NO: 8707 - RNA, 16 nt, Homo sapiens
gggacguagagcugga

SEQ ID NO: 8708 - RNA, 19 nt, Homo sapiens
ggguaacccuuaauuccuc

SEQ ID NO: 8709 - RNA, 16 nt, Homo sapiens
gugccuucuaagccag

SEQ ID NO: 8710 - RNA, 20 nt, Homo sapiens
gugcuuccuuccugucugcc

SEQ ID NO: 8711 - RNA, 21 nt, Homo sapiens
ucgaacuccugaccucaugau

SEQ ID NO: 8712 - RNA, 15 nt, Homo sapiens
ugcaaggucugaagg

SEQ ID NO: 8713 - RNA, 16 nt, Homo sapiens
ugccaccucuagcaau

SEQ ID NO: 8714 - RNA, 22 nt, Homo sapiens
ugcccagcucucccugaagguc

SEQ ID NO: 8715 - RNA, 21 nt, Homo sapiens
ugggcaugaaaagaaagggaa

SEQ ID NO: 8716 - RNA, 19 nt, Homo sapiens
uuagauagggaguaaggga

SEQ ID NO: 8717 - RNA, 19 nt, Homo sapiens
uuaguauuuuuccucuugu

SEQ ID NO: 8718 - RNA, 18 nt, Homo sapiens
ggcagccguccagccugg

SEQ ID NO: 8719 - RNA, 18 nt, Homo sapiens
gggaggggagugggcagg

SEQ ID NO: 8720 - RNA, 18 nt, Homo sapiens
ugucagagccccaccgcc

SEQ ID NO: 8721 - RNA, 16 nt, Homo sapiens
acaauguucuguaugg

SEQ ID NO: 8722 - RNA, 18 nt, Homo sapiens
agaacguuucaguauugu

SEQ ID NO: 8723 - RNA, 17 nt, Homo sapiens
caguggcugcugugccu

SEQ ID NO: 8724 - RNA, 22 nt, Homo sapiens
cccuacgucgguguuuguccuc

SEQ ID NO: 8725 - RNA, 19 nt, Homo sapiens
ccuacuccccgcucccugg

SEQ ID NO: 8726 - RNA, 18 nt, Homo sapiens
cucgcagcuugccgggcu

SEQ ID NO: 8727 - RNA, 20 nt, Homo sapiens
gaaaggaccugccuuuccug

SEQ ID NO: 8728 - RNA, 17 nt, Homo sapiens
gacaucuuuuugggugg

SEQ ID NO: 8729 - RNA, 16 nt, Homo sapiens
gccauccaggcagugc

SEQ ID NO: 8730 - RNA, 16 nt, Homo sapiens
gggagggaggcagaaa

SEQ ID NO: 8731 - RNA, 22 nt, Homo sapiens
guggagcugggagacucgcaga

SEQ ID NO: 8732 - RNA, 20 nt, Homo sapiens
guggggacaucuuuuugggu

SEQ ID NO: 8733 - RNA, 26 nt, Homo sapiens
ucaaguauuuaugcggugcacucaag

SEQ ID NO: 8734 - RNA, 19 nt, Homo sapiens
ucaggcaauuuuacaagga

SEQ ID NO: 8735 - RNA, 19 nt, Homo sapiens
ugggaucguggcgcuuucc

SEQ ID NO: 8736 - RNA, 22 nt, Homo sapiens
guuuucugauagugagagcugc

SEQ ID NO: 8737 - RNA, 18 nt, Homo sapiens
uguaguuggguuuucuga

SEQ ID NO: 8738 - RNA, 18 nt, Homo sapiens
cggugcucucugccccca

SEQ ID NO: 8739 - RNA, 17 nt, Homo sapiens
ucuggguugguccucuu

SEQ ID NO: 8740 - RNA, 18 nt, Homo sapiens
agcagccacggagccgcc

SEQ ID NO: 8741 - RNA, 19 nt, Homo sapiens
agggaggggccacaggagc

SEQ ID NO: 8742 - RNA, 15 nt, Homo sapiens
gcgcggggcgcgcca

SEQ ID NO: 8743 - RNA, 23 nt, Homo sapiens
ggggaggagggggagggaggggc

SEQ ID NO: 8744 - RNA, 22 nt, Homo sapiens
ucuagaguaaaagaggggagga

SEQ ID NO: 8745 - RNA, 16 nt, Homo sapiens
caaauuuuugccuuuu

SEQ ID NO: 8746 - RNA, 18 nt, Homo sapiens
caacugauuuuuucucaa

SEQ ID NO: 8747 - RNA, 18 nt, Homo sapiens
caucauuauuuuuuuucc

SEQ ID NO: 8748 - RNA, 20 nt, Homo sapiens
ccgccuccucuccccgccuc

SEQ ID NO: 8749 - RNA, 20 nt, Homo sapiens
cgccccuggaggccuccucc

SEQ ID NO: 8750 - RNA, 17 nt, Homo sapiens
cgggacccucgccgccu

SEQ ID NO: 8751 - RNA, 18 nt, Homo sapiens
cgggagcucggcguggcc

SEQ ID NO: 8752 - RNA, 19 nt, Homo sapiens
gaaaacaggaaaggugagg

SEQ ID NO: 8753 - RNA, 21 nt, Homo sapiens
gagccggcggccccggcccgg

SEQ ID NO: 8754 - RNA, 17 nt, Homo sapiens
gcaaaagugaaaacagg

SEQ ID NO: 8755 - RNA, 22 nt, Homo sapiens
gcgccccgggacccucgccgcc

SEQ ID NO: 8756 - RNA, 18 nt, Homo sapiens
gcgcgcgggaagccgggg

SEQ ID NO: 8757 - RNA, 19 nt, Homo sapiens
gcggccccggcccggcggc

SEQ ID NO: 8758 - RNA, 16 nt, Homo sapiens
gggcuacaggacuuug

SEQ ID NO: 8759 - RNA, 19 nt, Homo sapiens
ucaaugguuuguggcccuu

SEQ ID NO: 8760 - RNA, 21 nt, Homo sapiens
ugggagagggcagcgccuucc

SEQ ID NO: 8761 - RNA, 18 nt, Homo sapiens
uguuccgguuaacuccag

SEQ ID NO: 8762 - RNA, 18 nt, Homo sapiens
aaccaggacgcaguguau

SEQ ID NO: 8763 - RNA, 19 nt, Homo sapiens
acuuuccccugcaccccgc

SEQ ID NO: 8764 - RNA, 18 nt, Homo sapiens
ccugcuguuuccugcagc

SEQ ID NO: 8765 - RNA, 18 nt, Homo sapiens
ggcguugaggcgggggcg

SEQ ID NO: 8766 - RNA, 14 nt, Homo sapiens
uaacgacacgaggu

SEQ ID NO: 8767 - RNA, 19 nt, Homo sapiens
ugagcgacuacugugugca

SEQ ID NO: 8768 - RNA, 22 nt, Homo sapiens
ugaggcgggggcggaaugggga

SEQ ID NO: 8769 - RNA, 22 nt, Homo sapiens
uggggccgagcgcaugguacuc

SEQ ID NO: 8770 - RNA, 17 nt, Homo sapiens
ugguacucugccaggcu

SEQ ID NO: 8771 - RNA, 20 nt, Homo sapiens
ugugcagggcacugugcugg

SEQ ID NO: 8772 - RNA, 19 nt, Homo sapiens
uggcuucccaauucugucu

SEQ ID NO: 8773 - RNA, 18 nt, Homo sapiens
aagugaaggggcucaggg

SEQ ID NO: 8774 - RNA, 22 nt, Homo sapiens
aggcaaccccugggcaccaucc

SEQ ID NO: 8775 - RNA, 20 nt, Homo sapiens
auggggggcucagaugcaga

SEQ ID NO: 8776 - RNA, 20 nt, Homo sapiens
cagcgcccccuggaggacau

SEQ ID NO: 8777 - RNA, 19 nt, Homo sapiens
caggguugcugggcuacag

SEQ ID NO: 8778 - RNA, 23 nt, Homo sapiens
cccuggcucagagcccuuccucc

SEQ ID NO: 8779 - RNA, 17 nt, Homo sapiens
cgcucccuccccucccc

SEQ ID NO: 8780 - RNA, 21 nt, Homo sapiens
cggguccucuccccuggggcc

SEQ ID NO: 8781 - RNA, 18 nt, Homo sapiens
gccccucgcucccucccc

SEQ ID NO: 8782 - RNA, 20 nt, Homo sapiens
gcgaggacaaagaagcaggc

SEQ ID NO: 8783 - RNA, 17 nt, Homo sapiens
ggacagugguuuuauau

SEQ ID NO: 8784 - RNA, 17 nt, Homo sapiens
ggagguggggggugggg

SEQ ID NO: 8785 - RNA, 16 nt, Homo sapiens
ggguccucuccccugg

SEQ ID NO: 8786 - RNA, 15 nt, Homo sapiens
ugcaccuuuucucua

SEQ ID NO: 8787 - RNA, 18 nt, Homo sapiens
ugggcaccaucccacggg

SEQ ID NO: 8788 - RNA, 15 nt, Homo sapiens
aagcugcacugugcc

SEQ ID NO: 8789 - RNA, 18 nt, Homo sapiens
acugcuucuuagcacgcu

SEQ ID NO: 8790 - RNA, 21 nt, Homo sapiens
agccauucucaacucgggaga

SEQ ID NO: 8791 - RNA, 23 nt, Homo sapiens
auauauauauauauauuauauau

SEQ ID NO: 8792 - RNA, 19 nt, Homo sapiens
cguguggcuucaccaagcu

SEQ ID NO: 8793 - RNA, 23 nt, Homo sapiens
gcuuguuggauacaucaacuaca

SEQ ID NO: 8794 - RNA, 23 nt, Homo sapiens
uauauauauauauauuauauaua

SEQ ID NO: 8795 - RNA, 19 nt, Homo sapiens
uauauauauauauuauaua

SEQ ID NO: 8796 - RNA, 19 nt, Homo sapiens
uauauauauauuauauaua

SEQ ID NO: 8797 - RNA, 17 nt, Homo sapiens
ucgcgacccugcaguac

SEQ ID NO: 8798 - RNA, 18 nt, Homo sapiens
ugauauauauauauauau

SEQ ID NO: 8799 - RNA, 19 nt, Homo sapiens
uuuuggggaugcuguuagu

SEQ ID NO: 8800 - RNA, 19 nt, Homo sapiens
gccccuuacuuagcauaaa

SEQ ID NO: 8801 - RNA, 19 nt, Homo sapiens
gugcggugggcggaggggg

SEQ ID NO: 8802 - RNA, 15 nt, Homo sapiens
ccagagagggugugu

SEQ ID NO: 8803 - RNA, 21 nt, Homo sapiens
gagccugcggcagcccagagg

SEQ ID NO: 8804 - RNA, 18 nt, Homo sapiens
ucaccagagagggugugu

SEQ ID NO: 8805 - RNA, 19 nt, Homo sapiens
ucgccgaggcgugggugcc

SEQ ID NO: 8806 - RNA, 16 nt, Homo sapiens
ccguugggcugauggc

SEQ ID NO: 8807 - RNA, 16 nt, Homo sapiens
cuuccguugggcugau

SEQ ID NO: 8808 - RNA, 18 nt, Homo sapiens
ggcguuuccaaccggagc

SEQ ID NO: 8809 - RNA, 15 nt, Homo sapiens
acauauccugcuuug

SEQ ID NO: 8810 - RNA, 19 nt, Homo sapiens
uccguucuuucuucucugc

SEQ ID NO: 8811 - RNA, 15 nt, Homo sapiens
aggccugaugguauu

SEQ ID NO: 8812 - RNA, 22 nt, Homo sapiens
agagggcugcaaaaggggacgg

SEQ ID NO: 8813 - RNA, 18 nt, Homo sapiens
gaggagcacagggcuggc

SEQ ID NO: 8814 - RNA, 18 nt, Homo sapiens
ggccucugucaacauuua

SEQ ID NO: 8815 - RNA, 23 nt, Homo sapiens
ugugagggugugacuacugauga

SEQ ID NO: 8816 - RNA, 18 nt, Homo sapiens
uuaggggguugguaggga

SEQ ID NO: 8817 - RNA, 15 nt, Homo sapiens
aguggugaaaucccc

SEQ ID NO: 8818 - RNA, 18 nt, Homo sapiens
ccccaggaaguggaggac

SEQ ID NO: 8819 - RNA, 21 nt, Homo sapiens
ccgcccaccuucccaugcccc

SEQ ID NO: 8820 - RNA, 19 nt, Homo sapiens
gcccuggcugacccucccc

SEQ ID NO: 8821 - RNA, 19 nt, Homo sapiens
uauucugcagcuaccuccc

SEQ ID NO: 8822 - RNA, 18 nt, Homo sapiens
uguugcgucuuccugcga

SEQ ID NO: 8823 - RNA, 23 nt, Homo sapiens
uccgaagagggauuuuagcuucg

SEQ ID NO: 8824 - RNA, 22 nt, Homo sapiens
ccaggaggugauaggaugcugg

SEQ ID NO: 8825 - RNA, 18 nt, Homo sapiens
ccccagcccucuccucuc

SEQ ID NO: 8826 - RNA, 22 nt, Homo sapiens
gugggguccugggagccaggag

SEQ ID NO: 8827 - RNA, 16 nt, Homo sapiens
uuuauaccucgggguu

SEQ ID NO: 8828 - RNA, 21 nt, Homo sapiens
agccagaacggcuucaugcag

SEQ ID NO: 8829 - RNA, 22 nt, Homo sapiens
agcugcugcuggauucugugag

SEQ ID NO: 8830 - RNA, 17 nt, Homo sapiens
gagaggaaugacgucaa

SEQ ID NO: 8831 - RNA, 22 nt, Homo sapiens
uccuccccuuccggaagagccc

SEQ ID NO: 8832 - RNA, 17 nt, Homo sapiens
ugcuggauucugugagg

SEQ ID NO: 8833 - RNA, 16 nt, Homo sapiens
aggaagcagccuccuc

SEQ ID NO: 8834 - RNA, 22 nt, Homo sapiens
cagcccaaaauguccguagugc

SEQ ID NO: 8835 - RNA, 23 nt, Homo sapiens
ccgcuggguuuccagcgcccucg

SEQ ID NO: 8836 - RNA, 21 nt, Homo sapiens
gaggacacagcuagaaggcac

SEQ ID NO: 8837 - RNA, 21 nt, Homo sapiens
gccgcggacccggacggucgg

SEQ ID NO: 8838 - RNA, 20 nt, Homo sapiens
uaugucauuggcaucuagug

SEQ ID NO: 8839 - RNA, 20 nt, Homo sapiens
ucauuggcaucuagugaguu

SEQ ID NO: 8840 - RNA, 19 nt, Homo sapiens
ugagaaguuucuguuguuu

SEQ ID NO: 8841 - RNA, 23 nt, Homo sapiens
ugguguacuaagacaguuauauu

SEQ ID NO: 8842 - RNA, 21 nt, Homo sapiens
ugucaguggugaugaucacgu

SEQ ID NO: 8843 - RNA, 15 nt, Homo sapiens
uuagauagaaggugg

SEQ ID NO: 8844 - RNA, 18 nt, Homo sapiens
accccuggcuggaugggg

SEQ ID NO: 8845 - RNA, 20 nt, Homo sapiens
aguaccccaggggcugaagc

SEQ ID NO: 8846 - RNA, 19 nt, Homo sapiens
caugccucccgcgccucgc

SEQ ID NO: 8847 - RNA, 18 nt, Homo sapiens
ccccgcccggcccugccc

SEQ ID NO: 8848 - RNA, 19 nt, Homo sapiens
ccgcuucggccgccgggcc

SEQ ID NO: 8849 - RNA, 16 nt, Homo sapiens
ccuggccccgccccuc

SEQ ID NO: 8850 - RNA, 18 nt, Homo sapiens
cgcggccccgcccggccc

SEQ ID NO: 8851 - RNA, 19 nt, Homo sapiens
gcucccggcuccccgccgc

SEQ ID NO: 8852 - RNA, 21 nt, Homo sapiens
gcugccgggugcgccaucuuu

SEQ ID NO: 8853 - RNA, 18 nt, Homo sapiens
ggaaacccucaggguccu

SEQ ID NO: 8854 - RNA, 20 nt, Homo sapiens
ggcggcggcgcggcagggag

SEQ ID NO: 8855 - RNA, 19 nt, Homo sapiens
uacuguagcaggaaguccu

SEQ ID NO: 8856 - RNA, 17 nt, Homo sapiens
ccugcccuuccaccccu

SEQ ID NO: 8857 - RNA, 17 nt, Homo sapiens
ccuguccccuuccuggc

SEQ ID NO: 8858 - RNA, 21 nt, Homo sapiens
cgggcauagcucgcugccucg

SEQ ID NO: 8859 - RNA, 19 nt, Homo sapiens
gcccuuccaccccuugucc

SEQ ID NO: 8860 - RNA, 18 nt, Homo sapiens
gccuacaccggcuggagc

SEQ ID NO: 8861 - RNA, 20 nt, Homo sapiens
gguggugccggccgccgcgg

SEQ ID NO: 8862 - RNA, 20 nt, Homo sapiens
ugagcaggcggaggcuuuuc

SEQ ID NO: 8863 - RNA, 24 nt, Homo sapiens
uuggcaggaaucgcugaccacugu

SEQ ID NO: 8864 - RNA, 25 nt, Homo sapiens
agcauuuccauuggaaaaggggguu

SEQ ID NO: 8865 - RNA, 17 nt, Homo sapiens
agaagugugugaggaac

SEQ ID NO: 8866 - RNA, 18 nt, Homo sapiens
agcgccgguccuggcccc

SEQ ID NO: 8867 - RNA, 22 nt, Homo sapiens
agggaaggccucucagaggagg

SEQ ID NO: 8868 - RNA, 21 nt, Homo sapiens
caucggccacaacccagaaag

SEQ ID NO: 8869 - RNA, 20 nt, Homo sapiens
ccucugagcugggaagaauc

SEQ ID NO: 8870 - RNA, 20 nt, Homo sapiens
cuccuacuggggcuuccugg

SEQ ID NO: 8871 - RNA, 20 nt, Homo sapiens
gggaaggccucucagaggag

SEQ ID NO: 8872 - RNA, 18 nt, Homo sapiens
ugggaagcccugggggaa

SEQ ID NO: 8873 - RNA, 18 nt, Homo sapiens
uggggucacagggcaccc

SEQ ID NO: 8874 - RNA, 18 nt, Homo sapiens
ccugcugucuccuggcuc

SEQ ID NO: 8875 - RNA, 22 nt, Homo sapiens
aaaaacuaaaaauuccuggcag

SEQ ID NO: 8876 - RNA, 18 nt, Homo sapiens
acaagcuuuggcaggaac

SEQ ID NO: 8877 - RNA, 18 nt, Homo sapiens
acacacaaaguugaggcc

SEQ ID NO: 8878 - RNA, 16 nt, Homo sapiens
cagaaugccaauuacu

SEQ ID NO: 8879 - RNA, 18 nt, Homo sapiens
cagaaugccaauuacuuc

SEQ ID NO: 8880 - RNA, 22 nt, Homo sapiens
cagagcagagaugaccucgcag

SEQ ID NO: 8881 - RNA, 18 nt, Homo sapiens
ccaucuuccagcaccccc

SEQ ID NO: 8882 - RNA, 21 nt, Homo sapiens
cgcagcugucagaggauauga

SEQ ID NO: 8883 - RNA, 18 nt, Homo sapiens
gaacugguuggaagcuga

SEQ ID NO: 8884 - RNA, 16 nt, Homo sapiens
gaagucagaguucagg

SEQ ID NO: 8885 - RNA, 19 nt, Homo sapiens
gucagggcaggguggugua

SEQ ID NO: 8886 - RNA, 19 nt, Homo sapiens
guggccacugaggucccuu

SEQ ID NO: 8887 - RNA, 22 nt, Homo sapiens
uacaagcuuuggcaggaacugg

SEQ ID NO: 8888 - RNA, 19 nt, Homo sapiens
uaggugcuguuugcuaaau

SEQ ID NO: 8889 - RNA, 18 nt, Homo sapiens
ucagauuggaggcuacaa

SEQ ID NO: 8890 - RNA, 19 nt, Homo sapiens
ugaggagcaggagugaggg

SEQ ID NO: 8891 - RNA, 18 nt, Homo sapiens
cagugccucagaagcagc

SEQ ID NO: 8892 - RNA, 18 nt, Homo sapiens
cucuggcugcgggagggg

SEQ ID NO: 8893 - RNA, 23 nt, Homo sapiens
gcgccgccgccgccgcggcuggg

SEQ ID NO: 8894 - RNA, 19 nt, Homo sapiens
cagagagacgucuccgggg

SEQ ID NO: 8895 - RNA, 16 nt, Homo sapiens
cucucccucucucccu

SEQ ID NO: 8896 - RNA, 18 nt, Homo sapiens
uucccacucucuuuuucu

SEQ ID NO: 8897 - RNA, 17 nt, Homo sapiens
gagcagcuccccggcug

SEQ ID NO: 8898 - RNA, 19 nt, Homo sapiens
gcuuggccagccucaucug

SEQ ID NO: 8899 - RNA, 17 nt, Homo sapiens
uaucagggucagugugg

SEQ ID NO: 8900 - RNA, 16 nt, Homo sapiens
caugggauggggaggg

SEQ ID NO: 8901 - RNA, 22 nt, Homo sapiens
ccacccagaaaaacaggagaca

SEQ ID NO: 8902 - RNA, 18 nt, Homo sapiens
gacaugauuccuccuguc

SEQ ID NO: 8903 - RNA, 19 nt, Homo sapiens
ggugaagagguggagggug

SEQ ID NO: 8904 - RNA, 22 nt, Homo sapiens
ugggagaccugauacucucaag

SEQ ID NO: 8905 - RNA, 17 nt, Homo sapiens
cauuggguggggcugga

SEQ ID NO: 8906 - RNA, 18 nt, Homo sapiens
cccagccccugcuuggcc

SEQ ID NO: 8907 - RNA, 19 nt, Homo sapiens
gcuuauggacccuccccuc

SEQ ID NO: 8908 - RNA, 19 nt, Homo sapiens
gggaggagagggagaugcu

SEQ ID NO: 8909 - RNA, 22 nt, Homo sapiens
uccccucuucuccagcuagcuc

SEQ ID NO: 8910 - RNA, 22 nt, Homo sapiens
ugggaggagagggagaugcugg

SEQ ID NO: 8911 - RNA, 22 nt, Homo sapiens
agcaguugccagggcuggugag

SEQ ID NO: 8912 - RNA, 19 nt, Homo sapiens
cagcuacuugggaggccga

SEQ ID NO: 8913 - RNA, 24 nt, Homo sapiens
caggcgugguggugugugccugua

SEQ ID NO: 8914 - RNA, 18 nt, Homo sapiens
gaagccaaggcaggugga

SEQ ID NO: 8915 - RNA, 21 nt, Homo sapiens
uauauauauauguauauauau

SEQ ID NO: 8916 - RNA, 23 nt, Homo sapiens
uauauauauauguauauauauau

SEQ ID NO: 8917 - RNA, 19 nt, Homo sapiens
uggccaggcugcuuuccaa

SEQ ID NO: 8918 - RNA, 17 nt, Homo sapiens
uugggaggcugaggcgg

SEQ ID NO: 8919 - RNA, 18 nt, Homo sapiens
uuuaagaauguaaguuag

SEQ ID NO: 8920 - RNA, 19 nt, Homo sapiens
agagguugcagugaacaaa

SEQ ID NO: 8921 - RNA, 20 nt, Homo sapiens
ccagccugggagacagagca

SEQ ID NO: 8922 - RNA, 23 nt, Homo sapiens
ucaccaccagccuggccaacaug

SEQ ID NO: 8923 - RNA, 17 nt, Homo sapiens
ucgauaaucucacuccu

SEQ ID NO: 8924 - RNA, 23 nt, Homo sapiens
ugccuguaauaucagcacuuugg

SEQ ID NO: 8925 - RNA, 20 nt, Homo sapiens
ugggguauggggagugacag

SEQ ID NO: 8926 - RNA, 17 nt, Homo sapiens
uugggaggcuaaggugg

SEQ ID NO: 8927 - RNA, 17 nt, Homo sapiens
uuguacagcuuugugaa

SEQ ID NO: 8928 - RNA, 18 nt, Homo sapiens
caucugccucugcccugc

SEQ ID NO: 8929 - RNA, 23 nt, Homo sapiens
agacaccagugguuucagaacac

SEQ ID NO: 8930 - RNA, 18 nt, Homo sapiens
cugcuguuugcugggcug

SEQ ID NO: 8931 - RNA, 20 nt, Homo sapiens
ugcugcuguuugcugggcug

SEQ ID NO: 8932 - RNA, 24 nt, Homo sapiens
agcaguaauaggaaacuaauauag

SEQ ID NO: 8933 - RNA, 21 nt, Homo sapiens
aggcaggaguuugggaggugg

SEQ ID NO: 8934 - RNA, 18 nt, Homo sapiens
cagcacagagcuuggugu

SEQ ID NO: 8935 - RNA, 19 nt, Homo sapiens
cccgagcucuggaagugca

SEQ ID NO: 8936 - RNA, 18 nt, Homo sapiens
agccaucugggaccccau

SEQ ID NO: 8937 - RNA, 18 nt, Homo sapiens
uugaauaaaugaaugagc

SEQ ID NO: 8938 - RNA, 22 nt, Homo sapiens
gcuaccacaccuggcuguaaug

SEQ ID NO: 8939 - RNA, 23 nt, Homo sapiens
ccccaccccugggccuuccuccc

SEQ ID NO: 8940 - RNA, 21 nt, Homo sapiens
uucaaccugcugagcaggcug

SEQ ID NO: 8941 - RNA, 16 nt, Homo sapiens
cagaaggacucggcga

SEQ ID NO: 8942 - RNA, 27 nt, Homo sapiens
caggaggaugggguggggccucgcuga

SEQ ID NO: 8943 - RNA, 18 nt, Homo sapiens
cgcgggaaggcaggagga

SEQ ID NO: 8944 - RNA, 16 nt, Homo sapiens
cuugcuggagccacgg

SEQ ID NO: 8945 - RNA, 20 nt, Homo sapiens
gaaagcugggaguccuccug

SEQ ID NO: 8946 - RNA, 23 nt, Homo sapiens
gaggaugggguggggcgagguug

SEQ ID NO: 8947 - RNA, 16 nt, Homo sapiens
ggccggugucuggggu

SEQ ID NO: 8948 - RNA, 15 nt, Homo sapiens
ggguggggcgaggug

SEQ ID NO: 8949 - RNA, 21 nt, Homo sapiens
gguaccucuugaaaagggaaa

SEQ ID NO: 8950 - RNA, 15 nt, Homo sapiens
ggugccuccuugcac

SEQ ID NO: 8951 - RNA, 24 nt, Homo sapiens
ucuaguuucccaauaauguuuuua

SEQ ID NO: 8952 - RNA, 20 nt, Homo sapiens
uuaaagucacacugaauguu

SEQ ID NO: 8953 - RNA, 18 nt, Homo sapiens
gcagggcggguucaaagc

SEQ ID NO: 8954 - RNA, 24 nt, Homo sapiens
gccaagcaagcagagagaccaugg

SEQ ID NO: 8955 - RNA, 22 nt, Homo sapiens
ucaaucuaagaauguguauggu

SEQ ID NO: 8956 - RNA, 20 nt, Homo sapiens
ucacacauuggucagggccg

SEQ ID NO: 8957 - RNA, 21 nt, Homo sapiens
ccaauuuuauuacucccaagg

SEQ ID NO: 8958 - RNA, 17 nt, Homo sapiens
gccgaggucgccaccgc

SEQ ID NO: 8959 - RNA, 18 nt, Homo sapiens
uaaaauuacuaucuggaa

SEQ ID NO: 8960 - RNA, 23 nt, Homo sapiens
ugccuguaaucccagcacuuugg

SEQ ID NO: 8961 - RNA, 19 nt, Homo sapiens
uggcaagagcgaugaguac

SEQ ID NO: 8962 - RNA, 18 nt, Homo sapiens
uguagaacuagauacaua

SEQ ID NO: 8963 - RNA, 17 nt, Homo sapiens
uugggaggccaaggcgg

SEQ ID NO: 8964 - RNA, 22 nt, Homo sapiens
agcagcggggcgggggcggggg

SEQ ID NO: 8965 - RNA, 19 nt, Homo sapiens
aggccacacccagugaggc

SEQ ID NO: 8966 - RNA, 17 nt, Homo sapiens
agggcuggcggagggcu

SEQ ID NO: 8967 - RNA, 16 nt, Homo sapiens
cccacagggacagcau

SEQ ID NO: 8968 - RNA, 21 nt, Homo sapiens
cgggggcgggggcguucccgg

SEQ ID NO: 8969 - RNA, 23 nt, Homo sapiens
gaguagagugcacagugugcucg

SEQ ID NO: 8970 - RNA, 16 nt, Homo sapiens
ggaggagggggaggag

SEQ ID NO: 8971 - RNA, 18 nt, Homo sapiens
ggccgggcaggcuggccc

SEQ ID NO: 8972 - RNA, 20 nt, Homo sapiens
gugccugucccagaagccag

SEQ ID NO: 8973 - RNA, 19 nt, Homo sapiens
ugccgccucgucuuuuggu

SEQ ID NO: 8974 - RNA, 21 nt, Homo sapiens
ugggcgugcagggcuguucca

SEQ ID NO: 8975 - RNA, 17 nt, Homo sapiens
uguuccauggggaucgu

SEQ ID NO: 8976 - RNA, 24 nt, Homo sapiens
aaagaaacuuauauuaauaugaag

SEQ ID NO: 8977 - RNA, 18 nt, Homo sapiens
acucuuccccuuauuuua

SEQ ID NO: 8978 - RNA, 23 nt, Homo sapiens
agaggugggacuaaacuguuaag

SEQ ID NO: 8979 - RNA, 19 nt, Homo sapiens
ggcaccagggaaaaaagcc

SEQ ID NO: 8980 - RNA, 19 nt, Homo sapiens
uaaauuaucaucuuugaau

SEQ ID NO: 8981 - RNA, 18 nt, Homo sapiens
uacagauuugaaauuaag

SEQ ID NO: 8982 - RNA, 16 nt, Homo sapiens
gcccuugggcagggcc

SEQ ID NO: 8983 - RNA, 17 nt, Homo sapiens
ucucuggugggaggccc

SEQ ID NO: 8984 - RNA, 24 nt, Homo sapiens
cagacaaaaucacaacccucugga

SEQ ID NO: 8985 - RNA, 23 nt, Homo sapiens
ugaacauugauugcccuggaaaa

SEQ ID NO: 8986 - RNA, 17 nt, Homo sapiens
aaaugguuaaguacaau

SEQ ID NO: 8987 - RNA, 18 nt, Homo sapiens
agcuacuugggagccuga

SEQ ID NO: 8988 - RNA, 18 nt, Homo sapiens
aguggggaauaaaaacaa

SEQ ID NO: 8989 - RNA, 20 nt, Homo sapiens
caggcgaggccccgcccccc

SEQ ID NO: 8990 - RNA, 21 nt, Homo sapiens
ccccugcgaggcaagcgguuu

SEQ ID NO: 8991 - RNA, 20 nt, Homo sapiens
ccgccccgcccccucguccc

SEQ ID NO: 8992 - RNA, 23 nt, Homo sapiens
ccuauccuguacuucuuucugcc

SEQ ID NO: 8993 - RNA, 19 nt, Homo sapiens
gaauacaggugugcgccac

SEQ ID NO: 8994 - RNA, 14 nt, Homo sapiens
gccgccccgccccc

SEQ ID NO: 8995 - RNA, 22 nt, Homo sapiens
uaauuuuuguguuuuuuguaga

SEQ ID NO: 8996 - RNA, 18 nt, Homo sapiens
uacacugcuuucacugaa

SEQ ID NO: 8997 - RNA, 24 nt, Homo sapiens
uacaggugugcgccacaaugccca

SEQ ID NO: 8998 - RNA, 19 nt, Homo sapiens
uugcuuuaaguguuuggca

SEQ ID NO: 8999 - RNA, 17 nt, Homo sapiens
uugggaggcugaggugg

SEQ ID NO: 9000 - RNA, 17 nt, Homo sapiens
aauucuguuauuaguuu

SEQ ID NO: 9001 - RNA, 17 nt, Homo sapiens
ccgugugcagggaaugu

SEQ ID NO: 9002 - RNA, 16 nt, Homo sapiens
ucaaagaccgugugca

SEQ ID NO: 9003 - RNA, 19 nt, Homo sapiens
ucccauaauugguucuaaa

SEQ ID NO: 9004 - RNA, 24 nt, Homo sapiens
aagggcacuagaccccggcuaagg

SEQ ID NO: 9005 - RNA, 20 nt, Homo sapiens
agcagggccccgcgccuccc

SEQ ID NO: 9006 - RNA, 18 nt, Homo sapiens
cccgcgccuccccgcagg

SEQ ID NO: 9007 - RNA, 20 nt, Homo sapiens
gcagggguucggcucccggu

SEQ ID NO: 9008 - RNA, 21 nt, Homo sapiens
ucucaaagccccuggagcuug

SEQ ID NO: 9009 - RNA, 19 nt, Homo sapiens
uggagauuguucaaagggc

SEQ ID NO: 9010 - RNA, 20 nt, Homo sapiens
uguguguuugcuucauuggc

SEQ ID NO: 9011 - RNA, 17 nt, Homo sapiens
cagcuuccccuccuucc

SEQ ID NO: 9012 - RNA, 20 nt, Homo sapiens
ccggggugaagaggaggccg

SEQ ID NO: 9013 - RNA, 20 nt, Homo sapiens
cgucagaguguggcagaggc

SEQ ID NO: 9014 - RNA, 17 nt, Homo sapiens
cuggcagagugagggug

SEQ ID NO: 9015 - RNA, 21 nt, Homo sapiens
gagggagcuaagguuuuuggc

SEQ ID NO: 9016 - RNA, 21 nt, Homo sapiens
gcgucagaguguggcagaggc

SEQ ID NO: 9017 - RNA, 16 nt, Homo sapiens
ggcagugaggagcaug

SEQ ID NO: 9018 - RNA, 14 nt, Homo sapiens
ggccccggacggcg

SEQ ID NO: 9019 - RNA, 23 nt, Homo sapiens
gggggcccagccccagggcuggu

SEQ ID NO: 9020 - RNA, 22 nt, Homo sapiens
gugagguggguccggacuagcc

SEQ ID NO: 9021 - RNA, 20 nt, Homo sapiens
ugccccugagcuggggggcc

SEQ ID NO: 9022 - RNA, 14 nt, Homo sapiens
uggaggugggaggg

SEQ ID NO: 9023 - RNA, 20 nt, Homo sapiens
uggcuugggaaucucugggg

SEQ ID NO: 9024 - RNA, 22 nt, Homo sapiens
cuccuuggucccugaggccugg

SEQ ID NO: 9025 - RNA, 21 nt, Homo sapiens
auuugcgugugugugcgugcu

SEQ ID NO: 9026 - RNA, 16 nt, Homo sapiens
cuugucagugucugug

SEQ ID NO: 9027 - RNA, 17 nt, Homo sapiens
ucugugcgguuaugcag

SEQ ID NO: 9028 - RNA, 19 nt, Homo sapiens
agcauggcucugucccuga

SEQ ID NO: 9029 - RNA, 18 nt, Homo sapiens
aggugcgaaaacagguaa

SEQ ID NO: 9030 - RNA, 15 nt, Homo sapiens
auugcuggcacugga

SEQ ID NO: 9031 - RNA, 17 nt, Homo sapiens
cggagcagagcgggcgc

SEQ ID NO: 9032 - RNA, 17 nt, Homo sapiens
gcgggggaggguguggc

SEQ ID NO: 9033 - RNA, 18 nt, Homo sapiens
gcgguggccccgguccgg

SEQ ID NO: 9034 - RNA, 18 nt, Homo sapiens
ggccuggaggagagggcg

SEQ ID NO: 9035 - RNA, 17 nt, Homo sapiens
ggucauccugucccuga

SEQ ID NO: 9036 - RNA, 22 nt, Homo sapiens
agaagcaauuuggucccucugu

SEQ ID NO: 9037 - RNA, 19 nt, Homo sapiens
ccuugugguguuuuuuguu

SEQ ID NO: 9038 - RNA, 18 nt, Homo sapiens
ccacagccucugucuucg

SEQ ID NO: 9039 - RNA, 17 nt, Homo sapiens
uaaauucccagugcaga

SEQ ID NO: 9040 - RNA, 18 nt, Homo sapiens
uaugaaaauaaggaaacu

SEQ ID NO: 9041 - RNA, 25 nt, Homo sapiens
agagagcguggagcgaugggcuggu

SEQ ID NO: 9042 - RNA, 20 nt, Homo sapiens
cgguguuuucuucuuuugcc

SEQ ID NO: 9043 - RNA, 21 nt, Homo sapiens
ucaaaggauucaucuaggaau

SEQ ID NO: 9044 - RNA, 20 nt, Homo sapiens
uuaaaucagguccuagggua

SEQ ID NO: 9045 - RNA, 21 nt, Homo sapiens
ucugagcggaaaggagagaag

SEQ ID NO: 9046 - RNA, 21 nt, Homo sapiens
acaugcuuacagaagcugcgu

SEQ ID NO: 9047 - RNA, 18 nt, Homo sapiens
ccgccgccgcgcuggccc

SEQ ID NO: 9048 - RNA, 23 nt, Homo sapiens
cccccaccugccucuaguagguc

SEQ ID NO: 9049 - RNA, 19 nt, Homo sapiens
cucgccucuugccucuugg

SEQ ID NO: 9050 - RNA, 20 nt, Homo sapiens
aguuguuggacaagcugguu

SEQ ID NO: 9051 - RNA, 23 nt, Homo sapiens
caggagaucuaguuauuauccaa

SEQ ID NO: 9052 - RNA, 15 nt, Homo sapiens
guucccucucgcacc

SEQ ID NO: 9053 - RNA, 22 nt, Homo sapiens
uauguugguagaaguauuuuau

SEQ ID NO: 9054 - RNA, 20 nt, Homo sapiens
cggcuuggcccugcgcgcgc

SEQ ID NO: 9055 - RNA, 23 nt, Homo sapiens
gcccugcgcgcgcgugcgugccg

SEQ ID NO: 9056 - RNA, 21 nt, Homo sapiens
gcgcggggacgcgcggggccg

SEQ ID NO: 9057 - RNA, 24 nt, Homo sapiens
ugcgcgcgcgugcgugccgugugg

SEQ ID NO: 9058 - RNA, 19 nt, Homo sapiens
ugggggaauguugauguca

SEQ ID NO: 9059 - RNA, 18 nt, Homo sapiens
acaaguggcagggugcag

SEQ ID NO: 9060 - RNA, 22 nt, Homo sapiens
gugagccacggcacccagcccc

SEQ ID NO: 9061 - RNA, 23 nt, Homo sapiens
ucgaacuccuggccucaagugau

SEQ ID NO: 9062 - RNA, 21 nt, Homo sapiens
ucugugacuggcugcuucuac

SEQ ID NO: 9063 - RNA, 23 nt, Homo sapiens
ugacuggcugcuucuacaucugc

SEQ ID NO: 9064 - RNA, 19 nt, Homo sapiens
ugcaguggcucgaucucgg

SEQ ID NO: 9065 - RNA, 18 nt, Homo sapiens
ccuugggcuagagcccca

SEQ ID NO: 9066 - RNA, 19 nt, Homo sapiens
gaugagagcagacacagag

SEQ ID NO: 9067 - RNA, 25 nt, Homo sapiens
gccccgggcuggguaacagcugggg

SEQ ID NO: 9068 - RNA, 19 nt, Homo sapiens
uacagguuuauuggcuccu

SEQ ID NO: 9069 - RNA, 23 nt, Homo sapiens
cagcgugcauaucauuuuauuau

SEQ ID NO: 9070 - RNA, 18 nt, Homo sapiens
uaugaaaauucaaaaguu

SEQ ID NO: 9071 - RNA, 22 nt, Homo sapiens
ugccauucaaaauuaaggugcc

SEQ ID NO: 9072 - RNA, 16 nt, Homo sapiens
aaaguagcuccuacua

SEQ ID NO: 9073 - RNA, 21 nt, Homo sapiens
acuaaaauagucuauacuuuu

SEQ ID NO: 9074 - RNA, 20 nt, Homo sapiens
caacacagcacuuuauuaug

SEQ ID NO: 9075 - RNA, 21 nt, Homo sapiens
cauuuugccuuaacauuuccc

SEQ ID NO: 9076 - RNA, 18 nt, Homo sapiens
ccucuaauuuucuaauga

SEQ ID NO: 9077 - RNA, 22 nt, Homo sapiens
gcuggcuugccuuuaguuucuu

SEQ ID NO: 9078 - RNA, 20 nt, Homo sapiens
ucuaaugaaaugugucucca

SEQ ID NO: 9079 - RNA, 23 nt, Homo sapiens
ugguaaauuauacugcaaaugga

SEQ ID NO: 9080 - RNA, 18 nt, Homo sapiens
uuucauuccugagauaga

SEQ ID NO: 9081 - RNA, 22 nt, Homo sapiens
cauaacacguccauuuucucca

SEQ ID NO: 9082 - RNA, 19 nt, Homo sapiens
ccuucuuuggcuguuuucc

SEQ ID NO: 9083 - RNA, 17 nt, Homo sapiens
gaguagaaaaagauguu

SEQ ID NO: 9084 - RNA, 18 nt, Homo sapiens
uaagucauuaugaaucaa

SEQ ID NO: 9085 - RNA, 19 nt, Homo sapiens
uuccuuuuccuccucuucc

SEQ ID NO: 9086 - RNA, 17 nt, Homo sapiens
cccuuuauucuuuucgc

SEQ ID NO: 9087 - RNA, 18 nt, Homo sapiens
ccuuccuugcuugcuugc

SEQ ID NO: 9088 - RNA, 19 nt, Homo sapiens
cugccuguucuuuuccucc

SEQ ID NO: 9089 - RNA, 19 nt, Homo sapiens
gacucuacucucagagaca

SEQ ID NO: 9090 - RNA, 21 nt, Homo sapiens
gguguuucccccccuuucccu

SEQ ID NO: 9091 - RNA, 15 nt, Homo sapiens
ucccccccuuucccu

SEQ ID NO: 9092 - RNA, 19 nt, Homo sapiens
gcucuuacacccccucccc

SEQ ID NO: 9093 - RNA, 20 nt, Homo sapiens
cugagcucucucggggcucc

SEQ ID NO: 9094 - RNA, 18 nt, Homo sapiens
gcgcgcuccccacggagc

SEQ ID NO: 9095 - RNA, 18 nt, Homo sapiens
cagggcugcggcagaaac

SEQ ID NO: 9096 - RNA, 20 nt, Homo sapiens
cucucccauaccccaaacuc

SEQ ID NO: 9097 - RNA, 18 nt, Homo sapiens
gaacaggggcugccaggg

SEQ ID NO: 9098 - RNA, 14 nt, Homo sapiens
ggguacaggggacg

SEQ ID NO: 9099 - RNA, 21 nt, Homo sapiens
uaccccaaacuccucuuuucc

SEQ ID NO: 9100 - RNA, 20 nt, Homo sapiens
ucucuggccucacggucaag

SEQ ID NO: 9101 - RNA, 24 nt, Homo sapiens
uggcagcuuuagaaacccacagaa

SEQ ID NO: 9102 - RNA, 18 nt, Homo sapiens
agacagauggcauuguac

SEQ ID NO: 9103 - RNA, 21 nt, Homo sapiens
agcagccaccggguuuagcgg

SEQ ID NO: 9104 - RNA, 18 nt, Homo sapiens
auaacaucaccauuggca

SEQ ID NO: 9105 - RNA, 19 nt, Homo sapiens
cagaaaugacaaauacuuu

SEQ ID NO: 9106 - RNA, 16 nt, Homo sapiens
caucgcccccacgggg

SEQ ID NO: 9107 - RNA, 18 nt, Homo sapiens
ccuggucaucuccagggc

SEQ ID NO: 9108 - RNA, 20 nt, Homo sapiens
cgaggaugcaguggggcgcg

SEQ ID NO: 9109 - RNA, 18 nt, Homo sapiens
cucagcaguggccgcucc

SEQ ID NO: 9110 - RNA, 16 nt, Homo sapiens
gaugugucuuggaaau

SEQ ID NO: 9111 - RNA, 18 nt, Homo sapiens
gcgcugcgcgcacgagca

SEQ ID NO: 9112 - RNA, 23 nt, Homo sapiens
gggggcggcuaucccagccggag

SEQ ID NO: 9113 - RNA, 19 nt, Homo sapiens
gucgggggcacuuguuuuu

SEQ ID NO: 9114 - RNA, 18 nt, Homo sapiens
uacccaguaggcaugucc

SEQ ID NO: 9115 - RNA, 20 nt, Homo sapiens
uccccucucuguuucuaacu

SEQ ID NO: 9116 - RNA, 17 nt, Homo sapiens
uugaggagaauaagaau

SEQ ID NO: 9117 - RNA, 21 nt, Homo sapiens
uuugaggaauuuuuccuacau

SEQ ID NO: 9118 - RNA, 19 nt, Homo sapiens
aagcucauuucucuuaacu

SEQ ID NO: 9119 - RNA, 16 nt, Homo sapiens
agaacugugaaaagga

SEQ ID NO: 9120 - RNA, 18 nt, Homo sapiens
cguaccuccagagcugca

SEQ ID NO: 9121 - RNA, 18 nt, Homo sapiens
cuggucaccaggguugcc

SEQ ID NO: 9122 - RNA, 17 nt, Homo sapiens
gauugcucaccgccuuu

SEQ ID NO: 9123 - RNA, 28 nt, Homo sapiens
gaggcuacugaggucacuggcugacugc

SEQ ID NO: 9124 - RNA, 15 nt, Homo sapiens
gagggucacucgggc

SEQ ID NO: 9125 - RNA, 22 nt, Homo sapiens
gcuggcucggagccugaguggc

SEQ ID NO: 9126 - RNA, 19 nt, Homo sapiens
ggcucgaguguacguggca

SEQ ID NO: 9127 - RNA, 20 nt, Homo sapiens
gggaggagggggcgcgagca

SEQ ID NO: 9128 - RNA, 27 nt, Homo sapiens
ucgcgauggcucgagugcgagcgcgcu

SEQ ID NO: 9129 - RNA, 24 nt, Homo sapiens
cuguuggggggauggcgggggggc

SEQ ID NO: 9130 - RNA, 24 nt, Homo sapiens
aagaugaggagucugucagcccag

SEQ ID NO: 9131 - RNA, 19 nt, Homo sapiens
caccaaaagucuuagacca

SEQ ID NO: 9132 - RNA, 20 nt, Homo sapiens
cagcagcagcagcggucucc

SEQ ID NO: 9133 - RNA, 19 nt, Homo sapiens
cugcugucccaucauccca

SEQ ID NO: 9134 - RNA, 21 nt, Homo sapiens
gauaauaguaggcauucagag

SEQ ID NO: 9135 - RNA, 15 nt, Homo sapiens
gcaguagcggcagca

SEQ ID NO: 9136 - RNA, 20 nt, Homo sapiens
gccgccucucccggaguggu

SEQ ID NO: 9137 - RNA, 21 nt, Homo sapiens
gucucaugcugauggauuguu

SEQ ID NO: 9138 - RNA, 19 nt, Homo sapiens
guuagauguuacuguaugu

SEQ ID NO: 9139 - RNA, 21 nt, Homo sapiens
uaaagauucuaagaugauuuu

SEQ ID NO: 9140 - RNA, 18 nt, Homo sapiens
uacaucaaggugaagagu

SEQ ID NO: 9141 - RNA, 17 nt, Homo sapiens
uacguaggagaaauaau

SEQ ID NO: 9142 - RNA, 16 nt, Homo sapiens
ucacaugguuuguucu

SEQ ID NO: 9143 - RNA, 18 nt, Homo sapiens
ucacucucaguuuuugug

SEQ ID NO: 9144 - RNA, 21 nt, Homo sapiens
uccaccaccgccuccuucccc

SEQ ID NO: 9145 - RNA, 20 nt, Homo sapiens
uggaggcguuuguaagggaa

SEQ ID NO: 9146 - RNA, 19 nt, Homo sapiens
uggaggugugggagaucgg

SEQ ID NO: 9147 - RNA, 22 nt, Homo sapiens
uggccuggcccuucccuucccc

SEQ ID NO: 9148 - RNA, 22 nt, Homo sapiens
uuuauuggugguaaaaagggau

SEQ ID NO: 9149 - RNA, 21 nt, Homo sapiens
cagccuagaaaguucuagcac

SEQ ID NO: 9150 - RNA, 22 nt, Homo sapiens
gcugaccgcgguggcagcggcg

SEQ ID NO: 9151 - RNA, 21 nt, Homo sapiens
ggcacuagacucagccuagaa

SEQ ID NO: 9152 - RNA, 21 nt, Homo sapiens
ggcggugagccugcacccggg

SEQ ID NO: 9153 - RNA, 21 nt, Homo sapiens
ucucauuuccaaacuggaucu

SEQ ID NO: 9154 - RNA, 18 nt, Homo sapiens
cacacggcagaugggcgg

SEQ ID NO: 9155 - RNA, 18 nt, Homo sapiens
caccgccccggccccucg

SEQ ID NO: 9156 - RNA, 14 nt, Homo sapiens
cagcaccaagccac

SEQ ID NO: 9157 - RNA, 19 nt, Homo sapiens
ccgccccggccccucgucc

SEQ ID NO: 9158 - RNA, 19 nt, Homo sapiens
gaggggcaggcgggcaggc

SEQ ID NO: 9159 - RNA, 17 nt, Homo sapiens
gccccggccccucgucc

SEQ ID NO: 9160 - RNA, 22 nt, Homo sapiens
gcggggcaggcgggcaggcugc

SEQ ID NO: 9161 - RNA, 20 nt, Homo sapiens
ggcaagacagacggcagacg

SEQ ID NO: 9162 - RNA, 17 nt, Homo sapiens
ggcaggcgggcaggcgg

SEQ ID NO: 9163 - RNA, 18 nt, Homo sapiens
aaacaggaaaaucuuuag

SEQ ID NO: 9164 - RNA, 18 nt, Homo sapiens
acauuacacacguguauc

SEQ ID NO: 9165 - RNA, 22 nt, Homo sapiens
acccaugagagagcugcacagg

SEQ ID NO: 9166 - RNA, 21 nt, Homo sapiens
agaccagccugggcaacauag

SEQ ID NO: 9167 - RNA, 19 nt, Homo sapiens
cacaguggaccacagguga

SEQ ID NO: 9168 - RNA, 16 nt, Homo sapiens
cagccugggcaacaua

SEQ ID NO: 9169 - RNA, 22 nt, Homo sapiens
cgcggggagggacaccgggguc

SEQ ID NO: 9170 - RNA, 19 nt, Homo sapiens
cuuuagagcucucauccca

SEQ ID NO: 9171 - RNA, 23 nt, Homo sapiens
gaaaacagcaaaugcaggaaaac

SEQ ID NO: 9172 - RNA, 20 nt, Homo sapiens
gggaggauugcuugagccca

SEQ ID NO: 9173 - RNA, 19 nt, Homo sapiens
ggggaaggagagcgcgggc

SEQ ID NO: 9174 - RNA, 19 nt, Homo sapiens
ggggagacagaggggcggg

SEQ ID NO: 9175 - RNA, 17 nt, Homo sapiens
uacuauacagaagcucu

SEQ ID NO: 9176 - RNA, 15 nt, Homo sapiens
uaggugcgauggcuc

SEQ ID NO: 9177 - RNA, 21 nt, Homo sapiens
uggagauacccugcaaguaga

SEQ ID NO: 9178 - RNA, 20 nt, Homo sapiens
uggcucuggggaguuagcuc

SEQ ID NO: 9179 - RNA, 15 nt, Homo sapiens
uuggauaaagugugg

SEQ ID NO: 9180 - RNA, 17 nt, Homo sapiens
accuaucauauaccaaa

SEQ ID NO: 9181 - RNA, 21 nt, Homo sapiens
agccaaguguuugccccauaa

SEQ ID NO: 9182 - RNA, 17 nt, Homo sapiens
agguccgggcccuucag

SEQ ID NO: 9183 - RNA, 15 nt, Homo sapiens
caaaaccucaagaca

SEQ ID NO: 9184 - RNA, 21 nt, Homo sapiens
ccuccgggaaagcccaggggc

SEQ ID NO: 9185 - RNA, 22 nt, Homo sapiens
cgcuggagggaacggugguggg

SEQ ID NO: 9186 - RNA, 17 nt, Homo sapiens
cuccugcaggcacggag

SEQ ID NO: 9187 - RNA, 17 nt, Homo sapiens
gcggcgcuggagggaac

SEQ ID NO: 9188 - RNA, 20 nt, Homo sapiens
gggggaauccggggaggggc

SEQ ID NO: 9189 - RNA, 24 nt, Homo sapiens
gguuguuuuuuuccacuaaauugg

SEQ ID NO: 9190 - RNA, 16 nt, Homo sapiens
guccauucuaaagagc

SEQ ID NO: 9191 - RNA, 15 nt, Homo sapiens
uagcacaacccaggg

SEQ ID NO: 9192 - RNA, 17 nt, Homo sapiens
uaguuuuccuuuuguga

SEQ ID NO: 9193 - RNA, 19 nt, Homo sapiens
agugcagggaaggguaaug

SEQ ID NO: 9194 - RNA, 24 nt, Homo sapiens
cagcaggcugaguaugggcuccuc

SEQ ID NO: 9195 - RNA, 18 nt, Homo sapiens
cgaggaggcaggugcugg

SEQ ID NO: 9196 - RNA, 19 nt, Homo sapiens
uccagcugcgcugcacagc

SEQ ID NO: 9197 - RNA, 20 nt, Homo sapiens
acccgcccccucggccccgc

SEQ ID NO: 9198 - RNA, 22 nt, Homo sapiens
accuagcgccagacccgccccc

SEQ ID NO: 9199 - RNA, 24 nt, Homo sapiens
cagcaggcugaguaugggcuccuc

SEQ ID NO: 9200 - RNA, 19 nt, Homo sapiens
ccucggccccgcugcgccc

SEQ ID NO: 9201 - RNA, 18 nt, Homo sapiens
cgaggaggcaggugcugg

SEQ ID NO: 9202 - RNA, 19 nt, Homo sapiens
gaccuccucugggguuccc

SEQ ID NO: 9203 - RNA, 19 nt, Homo sapiens
uccagcugcgcugcacagc

SEQ ID NO: 9204 - RNA, 18 nt, Homo sapiens
aagacguuaggaggggga

SEQ ID NO: 9205 - RNA, 17 nt, Homo sapiens
ccccaucagccuagccc

SEQ ID NO: 9206 - RNA, 18 nt, Homo sapiens
gauggaggacagugggga

SEQ ID NO: 9207 - RNA, 19 nt, Homo sapiens
uccccaucagccuagcccc

SEQ ID NO: 9208 - RNA, 18 nt, Homo sapiens
ugcucagcccccuucccc

SEQ ID NO: 9209 - RNA, 21 nt, Homo sapiens
ugcucagcccccuuccccauc

SEQ ID NO: 9210 - RNA, 20 nt, Homo sapiens
uguuagaagaaaggaagcca

SEQ ID NO: 9211 - RNA, 21 nt, Homo sapiens
cgacgcggugugggcagcagc

SEQ ID NO: 9212 - RNA, 16 nt, Homo sapiens
aagaaaacauggaauc

SEQ ID NO: 9213 - RNA, 19 nt, Homo sapiens
accgcggucggcggggcgg

SEQ ID NO: 9214 - RNA, 25 nt, Homo sapiens
ccucugcugcugcucgcgcggcgcc

SEQ ID NO: 9215 - RNA, 19 nt, Homo sapiens
cgcggggcgcugcggucgc

SEQ ID NO: 9216 - RNA, 21 nt, Homo sapiens
cggggaggcuccgagagugug

SEQ ID NO: 9217 - RNA, 17 nt, Homo sapiens
cucggcgcaucgccgug

SEQ ID NO: 9218 - RNA, 21 nt, Homo sapiens
cugcugcucgcgcggcgccgc

SEQ ID NO: 9219 - RNA, 21 nt, Homo sapiens
gaauggacacaucuuauuucc

SEQ ID NO: 9220 - RNA, 19 nt, Homo sapiens
gccgccgccgccucugcug

SEQ ID NO: 9221 - RNA, 21 nt, Homo sapiens
gcggccgaggcgguggcggcg

SEQ ID NO: 9222 - RNA, 20 nt, Homo sapiens
ggcgcugcggucgcgcccgg

SEQ ID NO: 9223 - RNA, 18 nt, Homo sapiens
gggcggggagggcugcgg

SEQ ID NO: 9224 - RNA, 16 nt, Homo sapiens
ucgcgcccggcggggc

SEQ ID NO: 9225 - RNA, 21 nt, Homo sapiens
ugcagcggccgaggcgguggc

SEQ ID NO: 9226 - RNA, 19 nt, Homo sapiens
ugcuuguucucaacaaagc

SEQ ID NO: 9227 - RNA, 17 nt, Homo sapiens
gcagaggcggcagcggc

SEQ ID NO: 9228 - RNA, 20 nt, Homo sapiens
guggaacacuaaacagauuu

SEQ ID NO: 9229 - RNA, 22 nt, Homo sapiens
uguuaggagaaaacuggaaccu

SEQ ID NO: 9230 - RNA, 19 nt, Homo sapiens
caggggacagcccagcgag

SEQ ID NO: 9231 - RNA, 17 nt, Homo sapiens
gggcccggcccagggcg

SEQ ID NO: 9232 - RNA, 20 nt, Homo sapiens
ugcgcggcuauguuuggguc

SEQ ID NO: 9233 - RNA, 16 nt, Homo sapiens
agucaccaaccuccug

SEQ ID NO: 9234 - RNA, 20 nt, Homo sapiens
cacugccacuuccaugaaaa

SEQ ID NO: 9235 - RNA, 23 nt, Homo sapiens
cagcuuauauuugcuuucagagg

SEQ ID NO: 9236 - RNA, 20 nt, Homo sapiens
cucuacaagagacaucauca

SEQ ID NO: 9237 - RNA, 22 nt, Homo sapiens
ucaauaacucugcugacccccu

SEQ ID NO: 9238 - RNA, 20 nt, Homo sapiens
uccacaauaacaaugcagac

SEQ ID NO: 9239 - RNA, 21 nt, Homo sapiens
uucaagaauuucaucaaaacu

SEQ ID NO: 9240 - RNA, 18 nt, Homo sapiens
uuucagagucaucucuac

SEQ ID NO: 9241 - RNA, 19 nt, Homo sapiens
cauuuuuccauacagcagu

SEQ ID NO: 9242 - RNA, 18 nt, Homo sapiens
gaaauguucaguugaaag

SEQ ID NO: 9243 - RNA, 18 nt, Homo sapiens
uaauuuauggagaucaga

SEQ ID NO: 9244 - RNA, 19 nt, Homo sapiens
uacuuugucuuuaauacau

SEQ ID NO: 9245 - RNA, 19 nt, Homo sapiens
uagaccagaguuauuaaua

SEQ ID NO: 9246 - RNA, 21 nt, Homo sapiens
uagcuuuccucuuuuaaagua

SEQ ID NO: 9247 - RNA, 21 nt, Homo sapiens
uaugaacuuguaugugagugu

SEQ ID NO: 9248 - RNA, 19 nt, Homo sapiens
uguaugugaguguuuuaca

SEQ ID NO: 9249 - RNA, 20 nt, Homo sapiens
acaugcugggauuauaggcu

SEQ ID NO: 9250 - RNA, 18 nt, Homo sapiens
aggucuucugaacaaugg

SEQ ID NO: 9251 - RNA, 18 nt, Homo sapiens
cugcagcuucugaaaccg

SEQ ID NO: 9252 - RNA, 19 nt, Homo sapiens
gagaaagcuguuaaagagg

SEQ ID NO: 9253 - RNA, 16 nt, Homo sapiens
ggguguuguggggcuu

SEQ ID NO: 9254 - RNA, 17 nt, Homo sapiens
gugugcaagcugcauaa

SEQ ID NO: 9255 - RNA, 16 nt, Homo sapiens
uacaaugagucugagg

SEQ ID NO: 9256 - RNA, 22 nt, Homo sapiens
uccaugugcuauacauauugug

SEQ ID NO: 9257 - RNA, 15 nt, Homo sapiens
ucuggagaaagcugu

SEQ ID NO: 9258 - RNA, 18 nt, Homo sapiens
uucugaacaaugguuucu

SEQ ID NO: 9259 - RNA, 16 nt, Homo sapiens
caccaggaaacagaag

SEQ ID NO: 9260 - RNA, 17 nt, Homo sapiens
cagaaguuaagaaaaca

SEQ ID NO: 9261 - RNA, 17 nt, Homo sapiens
ccccgccccccaccacc

SEQ ID NO: 9262 - RNA, 18 nt, Homo sapiens
gaaaucuucaguccugcg

SEQ ID NO: 9263 - RNA, 19 nt, Homo sapiens
ggugggcgucuaaagccgg

SEQ ID NO: 9264 - RNA, 20 nt, Homo sapiens
uaugcuaaguagugaaaucu

SEQ ID NO: 9265 - RNA, 23 nt, Homo sapiens
uauuaaacaagaccggacuauuu

SEQ ID NO: 9266 - RNA, 15 nt, Homo sapiens
ucaggguccuggaac

SEQ ID NO: 9267 - RNA, 23 nt, Homo sapiens
ugccuguaaucccagcacuuugg

SEQ ID NO: 9268 - RNA, 20 nt, Homo sapiens
uucacggacaacugggagag

SEQ ID NO: 9269 - RNA, 22 nt, Homo sapiens
uugagacauucguguguuuaau

SEQ ID NO: 9270 - RNA, 20 nt, Homo sapiens
ccgcgaacccgggaggcgga

SEQ ID NO: 9271 - RNA, 20 nt, Homo sapiens
cuccugagcuggaucagagc

SEQ ID NO: 9272 - RNA, 21 nt, Homo sapiens
uaucacagauaagaccagagg

SEQ ID NO: 9273 - RNA, 17 nt, Homo sapiens
uugggaggccgaggcgg

SEQ ID NO: 9274 - RNA, 18 nt, Homo sapiens
aucccguuccgaacagug

SEQ ID NO: 9275 - RNA, 18 nt, Homo sapiens
uccgaacaguggucagca

SEQ ID NO: 9276 - RNA, 17 nt, Homo sapiens
agaggcacauucucagg

SEQ ID NO: 9277 - RNA, 18 nt, Homo sapiens
agcggucgccgcggcggc

SEQ ID NO: 9278 - RNA, 22 nt, Homo sapiens
aggauaauuaccagguugggua

SEQ ID NO: 9279 - RNA, 21 nt, Homo sapiens
auuguaacacaacacuauauu

SEQ ID NO: 9280 - RNA, 19 nt, Homo sapiens
caaauuuccaggaugcuga

SEQ ID NO: 9281 - RNA, 15 nt, Homo sapiens
cacugucaugugccu

SEQ ID NO: 9282 - RNA, 17 nt, Homo sapiens
cgagaaacggacucggc

SEQ ID NO: 9283 - RNA, 26 nt, Homo sapiens
cggcagucggugcgcuggcgaagccg

SEQ ID NO: 9284 - RNA, 22 nt, Homo sapiens
gaagggagggagagcaaaaaua

SEQ ID NO: 9285 - RNA, 17 nt, Homo sapiens
gaccgugcgccccccgg

SEQ ID NO: 9286 - RNA, 21 nt, Homo sapiens
gaggaaggaagcguccuccgc

SEQ ID NO: 9287 - RNA, 21 nt, Homo sapiens
gcgcugcgcgccgcaaccucg

SEQ ID NO: 9288 - RNA, 16 nt, Homo sapiens
gcgcugcgcugcgcgc

SEQ ID NO: 9289 - RNA, 20 nt, Homo sapiens
ggauugcugaaggauuuucu

SEQ ID NO: 9290 - RNA, 19 nt, Homo sapiens
uaaaguguauauuuacugu

SEQ ID NO: 9291 - RNA, 19 nt, Homo sapiens
uauuacaucucauuauccu

SEQ ID NO: 9292 - RNA, 16 nt, Homo sapiens
ucguuggccccuaacu

SEQ ID NO: 9293 - RNA, 15 nt, Homo sapiens
ugcaaaugccaccug

SEQ ID NO: 9294 - RNA, 16 nt, Homo sapiens
ugcccuuguggcagac

SEQ ID NO: 9295 - RNA, 21 nt, Homo sapiens
ugugcuaugagcuugcccuga

SEQ ID NO: 9296 - RNA, 23 nt, Homo sapiens
uucacauucuaagggcccaauuc

SEQ ID NO: 9297 - RNA, 16 nt, Homo sapiens
acauggcugugacgga

SEQ ID NO: 9298 - RNA, 20 nt, Homo sapiens
agacggcuauagcagcauac

SEQ ID NO: 9299 - RNA, 16 nt, Homo sapiens
aucucacagcuuguuu

SEQ ID NO: 9300 - RNA, 15 nt, Homo sapiens
cagggucccgcugcc

SEQ ID NO: 9301 - RNA, 18 nt, Homo sapiens
gucguuccuuugaaacaa

SEQ ID NO: 9302 - RNA, 23 nt, Homo sapiens
ucagggcagacacgccagcggcc

SEQ ID NO: 9303 - RNA, 17 nt, Homo sapiens
ugaccgagauaggacgc

SEQ ID NO: 9304 - RNA, 21 nt, Homo sapiens
ugaggagggucguuccuuuga

SEQ ID NO: 9305 - RNA, 19 nt, Homo sapiens
ugagugaguuggauuucaa

SEQ ID NO: 9306 - RNA, 16 nt, Homo sapiens
uucccgggacuucugc

SEQ ID NO: 9307 - RNA, 17 nt, Homo sapiens
gagggccccggcgaagc

SEQ ID NO: 9308 - RNA, 14 nt, Homo sapiens
ggaagucaagcaga

SEQ ID NO: 9309 - RNA, 24 nt, Homo sapiens
ggaagugggaacgcggggaggugg

SEQ ID NO: 9310 - RNA, 18 nt, Homo sapiens
ggaggugaguggggggac

SEQ ID NO: 9311 - RNA, 19 nt, Homo sapiens
ggaggugaguggggggaca

SEQ ID NO: 9312 - RNA, 18 nt, Homo sapiens
ggguggacggcaagggag

SEQ ID NO: 9313 - RNA, 16 nt, Homo sapiens
ucgcgcuaggucaggg

SEQ ID NO: 9314 - RNA, 18 nt, Homo sapiens
gggcucgcagggaccagc

SEQ ID NO: 9315 - RNA, 18 nt, Homo sapiens
agccaccgccacuugucc

SEQ ID NO: 9316 - RNA, 17 nt, Homo sapiens
ccgcgggcugcgcucgg

SEQ ID NO: 9317 - RNA, 21 nt, Homo sapiens
gaggagggcagaucacuugag

SEQ ID NO: 9318 - RNA, 17 nt, Homo sapiens
gauccuaaagucugucu

SEQ ID NO: 9319 - RNA, 18 nt, Homo sapiens
gcuacuauuuuccuuuuc

SEQ ID NO: 9320 - RNA, 18 nt, Homo sapiens
ggugguccgcgggcugcg

SEQ ID NO: 9321 - RNA, 23 nt, Homo sapiens
uacaaaaauuugcuaggcauggu

SEQ ID NO: 9322 - RNA, 23 nt, Homo sapiens
uaucagcuguacuguuugcucuu

SEQ ID NO: 9323 - RNA, 18 nt, Homo sapiens
uauguaaacaaugcacug

SEQ ID NO: 9324 - RNA, 28 nt, Homo sapiens
ucgauggcucuucccuguuuccuugugc

SEQ ID NO: 9325 - RNA, 18 nt, Homo sapiens
agaagcaaugagaccugu

SEQ ID NO: 9326 - RNA, 19 nt, Homo sapiens
agcugucucccgcgggcag

SEQ ID NO: 9327 - RNA, 19 nt, Homo sapiens
gacugguucucaagugcuc

SEQ ID NO: 9328 - RNA, 16 nt, Homo sapiens
gagaggagagagaaag

SEQ ID NO: 9329 - RNA, 20 nt, Homo sapiens
gcagcguuaaaaugguaaca

SEQ ID NO: 9330 - RNA, 17 nt, Homo sapiens
gcgcgugcgcacacguu

SEQ ID NO: 9331 - RNA, 20 nt, Homo sapiens
ugcacagauucaggauccaa

SEQ ID NO: 9332 - RNA, 20 nt, Homo sapiens
acaaugcgagaaaagucauu

SEQ ID NO: 9333 - RNA, 23 nt, Homo sapiens
acccugugcacguaugugugugu

SEQ ID NO: 9334 - RNA, 17 nt, Homo sapiens
caccagcagcgccuccc

SEQ ID NO: 9335 - RNA, 24 nt, Homo sapiens
cgggcgcgaggcuaacggcgcgcg

SEQ ID NO: 9336 - RNA, 18 nt, Homo sapiens
gaaaguuucuguuaaagg

SEQ ID NO: 9337 - RNA, 21 nt, Homo sapiens
gcacgcacgugugugugcccu

SEQ ID NO: 9338 - RNA, 18 nt, Homo sapiens
gcucgcacgcacgugugu

SEQ ID NO: 9339 - RNA, 19 nt, Homo sapiens
uagaacaccagagucuaua

SEQ ID NO: 9340 - RNA, 16 nt, Homo sapiens
uaugugugugugugcu

SEQ ID NO: 9341 - RNA, 24 nt, Homo sapiens
ucccgcggcuccgugcuccccugc

SEQ ID NO: 9342 - RNA, 17 nt, Homo sapiens
uccgcgcuguacccgcc

SEQ ID NO: 9343 - RNA, 18 nt, Homo sapiens
ucucaaaccugaguaauu

SEQ ID NO: 9344 - RNA, 18 nt, Homo sapiens
uggccucccuccuccucc

SEQ ID NO: 9345 - RNA, 21 nt, Homo sapiens
uggcuguuuuuuuuuccuuuu

SEQ ID NO: 9346 - RNA, 17 nt, Homo sapiens
uuaaggcuucuuauagg

SEQ ID NO: 9347 - RNA, 19 nt, Homo sapiens
aaaauuauuauuccaaaua

SEQ ID NO: 9348 - RNA, 23 nt, Homo sapiens
aaaggaggaggaagggucgaggc

SEQ ID NO: 9349 - RNA, 18 nt, Homo sapiens
aaaguugguguucaccca

SEQ ID NO: 9350 - RNA, 22 nt, Homo sapiens
aaauggcucaauaccuuuuauu

SEQ ID NO: 9351 - RNA, 18 nt, Homo sapiens
aaccaguuuuaacaaccg

SEQ ID NO: 9352 - RNA, 20 nt, Homo sapiens
aagcuggaggacagggcagg

SEQ ID NO: 9353 - RNA, 19 nt, Homo sapiens
agaauagaugaaaguagaa

SEQ ID NO: 9354 - RNA, 21 nt, Homo sapiens
agagggcauuuauugcccuuu

SEQ ID NO: 9355 - RNA, 22 nt, Homo sapiens
aggcgugagccaccacaccggg

SEQ ID NO: 9356 - RNA, 21 nt, Homo sapiens
ccuaggcaaaggaggaggaag

SEQ ID NO: 9357 - RNA, 21 nt, Homo sapiens
cuuggucaucaucacccccac

SEQ ID NO: 9358 - RNA, 20 nt, Homo sapiens
gagacggagucuugcucugu

SEQ ID NO: 9359 - RNA, 20 nt, Homo sapiens
gaggcucaaguccuagguuc

SEQ ID NO: 9360 - RNA, 18 nt, Homo sapiens
gccaguguggagugaggg

SEQ ID NO: 9361 - RNA, 20 nt, Homo sapiens
gcccuuucuucuaguucgcu

SEQ ID NO: 9362 - RNA, 19 nt, Homo sapiens
ggaaggaugguucaugugu

SEQ ID NO: 9363 - RNA, 16 nt, Homo sapiens
ggagugacaugcuggu

SEQ ID NO: 9364 - RNA, 17 nt, Homo sapiens
ggcuucugcugcaaaau

SEQ ID NO: 9365 - RNA, 20 nt, Homo sapiens
uaaaagaucuucccaagccc

SEQ ID NO: 9366 - RNA, 22 nt, Homo sapiens
uaaaaugcaggauaauaacaaa

SEQ ID NO: 9367 - RNA, 21 nt, Homo sapiens
uccaggugaccucagggauaa

SEQ ID NO: 9368 - RNA, 25 nt, Homo sapiens
ucccuuuguucauugaagugaguuu

SEQ ID NO: 9369 - RNA, 18 nt, Homo sapiens
ucgaacuccugaccucug

SEQ ID NO: 9370 - RNA, 20 nt, Homo sapiens
ucuuagggaaagucucccag

SEQ ID NO: 9371 - RNA, 18 nt, Homo sapiens
ugaagugcccugggcugc

SEQ ID NO: 9372 - RNA, 19 nt, Homo sapiens
ugcaguggcccaaacucgg

SEQ ID NO: 9373 - RNA, 14 nt, Homo sapiens
ugcucuguugccag

SEQ ID NO: 9374 - RNA, 21 nt, Homo sapiens
ugcuggugggaaagcaugggc

SEQ ID NO: 9375 - RNA, 18 nt, Homo sapiens
uggaaggcauuaaaaguu

SEQ ID NO: 9376 - RNA, 17 nt, Homo sapiens
aagugggagccucccaa

SEQ ID NO: 9377 - RNA, 18 nt, Homo sapiens
agaguuagcugggacugg

SEQ ID NO: 9378 - RNA, 15 nt, Homo sapiens
cagaguaacaaagau

SEQ ID NO: 9379 - RNA, 19 nt, Homo sapiens
cccugacagcuucucccuc

SEQ ID NO: 9380 - RNA, 24 nt, Homo sapiens
ccgaggaaggaagcccuggcugag

SEQ ID NO: 9381 - RNA, 21 nt, Homo sapiens
ccucuuucuccaggcgcccug

SEQ ID NO: 9382 - RNA, 17 nt, Homo sapiens
cuguggacggggagggg

SEQ ID NO: 9383 - RNA, 19 nt, Homo sapiens
gcccuggcugagacauggg

SEQ ID NO: 9384 - RNA, 16 nt, Homo sapiens
gcccuguggagcugcc

SEQ ID NO: 9385 - RNA, 20 nt, Homo sapiens
ggagggaaggaggaggcugg

SEQ ID NO: 9386 - RNA, 18 nt, Homo sapiens
ggaggggucgggguaggg

SEQ ID NO: 9387 - RNA, 17 nt, Homo sapiens
ggccaucucuccagggc

SEQ ID NO: 9388 - RNA, 20 nt, Homo sapiens
ggccuguaagugcaggugcc

SEQ ID NO: 9389 - RNA, 17 nt, Homo sapiens
gggaacccaagguccuc

SEQ ID NO: 9390 - RNA, 21 nt, Homo sapiens
gggaaggaggaggcuggggca

SEQ ID NO: 9391 - RNA, 24 nt, Homo sapiens
gggaaguuugucaccuagaugagg

SEQ ID NO: 9392 - RNA, 23 nt, Homo sapiens
ggggcgguggcagcgcgcgcucu

SEQ ID NO: 9393 - RNA, 19 nt, Homo sapiens
guuuuggaaagcacgcuca

SEQ ID NO: 9394 - RNA, 21 nt, Homo sapiens
ucccugagcugcagaggagac

SEQ ID NO: 9395 - RNA, 21 nt, Homo sapiens
ugcagagaggauuaguagguu

SEQ ID NO: 9396 - RNA, 22 nt, Homo sapiens
uggacugaggacccucaacagg

SEQ ID NO: 9397 - RNA, 15 nt, Homo sapiens
uuggacagagcuugg

SEQ ID NO: 9398 - RNA, 26 nt, Homo sapiens
uaagaaaaaaguauaucaauuuugcc

SEQ ID NO: 9399 - RNA, 24 nt, Homo sapiens
acugcaguuucauccaucccaagg

SEQ ID NO: 9400 - RNA, 24 nt, Homo sapiens
gucaauuuugaaucuuugaaacca

SEQ ID NO: 9401 - RNA, 19 nt, Homo sapiens
cagagguaucauguggaug

SEQ ID NO: 9402 - RNA, 19 nt, Homo sapiens
gccgcggcaggugagggcg

SEQ ID NO: 9403 - RNA, 17 nt, Homo sapiens
ggcugggaggcugaccc

SEQ ID NO: 9404 - RNA, 23 nt, Homo sapiens
ucauuucaaaguuuuauaaaaau

SEQ ID NO: 9405 - RNA, 21 nt, Homo sapiens
cccgggagcaguccugacucu

SEQ ID NO: 9406 - RNA, 16 nt, Homo sapiens
ccggggccccggcugg

SEQ ID NO: 9407 - RNA, 19 nt, Homo sapiens
gaagugccacauggcugag

SEQ ID NO: 9408 - RNA, 23 nt, Homo sapiens
gaggggcggggcgccggggcggg

SEQ ID NO: 9409 - RNA, 17 nt, Homo sapiens
gagguccaaucuagggc

SEQ ID NO: 9410 - RNA, 19 nt, Homo sapiens
gccucccugcagcgguggu

SEQ ID NO: 9411 - RNA, 16 nt, Homo sapiens
gcuggucucggagggg

SEQ ID NO: 9412 - RNA, 17 nt, Homo sapiens
gggccagagcagggcca

SEQ ID NO: 9413 - RNA, 19 nt, Homo sapiens
ggggagcggccugaggagc

SEQ ID NO: 9414 - RNA, 23 nt, Homo sapiens
uaauacacaaugacgcaacugug

SEQ ID NO: 9415 - RNA, 19 nt, Homo sapiens
ugccccuggggugggggcc

SEQ ID NO: 9416 - RNA, 19 nt, Homo sapiens
ugggcuccgccugggcucc

SEQ ID NO: 9417 - RNA, 19 nt, Homo sapiens
acuuucauuucaagauauc

SEQ ID NO: 9418 - RNA, 21 nt, Homo sapiens
augcgacgguuggccaacggg

SEQ ID NO: 9419 - RNA, 19 nt, Homo sapiens
caacgcaacacaccugaac

SEQ ID NO: 9420 - RNA, 25 nt, Homo sapiens
ccggccccacucccgguuggccggg

SEQ ID NO: 9421 - RNA, 17 nt, Homo sapiens
cgcccggccccacuccc

SEQ ID NO: 9422 - RNA, 14 nt, Homo sapiens
cgggacacaccugc

SEQ ID NO: 9423 - RNA, 21 nt, Homo sapiens
cgggagcuucgggugcucgcg

SEQ ID NO: 9424 - RNA, 15 nt, Homo sapiens
cguccaguucuuucg

SEQ ID NO: 9425 - RNA, 16 nt, Homo sapiens
gggaaccucggcugcg

SEQ ID NO: 9426 - RNA, 18 nt, Homo sapiens
ggguggggucccgggcgu

SEQ ID NO: 9427 - RNA, 17 nt, Homo sapiens
uguaaaccccagugugg

SEQ ID NO: 9428 - RNA, 23 nt, Homo sapiens
uuaacggugguuggggccuagaa

SEQ ID NO: 9429 - RNA, 19 nt, Homo sapiens
uggggcaagucagacuuuc

SEQ ID NO: 9430 - RNA, 22 nt, Homo sapiens
aggaagugacccagggcaugga

SEQ ID NO: 9431 - RNA, 24 nt, Homo sapiens
cagaggggcugucgacacaacgug

SEQ ID NO: 9432 - RNA, 22 nt, Homo sapiens
ccccagcugcugggguuccccc

SEQ ID NO: 9433 - RNA, 23 nt, Homo sapiens
ccucggccucccaaaaugcuggg

SEQ ID NO: 9434 - RNA, 22 nt, Homo sapiens
ccuugggucacucccuuucucu

SEQ ID NO: 9435 - RNA, 18 nt, Homo sapiens
cucugugugugugugugu

SEQ ID NO: 9436 - RNA, 21 nt, Homo sapiens
cugugugugugugugugugua

SEQ ID NO: 9437 - RNA, 21 nt, Homo sapiens
gcugggguucccccuuggugg

SEQ ID NO: 9438 - RNA, 16 nt, Homo sapiens
gguuccuccccacagc

SEQ ID NO: 9439 - RNA, 18 nt, Homo sapiens
guucacugaagccaguga

SEQ ID NO: 9440 - RNA, 19 nt, Homo sapiens
guugugggguccugugggc

SEQ ID NO: 9441 - RNA, 23 nt, Homo sapiens
uccccuccccugcucccaggcuc

SEQ ID NO: 9442 - RNA, 24 nt, Homo sapiens
ucuguguucacugaagccagugac

SEQ ID NO: 9443 - RNA, 22 nt, Homo sapiens
ugagauucuugggccaaaaagc

SEQ ID NO: 9444 - RNA, 18 nt, Homo sapiens
ugugugugugugugugug

SEQ ID NO: 9445 - RNA, 17 nt, Homo sapiens
ugagggaugguuucaac

SEQ ID NO: 9446 - RNA, 19 nt, Homo sapiens
aaaauccaacaauaagaag

SEQ ID NO: 9447 - RNA, 19 nt, Homo sapiens
aaagggauuuucuuuucuu

SEQ ID NO: 9448 - RNA, 17 nt, Homo sapiens
aacgcaggaggcggagg

SEQ ID NO: 9449 - RNA, 17 nt, Homo sapiens
acaaaaacagucagugu

SEQ ID NO: 9450 - RNA, 20 nt, Homo sapiens
acaguuuggcaguguuuugu

SEQ ID NO: 9451 - RNA, 16 nt, Homo sapiens
accccgccucuaucaa

SEQ ID NO: 9452 - RNA, 18 nt, Homo sapiens
cauuccuuuuuauggcug

SEQ ID NO: 9453 - RNA, 19 nt, Homo sapiens
cccgaacgcaggaggcgga

SEQ ID NO: 9454 - RNA, 17 nt, Homo sapiens
ccgcacaagcgucuuuc

SEQ ID NO: 9455 - RNA, 22 nt, Homo sapiens
ucguuugggcuacugugaauag

SEQ ID NO: 9456 - RNA, 18 nt, Homo sapiens
ucuguggaguuugcaggg

SEQ ID NO: 9457 - RNA, 18 nt, Homo sapiens
ucuuucauucaguaucau

SEQ ID NO: 9458 - RNA, 17 nt, Homo sapiens
ucuuuucuuuucuuucu

SEQ ID NO: 9459 - RNA, 16 nt, Homo sapiens
uggcaccaccccagcc

SEQ ID NO: 9460 - RNA, 19 nt, Homo sapiens
uguauggauggaccauauu

SEQ ID NO: 9461 - RNA, 19 nt, Homo sapiens
cuuucccggcuccgucggc

SEQ ID NO: 9462 - RNA, 17 nt, Homo sapiens
agcugcaaguucuaaau

SEQ ID NO: 9463 - RNA, 16 nt, Homo sapiens
gggaaaaaggggugca

SEQ ID NO: 9464 - RNA, 17 nt, Homo sapiens
ucucaggguucuugugu

SEQ ID NO: 9465 - RNA, 25 nt, Homo sapiens
uucguccugcaggucagucucaggg

SEQ ID NO: 9466 - RNA, 20 nt, Homo sapiens
aagaaauggacgcuaacgag

SEQ ID NO: 9467 - RNA, 20 nt, Homo sapiens
agggcucagaggcagcugcu

SEQ ID NO: 9468 - RNA, 22 nt, Homo sapiens
cagacagacaauuuggacuggg

SEQ ID NO: 9469 - RNA, 19 nt, Homo sapiens
cgaagagguuucagugugg

SEQ ID NO: 9470 - RNA, 16 nt, Homo sapiens
cugcugccccacgcca

SEQ ID NO: 9471 - RNA, 18 nt, Homo sapiens
gcgcauccugccaugauc

SEQ ID NO: 9472 - RNA, 18 nt, Homo sapiens
ucuagaggaaaagggaaa

SEQ ID NO: 9473 - RNA, 17 nt, Homo sapiens
uggcuuucauauuacug

SEQ ID NO: 9474 - RNA, 30 nt, Homo sapiens
uguauauauuuuuuuauuauuuuuuugugc

SEQ ID NO: 9475 - RNA, 21 nt, Homo sapiens
agaaauuuacacaaaauugca

SEQ ID NO: 9476 - RNA, 19 nt, Homo sapiens
aggcugucucccauuuuuc

SEQ ID NO: 9477 - RNA, 20 nt, Homo sapiens
ccucuugagcccagucggau

SEQ ID NO: 9478 - RNA, 22 nt, Homo sapiens
guauagaucagaaauaaaguau

SEQ ID NO: 9479 - RNA, 21 nt, Homo sapiens
uggauuuauugguuuaucucu

SEQ ID NO: 9480 - RNA, 18 nt, Homo sapiens
cgaguccagcaaucuucc

SEQ ID NO: 9481 - RNA, 18 nt, Homo sapiens
gcagaaaaaaaaaagugg

SEQ ID NO: 9482 - RNA, 18 nt, Homo sapiens
caagauacaugaaauuag

SEQ ID NO: 9483 - RNA, 19 nt, Homo sapiens
uaaaaugcucuuguuguca

SEQ ID NO: 9484 - RNA, 24 nt, Homo sapiens
ugauuucaaccccauuccuuggga

SEQ ID NO: 9485 - RNA, 21 nt, Homo sapiens
uuuaaaauauaguuucuccaa

SEQ ID NO: 9486 - RNA, 23 nt, Homo sapiens
aacacaaucucucucucucucca

SEQ ID NO: 9487 - RNA, 17 nt, Homo sapiens
agcggcugggcgguugg

SEQ ID NO: 9488 - RNA, 24 nt, Homo sapiens
cagagcggcugggcgguuggcgcu

SEQ ID NO: 9489 - RNA, 22 nt, Homo sapiens
cagaggcugcgggcgauggucc

SEQ ID NO: 9490 - RNA, 18 nt, Homo sapiens
ccccaaguuugauacucu

SEQ ID NO: 9491 - RNA, 15 nt, Homo sapiens
ccuggaccucgcguu

SEQ ID NO: 9492 - RNA, 23 nt, Homo sapiens
cgccgcgcgggcgggcagccgga

SEQ ID NO: 9493 - RNA, 17 nt, Homo sapiens
cucaggccaagcgcgcc

SEQ ID NO: 9494 - RNA, 22 nt, Homo sapiens
cugagaaaauuccacaacuucc

SEQ ID NO: 9495 - RNA, 16 nt, Homo sapiens
gagcucuggcucaggu

SEQ ID NO: 9496 - RNA, 17 nt, Homo sapiens
gcgagagcuggcccggc

SEQ ID NO: 9497 - RNA, 22 nt, Homo sapiens
gcgccgcgcgggcgggcagccg

SEQ ID NO: 9498 - RNA, 22 nt, Homo sapiens
gcugcggcugagggacugcggu

SEQ ID NO: 9499 - RNA, 19 nt, Homo sapiens
gggaaaaggcgagggcaaa

SEQ ID NO: 9500 - RNA, 18 nt, Homo sapiens
gggcgguuggcgcugccg

SEQ ID NO: 9501 - RNA, 19 nt, Homo sapiens
ucaauccagguccuaacgu

SEQ ID NO: 9502 - RNA, 18 nt, Homo sapiens
ucucaggccaagcgcgcc

SEQ ID NO: 9503 - RNA, 19 nt, Homo sapiens
uguccagggucucucagcc

SEQ ID NO: 9504 - RNA, 18 nt, Homo sapiens
uguguguaggagcagaga

SEQ ID NO: 9505 - RNA, 18 nt, Homo sapiens
uuuccaggaauuaaacag

SEQ ID NO: 9506 - RNA, 18 nt, Homo sapiens
caccggcccagccccccg

SEQ ID NO: 9507 - RNA, 15 nt, Homo sapiens
caucuagcggcccgg

SEQ ID NO: 9508 - RNA, 24 nt, Homo sapiens
ccaccggcugccugggcgcgggga

SEQ ID NO: 9509 - RNA, 23 nt, Homo sapiens
ccgccgcgucccucuccaccggc

SEQ ID NO: 9510 - RNA, 24 nt, Homo sapiens
ccgccgcgugccgcgccccggccg

SEQ ID NO: 9511 - RNA, 18 nt, Homo sapiens
ccgcgccccggccgcccc

SEQ ID NO: 9512 - RNA, 19 nt, Homo sapiens
ccgcugucucugcgccucg

SEQ ID NO: 9513 - RNA, 21 nt, Homo sapiens
ccuaucuacuggccccacucc

SEQ ID NO: 9514 - RNA, 20 nt, Homo sapiens
cgccccggccgccccgcugu

SEQ ID NO: 9515 - RNA, 18 nt, Homo sapiens
cgccgcccgcaccggccc

SEQ ID NO: 9516 - RNA, 17 nt, Homo sapiens
aagccaccccaaggagg

SEQ ID NO: 9517 - RNA, 23 nt, Homo sapiens
accccaaggaggggagggauaca

SEQ ID NO: 9518 - RNA, 25 nt, Homo sapiens
acuucguuuucauauuguuuguugc

SEQ ID NO: 9519 - RNA, 18 nt, Homo sapiens
agccucaggcugcagccc

SEQ ID NO: 9520 - RNA, 21 nt, Homo sapiens
aguugauuuuugcacauagug

SEQ ID NO: 9521 - RNA, 16 nt, Homo sapiens
caccuucuugauaggg

SEQ ID NO: 9522 - RNA, 16 nt, Homo sapiens
caggcugcagcccugg

SEQ ID NO: 9523 - RNA, 19 nt, Homo sapiens
cgguuggaauccccucgcc

SEQ ID NO: 9524 - RNA, 20 nt, Homo sapiens
cugugugcgugugugugugu

SEQ ID NO: 9525 - RNA, 26 nt, Homo sapiens
gcgcggacggcgucuggaugcggcgc

SEQ ID NO: 9526 - RNA, 20 nt, Homo sapiens
gcgugugugugugugccuug

SEQ ID NO: 9527 - RNA, 17 nt, Homo sapiens
gcugugugcgugugugu

SEQ ID NO: 9528 - RNA, 19 nt, Homo sapiens
gguuguuuccacuuuuugg

SEQ ID NO: 9529 - RNA, 23 nt, Homo sapiens
uauguuucuuucuaagauuuuau

SEQ ID NO: 9530 - RNA, 15 nt, Homo sapiens
ucaaggcuuauuugg

SEQ ID NO: 9531 - RNA, 20 nt, Homo sapiens
uccacccuccucugagccac

SEQ ID NO: 9532 - RNA, 18 nt, Homo sapiens
ugaguacuucauuucuuu

SEQ ID NO: 9533 - RNA, 21 nt, Homo sapiens
ugugcgugugugugugugugu

SEQ ID NO: 9534 - RNA, 18 nt, Homo sapiens
ugugugcgugugugugug

SEQ ID NO: 9535 - RNA, 18 nt, Homo sapiens
ugugugugugugugugug

SEQ ID NO: 9536 - RNA, 19 nt, Homo sapiens
ugugugugugugugugugu

SEQ ID NO: 9537 - RNA, 16 nt, Homo sapiens
uugcauuucuuuauga

SEQ ID NO: 9538 - RNA, 19 nt, Homo sapiens
uuuacuucuucuuuuccua

SEQ ID NO: 9539 - RNA, 19 nt, Homo sapiens
gucauuguugucacaacac

SEQ ID NO: 9540 - RNA, 17 nt, Homo sapiens
ugggacgagagggcggc

SEQ ID NO: 9541 - RNA, 20 nt, Homo sapiens
acaggccacaggccgugcug

SEQ ID NO: 9542 - RNA, 23 nt, Homo sapiens
agagagguucccuggguuuccgg

SEQ ID NO: 9543 - RNA, 20 nt, Homo sapiens
cacaaugagcccacgacagg

SEQ ID NO: 9544 - RNA, 16 nt, Homo sapiens
ccggcuccgucccucc

SEQ ID NO: 9545 - RNA, 21 nt, Homo sapiens
cggcagcgcccgggucuggcu

SEQ ID NO: 9546 - RNA, 20 nt, Homo sapiens
cgggggugaacggacggugu

SEQ ID NO: 9547 - RNA, 17 nt, Homo sapiens
gcagccaccagcuccuc

SEQ ID NO: 9548 - RNA, 19 nt, Homo sapiens
gcugcugggugugcagccc

SEQ ID NO: 9549 - RNA, 18 nt, Homo sapiens
gucauggcgacacugcag

SEQ ID NO: 9550 - RNA, 19 nt, Homo sapiens
ucggaggcgugcgcugcug

SEQ ID NO: 9551 - RNA, 14 nt, Homo sapiens
ugccuugaacaggc

SEQ ID NO: 9552 - RNA, 20 nt, Homo sapiens
ugcuguagagaggccagugg

SEQ ID NO: 9553 - RNA, 18 nt, Homo sapiens
acagcuucuguugaaggc

SEQ ID NO: 9554 - RNA, 18 nt, Homo sapiens
agcuucuguugaaggcuu

SEQ ID NO: 9555 - RNA, 17 nt, Homo sapiens
uggcuggccugggccug

SEQ ID NO: 9556 - RNA, 18 nt, Homo sapiens
agcucuuuuaggcaaguc

SEQ ID NO: 9557 - RNA, 17 nt, Homo sapiens
cccuucuuuucugcucc

SEQ ID NO: 9558 - RNA, 18 nt, Homo sapiens
gcuuuaccauccauugcc

SEQ ID NO: 9559 - RNA, 23 nt, Homo sapiens
ucgaacuccuaaccucaggugau

SEQ ID NO: 9560 - RNA, 19 nt, Homo sapiens
ugggugggaaagugaagca

SEQ ID NO: 9561 - RNA, 22 nt, Homo sapiens
agcuccccgcucccuggcagcc

SEQ ID NO: 9562 - RNA, 16 nt, Homo sapiens
cagugggugucaggug

SEQ ID NO: 9563 - RNA, 26 nt, Homo sapiens
cuccccgcucccuggcagccaccugg

SEQ ID NO: 9564 - RNA, 18 nt, Homo sapiens
cugaugacaucaaacacu

SEQ ID NO: 9565 - RNA, 18 nt, Homo sapiens
ggggaggucccagggggc

SEQ ID NO: 9566 - RNA, 23 nt, Homo sapiens
uccccuccccacacauagggcuc

SEQ ID NO: 9567 - RNA, 19 nt, Homo sapiens
uccugauggauggugcuga

SEQ ID NO: 9568 - RNA, 24 nt, Homo sapiens
ugcugaugacaucaaacacuuugg

SEQ ID NO: 9569 - RNA, 18 nt, Homo sapiens
ccccuuuucuccuccccc

SEQ ID NO: 9570 - RNA, 17 nt, Homo sapiens
ggggcgggggagggcgg

SEQ ID NO: 9571 - RNA, 18 nt, Homo sapiens
gggucgggggcgggggag

SEQ ID NO: 9572 - RNA, 18 nt, Homo sapiens
cugguugcuuccugaagu

SEQ ID NO: 9573 - RNA, 18 nt, Homo sapiens
gcgcuccuuggaacggcc

SEQ ID NO: 9574 - RNA, 18 nt, Homo sapiens
ugaugaugucucucacuc

SEQ ID NO: 9575 - RNA, 21 nt, Homo sapiens
uugcuacuucuauaaucuuuu

SEQ ID NO: 9576 - RNA, 19 nt, Homo sapiens
ggagaguacagugugagau

SEQ ID NO: 9577 - RNA, 17 nt, Homo sapiens
cuuaggagccucucuca

SEQ ID NO: 9578 - RNA, 18 nt, Homo sapiens
ucggaacauugguaucca

SEQ ID NO: 9579 - RNA, 20 nt, Homo sapiens
uggcccuggggguccgccaa

SEQ ID NO: 9580 - RNA, 18 nt, Homo sapiens
uggccuggccucaaaucc

SEQ ID NO: 9581 - RNA, 20 nt, Homo sapiens
aguaaauuuuuguggauuug

SEQ ID NO: 9582 - RNA, 18 nt, Homo sapiens
caguguccucuguuccca

SEQ ID NO: 9583 - RNA, 20 nt, Homo sapiens
cuaggguaaaaggaagagga

SEQ ID NO: 9584 - RNA, 25 nt, Homo sapiens
gagaacaaggggcaagcggcacugg

SEQ ID NO: 9585 - RNA, 17 nt, Homo sapiens
guuuucucugaugcaaa

SEQ ID NO: 9586 - RNA, 18 nt, Homo sapiens
ugagugagucuuuugaug

SEQ ID NO: 9587 - RNA, 14 nt, Homo sapiens
uugcuaaugcacug

SEQ ID NO: 9588 - RNA, 20 nt, Homo sapiens
uuguguucagaaguuuugug

SEQ ID NO: 9589 - RNA, 15 nt, Homo sapiens
aggccacagccaggc

SEQ ID NO: 9590 - RNA, 15 nt, Homo sapiens
gaagaaagaugaggg

SEQ ID NO: 9591 - RNA, 16 nt, Homo sapiens
gcccucucccccuccc

SEQ ID NO: 9592 - RNA, 20 nt, Homo sapiens
gcucccggcuccccgaugcc

SEQ ID NO: 9593 - RNA, 16 nt, Homo sapiens
gucggggugucccagc

SEQ ID NO: 9594 - RNA, 16 nt, Homo sapiens
gucuccuggcagaacu

SEQ ID NO: 9595 - RNA, 22 nt, Homo sapiens
ccugauauaaaauucaaguacu

SEQ ID NO: 9596 - RNA, 18 nt, Homo sapiens
guguucccuuaguaacac

SEQ ID NO: 9597 - RNA, 20 nt, Homo sapiens
uuuuauaauuuucuaacaca

SEQ ID NO: 9598 - RNA, 21 nt, Homo sapiens
agcugggcugggggugacgcc

SEQ ID NO: 9599 - RNA, 17 nt, Homo sapiens
ccgcaccccacgugccc

SEQ ID NO: 9600 - RNA, 18 nt, Homo sapiens
ggaggaggggaagguggc

SEQ ID NO: 9601 - RNA, 19 nt, Homo sapiens
gcaaggggcuuuggggucg

SEQ ID NO: 9602 - RNA, 18 nt, Homo sapiens
gcggcucuucuuccccuc

SEQ ID NO: 9603 - RNA, 20 nt, Homo sapiens
ggaggcggcagcagggcagg

SEQ ID NO: 9604 - RNA, 21 nt, Homo sapiens
ggggagagcaaggggcuuugg

SEQ ID NO: 9605 - RNA, 15 nt, Homo sapiens
ucucucggucgcggc

SEQ ID NO: 9606 - RNA, 16 nt, Homo sapiens
gagcgguggcagcggc

SEQ ID NO: 9607 - RNA, 19 nt, Homo sapiens
gcgcuaccggcacgggcgc

SEQ ID NO: 9608 - RNA, 22 nt, Homo sapiens
acagccauuuuuuuuuucuuaa

SEQ ID NO: 9609 - RNA, 19 nt, Homo sapiens
cacgagcacccaccccggc

SEQ ID NO: 9610 - RNA, 24 nt, Homo sapiens
ccgccgcgcugcaaaccgcucggc

SEQ ID NO: 9611 - RNA, 19 nt, Homo sapiens
ccgccgcugccgccagccc

SEQ ID NO: 9612 - RNA, 18 nt, Homo sapiens
gagcacgccucccgguuc

SEQ ID NO: 9613 - RNA, 20 nt, Homo sapiens
gcgacuguaaacguacaaua

SEQ ID NO: 9614 - RNA, 21 nt, Homo sapiens
ggagaaauauccacaggaaaa

SEQ ID NO: 9615 - RNA, 20 nt, Homo sapiens
guugccacuuuuuuuaggau

SEQ ID NO: 9616 - RNA, 22 nt, Homo sapiens
uacaaaugcaacucuuuucugu

SEQ ID NO: 9617 - RNA, 19 nt, Homo sapiens
ucaaaggcauuaagcauuu

SEQ ID NO: 9618 - RNA, 24 nt, Homo sapiens
uggaaggaugagaauucuguaagu

SEQ ID NO: 9619 - RNA, 17 nt, Homo sapiens
uuucacaagguuugcua

SEQ ID NO: 9620 - RNA, 18 nt, Homo sapiens
uuugguguaucuuaaauc

SEQ ID NO: 9621 - RNA, 19 nt, Homo sapiens
ggcagccagcuguucccgg

SEQ ID NO: 9622 - RNA, 16 nt, Homo sapiens
ugagcccaggagucug

SEQ ID NO: 9623 - RNA, 19 nt, Homo sapiens
ugccugggcaacauaggga

SEQ ID NO: 9624 - RNA, 22 nt, Homo sapiens
uggaacggaucauuaaggaccu

SEQ ID NO: 9625 - RNA, 24 nt, Homo sapiens
uaaccaaucauuccauuagucaag

SEQ ID NO: 9626 - RNA, 22 nt, Homo sapiens
uuccugcacgaggacaugaagc

SEQ ID NO: 9627 - RNA, 18 nt, Homo sapiens
caucggggagaacuaggu

SEQ ID NO: 9628 - RNA, 19 nt, Homo sapiens
gacuacaggcgugugccac

SEQ ID NO: 9629 - RNA, 22 nt, Homo sapiens
gccuguagcaggggcagcggcu

SEQ ID NO: 9630 - RNA, 20 nt, Homo sapiens
ggaaugaucagcugguccug

SEQ ID NO: 9631 - RNA, 18 nt, Homo sapiens
uggccaggauggucucga

SEQ ID NO: 9632 - RNA, 20 nt, Homo sapiens
cagcuucagcccuggggagu

SEQ ID NO: 9633 - RNA, 21 nt, Homo sapiens
gggcaggggugcuuuggcggg

SEQ ID NO: 9634 - RNA, 18 nt, Homo sapiens
ggggagccggggcagggg

SEQ ID NO: 9635 - RNA, 22 nt, Homo sapiens
ggggagccggggcaggggcucg

SEQ ID NO: 9636 - RNA, 20 nt, Homo sapiens
ggguccccaucaccggccgc

SEQ ID NO: 9637 - RNA, 18 nt, Homo sapiens
cagcuuaaauguuuguau

SEQ ID NO: 9638 - RNA, 19 nt, Homo sapiens
ccuggaaaagagaugcgcc

SEQ ID NO: 9639 - RNA, 19 nt, Homo sapiens
uuguaacauuucagaugag

SEQ ID NO: 9640 - RNA, 24 nt, Homo sapiens
acgcggcgcgggcggcggcggagg

SEQ ID NO: 9641 - RNA, 23 nt, Homo sapiens
acuccgcugcugggaccgcggcc

SEQ ID NO: 9642 - RNA, 19 nt, Homo sapiens
caaaauuccucaucugcug

SEQ ID NO: 9643 - RNA, 23 nt, Homo sapiens
cagcgggagggggcagacgcggc

SEQ ID NO: 9644 - RNA, 21 nt, Homo sapiens
ccgcugcugggaccgcggccg

SEQ ID NO: 9645 - RNA, 19 nt, Homo sapiens
cgcggcgcgggcggcggcg

SEQ ID NO: 9646 - RNA, 22 nt, Homo sapiens
cgggcggcggcggaggucggcg

SEQ ID NO: 9647 - RNA, 16 nt, Homo sapiens
gcgcgggcggcggcgg

SEQ ID NO: 9648 - RNA, 18 nt, Homo sapiens
gcugccccccauggugcg

SEQ ID NO: 9649 - RNA, 17 nt, Homo sapiens
ggaaacaggacauaaca

SEQ ID NO: 9650 - RNA, 19 nt, Homo sapiens
gggauggcguccagagagc

SEQ ID NO: 9651 - RNA, 24 nt, Homo sapiens
ugcugggaccgcggccgcggcggc

SEQ ID NO: 9652 - RNA, 20 nt, Homo sapiens
aguggcugucgauuuuugga

SEQ ID NO: 9653 - RNA, 18 nt, Homo sapiens
gcagcagcgguggcagcc

SEQ ID NO: 9654 - RNA, 19 nt, Homo sapiens
ggacccgccuccaaccugc

SEQ ID NO: 9655 - RNA, 24 nt, Homo sapiens
ggaggacagcguucaggugugagg

SEQ ID NO: 9656 - RNA, 19 nt, Homo sapiens
ugcuggauuucuuacucgc

SEQ ID NO: 9657 - RNA, 24 nt, Homo sapiens
auugugucuaccucccauuggcaa

SEQ ID NO: 9658 - RNA, 16 nt, Homo sapiens
cacauggccaggguga

SEQ ID NO: 9659 - RNA, 17 nt, Homo sapiens
ccugaaucugacaauag

SEQ ID NO: 9660 - RNA, 21 nt, Homo sapiens
guuguuauaacaaaccaucau

SEQ ID NO: 9661 - RNA, 17 nt, Homo sapiens
ucaugaccaugcaugug

SEQ ID NO: 9662 - RNA, 20 nt, Homo sapiens
ugacaagaaugggcccauuc

SEQ ID NO: 9663 - RNA, 24 nt, Homo sapiens
ugagaaagagccuuuguuucucua

SEQ ID NO: 9664 - RNA, 21 nt, Homo sapiens
gagauggauggggaauccagg

SEQ ID NO: 9665 - RNA, 19 nt, Homo sapiens
ugcagcagccuccccuucc

SEQ ID NO: 9666 - RNA, 17 nt, Homo sapiens
aaaauauagcaaauaau

SEQ ID NO: 9667 - RNA, 14 nt, Homo sapiens
aaggcaauucuaac

SEQ ID NO: 9668 - RNA, 15 nt, Homo sapiens
aagggacuccuuugg

SEQ ID NO: 9669 - RNA, 16 nt, Homo sapiens
agcaauggggcaaucu

SEQ ID NO: 9670 - RNA, 17 nt, Homo sapiens
aggaggcggcagugggg

SEQ ID NO: 9671 - RNA, 24 nt, Homo sapiens
cccuugggaaugugagcccagugu

SEQ ID NO: 9672 - RNA, 16 nt, Homo sapiens
gagcugagaucgugcc

SEQ ID NO: 9673 - RNA, 15 nt, Homo sapiens
gccagcucccuguga

SEQ ID NO: 9674 - RNA, 16 nt, Homo sapiens
ggcaggcugggcagag

SEQ ID NO: 9675 - RNA, 22 nt, Homo sapiens
ggggcuggcggggcuggcggcc

SEQ ID NO: 9676 - RNA, 19 nt, Homo sapiens
uaaucacaaugguaaggaa

SEQ ID NO: 9677 - RNA, 18 nt, Homo sapiens
uccaucuggagaacaggc

SEQ ID NO: 9678 - RNA, 15 nt, Homo sapiens
ugagaguaacgaggu

SEQ ID NO: 9679 - RNA, 23 nt, Homo sapiens
ugccuguaauccuagcacuuugg

SEQ ID NO: 9680 - RNA, 19 nt, Homo sapiens
uggcggggcuggcggccug

SEQ ID NO: 9681 - RNA, 18 nt, Homo sapiens
uggugaagccgagagcac

SEQ ID NO: 9682 - RNA, 24 nt, Homo sapiens
uucauucuugccacugagcuuaaa

SEQ ID NO: 9683 - RNA, 17 nt, Homo sapiens
uugggaggccgaggcgg

SEQ ID NO: 9684 - RNA, 17 nt, Homo sapiens
agcaguccugagcugag

SEQ ID NO: 9685 - RNA, 18 nt, Homo sapiens
cccucuucccaaaagaaa

SEQ ID NO: 9686 - RNA, 22 nt, Homo sapiens
cggcgggcagggcgcggcgcgg

SEQ ID NO: 9687 - RNA, 22 nt, Homo sapiens
gaggaguuccuggacgugcucc

SEQ ID NO: 9688 - RNA, 20 nt, Homo sapiens
gccaggcuugauuccaaugc

SEQ ID NO: 9689 - RNA, 19 nt, Homo sapiens
gcgcggggguaggcuuugc

SEQ ID NO: 9690 - RNA, 20 nt, Homo sapiens
gcuuuucacuuaaaauaagu

SEQ ID NO: 9691 - RNA, 17 nt, Homo sapiens
gucauugcuacuuuugc

SEQ ID NO: 9692 - RNA, 21 nt, Homo sapiens
uacagauuuaaauccaagaca

SEQ ID NO: 9693 - RNA, 18 nt, Homo sapiens
uacuuuugcaaugugaua

SEQ ID NO: 9694 - RNA, 21 nt, Homo sapiens
ucagagagguaaccccaaaga

SEQ ID NO: 9695 - RNA, 20 nt, Homo sapiens
ugacaaugagauguggaaaa

SEQ ID NO: 9696 - RNA, 22 nt, Homo sapiens
uggcuaaaagaagaaaagaaaa

SEQ ID NO: 9697 - RNA, 21 nt, Homo sapiens
uuaguuacuucuaaugcauca

SEQ ID NO: 9698 - RNA, 20 nt, Homo sapiens
uucgcauacacaacccaaau

SEQ ID NO: 9699 - RNA, 17 nt, Homo sapiens
aaaugugcuuaaaauga

SEQ ID NO: 9700 - RNA, 21 nt, Homo sapiens
acccaguggucaggcagaggg

SEQ ID NO: 9701 - RNA, 20 nt, Homo sapiens
acuguccagugugugugugu

SEQ ID NO: 9702 - RNA, 23 nt, Homo sapiens
agagaaaagccggggcggagggc

SEQ ID NO: 9703 - RNA, 20 nt, Homo sapiens
cagugugugugugugccuug

SEQ ID NO: 9704 - RNA, 19 nt, Homo sapiens
ccaggucugggaaaacucu

SEQ ID NO: 9705 - RNA, 15 nt, Homo sapiens
ccucggggcaugggg

SEQ ID NO: 9706 - RNA, 19 nt, Homo sapiens
ccucugacgucagcccagg

SEQ ID NO: 9707 - RNA, 21 nt, Homo sapiens
cgggggugggggcagcucggg

SEQ ID NO: 9708 - RNA, 18 nt, Homo sapiens
cugucccacccccucugc

SEQ ID NO: 9709 - RNA, 19 nt, Homo sapiens
gaggaggagaacugggggg

SEQ ID NO: 9710 - RNA, 18 nt, Homo sapiens
gccccaaccccuggugaa

SEQ ID NO: 9711 - RNA, 18 nt, Homo sapiens
gggcccuugcucugcccu

SEQ ID NO: 9712 - RNA, 19 nt, Homo sapiens
gggggugcugguggcugag

SEQ ID NO: 9713 - RNA, 21 nt, Homo sapiens
gugucugggggcccuaugggg

SEQ ID NO: 9714 - RNA, 16 nt, Homo sapiens
guguuugugugugugc

SEQ ID NO: 9715 - RNA, 22 nt, Homo sapiens
uccaguguguguguguuugugu

SEQ ID NO: 9716 - RNA, 18 nt, Homo sapiens
ugaggaggagaacugggg

SEQ ID NO: 9717 - RNA, 18 nt, Homo sapiens
uuugugugugugcgcacg

SEQ ID NO: 9718 - RNA, 16 nt, Homo sapiens
uuguacacucgagggg

SEQ ID NO: 9719 - RNA, 25 nt, Homo sapiens
acccgcccugccuggccugcccacu

SEQ ID NO: 9720 - RNA, 21 nt, Homo sapiens
aggggucacaggggcccuggg

SEQ ID NO: 9721 - RNA, 19 nt, Homo sapiens
cagggucuuccucuugccc

SEQ ID NO: 9722 - RNA, 18 nt, Homo sapiens
cauuggaaggggugggga

SEQ ID NO: 9723 - RNA, 20 nt, Homo sapiens
gaucaggaaggggaugaaca

SEQ ID NO: 9724 - RNA, 19 nt, Homo sapiens
gcaucacacagcauuaggc

SEQ ID NO: 9725 - RNA, 20 nt, Homo sapiens
ggaggaagaaaggagggguc

SEQ ID NO: 9726 - RNA, 19 nt, Homo sapiens
gggacuuauaacggagggc

SEQ ID NO: 9727 - RNA, 17 nt, Homo sapiens
ucacuggcggucuggga

SEQ ID NO: 9728 - RNA, 18 nt, Homo sapiens
ucccuuugcccucucucc

SEQ ID NO: 9729 - RNA, 19 nt, Homo sapiens
ugcaggugcaucacacagc

SEQ ID NO: 9730 - RNA, 20 nt, Homo sapiens
uggaauggcagggucuuccu

SEQ ID NO: 9731 - RNA, 15 nt, Homo sapiens
uggcacaaggacggg

SEQ ID NO: 9732 - RNA, 22 nt, Homo sapiens
acgcuccucucagcccggcugc

SEQ ID NO: 9733 - RNA, 17 nt, Homo sapiens
cggcguccgcugcucga

SEQ ID NO: 9734 - RNA, 18 nt, Homo sapiens
ccuguucaccagcgcggc

SEQ ID NO: 9735 - RNA, 20 nt, Homo sapiens
auggguuuaguuuuuuuuua

SEQ ID NO: 9736 - RNA, 14 nt, Homo sapiens
cauuuugguuccca

SEQ ID NO: 9737 - RNA, 19 nt, Homo sapiens
gcggcagcggaguuagaaa

SEQ ID NO: 9738 - RNA, 18 nt, Homo sapiens
auauauauauauauauau

SEQ ID NO: 9739 - RNA, 22 nt, Homo sapiens
auauauauauauauauauauaa

SEQ ID NO: 9740 - RNA, 23 nt, Homo sapiens
auauauauauauauauauucaga

SEQ ID NO: 9741 - RNA, 21 nt, Homo sapiens
gugaaauuuuguaggugaaaa

SEQ ID NO: 9742 - RNA, 25 nt, Homo sapiens
uuuuaaaaguaguuagcauuuaaug

SEQ ID NO: 9743 - RNA, 22 nt, Homo sapiens
uggggggucgcaccaguccuuc

SEQ ID NO: 9744 - RNA, 15 nt, Homo sapiens
gcaccuuggcggcag

SEQ ID NO: 9745 - RNA, 18 nt, Homo sapiens
aaagggcagacagguuua

SEQ ID NO: 9746 - RNA, 24 nt, Homo sapiens
uuuuuggcuguaaguuuauucaau

SEQ ID NO: 9747 - RNA, 19 nt, Homo sapiens
gcagacggaugaaauugga

SEQ ID NO: 9748 - RNA, 18 nt, Homo sapiens
uugcuguugucccagauu

SEQ ID NO: 9749 - RNA, 22 nt, Homo sapiens
uuugcuguugucccagauuuau

SEQ ID NO: 9750 - RNA, 24 nt, Homo sapiens
ugcgcgcgggcuuccugcagcgcc

SEQ ID NO: 9751 - RNA, 18 nt, Homo sapiens
cgcggcggcggucuggcg

SEQ ID NO: 9752 - RNA, 19 nt, Homo sapiens
gcgcggcggcggucuggcg

SEQ ID NO: 9753 - RNA, 16 nt, Homo sapiens
ggcggcgcggcggcgg

SEQ ID NO: 9754 - RNA, 19 nt, Homo sapiens
auuuuggugaaaaucccaa

SEQ ID NO: 9755 - RNA, 18 nt, Homo sapiens
caagaugacuuauuuugc

SEQ ID NO: 9756 - RNA, 19 nt, Homo sapiens
uuaaccacucccuguaugc

SEQ ID NO: 9757 - RNA, 19 nt, Homo sapiens
cccgcgccgcgcgcucccg

SEQ ID NO: 9758 - RNA, 16 nt, Homo sapiens
gaauuggcucccauua

SEQ ID NO: 9759 - RNA, 16 nt, Homo sapiens
gcucccggcccuuccc

SEQ ID NO: 9760 - RNA, 16 nt, Homo sapiens
uaacuggcugugcugg

SEQ ID NO: 9761 - RNA, 18 nt, Homo sapiens
uacagugagaaauaaaau

SEQ ID NO: 9762 - RNA, 22 nt, Homo sapiens
uaucgccgccgugaguacaaaa

SEQ ID NO: 9763 - RNA, 17 nt, Homo sapiens
uggaucauuuuguuuaa

SEQ ID NO: 9764 - RNA, 17 nt, Homo sapiens
uucccauuggcugcgcc

SEQ ID NO: 9765 - RNA, 15 nt, Homo sapiens
aagugcaaacugcuu

SEQ ID NO: 9766 - RNA, 21 nt, Homo sapiens
auguuuccaagagagcagaga

SEQ ID NO: 9767 - RNA, 21 nt, Homo sapiens
cgggggcuggagggggccgcg

SEQ ID NO: 9768 - RNA, 19 nt, Homo sapiens
ggugaguguggcugccacg

SEQ ID NO: 9769 - RNA, 17 nt, Homo sapiens
uguuaugacagugucca

SEQ ID NO: 9770 - RNA, 18 nt, Homo sapiens
acguauuacuuuauugca

SEQ ID NO: 9771 - RNA, 17 nt, Homo sapiens
cuucccccggcagccgc

SEQ ID NO: 9772 - RNA, 23 nt, Homo sapiens
gcgccucugcuucccccggcagc

SEQ ID NO: 9773 - RNA, 22 nt, Homo sapiens
ggaaguugacuguccagaauug

SEQ ID NO: 9774 - RNA, 22 nt, Homo sapiens
uaagguugagauuuuuuuuucu

SEQ ID NO: 9775 - RNA, 22 nt, Homo sapiens
uagcacagauuuucagcaguuu

SEQ ID NO: 9776 - RNA, 21 nt, Homo sapiens
uuagacugcaguuauuaucuu

SEQ ID NO: 9777 - RNA, 21 nt, Homo sapiens
agcggggcgagaggcggcggg

SEQ ID NO: 9778 - RNA, 18 nt, Homo sapiens
cccccucccgggccgccg

SEQ ID NO: 9779 - RNA, 15 nt, Homo sapiens
cgccccccucccggg

SEQ ID NO: 9780 - RNA, 21 nt, Homo sapiens
ggcggcgggaccuggcggcgg

SEQ ID NO: 9781 - RNA, 18 nt, Homo sapiens
ccagggccagcacccucc

SEQ ID NO: 9782 - RNA, 17 nt, Homo sapiens
ggcagaggugccggggc

SEQ ID NO: 9783 - RNA, 21 nt, Homo sapiens
uaauggugucugagcaggguu

SEQ ID NO: 9784 - RNA, 21 nt, Homo sapiens
uacuggagagcaguguggcca

SEQ ID NO: 9785 - RNA, 24 nt, Homo sapiens
uggagcauacauaaacgggcaaga

SEQ ID NO: 9786 - RNA, 20 nt, Homo sapiens
uguucagaggcaguaccaag

SEQ ID NO: 9787 - RNA, 19 nt, Homo sapiens
aagucagauugucuggggu

SEQ ID NO: 9788 - RNA, 19 nt, Homo sapiens
caccacugccucggcuccc

SEQ ID NO: 9789 - RNA, 16 nt, Homo sapiens
cagccugggcaacaua

SEQ ID NO: 9790 - RNA, 23 nt, Homo sapiens
ucaauuuauucauccacaaaauu

SEQ ID NO: 9791 - RNA, 17 nt, Homo sapiens
ucacaagcggcuccagc

SEQ ID NO: 9792 - RNA, 15 nt, Homo sapiens
ucagguggccagaug

SEQ ID NO: 9793 - RNA, 20 nt, Homo sapiens
ucccgggauuuaucucagcc

SEQ ID NO: 9794 - RNA, 19 nt, Homo sapiens
ucugugagcaguuggcuug

SEQ ID NO: 9795 - RNA, 23 nt, Homo sapiens
ugccuguaaucccugcacuuugg

SEQ ID NO: 9796 - RNA, 18 nt, Homo sapiens
uggugguccugacuagau

SEQ ID NO: 9797 - RNA, 16 nt, Homo sapiens
ccugcggaggccgcgg

SEQ ID NO: 9798 - RNA, 16 nt, Homo sapiens
gcucucccaccccugc

SEQ ID NO: 9799 - RNA, 21 nt, Homo sapiens
ggcugcagggauucuuuucca

SEQ ID NO: 9800 - RNA, 18 nt, Homo sapiens
ucucugcucugguuuguc

SEQ ID NO: 9801 - RNA, 19 nt, Homo sapiens
ugggaggaguccaaggugg

SEQ ID NO: 9802 - RNA, 21 nt, Homo sapiens
uggggaggaaaggggaugggg

SEQ ID NO: 9803 - RNA, 22 nt, Homo sapiens
uggggaggaaaggggauggggg

SEQ ID NO: 9804 - RNA, 18 nt, Homo sapiens
ccuccuucuccuccaggc

SEQ ID NO: 9805 - RNA, 16 nt, Homo sapiens
acugugagcacgggga

SEQ ID NO: 9806 - RNA, 20 nt, Homo sapiens
agccgggagcagggagcagg

SEQ ID NO: 9807 - RNA, 17 nt, Homo sapiens
ccucacacagacagcau

SEQ ID NO: 9808 - RNA, 24 nt, Homo sapiens
ccucugaacagacugugugugcaa

SEQ ID NO: 9809 - RNA, 19 nt, Homo sapiens
cgcccgggccugggcuuug

SEQ ID NO: 9810 - RNA, 18 nt, Homo sapiens
cuccuuucucucgaaacu

SEQ ID NO: 9811 - RNA, 18 nt, Homo sapiens
gacuggcccugcacggcc

SEQ ID NO: 9812 - RNA, 21 nt, Homo sapiens
gccauucgcaaacauaaaaac

SEQ ID NO: 9813 - RNA, 16 nt, Homo sapiens
gcgaggugcgcucccg

SEQ ID NO: 9814 - RNA, 28 nt, Homo sapiens
ggccagaaggcgauggggcuccucuggg

SEQ ID NO: 9815 - RNA, 23 nt, Homo sapiens
ucuucugcuuuguuguuuguguu

SEQ ID NO: 9816 - RNA, 18 nt, Homo sapiens
uuuccuggugagacauac

SEQ ID NO: 9817 - RNA, 20 nt, Homo sapiens
uuugugguuuccuccauuuc

SEQ ID NO: 9818 - RNA, 18 nt, Homo sapiens
aaccuaauccuaacugau

SEQ ID NO: 9819 - RNA, 18 nt, Homo sapiens
cacagcagcacauggauu

SEQ ID NO: 9820 - RNA, 18 nt, Homo sapiens
cagcacauggauuagaag

SEQ ID NO: 9821 - RNA, 16 nt, Homo sapiens
gcugugucacagucua

SEQ ID NO: 9822 - RNA, 21 nt, Homo sapiens
agucaccauucgccauuguga

SEQ ID NO: 9823 - RNA, 17 nt, Homo sapiens
cagcacgcccuccacac

SEQ ID NO: 9824 - RNA, 19 nt, Homo sapiens
aagggccacgaggagcuuc

SEQ ID NO: 9825 - RNA, 18 nt, Homo sapiens
acccagagcuugaaauuc

SEQ ID NO: 9826 - RNA, 25 nt, Homo sapiens
gaggaggggcggcuaccggaggggc

SEQ ID NO: 9827 - RNA, 27 nt, Homo sapiens
gaggaggggcggcuaccggaggggcgg

SEQ ID NO: 9828 - RNA, 16 nt, Homo sapiens
ggcggcggcgcggggg

SEQ ID NO: 9829 - RNA, 19 nt, Homo sapiens
ggcggcggcgcggggggag

SEQ ID NO: 9830 - RNA, 17 nt, Homo sapiens
gggaggaggggcggcua

SEQ ID NO: 9831 - RNA, 18 nt, Homo sapiens
gggcggcggcgcgggggg

SEQ ID NO: 9832 - RNA, 23 nt, Homo sapiens
gggcggcggcgcggggggaggag

SEQ ID NO: 9833 - RNA, 21 nt, Homo sapiens
uacuccguaugaaccaccacc

SEQ ID NO: 9834 - RNA, 22 nt, Homo sapiens
uuauauugauaacagguacagg

SEQ ID NO: 9835 - RNA, 20 nt, Homo sapiens
agaacuuaggccaauaagag

SEQ ID NO: 9836 - RNA, 22 nt, Homo sapiens
agaccagccugggcaacauagc

SEQ ID NO: 9837 - RNA, 23 nt, Homo sapiens
agcaagacccuauuuuaaaaaaa

SEQ ID NO: 9838 - RNA, 22 nt, Homo sapiens
ccucagggcuggcugcaccagg

SEQ ID NO: 9839 - RNA, 22 nt, Homo sapiens
cuuuucacuuuucuuuucuuuu

SEQ ID NO: 9840 - RNA, 15 nt, Homo sapiens
gcacucaggccaugu

SEQ ID NO: 9841 - RNA, 18 nt, Homo sapiens
gccaggcacugcauuagg

SEQ ID NO: 9842 - RNA, 18 nt, Homo sapiens
uaccucaagguauuauga

SEQ ID NO: 9843 - RNA, 19 nt, Homo sapiens
uacuguuaaucaucacaga

SEQ ID NO: 9844 - RNA, 19 nt, Homo sapiens
uucugacaucuccucugug

SEQ ID NO: 9845 - RNA, 19 nt, Homo sapiens
aggcagaugugcgggcgcc

SEQ ID NO: 9846 - RNA, 20 nt, Homo sapiens
auggaccuaagaaguuuuau

SEQ ID NO: 9847 - RNA, 14 nt, Homo sapiens
cagagccuucccug

SEQ ID NO: 9848 - RNA, 17 nt, Homo sapiens
caugcuuuacaaaaugg

SEQ ID NO: 9849 - RNA, 20 nt, Homo sapiens
cgcgggaggggcgcucuguc

SEQ ID NO: 9850 - RNA, 17 nt, Homo sapiens
cgggcgccgaggguggg

SEQ ID NO: 9851 - RNA, 20 nt, Homo sapiens
cucuggaugggaaaaagggg

SEQ ID NO: 9852 - RNA, 24 nt, Homo sapiens
gaaccccugggcacauuucuguau

SEQ ID NO: 9853 - RNA, 16 nt, Homo sapiens
gaacccgggaggcgga

SEQ ID NO: 9854 - RNA, 19 nt, Homo sapiens
gagaaggggugggagcucu

SEQ ID NO: 9855 - RNA, 18 nt, Homo sapiens
gaggguggggcgagggcu

SEQ ID NO: 9856 - RNA, 22 nt, Homo sapiens
gcacugguucaggcacaccuuc

SEQ ID NO: 9857 - RNA, 21 nt, Homo sapiens
gcagugagccgagaucgugcc

SEQ ID NO: 9858 - RNA, 23 nt, Homo sapiens
gggaggaguuggggguccccggg

SEQ ID NO: 9859 - RNA, 19 nt, Homo sapiens
uauuggguuuggaggaauu

SEQ ID NO: 9860 - RNA, 19 nt, Homo sapiens
ucuaaaaaaaaaaauagca

SEQ ID NO: 9861 - RNA, 23 nt, Homo sapiens
ugccugugaucccagcacuuugg

SEQ ID NO: 9862 - RNA, 22 nt, Homo sapiens
uguuggagguucaaaaggaagc

SEQ ID NO: 9863 - RNA, 19 nt, Homo sapiens
gaacauguagagagagaag

SEQ ID NO: 9864 - RNA, 21 nt, Homo sapiens
uggaacuccacugcaaaugga

SEQ ID NO: 9865 - RNA, 19 nt, Homo sapiens
gcaaacucauggaucaucu

SEQ ID NO: 9866 - RNA, 22 nt, Homo sapiens
uuuuucauuuuucucaaaacau

SEQ ID NO: 9867 - RNA, 22 nt, Homo sapiens
uuuuuuuuuuuuuucauuuuuc

SEQ ID NO: 9868 - RNA, 20 nt, Homo sapiens
ccucucuccgcgcgcacagc

SEQ ID NO: 9869 - RNA, 17 nt, Homo sapiens
gguuggaaggcgaucuc

SEQ ID NO: 9870 - RNA, 20 nt, Homo sapiens
ugccaaguuucuauuagugu

SEQ ID NO: 9871 - RNA, 22 nt, Homo sapiens
aaaaacccaagggcuccagaag

SEQ ID NO: 9872 - RNA, 20 nt, Homo sapiens
cccagggggagaaacaaaca

SEQ ID NO: 9873 - RNA, 19 nt, Homo sapiens
ggagggggaaggcugacuc

SEQ ID NO: 9874 - RNA, 19 nt, Homo sapiens
ggcugcggcuguggagggc

SEQ ID NO: 9875 - RNA, 17 nt, Homo sapiens
gggcaggucacagagag

SEQ ID NO: 9876 - RNA, 23 nt, Homo sapiens
ucgaacuccuaaccucaggugau

SEQ ID NO: 9877 - RNA, 17 nt, Homo sapiens
ucuugcccaggccacag

SEQ ID NO: 9878 - RNA, 18 nt, Homo sapiens
ugaguagcugggacuaua

SEQ ID NO: 9879 - RNA, 19 nt, Homo sapiens
ugcaguggcgugaucucgg

SEQ ID NO: 9880 - RNA, 17 nt, Homo sapiens
uggcuacacacacccac

SEQ ID NO: 9881 - RNA, 21 nt, Homo sapiens
aaauaaucacauaacuacucu

SEQ ID NO: 9882 - RNA, 16 nt, Homo sapiens
uagaaaaggaggaaga

SEQ ID NO: 9883 - RNA, 17 nt, Homo sapiens
ucuauugacugugucaa

SEQ ID NO: 9884 - RNA, 18 nt, Homo sapiens
ucuuuggccucugaugau

SEQ ID NO: 9885 - RNA, 16 nt, Homo sapiens
gaaaaauguuugugcu

SEQ ID NO: 9886 - RNA, 21 nt, Homo sapiens
gcccucggagcggugcgcggc

SEQ ID NO: 9887 - RNA, 20 nt, Homo sapiens
aagaaguugcauuuuuaggc

SEQ ID NO: 9888 - RNA, 19 nt, Homo sapiens
ugugaaagggaauaaaaua

SEQ ID NO: 9889 - RNA, 20 nt, Homo sapiens
cucgaguggcuggaauuaca

SEQ ID NO: 9890 - RNA, 16 nt, Homo sapiens
ggccuacaaauauuga

SEQ ID NO: 9891 - RNA, 18 nt, Homo sapiens
agggggcgcucgggcugc

SEQ ID NO: 9892 - RNA, 18 nt, Homo sapiens
gcgggggaggggcggcgg

SEQ ID NO: 9893 - RNA, 19 nt, Homo sapiens
ggaggcgggggaggggcgg

SEQ ID NO: 9894 - RNA, 18 nt, Homo sapiens
gggaggcgggggaggggc

SEQ ID NO: 9895 - RNA, 20 nt, Homo sapiens
gggaggcgggggaggggcgg

SEQ ID NO: 9896 - RNA, 19 nt, Homo sapiens
gggaggggcggcggcucgg

SEQ ID NO: 9897 - RNA, 20 nt, Homo sapiens
ggggaggggcggcggcucgg

SEQ ID NO: 9898 - RNA, 18 nt, Homo sapiens
agcccugggggccugucc

SEQ ID NO: 9899 - RNA, 18 nt, Homo sapiens
cuuuauuuagcccugcuc

SEQ ID NO: 9900 - RNA, 17 nt, Homo sapiens
ggggccuguccgcaggc

SEQ ID NO: 9901 - RNA, 19 nt, Homo sapiens
ccugucccugccugauggc

SEQ ID NO: 9902 - RNA, 19 nt, Homo sapiens
cuagagaaguagguggucu

SEQ ID NO: 9903 - RNA, 20 nt, Homo sapiens
cuccgcacagagggcuccgg

SEQ ID NO: 9904 - RNA, 16 nt, Homo sapiens
ugggacggugcccggc

SEQ ID NO: 9905 - RNA, 16 nt, Homo sapiens
acuguggcggcgcccg

SEQ ID NO: 9906 - RNA, 15 nt, Homo sapiens
cagagaaauggaugc

SEQ ID NO: 9907 - RNA, 24 nt, Homo sapiens
ggccagaggcagucuucagaggag

SEQ ID NO: 9908 - RNA, 19 nt, Homo sapiens
gugccugaaugguugccag

SEQ ID NO: 9909 - RNA, 21 nt, Homo sapiens
uguaggguaaaucagaggcag

SEQ ID NO: 9910 - RNA, 21 nt, Homo sapiens
acacaccgacacucggaugcc

SEQ ID NO: 9911 - RNA, 21 nt, Homo sapiens
gaaguggagauucccaaacgg

SEQ ID NO: 9912 - RNA, 18 nt, Homo sapiens
cagcacuggggccauccc

SEQ ID NO: 9913 - RNA, 22 nt, Homo sapiens
gcuucuuuccagcacuggggcc

SEQ ID NO: 9914 - RNA, 23 nt, Homo sapiens
ggccggagcgaggucuaggcagc

SEQ ID NO: 9915 - RNA, 18 nt, Homo sapiens
uagcagagagucccaugg

SEQ ID NO: 9916 - RNA, 23 nt, Homo sapiens
ugauugugcaguucugauuccag

SEQ ID NO: 9917 - RNA, 17 nt, Homo sapiens
ugggcagcuuggggaaa

SEQ ID NO: 9918 - RNA, 20 nt, Homo sapiens
ggagugaagggcucacuggg

SEQ ID NO: 9919 - RNA, 19 nt, Homo sapiens
ggcucacugggucuguuga

SEQ ID NO: 9920 - RNA, 18 nt, Homo sapiens
uauguuuauuuauuuauu

SEQ ID NO: 9921 - RNA, 19 nt, Homo sapiens
aaaaaccaaaacaaaacaa

SEQ ID NO: 9922 - RNA, 21 nt, Homo sapiens
aaccaaaacaaaacaaaaaaa

SEQ ID NO: 9923 - RNA, 14 nt, Homo sapiens
ccuuagagagaagu

SEQ ID NO: 9924 - RNA, 23 nt, Homo sapiens
cggcggaucggcaaaggcgaggc

SEQ ID NO: 9925 - RNA, 18 nt, Homo sapiens
ggaagggggggcacgaag

SEQ ID NO: 9926 - RNA, 18 nt, Homo sapiens
ggacuugggagaggacug

SEQ ID NO: 9927 - RNA, 22 nt, Homo sapiens
ggggaagggggggcacgaaggc

SEQ ID NO: 9928 - RNA, 18 nt, Homo sapiens
gggggaagggggggcacg

SEQ ID NO: 9929 - RNA, 23 nt, Homo sapiens
ugggggacaaaaagggggaaggg

SEQ ID NO: 9930 - RNA, 19 nt, Homo sapiens
ccgccgcggcgcugcuggc

SEQ ID NO: 9931 - RNA, 20 nt, Homo sapiens
cugagcaacggcugcugccc

SEQ ID NO: 9932 - RNA, 17 nt, Homo sapiens
cuuugugcuugguuauu

SEQ ID NO: 9933 - RNA, 20 nt, Homo sapiens
gcccgguuccgccgcggcgc

SEQ ID NO: 9934 - RNA, 19 nt, Homo sapiens
gcggcgcugcuggcgaagg

SEQ ID NO: 9935 - RNA, 20 nt, Homo sapiens
ggaauauaacuuugugcuug

SEQ ID NO: 9936 - RNA, 18 nt, Homo sapiens
gggcuggcggggccgggc

SEQ ID NO: 9937 - RNA, 19 nt, Homo sapiens
ucccacaccaaaauggaca

SEQ ID NO: 9938 - RNA, 21 nt, Homo sapiens
agcaaaaagaaagaaugaaca

SEQ ID NO: 9939 - RNA, 16 nt, Homo sapiens
aggcggcgggcggcgg

SEQ ID NO: 9940 - RNA, 22 nt, Homo sapiens
caaaaagcaugggaaccuggaa

SEQ ID NO: 9941 - RNA, 24 nt, Homo sapiens
cgggcgcggggugaccuucgcgcg

SEQ ID NO: 9942 - RNA, 18 nt, Homo sapiens
cgggcggcgggcgcgggg

SEQ ID NO: 9943 - RNA, 22 nt, Homo sapiens
cgggcggcgggcggcgggcgcg

SEQ ID NO: 9944 - RNA, 16 nt, Homo sapiens
cuccuacucuaacucu

SEQ ID NO: 9945 - RNA, 16 nt, Homo sapiens
gccggggcugcggcgg

SEQ ID NO: 9946 - RNA, 18 nt, Homo sapiens
gcgcggggugaccuucgc

SEQ ID NO: 9947 - RNA, 21 nt, Homo sapiens
gcggcgggcggcgggcggcgg

SEQ ID NO: 9948 - RNA, 15 nt, Homo sapiens
ggcggcgggcggcgg

SEQ ID NO: 9949 - RNA, 18 nt, Homo sapiens
ggcgggcggcgggcgcgg

SEQ ID NO: 9950 - RNA, 21 nt, Homo sapiens
ggcgggcggcgggcggcgggc

SEQ ID NO: 9951 - RNA, 23 nt, Homo sapiens
uaaacugacuuccacguguccuu

SEQ ID NO: 9952 - RNA, 17 nt, Homo sapiens
ucugaugggaugaguga

SEQ ID NO: 9953 - RNA, 19 nt, Homo sapiens
ugaugaaccagucaguacu

SEQ ID NO: 9954 - RNA, 21 nt, Homo sapiens
uggaaaaacaggggggaauua

SEQ ID NO: 9955 - RNA, 17 nt, Homo sapiens
ugugguuuuuucccccc

SEQ ID NO: 9956 - RNA, 18 nt, Homo sapiens
uuuacaaauagcaaaccu

SEQ ID NO: 9957 - RNA, 15 nt, Homo sapiens
aaagcuaugcaaagc

SEQ ID NO: 9958 - RNA, 18 nt, Homo sapiens
cagugggcuauggucaca

SEQ ID NO: 9959 - RNA, 17 nt, Homo sapiens
ccauuuuagaguauagu

SEQ ID NO: 9960 - RNA, 18 nt, Homo sapiens
cugcagugugaacaguuc

SEQ ID NO: 9961 - RNA, 18 nt, Homo sapiens
uacucggagaguagaaga

SEQ ID NO: 9962 - RNA, 20 nt, Homo sapiens
aucauacagguaauauauaa

SEQ ID NO: 9963 - RNA, 22 nt, Homo sapiens
ccaucauacagguaauauauaa

SEQ ID NO: 9964 - RNA, 22 nt, Homo sapiens
uuauugauuagauuuguguaca

SEQ ID NO: 9965 - RNA, 22 nt, Homo sapiens
gaagagcacggaggggaaccug

SEQ ID NO: 9966 - RNA, 22 nt, Homo sapiens
agggagaagcugaaggggcuug

SEQ ID NO: 9967 - RNA, 14 nt, Homo sapiens
cccgcccauacccg

SEQ ID NO: 9968 - RNA, 19 nt, Homo sapiens
ccgccgccuccucacgggu

SEQ ID NO: 9969 - RNA, 22 nt, Homo sapiens
ccgcgccccuaccucccgccca

SEQ ID NO: 9970 - RNA, 16 nt, Homo sapiens
cugccgccgcccaugg

SEQ ID NO: 9971 - RNA, 19 nt, Homo sapiens
gcgcgggggacgguucccg

SEQ ID NO: 9972 - RNA, 19 nt, Homo sapiens
ucgcuccacuucaggggcc

SEQ ID NO: 9973 - RNA, 18 nt, Homo sapiens
agaggaaauggaccgcag

SEQ ID NO: 9974 - RNA, 18 nt, Homo sapiens
ucacagaguuugaagaca

SEQ ID NO: 9975 - RNA, 22 nt, Homo sapiens
gcguggccguggccucgcgcgg

SEQ ID NO: 9976 - RNA, 20 nt, Homo sapiens
uccaccagucccuggaaccc

SEQ ID NO: 9977 - RNA, 22 nt, Homo sapiens
aacuuuacgggguucaugggga

SEQ ID NO: 9978 - RNA, 18 nt, Homo sapiens
aauguguuucuauguuau

SEQ ID NO: 9979 - RNA, 18 nt, Homo sapiens
agggagagggagucucca

SEQ ID NO: 9980 - RNA, 18 nt, Homo sapiens
auccuucuaguuuugaag

SEQ ID NO: 9981 - RNA, 20 nt, Homo sapiens
caagaacggcucagcauuug

SEQ ID NO: 9982 - RNA, 21 nt, Homo sapiens
cagcauuugugagggggcggg

SEQ ID NO: 9983 - RNA, 18 nt, Homo sapiens
ccaaguugucucuaaaca

SEQ ID NO: 9984 - RNA, 20 nt, Homo sapiens
ccacuagucuacccagcacc

SEQ ID NO: 9985 - RNA, 20 nt, Homo sapiens
cucucuaccuguuugaaacc

SEQ ID NO: 9986 - RNA, 18 nt, Homo sapiens
cugccaacacccuccccc

SEQ ID NO: 9987 - RNA, 22 nt, Homo sapiens
cugcugcuccccgccuucuugc

SEQ ID NO: 9988 - RNA, 23 nt, Homo sapiens
gggcuggggagagggccucuggg

SEQ ID NO: 9989 - RNA, 20 nt, Homo sapiens
gguaagaaaaguaagauaca

SEQ ID NO: 9990 - RNA, 16 nt, Homo sapiens
ucagagcaagaacggc

SEQ ID NO: 9991 - RNA, 17 nt, Homo sapiens
uggaaauaaaaaugcau

SEQ ID NO: 9992 - RNA, 17 nt, Homo sapiens
uuuguuagauacgugug

SEQ ID NO: 9993 - RNA, 16 nt, Homo sapiens
aaagacucaaaggcgg

SEQ ID NO: 9994 - RNA, 16 nt, Homo sapiens
acgcagcggcaguggc

SEQ ID NO: 9995 - RNA, 21 nt, Homo sapiens
aggaggaggagggggucacgg

SEQ ID NO: 9996 - RNA, 18 nt, Homo sapiens
cagggggccuggccggcg

SEQ ID NO: 9997 - RNA, 17 nt, Homo sapiens
ccagaagcaucccuccc

SEQ ID NO: 9998 - RNA, 24 nt, Homo sapiens
ccccagggucccagccugaucuau

SEQ ID NO: 9999 - RNA, 16 nt, Homo sapiens
cccccggaaccgggcc

SEQ ID NO: 10000 - RNA, 15 nt, Homo sapiens
cccgcccgcccagac

SEQ ID NO: 10001 - RNA, 18 nt, Homo sapiens
cccgccucgcccuagccc

SEQ ID NO: 10002 - RNA, 19 nt, Homo sapiens
ccuuuucgcccuuccuacc

SEQ ID NO: 10003 - RNA, 15 nt, Homo sapiens
cgccgccgcgugcca

SEQ ID NO: 10004 - RNA, 17 nt, Homo sapiens
cggacaaagccugcggc

SEQ ID NO: 10005 - RNA, 21 nt, Homo sapiens
cgggccggggguggcggaggg

SEQ ID NO: 10006 - RNA, 15 nt, Homo sapiens
cugcacugggcuuug

SEQ ID NO: 10007 - RNA, 25 nt, Homo sapiens
gccggcggugaccggcggccgcggc

SEQ ID NO: 10008 - RNA, 16 nt, Homo sapiens
ggaggagaagggaggc

SEQ ID NO: 10009 - RNA, 21 nt, Homo sapiens
ggaggaggagggggucacggu

SEQ ID NO: 10010 - RNA, 17 nt, Homo sapiens
ggaggcccgaggccgcg

SEQ ID NO: 10011 - RNA, 24 nt, Homo sapiens
ggccagaagcaucccucccggagg

SEQ ID NO: 10012 - RNA, 24 nt, Homo sapiens
ggccggcgggcgcccccggccuuc

SEQ ID NO: 10013 - RNA, 16 nt, Homo sapiens
ggcugcagggggccug

SEQ ID NO: 10014 - RNA, 19 nt, Homo sapiens
ggggcggagcugggggcgg

SEQ ID NO: 10015 - RNA, 19 nt, Homo sapiens
gguggaggagcgguggugg

SEQ ID NO: 10016 - RNA, 18 nt, Homo sapiens
ucccggaggggguguggg

SEQ ID NO: 10017 - RNA, 20 nt, Homo sapiens
cauaacaccacguccgggga

SEQ ID NO: 10018 - RNA, 18 nt, Homo sapiens
cggcucugagacccccga

SEQ ID NO: 10019 - RNA, 18 nt, Homo sapiens
cuuuuguucuaaaaguca

SEQ ID NO: 10020 - RNA, 21 nt, Homo sapiens
gcgggugggcaauggggggug

SEQ ID NO: 10021 - RNA, 17 nt, Homo sapiens
ggcagcgggugggcgcc

SEQ ID NO: 10022 - RNA, 19 nt, Homo sapiens
gggcagcgggugggcgccg

SEQ ID NO: 10023 - RNA, 16 nt, Homo sapiens
gggguggcggagcugu

SEQ ID NO: 10024 - RNA, 19 nt, Homo sapiens
ggugggcaauggggggugg

SEQ ID NO: 10025 - RNA, 24 nt, Homo sapiens
uucucuauggcuuugccaaaucga

SEQ ID NO: 10026 - RNA, 17 nt, Homo sapiens
aagcccccagaaggagg

SEQ ID NO: 10027 - RNA, 17 nt, Homo sapiens
gcgagcacggcuguggc

SEQ ID NO: 10028 - RNA, 16 nt, Homo sapiens
uccgaaguccaagccc

SEQ ID NO: 10029 - RNA, 23 nt, Homo sapiens
uccgggggucucagcauucauuu

SEQ ID NO: 10030 - RNA, 22 nt, Homo sapiens
uggcaaggcuugagcuguucua

SEQ ID NO: 10031 - RNA, 17 nt, Homo sapiens
acagcuucuguggcugc

SEQ ID NO: 10032 - RNA, 18 nt, Homo sapiens
acaggggcucugggagcu

SEQ ID NO: 10033 - RNA, 19 nt, Homo sapiens
agccccgccuggucccucc

SEQ ID NO: 10034 - RNA, 18 nt, Homo sapiens
caccucucgcucucccgg

SEQ ID NO: 10035 - RNA, 19 nt, Homo sapiens
gcagaaguggggaguuggg

SEQ ID NO: 10036 - RNA, 18 nt, Homo sapiens
gcaggcccugggcuccuc

SEQ ID NO: 10037 - RNA, 22 nt, Homo sapiens
gcgcacccgcuuacccagcccc

SEQ ID NO: 10038 - RNA, 20 nt, Homo sapiens
gcggcucggagccccgcggc

SEQ ID NO: 10039 - RNA, 18 nt, Homo sapiens
ggcacagcuucuguggcu

SEQ ID NO: 10040 - RNA, 15 nt, Homo sapiens
gugggcgcuggccgg

SEQ ID NO: 10041 - RNA, 19 nt, Homo sapiens
ucagaaaaccauccccaac

SEQ ID NO: 10042 - RNA, 23 nt, Homo sapiens
ucucucggcccagucuuggggcc

SEQ ID NO: 10043 - RNA, 22 nt, Homo sapiens
ugaggaauguaucacaggcagu

SEQ ID NO: 10044 - RNA, 19 nt, Homo sapiens
uggucccuuaucuguagcc

SEQ ID NO: 10045 - RNA, 18 nt, Homo sapiens
aaagaaggggcaacucuu

SEQ ID NO: 10046 - RNA, 20 nt, Homo sapiens
aaagguacuuuugauacaga

SEQ ID NO: 10047 - RNA, 20 nt, Homo sapiens
auggauugcaguccuuuucu

SEQ ID NO: 10048 - RNA, 22 nt, Homo sapiens
cagcaguucucuucagcuccuc

SEQ ID NO: 10049 - RNA, 19 nt, Homo sapiens
gcugcuuauuuccucaggg

SEQ ID NO: 10050 - RNA, 19 nt, Homo sapiens
ucucuucagcuccucaugc

SEQ ID NO: 10051 - RNA, 19 nt, Homo sapiens
uucuugguaacaaacauac

SEQ ID NO: 10052 - RNA, 21 nt, Homo sapiens
ccggcucgggcugcugggggc

SEQ ID NO: 10053 - RNA, 18 nt, Homo sapiens
cgcgggcugcgccccggc

SEQ ID NO: 10054 - RNA, 18 nt, Homo sapiens
cgucccucgugccccccc

SEQ ID NO: 10055 - RNA, 16 nt, Homo sapiens
gccucugucuccccuc

SEQ ID NO: 10056 - RNA, 19 nt, Homo sapiens
ggaaggggagggggaaucc

SEQ ID NO: 10057 - RNA, 21 nt, Homo sapiens
ggcugcugcgcuucgcgaggu

SEQ ID NO: 10058 - RNA, 23 nt, Homo sapiens
uaccagggugagagggcuguggc

SEQ ID NO: 10059 - RNA, 18 nt, Homo sapiens
aggcagguguuggacuug

SEQ ID NO: 10060 - RNA, 18 nt, Homo sapiens
aggcgggggugggaguug

SEQ ID NO: 10061 - RNA, 19 nt, Homo sapiens
cagguguuggacuugaccu

SEQ ID NO: 10062 - RNA, 16 nt, Homo sapiens
ugggaguugaaccaca

SEQ ID NO: 10063 - RNA, 17 nt, Homo sapiens
uuaaggcagguguugga

SEQ ID NO: 10064 - RNA, 19 nt, Homo sapiens
uuauggaauuuagacucuu

SEQ ID NO: 10065 - RNA, 18 nt, Homo sapiens
aguuauuuuguuauuggc

SEQ ID NO: 10066 - RNA, 19 nt, Homo sapiens
ggcagugguggaagcacaa

SEQ ID NO: 10067 - RNA, 25 nt, Homo sapiens
uaauucacaaaaaguguuaaaucag

SEQ ID NO: 10068 - RNA, 18 nt, Homo sapiens
uggcagugguggaagcac

SEQ ID NO: 10069 - RNA, 15 nt, Homo sapiens
uuguuauuggcagug

SEQ ID NO: 10070 - RNA, 17 nt, Homo sapiens
uggcaaggugggguuau

SEQ ID NO: 10071 - RNA, 26 nt, Homo sapiens
ggagcccagcugguggugagugagca

SEQ ID NO: 10072 - RNA, 20 nt, Homo sapiens
uagggcacagaauggggaga

SEQ ID NO: 10073 - RNA, 16 nt, Homo sapiens
aggaagauaggaaagg

SEQ ID NO: 10074 - RNA, 16 nt, Homo sapiens
cagccuaggcaacaua

SEQ ID NO: 10075 - RNA, 20 nt, Homo sapiens
ccucuagaguaaaauguguu

SEQ ID NO: 10076 - RNA, 20 nt, Homo sapiens
gauuuauauaauuguggcua

SEQ ID NO: 10077 - RNA, 21 nt, Homo sapiens
ugggugcagagaccaugaaaa

SEQ ID NO: 10078 - RNA, 22 nt, Homo sapiens
ugaugguucuuugaauguauuc

SEQ ID NO: 10079 - RNA, 17 nt, Homo sapiens
guuuuacaauaaaaaca

SEQ ID NO: 10080 - RNA, 18 nt, Homo sapiens
uagaaaguauuacaaaga

SEQ ID NO: 10081 - RNA, 19 nt, Homo sapiens
uuauugaaauaaauuaucu

SEQ ID NO: 10082 - RNA, 19 nt, Homo sapiens
ggacaggagcuuugcucuc

SEQ ID NO: 10083 - RNA, 22 nt, Homo sapiens
aggcaaaaagggguagaauaca

SEQ ID NO: 10084 - RNA, 19 nt, Homo sapiens
aaucacaauuauggauguu

SEQ ID NO: 10085 - RNA, 17 nt, Homo sapiens
caaacuugagggcaaac

SEQ ID NO: 10086 - RNA, 23 nt, Homo sapiens
cagugcgcagccgugacuuucag

SEQ ID NO: 10087 - RNA, 20 nt, Homo sapiens
cuugguugugacagcagcgu

SEQ ID NO: 10088 - RNA, 18 nt, Homo sapiens
guguuguucccucccuca

SEQ ID NO: 10089 - RNA, 18 nt, Homo sapiens
uagguguucugucuaauc

SEQ ID NO: 10090 - RNA, 16 nt, Homo sapiens
ugggaagaacaguccu

SEQ ID NO: 10091 - RNA, 17 nt, Homo sapiens
aaauacccccgacuggg

SEQ ID NO: 10092 - RNA, 18 nt, Homo sapiens
aaauacccccgacugggg

SEQ ID NO: 10093 - RNA, 19 nt, Homo sapiens
cagcgaacacacacacacu

SEQ ID NO: 10094 - RNA, 18 nt, Homo sapiens
uggaaugguguuuuguca

SEQ ID NO: 10095 - RNA, 24 nt, Homo sapiens
aggugaaagaggguacagggcggc

SEQ ID NO: 10096 - RNA, 17 nt, Homo sapiens
gaggcccugcaccagcc

SEQ ID NO: 10097 - RNA, 20 nt, Homo sapiens
gaggugcucaggcagccugg

SEQ ID NO: 10098 - RNA, 18 nt, Homo sapiens
gcgggguuggcaugaggg

SEQ ID NO: 10099 - RNA, 18 nt, Homo sapiens
auggaaauggcuuuagag

SEQ ID NO: 10100 - RNA, 21 nt, Homo sapiens
uguuauagaauacaacaugcc

SEQ ID NO: 10101 - RNA, 18 nt, Homo sapiens
gaaggaaggcaguggggu

SEQ ID NO: 10102 - RNA, 17 nt, Homo sapiens
ggagagcggcggagagc

SEQ ID NO: 10103 - RNA, 23 nt, Homo sapiens
uaucaugguuacaaauguaauau

SEQ ID NO: 10104 - RNA, 22 nt, Homo sapiens
cacucggggcacuggggagccg

SEQ ID NO: 10105 - RNA, 17 nt, Homo sapiens
uuuguuagaaacagaca

SEQ ID NO: 10106 - RNA, 22 nt, Homo sapiens
agcauaucuaucaaaucuaaau

SEQ ID NO: 10107 - RNA, 22 nt, Homo sapiens
aguaccaacccauccaccccga

SEQ ID NO: 10108 - RNA, 18 nt, Homo sapiens
auuuaugcaugugauauu

SEQ ID NO: 10109 - RNA, 18 nt, Homo sapiens
uagaagccaaguaggagc

SEQ ID NO: 10110 - RNA, 18 nt, Homo sapiens
ugccuuucacuauauggu

SEQ ID NO: 10111 - RNA, 21 nt, Homo sapiens
guauguauucacauuuucauu

SEQ ID NO: 10112 - RNA, 19 nt, Homo sapiens
aagcagaaggagguaggag

SEQ ID NO: 10113 - RNA, 21 nt, Homo sapiens
acaaccuucccuggaccugag

SEQ ID NO: 10114 - RNA, 16 nt, Homo sapiens
cgggcuccgccgcggc

SEQ ID NO: 10115 - RNA, 18 nt, Homo sapiens
gacggagguggcucaggc

SEQ ID NO: 10116 - RNA, 17 nt, Homo sapiens
gcagcguguuccccagg

SEQ ID NO: 10117 - RNA, 20 nt, Homo sapiens
gcaguggaagcagggggucg

SEQ ID NO: 10118 - RNA, 24 nt, Homo sapiens
ccccagcuggggcucagcuauccc

SEQ ID NO: 10119 - RNA, 19 nt, Homo sapiens
ggacaagccuugcuuuauu

SEQ ID NO: 10120 - RNA, 22 nt, Homo sapiens
uuuauuggggaauggaugggau

SEQ ID NO: 10121 - RNA, 20 nt, Homo sapiens
aauguguaaauguucucauu

SEQ ID NO: 10122 - RNA, 16 nt, Homo sapiens
ucccaggucuaacccc

SEQ ID NO: 10123 - RNA, 17 nt, Homo sapiens
ugugagaauguguaaau

SEQ ID NO: 10124 - RNA, 22 nt, Homo sapiens
uguuagggauguggauagaaua

SEQ ID NO: 10125 - RNA, 26 nt, Homo sapiens
uguuagggauguggauagaauaagca

SEQ ID NO: 10126 - RNA, 17 nt, Homo sapiens
ggcaggggaugugacua

SEQ ID NO: 10127 - RNA, 16 nt, Homo sapiens
uagaacaggaaggaag

SEQ ID NO: 10128 - RNA, 16 nt, Homo sapiens
uagggacucauugggc

SEQ ID NO: 10129 - RNA, 24 nt, Homo sapiens
uggcccugauggaggaucagaggg

SEQ ID NO: 10130 - RNA, 19 nt, Homo sapiens
uuauucuuguucucuugug

SEQ ID NO: 10131 - RNA, 22 nt, Homo sapiens
caaaauauacaauuaaugcaag

SEQ ID NO: 10132 - RNA, 17 nt, Homo sapiens
cccggcacacaggaagc

SEQ ID NO: 10133 - RNA, 19 nt, Homo sapiens
ccgggagcgcccgcgcccg

SEQ ID NO: 10134 - RNA, 21 nt, Homo sapiens
ccguggcucgccgggagcgcc

SEQ ID NO: 10135 - RNA, 22 nt, Homo sapiens
cgccgggagcgcccgcgcccgc

SEQ ID NO: 10136 - RNA, 23 nt, Homo sapiens
cggcggcggugaguccggcgcgg

SEQ ID NO: 10137 - RNA, 19 nt, Homo sapiens
caagucuucaggaugggau

SEQ ID NO: 10138 - RNA, 19 nt, Homo sapiens
cuucaggaugggauguugu

SEQ ID NO: 10139 - RNA, 20 nt, Homo sapiens
uguggaucccuauaguuauu

SEQ ID NO: 10140 - RNA, 22 nt, Homo sapiens
ggagaguggaggaggggcuggu

SEQ ID NO: 10141 - RNA, 16 nt, Homo sapiens
gugaaagguguggaga

SEQ ID NO: 10142 - RNA, 19 nt, Homo sapiens
aauauguacaccuuguugg

SEQ ID NO: 10143 - RNA, 19 nt, Homo sapiens
acccguguacugcuuauug

SEQ ID NO: 10144 - RNA, 18 nt, Homo sapiens
auaguuccagaauuugaa

SEQ ID NO: 10145 - RNA, 19 nt, Homo sapiens
caucaaacauugagaaggc

SEQ ID NO: 10146 - RNA, 16 nt, Homo sapiens
cgagagcgcccggcgg

SEQ ID NO: 10147 - RNA, 20 nt, Homo sapiens
gcugaggcgcggcgcggccc

SEQ ID NO: 10148 - RNA, 24 nt, Homo sapiens
uaagcuauagcaaacuguuaaaaa

SEQ ID NO: 10149 - RNA, 22 nt, Homo sapiens
uauauauguauacauacacaua

SEQ ID NO: 10150 - RNA, 23 nt, Homo sapiens
uauucauguagccagacuuucua

SEQ ID NO: 10151 - RNA, 22 nt, Homo sapiens
uccaaguuaaaaugauuugugu

SEQ ID NO: 10152 - RNA, 18 nt, Homo sapiens
ucugcuucuuuuauaauc

SEQ ID NO: 10153 - RNA, 20 nt, Homo sapiens
ugcuucuaauuaucaucaac

SEQ ID NO: 10154 - RNA, 19 nt, Homo sapiens
uuuaaaaaaucaucaaaca

SEQ ID NO: 10155 - RNA, 15 nt, Homo sapiens
acaagacagguggga

SEQ ID NO: 10156 - RNA, 20 nt, Homo sapiens
agcggcacugcggugggcgc

SEQ ID NO: 10157 - RNA, 20 nt, Homo sapiens
aggcagcggcacugcggugg

SEQ ID NO: 10158 - RNA, 17 nt, Homo sapiens
aggggagucccgggcca

SEQ ID NO: 10159 - RNA, 21 nt, Homo sapiens
caccacacuuggaggcucccc

SEQ ID NO: 10160 - RNA, 17 nt, Homo sapiens
gcacugcggugggcgcc

SEQ ID NO: 10161 - RNA, 19 nt, Homo sapiens
ggacuucagagaaggaaga

SEQ ID NO: 10162 - RNA, 24 nt, Homo sapiens
gcugggggccaagaugccuggguc

SEQ ID NO: 10163 - RNA, 18 nt, Homo sapiens
uauccuugaccgcacgac

SEQ ID NO: 10164 - RNA, 17 nt, Homo sapiens
caagagcagcuagaaug

SEQ ID NO: 10165 - RNA, 18 nt, Homo sapiens
caggggcgaugggggugg

SEQ ID NO: 10166 - RNA, 19 nt, Homo sapiens
ccgccggcccugcccgucc

SEQ ID NO: 10167 - RNA, 21 nt, Homo sapiens
gccccuggcccgccugggccc

SEQ ID NO: 10168 - RNA, 20 nt, Homo sapiens
gcgcggggcgaugagggggg

SEQ ID NO: 10169 - RNA, 21 nt, Homo sapiens
gcggagcggagccgccgccgc

SEQ ID NO: 10170 - RNA, 14 nt, Homo sapiens
gcuggagggaggcg

SEQ ID NO: 10171 - RNA, 19 nt, Homo sapiens
ggcagcgggaagccggcgg

SEQ ID NO: 10172 - RNA, 18 nt, Homo sapiens
gggguguggggguuaaug

SEQ ID NO: 10173 - RNA, 19 nt, Homo sapiens
ggucuggaugacggccccg

SEQ ID NO: 10174 - RNA, 19 nt, Homo sapiens
ucagccacugggccgcccc

SEQ ID NO: 10175 - RNA, 17 nt, Homo sapiens
uccucucagccacuggg

SEQ ID NO: 10176 - RNA, 20 nt, Homo sapiens
ugcgugagcgcgaugggggc

SEQ ID NO: 10177 - RNA, 18 nt, Homo sapiens
augugcagauucaugugu

SEQ ID NO: 10178 - RNA, 19 nt, Homo sapiens
cagccgcgggggcgcgggc

SEQ ID NO: 10179 - RNA, 20 nt, Homo sapiens
cagcgucucccaggcgcgcg

SEQ ID NO: 10180 - RNA, 17 nt, Homo sapiens
uggaaauaaaggcaccg

SEQ ID NO: 10181 - RNA, 18 nt, Homo sapiens
uucaaguauauuaaugua

SEQ ID NO: 10182 - RNA, 17 nt, Homo sapiens
cguccggccgcccgggc

SEQ ID NO: 10183 - RNA, 15 nt, Homo sapiens
gcgcggucgcugcuc

SEQ ID NO: 10184 - RNA, 18 nt, Homo sapiens
aguggaggggcggugggg

SEQ ID NO: 10185 - RNA, 18 nt, Homo sapiens
ggcaccggcgcaaagugg

SEQ ID NO: 10186 - RNA, 18 nt, Homo sapiens
ggcgguggggcucggaga

SEQ ID NO: 10187 - RNA, 23 nt, Homo sapiens
aggagccggcggcggagccgagg

SEQ ID NO: 10188 - RNA, 15 nt, Homo sapiens
ccgggacgcggccgg

SEQ ID NO: 10189 - RNA, 15 nt, Homo sapiens
gccggcggcggagcc

SEQ ID NO: 10190 - RNA, 19 nt, Homo sapiens
ucaaaugaguucuuugcca

SEQ ID NO: 10191 - RNA, 19 nt, Homo sapiens
ccucgcuuucuuucuuucc

SEQ ID NO: 10192 - RNA, 22 nt, Homo sapiens
gagcagcagcggcgucucaggc

SEQ ID NO: 10193 - RNA, 21 nt, Homo sapiens
gcuccgcgcuccuucccuccc

SEQ ID NO: 10194 - RNA, 19 nt, Homo sapiens
gcucgccagcagcagcucc

SEQ ID NO: 10195 - RNA, 18 nt, Homo sapiens
ggccggggacuguggcgc

SEQ ID NO: 10196 - RNA, 27 nt, Homo sapiens
uaaugacucauuuuauuaccacuuaug

SEQ ID NO: 10197 - RNA, 16 nt, Homo sapiens
uguaguguguggguga

SEQ ID NO: 10198 - RNA, 14 nt, Homo sapiens
uguggugugugugu

SEQ ID NO: 10199 - RNA, 19 nt, Homo sapiens
acaaguuacccaacgguuu

SEQ ID NO: 10200 - RNA, 18 nt, Homo sapiens
aguaccuguuggcuuucu

SEQ ID NO: 10201 - RNA, 23 nt, Homo sapiens
caggcuuguaaguuuaacuuuuu

SEQ ID NO: 10202 - RNA, 18 nt, Homo sapiens
ccacugggaagcaggacg

SEQ ID NO: 10203 - RNA, 23 nt, Homo sapiens
cugucuuugcccaggucgcuccc

SEQ ID NO: 10204 - RNA, 16 nt, Homo sapiens
gcccgcgucccgcgag

SEQ ID NO: 10205 - RNA, 19 nt, Homo sapiens
gcucccggcucccgcgucc

SEQ ID NO: 10206 - RNA, 17 nt, Homo sapiens
ggcuuucugcagagaug

SEQ ID NO: 10207 - RNA, 19 nt, Homo sapiens
ucaaggcuuguacugugga

SEQ ID NO: 10208 - RNA, 21 nt, Homo sapiens
uguuggcuuucugcagagaug

SEQ ID NO: 10209 - RNA, 19 nt, Homo sapiens
aagagaauaucaaauguga

SEQ ID NO: 10210 - RNA, 16 nt, Homo sapiens
agcuugcggagcuuug

SEQ ID NO: 10211 - RNA, 18 nt, Homo sapiens
cauaaagacagcugugcu

SEQ ID NO: 10212 - RNA, 18 nt, Homo sapiens
cauugugguauuuucccu

SEQ ID NO: 10213 - RNA, 19 nt, Homo sapiens
cccgcccggcacggcgcgg

SEQ ID NO: 10214 - RNA, 18 nt, Homo sapiens
cgaguaugggucagguga

SEQ ID NO: 10215 - RNA, 19 nt, Homo sapiens
gccucgcggucccguggcc

SEQ ID NO: 10216 - RNA, 20 nt, Homo sapiens
gccucgcggucccguggccg

SEQ ID NO: 10217 - RNA, 21 nt, Homo sapiens
gcgggcgacggcagcccaggc

SEQ ID NO: 10218 - RNA, 18 nt, Homo sapiens
gggaggcagggaaggggc

SEQ ID NO: 10219 - RNA, 18 nt, Homo sapiens
uauguuuacacauuucag

SEQ ID NO: 10220 - RNA, 21 nt, Homo sapiens
ugcauuuauauccaucuaagu

SEQ ID NO: 10221 - RNA, 19 nt, Homo sapiens
uggccuuacccccuccccc

SEQ ID NO: 10222 - RNA, 14 nt, Homo sapiens
ugguugaugucacu

SEQ ID NO: 10223 - RNA, 19 nt, Homo sapiens
uguugcugguaguaaauuu

SEQ ID NO: 10224 - RNA, 23 nt, Homo sapiens
uguuuugugacauuuuaaaacag

SEQ ID NO: 10225 - RNA, 17 nt, Homo sapiens
uugcuugcauaaagaca

SEQ ID NO: 10226 - RNA, 19 nt, Homo sapiens
uuuaaaaucuacccagucu

SEQ ID NO: 10227 - RNA, 17 nt, Homo sapiens
ccuggcucagguccucg

SEQ ID NO: 10228 - RNA, 18 nt, Homo sapiens
uaauguguguaaagugcu

SEQ ID NO: 10229 - RNA, 19 nt, Homo sapiens
ugacugcaacuugggccug

SEQ ID NO: 10230 - RNA, 16 nt, Homo sapiens
ugucuacuuuccuuuu

SEQ ID NO: 10231 - RNA, 18 nt, Homo sapiens
uuuugccauguuucccag

SEQ ID NO: 10232 - RNA, 18 nt, Homo sapiens
cuuuaaucagaaucccaa

SEQ ID NO: 10233 - RNA, 16 nt, Homo sapiens
gcugcagcggacaggc

SEQ ID NO: 10234 - RNA, 19 nt, Homo sapiens
uggggugucccagcacacg

SEQ ID NO: 10235 - RNA, 14 nt, Homo sapiens
caggaaguauucug

SEQ ID NO: 10236 - RNA, 17 nt, Homo sapiens
cccacaccuccucuccg

SEQ ID NO: 10237 - RNA, 22 nt, Homo sapiens
ccucuccguucucuuuucauua

SEQ ID NO: 10238 - RNA, 22 nt, Homo sapiens
uccccucgccuuguggggaggc

SEQ ID NO: 10239 - RNA, 18 nt, Homo sapiens
aaggaaaucagagggaga

SEQ ID NO: 10240 - RNA, 18 nt, Homo sapiens
aggcaaggaggcacccag

SEQ ID NO: 10241 - RNA, 19 nt, Homo sapiens
cagagggagaugccccguc

SEQ ID NO: 10242 - RNA, 19 nt, Homo sapiens
ccgggggcucccgguggcc

SEQ ID NO: 10243 - RNA, 19 nt, Homo sapiens
cgcgggcugugccgggggc

SEQ ID NO: 10244 - RNA, 25 nt, Homo sapiens
gcaaaaccuaagcagagagugcaca

SEQ ID NO: 10245 - RNA, 21 nt, Homo sapiens
gcaguagggauccugcagaag

SEQ ID NO: 10246 - RNA, 19 nt, Homo sapiens
gcgcgggcugugccggggg

SEQ ID NO: 10247 - RNA, 18 nt, Homo sapiens
gggaggaaaauggaggag

SEQ ID NO: 10248 - RNA, 18 nt, Homo sapiens
guccccauuuguccccga

SEQ ID NO: 10249 - RNA, 22 nt, Homo sapiens
uagcagaaggaaaucagaggga

SEQ ID NO: 10250 - RNA, 15 nt, Homo sapiens
ucacaauguauaucu

SEQ ID NO: 10251 - RNA, 19 nt, Homo sapiens
ucagagagagagaaguaga

SEQ ID NO: 10252 - RNA, 22 nt, Homo sapiens
uccacaggguucucaccugcgg

SEQ ID NO: 10253 - RNA, 19 nt, Homo sapiens
uucucagucauggcacuga

SEQ ID NO: 10254 - RNA, 19 nt, Homo sapiens
aauguuugucuacaugugu

SEQ ID NO: 10255 - RNA, 16 nt, Homo sapiens
agggaucauucaagau

SEQ ID NO: 10256 - RNA, 18 nt, Homo sapiens
cuccugaacauuucuuau

SEQ ID NO: 10257 - RNA, 17 nt, Homo sapiens
gaggaggaggaaugggg

SEQ ID NO: 10258 - RNA, 19 nt, Homo sapiens
gagguaugaggaucccugg

SEQ ID NO: 10259 - RNA, 18 nt, Homo sapiens
gguggcauuauuaaauua

SEQ ID NO: 10260 - RNA, 25 nt, Homo sapiens
gugaauuuuaauuguagugaaacca

SEQ ID NO: 10261 - RNA, 22 nt, Homo sapiens
uaaaaaguuuguaguaacaguc

SEQ ID NO: 10262 - RNA, 19 nt, Homo sapiens
uacccuauauuggggcuaa

SEQ ID NO: 10263 - RNA, 19 nt, Homo sapiens
uauaaaacuugguuuacac

SEQ ID NO: 10264 - RNA, 16 nt, Homo sapiens
ucuccugaacauuucu

SEQ ID NO: 10265 - RNA, 27 nt, Homo sapiens
ugagaaagaguaaagagcuaauguuug

SEQ ID NO: 10266 - RNA, 21 nt, Homo sapiens
ugugagguaugaggaucccug

SEQ ID NO: 10267 - RNA, 20 nt, Homo sapiens
uuauugaucucaggcuuaca

SEQ ID NO: 10268 - RNA, 17 nt, Homo sapiens
uucccaccacagcugug

SEQ ID NO: 10269 - RNA, 19 nt, Homo sapiens
gagggcugggcugcuugug

SEQ ID NO: 10270 - RNA, 20 nt, Homo sapiens
aacaugacucuaccacuguu

SEQ ID NO: 10271 - RNA, 21 nt, Homo sapiens
aacaugacucuaccacuguua

SEQ ID NO: 10272 - RNA, 16 nt, Homo sapiens
aggcagcccccaccau

SEQ ID NO: 10273 - RNA, 15 nt, Homo sapiens
caguggacacagcca

SEQ ID NO: 10274 - RNA, 18 nt, Homo sapiens
cucugaucucauugaucu

SEQ ID NO: 10275 - RNA, 19 nt, Homo sapiens
gaagugugggucaucagac

SEQ ID NO: 10276 - RNA, 15 nt, Homo sapiens
ugauggauacauauc

SEQ ID NO: 10277 - RNA, 20 nt, Homo sapiens
ugauugaauggauaaauugu

SEQ ID NO: 10278 - RNA, 19 nt, Homo sapiens
uuuaaagcuauaacagauu

SEQ ID NO: 10279 - RNA, 20 nt, Homo sapiens
augcugccccagaugucuuu

SEQ ID NO: 10280 - RNA, 23 nt, Homo sapiens
aggcuaggaagccagcugaccca

SEQ ID NO: 10281 - RNA, 20 nt, Homo sapiens
auuauacugcacacuuaaca

SEQ ID NO: 10282 - RNA, 21 nt, Homo sapiens
ccucagggcaucaguaugaac

SEQ ID NO: 10283 - RNA, 18 nt, Homo sapiens
gccuuguugagcaaggag

SEQ ID NO: 10284 - RNA, 19 nt, Homo sapiens
ugccauguucaggcacugc

SEQ ID NO: 10285 - RNA, 20 nt, Homo sapiens
aucuacuuucacauuuauuu

SEQ ID NO: 10286 - RNA, 18 nt, Homo sapiens
caucuuaauaguuuucuu

SEQ ID NO: 10287 - RNA, 20 nt, Homo sapiens
cccggccccgcccccccucg

SEQ ID NO: 10288 - RNA, 21 nt, Homo sapiens
cccggcuggcgcggugcggcu

SEQ ID NO: 10289 - RNA, 19 nt, Homo sapiens
cccucgccucgccuagccc

SEQ ID NO: 10290 - RNA, 19 nt, Homo sapiens
gcucccagcccggccgucc

SEQ ID NO: 10291 - RNA, 19 nt, Homo sapiens
gcucccgguccgcgcggcc

SEQ ID NO: 10292 - RNA, 21 nt, Homo sapiens
uauacaguaaaaugaaacauc

SEQ ID NO: 10293 - RNA, 19 nt, Homo sapiens
ccaggggcugcagcaccua

SEQ ID NO: 10294 - RNA, 20 nt, Homo sapiens
ccucccuaucuuugaagaac

SEQ ID NO: 10295 - RNA, 17 nt, Homo sapiens
ccugggucgggcugggc

SEQ ID NO: 10296 - RNA, 23 nt, Homo sapiens
cugcagcaccuaguuuuauaguu

SEQ ID NO: 10297 - RNA, 16 nt, Homo sapiens
gcccagaagccccucc

SEQ ID NO: 10298 - RNA, 17 nt, Homo sapiens
guggagugaauucuagc

SEQ ID NO: 10299 - RNA, 19 nt, Homo sapiens
ucugcuuuuccacccccac

SEQ ID NO: 10300 - RNA, 19 nt, Homo sapiens
uggauugauagcaacaaag

SEQ ID NO: 10301 - RNA, 20 nt, Homo sapiens
ucuagcucuuuugaagaugg

SEQ ID NO: 10302 - RNA, 24 nt, Homo sapiens
ccgccggguuguuacuugccuccg

SEQ ID NO: 10303 - RNA, 22 nt, Homo sapiens
cccgcccuccugcagcgcaggc

SEQ ID NO: 10304 - RNA, 23 nt, Homo sapiens
gcaguggcugcuucagguggcaa

SEQ ID NO: 10305 - RNA, 19 nt, Homo sapiens
gugcagcuaccgcaggugc

SEQ ID NO: 10306 - RNA, 18 nt, Homo sapiens
guggcaagccaaccuuug

SEQ ID NO: 10307 - RNA, 19 nt, Homo sapiens
agcgggggaagcgcgcggc

SEQ ID NO: 10308 - RNA, 18 nt, Homo sapiens
agggcugcagacaucugg

SEQ ID NO: 10309 - RNA, 20 nt, Homo sapiens
aggggccccgggagcuggcc

SEQ ID NO: 10310 - RNA, 21 nt, Homo sapiens
aggggccccgggagcuggccu

SEQ ID NO: 10311 - RNA, 20 nt, Homo sapiens
caccacuagaugcuggagcc

SEQ ID NO: 10312 - RNA, 16 nt, Homo sapiens
caccagaccccugcag

SEQ ID NO: 10313 - RNA, 18 nt, Homo sapiens
cacguggcugcccgauga

SEQ ID NO: 10314 - RNA, 19 nt, Homo sapiens
cauuugcauacacgucuga

SEQ ID NO: 10315 - RNA, 17 nt, Homo sapiens
ccaaagcgugcagagcc

SEQ ID NO: 10316 - RNA, 16 nt, Homo sapiens
ccggaagggcccaaug

SEQ ID NO: 10317 - RNA, 19 nt, Homo sapiens
ccugcugcccuccuagccc

SEQ ID NO: 10318 - RNA, 19 nt, Homo sapiens
cgugagguggccuggcggc

SEQ ID NO: 10319 - RNA, 20 nt, Homo sapiens
cucuggguuggugaggggcg

SEQ ID NO: 10320 - RNA, 18 nt, Homo sapiens
gaggccguggugccucuc

SEQ ID NO: 10321 - RNA, 19 nt, Homo sapiens
gccgcugcagcagagacag

SEQ ID NO: 10322 - RNA, 19 nt, Homo sapiens
gccucacgaccucucccuc

SEQ ID NO: 10323 - RNA, 16 nt, Homo sapiens
ucuggccaauguccag

SEQ ID NO: 10324 - RNA, 15 nt, Homo sapiens
ugccuggcaggcgug

SEQ ID NO: 10325 - RNA, 18 nt, Homo sapiens
ugccugggugaggccgug

SEQ ID NO: 10326 - RNA, 22 nt, Homo sapiens
uggguggggcccacagagagcg

SEQ ID NO: 10327 - RNA, 23 nt, Homo sapiens
uguacaagccccggauccccuag

SEQ ID NO: 10328 - RNA, 21 nt, Homo sapiens
caccacacuacauugcuuccc

SEQ ID NO: 10329 - RNA, 19 nt, Homo sapiens
ccuggagaaggaggacugc

SEQ ID NO: 10330 - RNA, 17 nt, Homo sapiens
uaugcccuuucugucca

SEQ ID NO: 10331 - RNA, 18 nt, Homo sapiens
ucugcccaccacacuaca

SEQ ID NO: 10332 - RNA, 22 nt, Homo sapiens
agggguugggggagggaugggg

SEQ ID NO: 10333 - RNA, 18 nt, Homo sapiens
gggggagggauggggcag

SEQ ID NO: 10334 - RNA, 17 nt, Homo sapiens
agaggugucucccucca

SEQ ID NO: 10335 - RNA, 22 nt, Homo sapiens
cccucagugugugccugugguu

SEQ ID NO: 10336 - RNA, 17 nt, Homo sapiens
ccgagacaccgagagcu

SEQ ID NO: 10337 - RNA, 20 nt, Homo sapiens
cugaagcagcucaaggggcu

SEQ ID NO: 10338 - RNA, 16 nt, Homo sapiens
gcaggaaggggagcuc

SEQ ID NO: 10339 - RNA, 18 nt, Homo sapiens
guccaggacaggaggguu

SEQ ID NO: 10340 - RNA, 22 nt, Homo sapiens
guggggucagcccgaggugggc

SEQ ID NO: 10341 - RNA, 21 nt, Homo sapiens
uaugcagacacacagacacug

SEQ ID NO: 10342 - RNA, 14 nt, Homo sapiens
ucaagcagcacagc

SEQ ID NO: 10343 - RNA, 18 nt, Homo sapiens
uccauggaggaggugggg

SEQ ID NO: 10344 - RNA, 20 nt, Homo sapiens
ugcccuuuuccggggagcag

SEQ ID NO: 10345 - RNA, 21 nt, Homo sapiens
uguggcucagcugacccgugg

SEQ ID NO: 10346 - RNA, 23 nt, Homo sapiens
uguggcucagcugacccguggca

SEQ ID NO: 10347 - RNA, 20 nt, Homo sapiens
aagaaagucuuaguuaaaga

SEQ ID NO: 10348 - RNA, 18 nt, Homo sapiens
agccaagggaugccucaa

SEQ ID NO: 10349 - RNA, 22 nt, Homo sapiens
aggcagccacuucaccugcauu

SEQ ID NO: 10350 - RNA, 21 nt, Homo sapiens
cugccgcagaggcggcccgcg

SEQ ID NO: 10351 - RNA, 21 nt, Homo sapiens
cuaaaucucuaggcucaaguc

SEQ ID NO: 10352 - RNA, 20 nt, Homo sapiens
cuuuuuggcucacagggcuc

SEQ ID NO: 10353 - RNA, 18 nt, Homo sapiens
uuucuuuguugaccagga

SEQ ID NO: 10354 - RNA, 22 nt, Homo sapiens
cacagcagcagcagcaccaggc

SEQ ID NO: 10355 - RNA, 21 nt, Homo sapiens
cuccugucucaaacugcaggg

SEQ ID NO: 10356 - RNA, 17 nt, Homo sapiens
cagcccccucccggggc

SEQ ID NO: 10357 - RNA, 17 nt, Homo sapiens
gcaggaggggcgauggg

SEQ ID NO: 10358 - RNA, 21 nt, Homo sapiens
gcccccucccggggcuccugg

SEQ ID NO: 10359 - RNA, 22 nt, Homo sapiens
gagaaguaguaacagcgauugg

SEQ ID NO: 10360 - RNA, 19 nt, Homo sapiens
ggagggggcgcagaauagc

SEQ ID NO: 10361 - RNA, 19 nt, Homo sapiens
cagcggcagcagcaaacuc

SEQ ID NO: 10362 - RNA, 23 nt, Homo sapiens
gcagaucacuugagggucaggag

SEQ ID NO: 10363 - RNA, 18 nt, Homo sapiens
gggcgcgguggugggcac

SEQ ID NO: 10364 - RNA, 22 nt, Homo sapiens
guccuugcaguuggugccuacg

SEQ ID NO: 10365 - RNA, 17 nt, Homo sapiens
aaaguggcacacucaug

SEQ ID NO: 10366 - RNA, 18 nt, Homo sapiens
agggagauuaaagaaaaa

SEQ ID NO: 10367 - RNA, 24 nt, Homo sapiens
ggucaguuacucuguuuaucugga

SEQ ID NO: 10368 - RNA, 18 nt, Homo sapiens
cggguuugcaaacaacgg

SEQ ID NO: 10369 - RNA, 18 nt, Homo sapiens
gccugcucugcuccucac

SEQ ID NO: 10370 - RNA, 16 nt, Homo sapiens
uaccuguacaccucuu

SEQ ID NO: 10371 - RNA, 18 nt, Homo sapiens
uauauauacauacagaua

SEQ ID NO: 10372 - RNA, 20 nt, Homo sapiens
ucggagcaaaagugacagcu

SEQ ID NO: 10373 - RNA, 20 nt, Homo sapiens
ugugugugugcaugugcggu

SEQ ID NO: 10374 - RNA, 20 nt, Homo sapiens
uuaguuuccacccaccuugc

SEQ ID NO: 10375 - RNA, 20 nt, Homo sapiens
uuguacauuuacugaggagg

SEQ ID NO: 10376 - RNA, 21 nt, Homo sapiens
uuucucugcucucccucucug

SEQ ID NO: 10377 - RNA, 19 nt, Homo sapiens
accccagcccagcgcuccc

SEQ ID NO: 10378 - RNA, 20 nt, Homo sapiens
aggcagcuggggcagcagcu

SEQ ID NO: 10379 - RNA, 15 nt, Homo sapiens
cuuugcucuccccag

SEQ ID NO: 10380 - RNA, 18 nt, Homo sapiens
ucgagaaaggaucugagu

SEQ ID NO: 10381 - RNA, 23 nt, Homo sapiens
ugcugaauuccuuagugcuuugc

SEQ ID NO: 10382 - RNA, 17 nt, Homo sapiens
acagcagcuggaaggcc

SEQ ID NO: 10383 - RNA, 20 nt, Homo sapiens
caggaucagcuuaaggcggc

SEQ ID NO: 10384 - RNA, 20 nt, Homo sapiens
cuguagggcuugcugagggg

SEQ ID NO: 10385 - RNA, 18 nt, Homo sapiens
gccuggacgccgcccgcc

SEQ ID NO: 10386 - RNA, 18 nt, Homo sapiens
uguacaguacauucucau

SEQ ID NO: 10387 - RNA, 19 nt, Homo sapiens
agaguuugugccagcccca

SEQ ID NO: 10388 - RNA, 18 nt, Homo sapiens
cacucagcgggcugcucc

SEQ ID NO: 10389 - RNA, 19 nt, Homo sapiens
ccgccgccgcccccagucg

SEQ ID NO: 10390 - RNA, 16 nt, Homo sapiens
gugggugggugaggga

SEQ ID NO: 10391 - RNA, 19 nt, Homo sapiens
ccgguuucuucucccuuuu

SEQ ID NO: 10392 - RNA, 17 nt, Homo sapiens
ucucgcgguccccggcc

SEQ ID NO: 10393 - RNA, 20 nt, Homo sapiens
acugacuuccuauugugccu

SEQ ID NO: 10394 - RNA, 18 nt, Homo sapiens
caccucgcagccgcgccc

SEQ ID NO: 10395 - RNA, 20 nt, Homo sapiens
cccgggccucccgcaccagg

SEQ ID NO: 10396 - RNA, 18 nt, Homo sapiens
cgucuccacgcagaggcc

SEQ ID NO: 10397 - RNA, 18 nt, Homo sapiens
gagcggccgccgcgccgg

SEQ ID NO: 10398 - RNA, 21 nt, Homo sapiens
gaggaggagaaggggcgggga

SEQ ID NO: 10399 - RNA, 15 nt, Homo sapiens
gccuccgguugccag

SEQ ID NO: 10400 - RNA, 17 nt, Homo sapiens
gcggggcgccccgccac

SEQ ID NO: 10401 - RNA, 18 nt, Homo sapiens
gguaggaggaggagaagg

SEQ ID NO: 10402 - RNA, 19 nt, Homo sapiens
ugcccgggccucccgcacc

SEQ ID NO: 10403 - RNA, 19 nt, Homo sapiens
uuacucauuuuauaguguu

SEQ ID NO: 10404 - RNA, 17 nt, Homo sapiens
ccucgcggcucuucugc

SEQ ID NO: 10405 - RNA, 17 nt, Homo sapiens
gccuccgaggcgguccc

SEQ ID NO: 10406 - RNA, 21 nt, Homo sapiens
gccuccgaggcggucccuccc

SEQ ID NO: 10407 - RNA, 19 nt, Homo sapiens
gcgccccagcccgcggugc

SEQ ID NO: 10408 - RNA, 19 nt, Homo sapiens
gcggcuuccgugauuaacg

SEQ ID NO: 10409 - RNA, 20 nt, Homo sapiens
gggggcacgaagggaaaggg

SEQ ID NO: 10410 - RNA, 18 nt, Homo sapiens
uggcugcgccccagcccg

SEQ ID NO: 10411 - RNA, 21 nt, Homo sapiens
agaggagcuggagggugggga

SEQ ID NO: 10412 - RNA, 23 nt, Homo sapiens
cagcggcgaguccuaggcgcucg

SEQ ID NO: 10413 - RNA, 21 nt, Homo sapiens
gcccugaccgcagccggcagc

SEQ ID NO: 10414 - RNA, 19 nt, Homo sapiens
gccuggggccggggcuggg

SEQ ID NO: 10415 - RNA, 20 nt, Homo sapiens
gcggggcgcgggcagcggcg

SEQ ID NO: 10416 - RNA, 20 nt, Homo sapiens
ggcaugggcuuuaaaacccu

SEQ ID NO: 10417 - RNA, 22 nt, Homo sapiens
ggcugggacgccuggggccggg

SEQ ID NO: 10418 - RNA, 18 nt, Homo sapiens
gggagaggcucagccuuc

SEQ ID NO: 10419 - RNA, 19 nt, Homo sapiens
uguuuccacguggcaggga

SEQ ID NO: 10420 - RNA, 20 nt, Homo sapiens
aaugacuccaaguaaaaaga

SEQ ID NO: 10421 - RNA, 23 nt, Homo sapiens
ucucagcuagugcuuuauaguua

SEQ ID NO: 10422 - RNA, 24 nt, Homo sapiens
agccagggccaaccaggaccaugg

SEQ ID NO: 10423 - RNA, 17 nt, Homo sapiens
aggggggaaguuuuggu

SEQ ID NO: 10424 - RNA, 20 nt, Homo sapiens
ccucugggcguggguccgug

SEQ ID NO: 10425 - RNA, 19 nt, Homo sapiens
gacuguuagggacaggaaa

SEQ ID NO: 10426 - RNA, 18 nt, Homo sapiens
ggacaggaaaggggcaca

SEQ ID NO: 10427 - RNA, 19 nt, Homo sapiens
ucccauggacaccuguucu

SEQ ID NO: 10428 - RNA, 18 nt, Homo sapiens
ugaggggcaagaguaugc

SEQ ID NO: 10429 - RNA, 18 nt, Homo sapiens
uggugucucuuugcgauu

SEQ ID NO: 10430 - RNA, 17 nt, Homo sapiens
ugugagggagguugugc

SEQ ID NO: 10431 - RNA, 17 nt, Homo sapiens
uucugagccaaauauuu

SEQ ID NO: 10432 - RNA, 18 nt, Homo sapiens
auuuacaauaauuuacag

SEQ ID NO: 10433 - RNA, 20 nt, Homo sapiens
gaagaucuguuuauaucuuu

SEQ ID NO: 10434 - RNA, 18 nt, Homo sapiens
gcaauuacuguguugguu

SEQ ID NO: 10435 - RNA, 19 nt, Homo sapiens
aaauuuccaagcacaagaa

SEQ ID NO: 10436 - RNA, 22 nt, Homo sapiens
acagaauacaagugagcuguga

SEQ ID NO: 10437 - RNA, 19 nt, Homo sapiens
agacaacuucaagcaagcu

SEQ ID NO: 10438 - RNA, 22 nt, Homo sapiens
agaggaacaaagauaaggauga

SEQ ID NO: 10439 - RNA, 19 nt, Homo sapiens
aggcaaaaggaaagugaca

SEQ ID NO: 10440 - RNA, 16 nt, Homo sapiens
caagacaugggauucg

SEQ ID NO: 10441 - RNA, 23 nt, Homo sapiens
cacagccgccaucuagagccucc

SEQ ID NO: 10442 - RNA, 18 nt, Homo sapiens
cagccgccaucuagagcc

SEQ ID NO: 10443 - RNA, 18 nt, Homo sapiens
ccaaauaaccugcaacuc

SEQ ID NO: 10444 - RNA, 30 nt, Homo sapiens
gaagagagagugggggaucagaaaaaauau

SEQ ID NO: 10445 - RNA, 15 nt, Homo sapiens
gagagagagagagag

SEQ ID NO: 10446 - RNA, 18 nt, Homo sapiens
ggcagcuacucagcuaca

SEQ ID NO: 10447 - RNA, 18 nt, Homo sapiens
gggaucccugauaccuag

SEQ ID NO: 10448 - RNA, 21 nt, Homo sapiens
uaaaaugcaaaguacacugga

SEQ ID NO: 10449 - RNA, 19 nt, Homo sapiens
uaaggacugugggcuggua

SEQ ID NO: 10450 - RNA, 24 nt, Homo sapiens
uaauauagguguaaugagaaucuc

SEQ ID NO: 10451 - RNA, 20 nt, Homo sapiens
ucccugauaccuaguguggc

SEQ ID NO: 10452 - RNA, 19 nt, Homo sapiens
ugaagaagauuguaaaaau

SEQ ID NO: 10453 - RNA, 19 nt, Homo sapiens
ugauugacacucucuacau

SEQ ID NO: 10454 - RNA, 18 nt, Homo sapiens
uucaucacaaaacaaugc

SEQ ID NO: 10455 - RNA, 23 nt, Homo sapiens
uugacauugaaaaggaaaguauu

SEQ ID NO: 10456 - RNA, 18 nt, Homo sapiens
acccuuuguuucccgauc

SEQ ID NO: 10457 - RNA, 15 nt, Homo sapiens
aggagaaagucucca

SEQ ID NO: 10458 - RNA, 21 nt, Homo sapiens
cucccugcucccuuugggaac

SEQ ID NO: 10459 - RNA, 17 nt, Homo sapiens
caagccuggcaggaacc

SEQ ID NO: 10460 - RNA, 19 nt, Homo sapiens
ugccccucacucccucccc

SEQ ID NO: 10461 - RNA, 18 nt, Homo sapiens
ugggacaagagaaaguga

SEQ ID NO: 10462 - RNA, 16 nt, Homo sapiens
ucaggaacuacuauuu

SEQ ID NO: 10463 - RNA, 15 nt, Homo sapiens
uucugcccuccucag

SEQ ID NO: 10464 - RNA, 19 nt, Homo sapiens
uuucaaauucagauacuaa

SEQ ID NO: 10465 - RNA, 19 nt, Homo sapiens
gaggggcggcuggacuggc

SEQ ID NO: 10466 - RNA, 18 nt, Homo sapiens
gcgcggggcugggggcgc

SEQ ID NO: 10467 - RNA, 17 nt, Homo sapiens
gcuggcgguguggggcc

SEQ ID NO: 10468 - RNA, 18 nt, Homo sapiens
ggcggcuggacuggcggc

SEQ ID NO: 10469 - RNA, 20 nt, Homo sapiens
ggcggcuggacuggcggccg

SEQ ID NO: 10470 - RNA, 21 nt, Homo sapiens
ggcgguguggggccgggcacc

SEQ ID NO: 10471 - RNA, 21 nt, Homo sapiens
ggcugggggcgcagugccucg

SEQ ID NO: 10472 - RNA, 22 nt, Homo sapiens
ugcaguggcaggagcgguggca

SEQ ID NO: 10473 - RNA, 19 nt, Homo sapiens
uucaccaaaaggucagaag

SEQ ID NO: 10474 - RNA, 21 nt, Homo sapiens
cccgagucuuacauugcgaug

SEQ ID NO: 10475 - RNA, 20 nt, Homo sapiens
gcucccggccagcuggagcc

SEQ ID NO: 10476 - RNA, 21 nt, Homo sapiens
ugucuuguaggauguuuggcu

SEQ ID NO: 10477 - RNA, 19 nt, Homo sapiens
aacacugcuaaacaggcug

SEQ ID NO: 10478 - RNA, 16 nt, Homo sapiens
aacuucugucagcuuu

SEQ ID NO: 10479 - RNA, 24 nt, Homo sapiens
agggauaaggcuacuacagguaag

SEQ ID NO: 10480 - RNA, 21 nt, Homo sapiens
caacugguaugaaacaggguu

SEQ ID NO: 10481 - RNA, 19 nt, Homo sapiens
cacacuuuuccuucuggaa

SEQ ID NO: 10482 - RNA, 20 nt, Homo sapiens
ccccauuucuuuccagaguc

SEQ ID NO: 10483 - RNA, 17 nt, Homo sapiens
gacacacuuuuccuucu

SEQ ID NO: 10484 - RNA, 21 nt, Homo sapiens
gagccggagagcacagcccag

SEQ ID NO: 10485 - RNA, 17 nt, Homo sapiens
gagcuguuauccaucac

SEQ ID NO: 10486 - RNA, 23 nt, Homo sapiens
gagggggugaggggacagcaucu

SEQ ID NO: 10487 - RNA, 22 nt, Homo sapiens
ggcggggguggcggcgggagcc

SEQ ID NO: 10488 - RNA, 17 nt, Homo sapiens
gggaccgcuccccacaa

SEQ ID NO: 10489 - RNA, 17 nt, Homo sapiens
gggugaggggacagcau

SEQ ID NO: 10490 - RNA, 20 nt, Homo sapiens
gguggcggcgggagccggag

SEQ ID NO: 10491 - RNA, 23 nt, Homo sapiens
uaacacugcuaaacaggcuggua

SEQ ID NO: 10492 - RNA, 18 nt, Homo sapiens
uccaaaugaccagggaua

SEQ ID NO: 10493 - RNA, 17 nt, Homo sapiens
uccacgauuccuccucu

SEQ ID NO: 10494 - RNA, 22 nt, Homo sapiens
uccccaucucuacucaaauucc

SEQ ID NO: 10495 - RNA, 20 nt, Homo sapiens
ugagauuauaauauggaaag

SEQ ID NO: 10496 - RNA, 21 nt, Homo sapiens
ugcccuaauguuagcacaggu

SEQ ID NO: 10497 - RNA, 19 nt, Homo sapiens
uguagaaaaagccagccau

SEQ ID NO: 10498 - RNA, 17 nt, Homo sapiens
uguaggaaaagaggguu

SEQ ID NO: 10499 - RNA, 20 nt, Homo sapiens
gccuccggcucggcgcgucc

SEQ ID NO: 10500 - RNA, 19 nt, Homo sapiens
guccaggcuccccucccag

SEQ ID NO: 10501 - RNA, 20 nt, Homo sapiens
guggagguagguuaugggac

SEQ ID NO: 10502 - RNA, 20 nt, Homo sapiens
ugcccugaacaccuuuuccc

SEQ ID NO: 10503 - RNA, 18 nt, Homo sapiens
uggcaagguuagaaaaaa

SEQ ID NO: 10504 - RNA, 20 nt, Homo sapiens
agaaguccaguuaccuugga

SEQ ID NO: 10505 - RNA, 19 nt, Homo sapiens
cuuuaaaaucacugagcaa

SEQ ID NO: 10506 - RNA, 22 nt, Homo sapiens
uaucaggcaaacagaaaggugc

SEQ ID NO: 10507 - RNA, 20 nt, Homo sapiens
uaccauuauauauauacaga

SEQ ID NO: 10508 - RNA, 16 nt, Homo sapiens
uguuuuacuauugcuc

SEQ ID NO: 10509 - RNA, 18 nt, Homo sapiens
caaggucaggagcaaauc

SEQ ID NO: 10510 - RNA, 14 nt, Homo sapiens
ucagggcaggcggc

SEQ ID NO: 10511 - RNA, 17 nt, Homo sapiens
aggccgggguccccaug

SEQ ID NO: 10512 - RNA, 21 nt, Homo sapiens
cccuggugcuacgaguccgug

SEQ ID NO: 10513 - RNA, 18 nt, Homo sapiens
ccgccugcccgcccagcu

SEQ ID NO: 10514 - RNA, 19 nt, Homo sapiens
ccgcgccugccgccugccc

SEQ ID NO: 10515 - RNA, 22 nt, Homo sapiens
ccggccccggugcccaccggcc

SEQ ID NO: 10516 - RNA, 20 nt, Homo sapiens
cugccgccugcccgcccagc

SEQ ID NO: 10517 - RNA, 16 nt, Homo sapiens
gcccucggggcagcag

SEQ ID NO: 10518 - RNA, 18 nt, Homo sapiens
gccgccugcccgcccagc

SEQ ID NO: 10519 - RNA, 20 nt, Homo sapiens
gcugggccagguguccucug

SEQ ID NO: 10520 - RNA, 21 nt, Homo sapiens
ggccuuggagguuuuucucag

SEQ ID NO: 10521 - RNA, 23 nt, Homo sapiens
ggguugggggaccaaggcagggc

SEQ ID NO: 10522 - RNA, 18 nt, Homo sapiens
uccagggcagggcagccc

SEQ ID NO: 10523 - RNA, 17 nt, Homo sapiens
ugcaagucaaaaagcag

SEQ ID NO: 10524 - RNA, 21 nt, Homo sapiens
caacuuguugucucaguauag

SEQ ID NO: 10525 - RNA, 20 nt, Homo sapiens
cacagucaagguaggaauua

SEQ ID NO: 10526 - RNA, 16 nt, Homo sapiens
gcccuggaagaggcag

SEQ ID NO: 10527 - RNA, 15 nt, Homo sapiens
gcggcaacacaggcc

SEQ ID NO: 10528 - RNA, 15 nt, Homo sapiens
ggaagaggcaccaag

SEQ ID NO: 10529 - RNA, 20 nt, Homo sapiens
uaaaaggcuggaaauuaaag

SEQ ID NO: 10530 - RNA, 17 nt, Homo sapiens
agccaccaugcccggca

SEQ ID NO: 10531 - RNA, 24 nt, Homo sapiens
cgcuggggcgaggggcgcagcggg

SEQ ID NO: 10532 - RNA, 20 nt, Homo sapiens
gcuggcgugcuggcgggacg

SEQ ID NO: 10533 - RNA, 18 nt, Homo sapiens
ggcgugcuggcgggacgg

SEQ ID NO: 10534 - RNA, 17 nt, Homo sapiens
aggaagaagaaagaaaa

SEQ ID NO: 10535 - RNA, 18 nt, Homo sapiens
auggaggauaggggcugu

SEQ ID NO: 10536 - RNA, 16 nt, Homo sapiens
gagacaaaaaguccca

SEQ ID NO: 10537 - RNA, 22 nt, Homo sapiens
uaaaauauauacauuuugagga

SEQ ID NO: 10538 - RNA, 23 nt, Homo sapiens
uaagugaaggauggaauuugagg

SEQ ID NO: 10539 - RNA, 19 nt, Homo sapiens
cgggggcaguggcggcacu

SEQ ID NO: 10540 - RNA, 17 nt, Homo sapiens
gcucugggggcuuugcu

SEQ ID NO: 10541 - RNA, 24 nt, Homo sapiens
ucugcacacucuucccuccucaca

SEQ ID NO: 10542 - RNA, 19 nt, Homo sapiens
ugggggcuuugcuggggga

SEQ ID NO: 10543 - RNA, 19 nt, Homo sapiens
ugugagggaguggggggac

SEQ ID NO: 10544 - RNA, 18 nt, Homo sapiens
gaaggaggagaggaaaga

SEQ ID NO: 10545 - RNA, 24 nt, Homo sapiens
agcauuuuggguaauauuuaaaaa

SEQ ID NO: 10546 - RNA, 21 nt, Homo sapiens
aggagagcguggugucuggag

SEQ ID NO: 10547 - RNA, 17 nt, Homo sapiens
cccagcaauuucucuuc

SEQ ID NO: 10548 - RNA, 16 nt, Homo sapiens
ccgccaucuuccuucc

SEQ ID NO: 10549 - RNA, 21 nt, Homo sapiens
cgggcuccgaaaggagagcgu

SEQ ID NO: 10550 - RNA, 20 nt, Homo sapiens
gagaaucaaugaauuguaca

SEQ ID NO: 10551 - RNA, 14 nt, Homo sapiens
gccaccaagugcca

SEQ ID NO: 10552 - RNA, 22 nt, Homo sapiens
ggagagcguggugucuggaggu

SEQ ID NO: 10553 - RNA, 17 nt, Homo sapiens
gggugggggccagaggu

SEQ ID NO: 10554 - RNA, 18 nt, Homo sapiens
gguugagaaugugugggg

SEQ ID NO: 10555 - RNA, 16 nt, Homo sapiens
uagcuauugguauugu

SEQ ID NO: 10556 - RNA, 18 nt, Homo sapiens
uggcagcggagggaaagg

SEQ ID NO: 10557 - RNA, 19 nt, Homo sapiens
uuucuuauuuggggagcau

SEQ ID NO: 10558 - RNA, 22 nt, Homo sapiens
ccccugauuuaguauaaguuca

SEQ ID NO: 10559 - RNA, 23 nt, Homo sapiens
uaaagcuuuaugucgauucugac

SEQ ID NO: 10560 - RNA, 23 nt, Homo sapiens
uagcucaucuuaaauuaaaaaga

SEQ ID NO: 10561 - RNA, 25 nt, Homo sapiens
ucucucuucuuaaugcaguguucuc

SEQ ID NO: 10562 - RNA, 21 nt, Homo sapiens
ugcaaguaggucucuuccaca

SEQ ID NO: 10563 - RNA, 22 nt, Homo sapiens
aggggccggggccgcugggccu

SEQ ID NO: 10564 - RNA, 19 nt, Homo sapiens
ccggggccgcugggccugg

SEQ ID NO: 10565 - RNA, 19 nt, Homo sapiens
cggcaaggcccgcuccacc

SEQ ID NO: 10566 - RNA, 17 nt, Homo sapiens
cggcgcgcgcuaacggc

SEQ ID NO: 10567 - RNA, 20 nt, Homo sapiens
cuuccuggcuucugggggug

SEQ ID NO: 10568 - RNA, 16 nt, Homo sapiens
ggagacgaggggccgg

SEQ ID NO: 10569 - RNA, 23 nt, Homo sapiens
ggccuggcgggagcugcggcgcc

SEQ ID NO: 10570 - RNA, 17 nt, Homo sapiens
cuagccucuucacccgc

SEQ ID NO: 10571 - RNA, 15 nt, Homo sapiens
cugaucugagagcag

SEQ ID NO: 10572 - RNA, 20 nt, Homo sapiens
aaaauauacuuuauuuggaa

SEQ ID NO: 10573 - RNA, 15 nt, Homo sapiens
agcugcaaggggaaa

SEQ ID NO: 10574 - RNA, 16 nt, Homo sapiens
aggcggccccaaacgc

SEQ ID NO: 10575 - RNA, 21 nt, Homo sapiens
aggggagaaagcucaaaugac

SEQ ID NO: 10576 - RNA, 17 nt, Homo sapiens
auacuuuauuuggaagc

SEQ ID NO: 10577 - RNA, 21 nt, Homo sapiens
cagcgacagagaacacaacuc

SEQ ID NO: 10578 - RNA, 19 nt, Homo sapiens
cauuuugguagaaauugca

SEQ ID NO: 10579 - RNA, 18 nt, Homo sapiens
cuuaaacugccaguucag

SEQ ID NO: 10580 - RNA, 22 nt, Homo sapiens
gcaaaaauacaaucuucaucga

SEQ ID NO: 10581 - RNA, 18 nt, Homo sapiens
gcccacuagcugcggugc

SEQ ID NO: 10582 - RNA, 20 nt, Homo sapiens
gcggugcugugcacaacucc

SEQ ID NO: 10583 - RNA, 18 nt, Homo sapiens
uacucuguuuacucagaa

SEQ ID NO: 10584 - RNA, 22 nt, Homo sapiens
uauuuucccccuuuucuuucuu

SEQ ID NO: 10585 - RNA, 16 nt, Homo sapiens
ucaacguucucuuagu

SEQ ID NO: 10586 - RNA, 23 nt, Homo sapiens
ucagagccugucaggaaauucau

SEQ ID NO: 10587 - RNA, 16 nt, Homo sapiens
ucucuacuccuguguu

SEQ ID NO: 10588 - RNA, 18 nt, Homo sapiens
ucugcaaguauggauuug

SEQ ID NO: 10589 - RNA, 16 nt, Homo sapiens
uggccugagagaagag

SEQ ID NO: 10590 - RNA, 21 nt, Homo sapiens
acgcgcggcugccccggcugc

SEQ ID NO: 10591 - RNA, 16 nt, Homo sapiens
agcaugaacacaacug

SEQ ID NO: 10592 - RNA, 21 nt, Homo sapiens
aggaagggggaaugaaaacac

SEQ ID NO: 10593 - RNA, 18 nt, Homo sapiens
ccgcccgccgccgcuccg

SEQ ID NO: 10594 - RNA, 16 nt, Homo sapiens
ccgccgccgcuccggc

SEQ ID NO: 10595 - RNA, 22 nt, Homo sapiens
cgcccgccgccgcuccggcugc

SEQ ID NO: 10596 - RNA, 16 nt, Homo sapiens
cggccccgcucccagc

SEQ ID NO: 10597 - RNA, 16 nt, Homo sapiens
gccccggcugcucggc

SEQ ID NO: 10598 - RNA, 16 nt, Homo sapiens
gcucggcccgcccgcc

SEQ ID NO: 10599 - RNA, 17 nt, Homo sapiens
guggagguggggcgagc

SEQ ID NO: 10600 - RNA, 21 nt, Homo sapiens
guuguuaaguaaaaaugggag

SEQ ID NO: 10601 - RNA, 19 nt, Homo sapiens
ugcggggcugucugacugg

SEQ ID NO: 10602 - RNA, 18 nt, Homo sapiens
aacacguauguggucaca

SEQ ID NO: 10603 - RNA, 19 nt, Homo sapiens
aggcacuugaauaauauuu

SEQ ID NO: 10604 - RNA, 19 nt, Homo sapiens
acgcggcagggcugagggc

SEQ ID NO: 10605 - RNA, 20 nt, Homo sapiens
agacugcagcagccgugccc

SEQ ID NO: 10606 - RNA, 17 nt, Homo sapiens
cagcgcccacccgcccc

SEQ ID NO: 10607 - RNA, 15 nt, Homo sapiens
ccccaaggggcugca

SEQ ID NO: 10608 - RNA, 18 nt, Homo sapiens
ccccaccccugccuuccc

SEQ ID NO: 10609 - RNA, 18 nt, Homo sapiens
cccccucccaggagggcc

SEQ ID NO: 10610 - RNA, 21 nt, Homo sapiens
cccccucccaggagggccugg

SEQ ID NO: 10611 - RNA, 20 nt, Homo sapiens
ccccugccuuccccuuuggu

SEQ ID NO: 10612 - RNA, 16 nt, Homo sapiens
cgagaagcacccgccu

SEQ ID NO: 10613 - RNA, 21 nt, Homo sapiens
cucgagaaaacggccuuugga

SEQ ID NO: 10614 - RNA, 15 nt, Homo sapiens
gcaccccacugggga

SEQ ID NO: 10615 - RNA, 15 nt, Homo sapiens
ggagggccugggcaa

SEQ ID NO: 10616 - RNA, 21 nt, Homo sapiens
ggcggcuggcggggcggggcc

SEQ ID NO: 10617 - RNA, 23 nt, Homo sapiens
gggcaggagugggguagggcggg

SEQ ID NO: 10618 - RNA, 21 nt, Homo sapiens
ggggcaggagugggguagggc

SEQ ID NO: 10619 - RNA, 23 nt, Homo sapiens
ggggcaggagugggguagggcgg

SEQ ID NO: 10620 - RNA, 19 nt, Homo sapiens
ugacgcuaacgggggcggc

SEQ ID NO: 10621 - RNA, 22 nt, Homo sapiens
gggugggaguaggaggugguca

SEQ ID NO: 10622 - RNA, 22 nt, Homo sapiens
gagcccucagagccgugagugc

SEQ ID NO: 10623 - RNA, 18 nt, Homo sapiens
agcaaaaagaggucaccc

SEQ ID NO: 10624 - RNA, 18 nt, Homo sapiens
ggcggcgguggcgguggc

SEQ ID NO: 10625 - RNA, 19 nt, Homo sapiens
cagcgggaggaggcggggc

SEQ ID NO: 10626 - RNA, 16 nt, Homo sapiens
cgggaggaggcggggc

SEQ ID NO: 10627 - RNA, 21 nt, Homo sapiens
gaaggagggagagcaagaaaa

SEQ ID NO: 10628 - RNA, 20 nt, Homo sapiens
ggaaggauggcuugagccca

SEQ ID NO: 10629 - RNA, 22 nt, Homo sapiens
ugaaggaaaggaggacaucaaa

SEQ ID NO: 10630 - RNA, 24 nt, Homo sapiens
aaaaagcacuuuguugacaaggag

SEQ ID NO: 10631 - RNA, 17 nt, Homo sapiens
aacgauaacccuuacgc

SEQ ID NO: 10632 - RNA, 22 nt, Homo sapiens
agaaacugcugaaugccuuguu

SEQ ID NO: 10633 - RNA, 18 nt, Homo sapiens
caucauaaagaaaacugg

SEQ ID NO: 10634 - RNA, 21 nt, Homo sapiens
ccggcccgaaugccucgucuc

SEQ ID NO: 10635 - RNA, 21 nt, Homo sapiens
ggcguugcgcggcgccgcccg

SEQ ID NO: 10636 - RNA, 25 nt, Homo sapiens
uaaacuauucugugucuugugcuua

SEQ ID NO: 10637 - RNA, 18 nt, Homo sapiens
uugcccaacugcagcauc

SEQ ID NO: 10638 - RNA, 22 nt, Homo sapiens
uaucuuacacaauaagcguuug

SEQ ID NO: 10639 - RNA, 25 nt, Homo sapiens
uuguacaucuuuuuacccccagaag

SEQ ID NO: 10640 - RNA, 18 nt, Homo sapiens
gaaaggaacacggagagc

SEQ ID NO: 10641 - RNA, 19 nt, Homo sapiens
uauuccguacaguuccuga

SEQ ID NO: 10642 - RNA, 22 nt, Homo sapiens
caaaacaguaugauaugaaggg

SEQ ID NO: 10643 - RNA, 18 nt, Homo sapiens
uaugaagggauguggugg

SEQ ID NO: 10644 - RNA, 18 nt, Homo sapiens
ccaauaagcugccaucuc

SEQ ID NO: 10645 - RNA, 15 nt, Homo sapiens
cguugcuuggaccuc

SEQ ID NO: 10646 - RNA, 23 nt, Homo sapiens
cuuccguugcuuggaccucuuca

SEQ ID NO: 10647 - RNA, 17 nt, Homo sapiens
ugugcgcauggggaaca

SEQ ID NO: 10648 - RNA, 19 nt, Homo sapiens
uguguuuuggggugugugu

SEQ ID NO: 10649 - RNA, 16 nt, Homo sapiens
uuggaggccaagggug

SEQ ID NO: 10650 - RNA, 20 nt, Homo sapiens
cccgccugcgcagcccucuc

SEQ ID NO: 10651 - RNA, 19 nt, Homo sapiens
ccugcagccugcuccucgc

SEQ ID NO: 10652 - RNA, 17 nt, Homo sapiens
ccugugggaauguggag

SEQ ID NO: 10653 - RNA, 18 nt, Homo sapiens
cgugcgccugcugagccc

SEQ ID NO: 10654 - RNA, 15 nt, Homo sapiens
cucucgggggagggg

SEQ ID NO: 10655 - RNA, 21 nt, Homo sapiens
gccgccucuaagcaaacaugu

SEQ ID NO: 10656 - RNA, 17 nt, Homo sapiens
ggggaccgaagcuggcc

SEQ ID NO: 10657 - RNA, 19 nt, Homo sapiens
gguggcccggggcgcuccu

SEQ ID NO: 10658 - RNA, 23 nt, Homo sapiens
ucucagaagaugagacaagaucu

SEQ ID NO: 10659 - RNA, 19 nt, Homo sapiens
uguaugugugugugugugu

SEQ ID NO: 10660 - RNA, 21 nt, Homo sapiens
uguguaugugugugugugugu

SEQ ID NO: 10661 - RNA, 19 nt, Homo sapiens
ugugugcaugugugagugu

SEQ ID NO: 10662 - RNA, 15 nt, Homo sapiens
uugaaacagaaugua

SEQ ID NO: 10663 - RNA, 24 nt, Homo sapiens
uuuuuuuccuucccuuuuuacaca

SEQ ID NO: 10664 - RNA, 19 nt, Homo sapiens
gcccuugggcugccccagc

SEQ ID NO: 10665 - RNA, 20 nt, Homo sapiens
cccccggagggaggaagugg

SEQ ID NO: 10666 - RNA, 21 nt, Homo sapiens
cucaagauuuauucaggaucg

SEQ ID NO: 10667 - RNA, 19 nt, Homo sapiens
uaacggaggcggugggagg

SEQ ID NO: 10668 - RNA, 20 nt, Homo sapiens
aagcugguuaucuccaggcc

SEQ ID NO: 10669 - RNA, 16 nt, Homo sapiens
cagggucccuggcacc

SEQ ID NO: 10670 - RNA, 16 nt, Homo sapiens
gaaacagcuccucaga

SEQ ID NO: 10671 - RNA, 16 nt, Homo sapiens
gaagaggauuauguga

SEQ ID NO: 10672 - RNA, 19 nt, Homo sapiens
ugaggaugaagaagaggau

SEQ ID NO: 10673 - RNA, 16 nt, Homo sapiens
ugcccuggaucccucc

SEQ ID NO: 10674 - RNA, 20 nt, Homo sapiens
acaauguucaucuuuggcca

SEQ ID NO: 10675 - RNA, 18 nt, Homo sapiens
cacguacaacgugugccc

SEQ ID NO: 10676 - RNA, 18 nt, Homo sapiens
uggagcgcaccgcgcggc

SEQ ID NO: 10677 - RNA, 20 nt, Homo sapiens
agaagcauuuucaaccauuu

SEQ ID NO: 10678 - RNA, 15 nt, Homo sapiens
uaaacugcaaaacau

SEQ ID NO: 10679 - RNA, 19 nt, Homo sapiens
uuuuuuuuuuuuccguaua

SEQ ID NO: 10680 - RNA, 18 nt, Homo sapiens
gcgguugggcgcaggggg

SEQ ID NO: 10681 - RNA, 22 nt, Homo sapiens
aggacuaguaaaggugacuggg

SEQ ID NO: 10682 - RNA, 20 nt, Homo sapiens
agguacuggacaccugccaa

SEQ ID NO: 10683 - RNA, 14 nt, Homo sapiens
caagugcugggcuc

SEQ ID NO: 10684 - RNA, 18 nt, Homo sapiens
ccucagggaagaaagcac

SEQ ID NO: 10685 - RNA, 19 nt, Homo sapiens
cgcccaccuuccccuggcc

SEQ ID NO: 10686 - RNA, 19 nt, Homo sapiens
cuggccugcuugcgcgcgc

SEQ ID NO: 10687 - RNA, 21 nt, Homo sapiens
gccccacccacgacugcagag

SEQ ID NO: 10688 - RNA, 21 nt, Homo sapiens
cagcacaucagugucacuggg

SEQ ID NO: 10689 - RNA, 21 nt, Homo sapiens
cagcugcgcucagggcgcgcg

SEQ ID NO: 10690 - RNA, 19 nt, Homo sapiens
cccccaccucucuuucccc

SEQ ID NO: 10691 - RNA, 25 nt, Homo sapiens
cccccaccucucuuugaccguuugg

SEQ ID NO: 10692 - RNA, 16 nt, Homo sapiens
gcgcgcgggcguggcc

SEQ ID NO: 10693 - RNA, 23 nt, Homo sapiens
ggagauuguucauguggcugagg

SEQ ID NO: 10694 - RNA, 18 nt, Homo sapiens
ucagucugaaaugguggc

SEQ ID NO: 10695 - RNA, 18 nt, Homo sapiens
cauuucacugagcagacu

SEQ ID NO: 10696 - RNA, 15 nt, Homo sapiens
cccuuuggccccucu

SEQ ID NO: 10697 - RNA, 18 nt, Homo sapiens
ccguucccucugucaguu

SEQ ID NO: 10698 - RNA, 19 nt, Homo sapiens
accccugccccacccuccc

SEQ ID NO: 10699 - RNA, 18 nt, Homo sapiens
aggaguguccccccucca

SEQ ID NO: 10700 - RNA, 17 nt, Homo sapiens
agggaggccggggggag

SEQ ID NO: 10701 - RNA, 20 nt, Homo sapiens
aggggugggagggaggccgg

SEQ ID NO: 10702 - RNA, 18 nt, Homo sapiens
cagaaggcggcagcauuu

SEQ ID NO: 10703 - RNA, 27 nt, Homo sapiens
cccccggugggucugugcacgggcucg

SEQ ID NO: 10704 - RNA, 16 nt, Homo sapiens
cccucccuuuuguguu

SEQ ID NO: 10705 - RNA, 18 nt, Homo sapiens
cuuaagccccuuccucau

SEQ ID NO: 10706 - RNA, 17 nt, Homo sapiens
cuuuacuaagggagggg

SEQ ID NO: 10707 - RNA, 18 nt, Homo sapiens
gggagggaggccgggggg

SEQ ID NO: 10708 - RNA, 18 nt, Homo sapiens
gggggcaggugggggcgg

SEQ ID NO: 10709 - RNA, 18 nt, Homo sapiens
gugggagaggauggggga

SEQ ID NO: 10710 - RNA, 22 nt, Homo sapiens
uuuuccccaaaaaaauucccag

SEQ ID NO: 10711 - RNA, 17 nt, Homo sapiens
ccgucccccgccccccc

SEQ ID NO: 10712 - RNA, 23 nt, Homo sapiens
ucgaacuccugaccucaagugau

SEQ ID NO: 10713 - RNA, 21 nt, Homo sapiens
agugcauguuggggauuccug

SEQ ID NO: 10714 - RNA, 18 nt, Homo sapiens
aucagugcauguugggga

SEQ ID NO: 10715 - RNA, 20 nt, Homo sapiens
gcggcggcagcgcaggcgcc

SEQ ID NO: 10716 - RNA, 19 nt, Homo sapiens
gggaggaggggauguacca

SEQ ID NO: 10717 - RNA, 18 nt, Homo sapiens
ccuuugaagaaaaagcag

SEQ ID NO: 10718 - RNA, 19 nt, Homo sapiens
uacgauggcacaucccgga

SEQ ID NO: 10719 - RNA, 19 nt, Homo sapiens
ucaguauucuuaaugcugu

SEQ ID NO: 10720 - RNA, 19 nt, Homo sapiens
uggauaaucauugguggac

SEQ ID NO: 10721 - RNA, 21 nt, Homo sapiens
agggaagggauggcuuugggg

SEQ ID NO: 10722 - RNA, 19 nt, Homo sapiens
aucccuagugccaccuccc

SEQ ID NO: 10723 - RNA, 17 nt, Homo sapiens
ggaguaaggauccaggc

SEQ ID NO: 10724 - RNA, 20 nt, Homo sapiens
caggacccggauugcugccu

SEQ ID NO: 10725 - RNA, 17 nt, Homo sapiens
ccucugccagggccguc

SEQ ID NO: 10726 - RNA, 22 nt, Homo sapiens
cgccaucaccugccugcgcaug

SEQ ID NO: 10727 - RNA, 15 nt, Homo sapiens
gaagaacgcggagag

SEQ ID NO: 10728 - RNA, 17 nt, Homo sapiens
gagguaggccugacgcu

SEQ ID NO: 10729 - RNA, 18 nt, Homo sapiens
ucaguacaggcagggccc

SEQ ID NO: 10730 - RNA, 17 nt, Homo sapiens
ucugaaaaccaccagcc

SEQ ID NO: 10731 - RNA, 19 nt, Homo sapiens
ugagaggggaugacuuugu

SEQ ID NO: 10732 - RNA, 15 nt, Homo sapiens
acugagaaacugagc

SEQ ID NO: 10733 - RNA, 18 nt, Homo sapiens
aguggcuacuguacugga

SEQ ID NO: 10734 - RNA, 19 nt, Homo sapiens
ccaggguccuucaaggauc

SEQ ID NO: 10735 - RNA, 14 nt, Homo sapiens
uacuggacagugca

SEQ ID NO: 10736 - RNA, 23 nt, Homo sapiens
ucaaguacgaguuugagaaaccc

SEQ ID NO: 10737 - RNA, 23 nt, Homo sapiens
ugggcagaggccagggaugcugc

SEQ ID NO: 10738 - RNA, 18 nt, Homo sapiens
aguggugaauuuuuucua

SEQ ID NO: 10739 - RNA, 15 nt, Homo sapiens
uggcugugaagggaa

SEQ ID NO: 10740 - RNA, 20 nt, Homo sapiens
aaaaagaaaagaaaaaggca

SEQ ID NO: 10741 - RNA, 18 nt, Homo sapiens
aaaggugacagaaaagga

SEQ ID NO: 10742 - RNA, 17 nt, Homo sapiens
agagagacaaggguggu

SEQ ID NO: 10743 - RNA, 18 nt, Homo sapiens
agggggccauguguuuaa

SEQ ID NO: 10744 - RNA, 23 nt, Homo sapiens
caaauacaacauugcuuaagaga

SEQ ID NO: 10745 - RNA, 19 nt, Homo sapiens
cacccggaaucagcugggu

SEQ ID NO: 10746 - RNA, 16 nt, Homo sapiens
cauuucuccucuugca

SEQ ID NO: 10747 - RNA, 16 nt, Homo sapiens
cuacuuugugauguuu

SEQ ID NO: 10748 - RNA, 20 nt, Homo sapiens
cugcagccucauaccucuaa

SEQ ID NO: 10749 - RNA, 17 nt, Homo sapiens
cugucugcgguuccacg

SEQ ID NO: 10750 - RNA, 15 nt, Homo sapiens
gagagagagagagag

SEQ ID NO: 10751 - RNA, 21 nt, Homo sapiens
gagagagagagagagaaggag

SEQ ID NO: 10752 - RNA, 15 nt, Homo sapiens
gcaagggaggaaaac

SEQ ID NO: 10753 - RNA, 18 nt, Homo sapiens
gcaggugguuagcaccag

SEQ ID NO: 10754 - RNA, 18 nt, Homo sapiens
gggugugguucccuguau

SEQ ID NO: 10755 - RNA, 18 nt, Homo sapiens
gugauggaaugaccuacu

SEQ ID NO: 10756 - RNA, 18 nt, Homo sapiens
uauagggccucuuucuau

SEQ ID NO: 10757 - RNA, 21 nt, Homo sapiens
ucccuguaugagcuugguggg

SEQ ID NO: 10758 - RNA, 19 nt, Homo sapiens
ucugcgguuccacguguga

SEQ ID NO: 10759 - RNA, 20 nt, Homo sapiens
accccagccccucugcaccc

SEQ ID NO: 10760 - RNA, 22 nt, Homo sapiens
agaggcaauaugaggagguugg

SEQ ID NO: 10761 - RNA, 22 nt, Homo sapiens
augaggugccagugaauucgaa

SEQ ID NO: 10762 - RNA, 23 nt, Homo sapiens
caaaaugugcucccucugcucaa

SEQ ID NO: 10763 - RNA, 17 nt, Homo sapiens
cacuucggaagucccaa

SEQ ID NO: 10764 - RNA, 23 nt, Homo sapiens
ccuagucaaugagguauaugcuu

SEQ ID NO: 10765 - RNA, 21 nt, Homo sapiens
ccucccuccuucuucugcucc

SEQ ID NO: 10766 - RNA, 16 nt, Homo sapiens
cggaagucccaagggc

SEQ ID NO: 10767 - RNA, 18 nt, Homo sapiens
cuucugcuccggcucgcc

SEQ ID NO: 10768 - RNA, 21 nt, Homo sapiens
gaauggaaagguggaaccagg

SEQ ID NO: 10769 - RNA, 22 nt, Homo sapiens
gcagacccuagggagcuguggu

SEQ ID NO: 10770 - RNA, 18 nt, Homo sapiens
gcagagcagagagugcag

SEQ ID NO: 10771 - RNA, 19 nt, Homo sapiens
gcuccggcucgcccgcgcc

SEQ ID NO: 10772 - RNA, 20 nt, Homo sapiens
ggaacuuacaaugaaugcug

SEQ ID NO: 10773 - RNA, 18 nt, Homo sapiens
ggagaaagccugggaagc

SEQ ID NO: 10774 - RNA, 17 nt, Homo sapiens
ggcucccucccuccuuc

SEQ ID NO: 10775 - RNA, 22 nt, Homo sapiens
ggugguggcugcagcggcuggc

SEQ ID NO: 10776 - RNA, 18 nt, Homo sapiens
uaagugaagaaagagagg

SEQ ID NO: 10777 - RNA, 18 nt, Homo sapiens
uaguuauuuuaauaacca

SEQ ID NO: 10778 - RNA, 18 nt, Homo sapiens
ucaagcuggaguuuucca

SEQ ID NO: 10779 - RNA, 22 nt, Homo sapiens
ucaccugacccacccaccuccc

SEQ ID NO: 10780 - RNA, 20 nt, Homo sapiens
ucagagagaaccgggaugga

SEQ ID NO: 10781 - RNA, 19 nt, Homo sapiens
uggaaggggaaacaggugg

SEQ ID NO: 10782 - RNA, 21 nt, Homo sapiens
ugggaagcuuguggcaaggaa

SEQ ID NO: 10783 - RNA, 20 nt, Homo sapiens
uucugguggaaugguucacu

SEQ ID NO: 10784 - RNA, 19 nt, Homo sapiens
uuggggggcaggccaaggg

SEQ ID NO: 10785 - RNA, 18 nt, Homo sapiens
gaagggcccccaacccaa

SEQ ID NO: 10786 - RNA, 18 nt, Homo sapiens
gagccaggguccuggggu

SEQ ID NO: 10787 - RNA, 17 nt, Homo sapiens
gcgguggcggcggcacc

SEQ ID NO: 10788 - RNA, 17 nt, Homo sapiens
guuuggguguuugugug

SEQ ID NO: 10789 - RNA, 17 nt, Homo sapiens
ugcaggcucagcacuac

SEQ ID NO: 10790 - RNA, 22 nt, Homo sapiens
acgcugcggccggagcccaggu

SEQ ID NO: 10791 - RNA, 18 nt, Homo sapiens
ccgcccgcccgccgcccg

SEQ ID NO: 10792 - RNA, 18 nt, Homo sapiens
ccgcccgccgccgccgcc

SEQ ID NO: 10793 - RNA, 20 nt, Homo sapiens
ccgcgccccacgcugcggcc

SEQ ID NO: 10794 - RNA, 18 nt, Homo sapiens
ccgcgcuccgcccggccc

SEQ ID NO: 10795 - RNA, 18 nt, Homo sapiens
ccgcuccccggccucccg

SEQ ID NO: 10796 - RNA, 17 nt, Homo sapiens
ccugccgcuccccggcc

SEQ ID NO: 10797 - RNA, 19 nt, Homo sapiens
cgccccccgcgcuccgccc

SEQ ID NO: 10798 - RNA, 20 nt, Homo sapiens
cgccgcccgcccgccgcccg

SEQ ID NO: 10799 - RNA, 17 nt, Homo sapiens
cgcgagcgacgcgccgg

SEQ ID NO: 10800 - RNA, 16 nt, Homo sapiens
cgcuccgcccggcccg

SEQ ID NO: 10801 - RNA, 18 nt, Homo sapiens
gcccgcccgccgcccgcc

SEQ ID NO: 10802 - RNA, 17 nt, Homo sapiens
gcccgccgcccgccgcc

SEQ ID NO: 10803 - RNA, 22 nt, Homo sapiens
gccgcucggcaccugcccgggg

SEQ ID NO: 10804 - RNA, 17 nt, Homo sapiens
gcgagcgacgcgccggc

SEQ ID NO: 10805 - RNA, 24 nt, Homo sapiens
gcgccgcgccccacgcugcggccg

SEQ ID NO: 10806 - RNA, 15 nt, Homo sapiens
gcgggcgggcaggcc

SEQ ID NO: 10807 - RNA, 15 nt, Homo sapiens
gcugccuagccgccc

SEQ ID NO: 10808 - RNA, 24 nt, Homo sapiens
uacaaccgcuguccagucaugcug

SEQ ID NO: 10809 - RNA, 20 nt, Homo sapiens
ugcgcagccagcggccuccc

SEQ ID NO: 10810 - RNA, 24 nt, Homo sapiens
uuaauauauuuuggcaauuuucuu

SEQ ID NO: 10811 - RNA, 21 nt, Homo sapiens
augauacugaguauaacagga

SEQ ID NO: 10812 - RNA, 20 nt, Homo sapiens
ucuguguguuagugaaucag

SEQ ID NO: 10813 - RNA, 19 nt, Homo sapiens
agccaggaacugccucccg

SEQ ID NO: 10814 - RNA, 21 nt, Homo sapiens
cagcugacaggucaaaugggc

SEQ ID NO: 10815 - RNA, 19 nt, Homo sapiens
gguggccuaaccaggaccu

SEQ ID NO: 10816 - RNA, 21 nt, Homo sapiens
caagggcacuggggccgcugc

SEQ ID NO: 10817 - RNA, 17 nt, Homo sapiens
gccccuuccccuccucc

SEQ ID NO: 10818 - RNA, 21 nt, Homo sapiens
uccccuccuccgucuuggcuc

SEQ ID NO: 10819 - RNA, 18 nt, Homo sapiens
agggaggaggaggggcgg

SEQ ID NO: 10820 - RNA, 20 nt, Homo sapiens
cugggcgggacggagcaggg

SEQ ID NO: 10821 - RNA, 17 nt, Homo sapiens
gggaggaggaggggcgg

SEQ ID NO: 10822 - RNA, 21 nt, Homo sapiens
uaagagugggguggcagguau

SEQ ID NO: 10823 - RNA, 20 nt, Homo sapiens
caagagcugggguccuucuc

SEQ ID NO: 10824 - RNA, 16 nt, Homo sapiens
caccgacccucugcag

SEQ ID NO: 10825 - RNA, 18 nt, Homo sapiens
cagaaguuuggccuuugg

SEQ ID NO: 10826 - RNA, 19 nt, Homo sapiens
cagccacucucccccgugg

SEQ ID NO: 10827 - RNA, 20 nt, Homo sapiens
cagcccuucaagagcugggg

SEQ ID NO: 10828 - RNA, 20 nt, Homo sapiens
ccaccccaggaaggagagag

SEQ ID NO: 10829 - RNA, 23 nt, Homo sapiens
cccccgccgcccucugggcacca

SEQ ID NO: 10830 - RNA, 16 nt, Homo sapiens
cccgccgcucgggccc

SEQ ID NO: 10831 - RNA, 19 nt, Homo sapiens
cccucuaucucccuccccc

SEQ ID NO: 10832 - RNA, 21 nt, Homo sapiens
cccucucccacuuucccuacc

SEQ ID NO: 10833 - RNA, 16 nt, Homo sapiens
cccuuguuucugcucc

SEQ ID NO: 10834 - RNA, 22 nt, Homo sapiens
ccgccgccccgggcccccgccc

SEQ ID NO: 10835 - RNA, 17 nt, Homo sapiens
ccuagggccacggagga

SEQ ID NO: 10836 - RNA, 20 nt, Homo sapiens
ccuagggccacggaggaucc

SEQ ID NO: 10837 - RNA, 17 nt, Homo sapiens
cugccgccucccgccgc

SEQ ID NO: 10838 - RNA, 14 nt, Homo sapiens
cuggaucugcuguu

SEQ ID NO: 10839 - RNA, 14 nt, Homo sapiens
ggcccccucccggg

SEQ ID NO: 10840 - RNA, 18 nt, Homo sapiens
uacuguaaacaaagugua

SEQ ID NO: 10841 - RNA, 18 nt, Homo sapiens
ugcacggccuccaccgcc

SEQ ID NO: 10842 - RNA, 22 nt, Homo sapiens
uggggagcaggaggcugccuug

SEQ ID NO: 10843 - RNA, 27 nt, Homo sapiens
uucucgguaaggagaguuuggguccug

SEQ ID NO: 10844 - RNA, 22 nt, Homo sapiens
agccagaggcuggccucacaaa

SEQ ID NO: 10845 - RNA, 22 nt, Homo sapiens
cagaacccagacuugaaaccug

SEQ ID NO: 10846 - RNA, 16 nt, Homo sapiens
ccucagggcagccgag

SEQ ID NO: 10847 - RNA, 19 nt, Homo sapiens
cgggucaacggcggcggcg

SEQ ID NO: 10848 - RNA, 21 nt, Homo sapiens
gaagggugugaagcccuggcu

SEQ ID NO: 10849 - RNA, 25 nt, Homo sapiens
gaggagaggggaggagaggugggga

SEQ ID NO: 10850 - RNA, 19 nt, Homo sapiens
gcaggaauugcugagggga

SEQ ID NO: 10851 - RNA, 19 nt, Homo sapiens
gcugcguguggcuuugucc

SEQ ID NO: 10852 - RNA, 27 nt, Homo sapiens
ggcggccgggucaacggcggcggcggc

SEQ ID NO: 10853 - RNA, 21 nt, Homo sapiens
gggcugcugggaacacccagc

SEQ ID NO: 10854 - RNA, 24 nt, Homo sapiens
uauaaaaaaaaugaaucccugaag

SEQ ID NO: 10855 - RNA, 17 nt, Homo sapiens
uccuuuuggugauggcg

SEQ ID NO: 10856 - RNA, 21 nt, Homo sapiens
ucuuugggaagggaaagggga

SEQ ID NO: 10857 - RNA, 19 nt, Homo sapiens
ugaggggagaagacagggg

SEQ ID NO: 10858 - RNA, 19 nt, Homo sapiens
ugaggggcaggccccccag

SEQ ID NO: 10859 - RNA, 19 nt, Homo sapiens
uggagucggggagaaagag

SEQ ID NO: 10860 - RNA, 25 nt, Homo sapiens
uggccugcccggggcgcggggcggg

SEQ ID NO: 10861 - RNA, 22 nt, Homo sapiens
uggggaagggaagggagccucg

SEQ ID NO: 10862 - RNA, 21 nt, Homo sapiens
uuaacccuuugcaggaauugc

SEQ ID NO: 10863 - RNA, 20 nt, Homo sapiens
cagccuggagguacucaaag

SEQ ID NO: 10864 - RNA, 16 nt, Homo sapiens
uaaaccccuugguugu

SEQ ID NO: 10865 - RNA, 18 nt, Homo sapiens
ucuaacaucuuuuacuuc

SEQ ID NO: 10866 - RNA, 21 nt, Homo sapiens
ccagagauugagcccuggcug

SEQ ID NO: 10867 - RNA, 21 nt, Homo sapiens
cccuuggcucccuucccuccc

SEQ ID NO: 10868 - RNA, 19 nt, Homo sapiens
gagcccuggcuggggcugg

SEQ ID NO: 10869 - RNA, 18 nt, Homo sapiens
uccccccuccugcugcuc

SEQ ID NO: 10870 - RNA, 19 nt, Homo sapiens
uggcucccuucccuccccc

SEQ ID NO: 10871 - RNA, 21 nt, Homo sapiens
aaagauacuccuaaaauauuu

SEQ ID NO: 10872 - RNA, 19 nt, Homo sapiens
accuucaccgagaacucag

SEQ ID NO: 10873 - RNA, 21 nt, Homo sapiens
caaaugcaguuacaucauagc

SEQ ID NO: 10874 - RNA, 16 nt, Homo sapiens
caugcugcuaauauac

SEQ ID NO: 10875 - RNA, 19 nt, Homo sapiens
gccuaugauaacuggcagc

SEQ ID NO: 10876 - RNA, 24 nt, Homo sapiens
ggaaaacaaaaaaaagggggaggg

SEQ ID NO: 10877 - RNA, 18 nt, Homo sapiens
ggaagggaggggaaaggg

SEQ ID NO: 10878 - RNA, 22 nt, Homo sapiens
ucaguguugcuauucaguuuuc

SEQ ID NO: 10879 - RNA, 19 nt, Homo sapiens
ucucucaaaacugaucagu

SEQ ID NO: 10880 - RNA, 19 nt, Homo sapiens
ggaggcggcggcggcgcgg

SEQ ID NO: 10881 - RNA, 24 nt, Homo sapiens
caccagggggcacugggccggggg

SEQ ID NO: 10882 - RNA, 16 nt, Homo sapiens
cacgguucgcuuuuuu

SEQ ID NO: 10883 - RNA, 22 nt, Homo sapiens
ccugggcaagggggucugggag

SEQ ID NO: 10884 - RNA, 18 nt, Homo sapiens
gaggggggcuccgggggu

SEQ ID NO: 10885 - RNA, 22 nt, Homo sapiens
gggcgggggauccccgggcacc

SEQ ID NO: 10886 - RNA, 18 nt, Homo sapiens
gggggcaggaggaugggg

SEQ ID NO: 10887 - RNA, 25 nt, Homo sapiens
gggggcaggaggauggggcgggggc

SEQ ID NO: 10888 - RNA, 24 nt, Homo sapiens
ggggugggagggcaggcggggugg

SEQ ID NO: 10889 - RNA, 17 nt, Homo sapiens
ucuuccccucccacccc

SEQ ID NO: 10890 - RNA, 17 nt, Homo sapiens
agagcuaccacugagcc

SEQ ID NO: 10891 - RNA, 18 nt, Homo sapiens
cauaacccuaacauggca

SEQ ID NO: 10892 - RNA, 17 nt, Homo sapiens
cccccuccccccucccc

SEQ ID NO: 10893 - RNA, 24 nt, Homo sapiens
cuggaaugugauguuuugcuuugg

SEQ ID NO: 10894 - RNA, 17 nt, Homo sapiens
gaaggacccgccucccg

SEQ ID NO: 10895 - RNA, 20 nt, Homo sapiens
gaaggacccgccucccgagg

SEQ ID NO: 10896 - RNA, 17 nt, Homo sapiens
gccuagcaaagaccaug

SEQ ID NO: 10897 - RNA, 18 nt, Homo sapiens
guguguaauuuugcggug

SEQ ID NO: 10898 - RNA, 20 nt, Homo sapiens
uaaagaaaaguaggcaagau

SEQ ID NO: 10899 - RNA, 16 nt, Homo sapiens
ucacccaagggccugu

SEQ ID NO: 10900 - RNA, 24 nt, Homo sapiens
ugccuuggcuuucagcaagaggcc

SEQ ID NO: 10901 - RNA, 20 nt, Homo sapiens
ugguuaucugaauguggauu

SEQ ID NO: 10902 - RNA, 17 nt, Homo sapiens
cagccgagcgaggcggg

SEQ ID NO: 10903 - RNA, 18 nt, Homo sapiens
gccccgcccuucuccucc

SEQ ID NO: 10904 - RNA, 16 nt, Homo sapiens
ggcagccgagcgaggc

SEQ ID NO: 10905 - RNA, 18 nt, Homo sapiens
gucggagucuugucccuc

SEQ ID NO: 10906 - RNA, 15 nt, Homo sapiens
cccgccgccccggcc

SEQ ID NO: 10907 - RNA, 18 nt, Homo sapiens
ccgccccggccgccgcgc

SEQ ID NO: 10908 - RNA, 18 nt, Homo sapiens
ccucccccuccuucaggc

SEQ ID NO: 10909 - RNA, 19 nt, Homo sapiens
cgggggcagcgaggcggug

SEQ ID NO: 10910 - RNA, 22 nt, Homo sapiens
gagcagaugcuuucucccccag

SEQ ID NO: 10911 - RNA, 15 nt, Homo sapiens
gcacggggcgggugc

SEQ ID NO: 10912 - RNA, 20 nt, Homo sapiens
gccccggccgccgcgccggc

SEQ ID NO: 10913 - RNA, 20 nt, Homo sapiens
gcgcgggcgcggccccggcc

SEQ ID NO: 10914 - RNA, 19 nt, Homo sapiens
gcggcgguucagucucgca

SEQ ID NO: 10915 - RNA, 18 nt, Homo sapiens
gcgucuggccuggaucgc

SEQ ID NO: 10916 - RNA, 22 nt, Homo sapiens
ggaggugggggagaagaggugg

SEQ ID NO: 10917 - RNA, 18 nt, Homo sapiens
ggcgccucggcgcuggcc

SEQ ID NO: 10918 - RNA, 19 nt, Homo sapiens
gggcagcgaggcggugggg

SEQ ID NO: 10919 - RNA, 21 nt, Homo sapiens
gggccggcgaugcgggucggg

SEQ ID NO: 10920 - RNA, 22 nt, Homo sapiens
gggcgggugcaggaaaaaagcu

SEQ ID NO: 10921 - RNA, 18 nt, Homo sapiens
gggggagaagaggugggc

SEQ ID NO: 10922 - RNA, 18 nt, Homo sapiens
ucaacgucauuguccauu

SEQ ID NO: 10923 - RNA, 18 nt, Homo sapiens
uccgcccucccccacccg

SEQ ID NO: 10924 - RNA, 19 nt, Homo sapiens
ucuggccuggaucgcucgu

SEQ ID NO: 10925 - RNA, 23 nt, Homo sapiens
ugggcgcgcgcgggacuuugcgg

SEQ ID NO: 10926 - RNA, 23 nt, Homo sapiens
acauguuucagaacuguggacuc

SEQ ID NO: 10927 - RNA, 18 nt, Homo sapiens
accguggggcgaaauccc

SEQ ID NO: 10928 - RNA, 16 nt, Homo sapiens
acgcuccggccgccgc

SEQ ID NO: 10929 - RNA, 16 nt, Homo sapiens
caccacgagccgcccc

SEQ ID NO: 10930 - RNA, 17 nt, Homo sapiens
cacccggcgacagcccc

SEQ ID NO: 10931 - RNA, 22 nt, Homo sapiens
cccgcccgggccggcuccggcc

SEQ ID NO: 10932 - RNA, 19 nt, Homo sapiens
cccgcggucagcgcgcccg

SEQ ID NO: 10933 - RNA, 21 nt, Homo sapiens
cccggccguccgccgcccucg

SEQ ID NO: 10934 - RNA, 18 nt, Homo sapiens
ccgagggcgugcgcggcg

SEQ ID NO: 10935 - RNA, 20 nt, Homo sapiens
ccgcccgcgcuccccggccg

SEQ ID NO: 10936 - RNA, 19 nt, Homo sapiens
ccgccgagucuuccgaggg

SEQ ID NO: 10937 - RNA, 23 nt, Homo sapiens
ccgccgcccggccguccccgccc

SEQ ID NO: 10938 - RNA, 18 nt, Homo sapiens
ccgccgccugggccgccc

SEQ ID NO: 10939 - RNA, 20 nt, Homo sapiens
ccucauuucugggacccugg

SEQ ID NO: 10940 - RNA, 18 nt, Homo sapiens
ccucgcggccgccgcccc

SEQ ID NO: 10941 - RNA, 17 nt, Homo sapiens
cgccgccucggccuccg

SEQ ID NO: 10942 - RNA, 17 nt, Homo sapiens
cgccgccugggccgccc

SEQ ID NO: 10943 - RNA, 21 nt, Homo sapiens
cgccggccgcgcucggcgcgg

SEQ ID NO: 10944 - RNA, 20 nt, Homo sapiens
cggcaggacugcggugggac

SEQ ID NO: 10945 - RNA, 19 nt, Homo sapiens
cggccgccgccgccgcccg

SEQ ID NO: 10946 - RNA, 19 nt, Homo sapiens
cggcgcucacgcccgcccg

SEQ ID NO: 10947 - RNA, 18 nt, Homo sapiens
cguccggccgccucgggc

SEQ ID NO: 10948 - RNA, 18 nt, Homo sapiens
cucgggcuccggcgccgc

SEQ ID NO: 10949 - RNA, 21 nt, Homo sapiens
cuggugugugugugugugugu

SEQ ID NO: 10950 - RNA, 19 nt, Homo sapiens
gaaggaggagggaguuagg

SEQ ID NO: 10951 - RNA, 16 nt, Homo sapiens
gagagcugcgcgcaug

SEQ ID NO: 10952 - RNA, 15 nt, Homo sapiens
gagcaggccuggggu

SEQ ID NO: 10953 - RNA, 19 nt, Homo sapiens
gccgccgcccggccguccc

SEQ ID NO: 10954 - RNA, 21 nt, Homo sapiens
gccgccgccgccgcccggccg

SEQ ID NO: 10955 - RNA, 19 nt, Homo sapiens
gccgccugggccgcccggg

SEQ ID NO: 10956 - RNA, 20 nt, Homo sapiens
gcgcccgcggucagcgcgcc

SEQ ID NO: 10957 - RNA, 17 nt, Homo sapiens
gcggcugcuggugagca

SEQ ID NO: 10958 - RNA, 15 nt, Homo sapiens
ggacacgcacaggaa

SEQ ID NO: 10959 - RNA, 20 nt, Homo sapiens
ggaggagggaguuaggugca

SEQ ID NO: 10960 - RNA, 18 nt, Homo sapiens
ggccucauuucugggacc

SEQ ID NO: 10961 - RNA, 14 nt, Homo sapiens
ggcugguggaguca

SEQ ID NO: 10962 - RNA, 18 nt, Homo sapiens
gguucuccggggacgccc

SEQ ID NO: 10963 - RNA, 24 nt, Homo sapiens
uccggcggggacgcgggccgccuc

SEQ ID NO: 10964 - RNA, 19 nt, Homo sapiens
uggauuuuauaccaccugu

SEQ ID NO: 10965 - RNA, 18 nt, Homo sapiens
ugggcacacccccuggcu

SEQ ID NO: 10966 - RNA, 19 nt, Homo sapiens
uguaagugugcgugugugu

SEQ ID NO: 10967 - RNA, 18 nt, Homo sapiens
ugugugugugugugugug

SEQ ID NO: 10968 - RNA, 19 nt, Homo sapiens
ugugugugugugugugugu

SEQ ID NO: 10969 - RNA, 17 nt, Homo sapiens
uucacaugcauacagac

SEQ ID NO: 10970 - RNA, 17 nt, Homo sapiens
cacuugguggaaaguga

SEQ ID NO: 10971 - RNA, 24 nt, Homo sapiens
cgccgcccgcgccgacuuccugcc

SEQ ID NO: 10972 - RNA, 17 nt, Homo sapiens
uggucgggggccucgag

SEQ ID NO: 10973 - RNA, 20 nt, Homo sapiens
caccgaggaggccccgcucc

SEQ ID NO: 10974 - RNA, 21 nt, Homo sapiens
ccacuguucuggccccugccg

SEQ ID NO: 10975 - RNA, 19 nt, Homo sapiens
ccgaggucucucggagcuc

SEQ ID NO: 10976 - RNA, 17 nt, Homo sapiens
ccgccacggccggcccc

SEQ ID NO: 10977 - RNA, 22 nt, Homo sapiens
ccugcccagccgaggucucucg

SEQ ID NO: 10978 - RNA, 16 nt, Homo sapiens
cgcgcggcggccggcg

SEQ ID NO: 10979 - RNA, 26 nt, Homo sapiens
cgcuccggcggcgggcgcaggcggcc

SEQ ID NO: 10980 - RNA, 19 nt, Homo sapiens
cggcggccagugcuggagc

SEQ ID NO: 10981 - RNA, 21 nt, Homo sapiens
cgggccgagcagcgccgcccg

SEQ ID NO: 10982 - RNA, 16 nt, Homo sapiens
cucucgcccucucucc

SEQ ID NO: 10983 - RNA, 25 nt, Homo sapiens
cugccgccucucuccaccacaggcg

SEQ ID NO: 10984 - RNA, 21 nt, Homo sapiens
gagaacucgcggcucuagagg

SEQ ID NO: 10985 - RNA, 14 nt, Homo sapiens
gcaaggcaggagca

SEQ ID NO: 10986 - RNA, 16 nt, Homo sapiens
gccacggccggccccu

SEQ ID NO: 10987 - RNA, 17 nt, Homo sapiens
gcgcuccgcgccgccgc

SEQ ID NO: 10988 - RNA, 17 nt, Homo sapiens
gcuccgacggcacccga

SEQ ID NO: 10989 - RNA, 16 nt, Homo sapiens
ggcggccggcggaggc

SEQ ID NO: 10990 - RNA, 19 nt, Homo sapiens
ggcggcgggcgcaggcggc

SEQ ID NO: 10991 - RNA, 18 nt, Homo sapiens
gggccgagcagcgccgcc

SEQ ID NO: 10992 - RNA, 20 nt, Homo sapiens
uaauauauauuuauauauau

SEQ ID NO: 10993 - RNA, 21 nt, Homo sapiens
uauauauauuuauauauauau

SEQ ID NO: 10994 - RNA, 22 nt, Homo sapiens
uauauauauuuauauauauaua

SEQ ID NO: 10995 - RNA, 25 nt, Homo sapiens
uauauauauuuauauauauauagau

SEQ ID NO: 10996 - RNA, 18 nt, Homo sapiens
uauauuuauauauauaua

SEQ ID NO: 10997 - RNA, 24 nt, Homo sapiens
uauauuuauauauauuuauauaua

SEQ ID NO: 10998 - RNA, 24 nt, Homo sapiens
uauuuauauauauuuauauauaua

SEQ ID NO: 10999 - RNA, 18 nt, Homo sapiens
uccuuuuucucuucgccg

SEQ ID NO: 11000 - RNA, 23 nt, Homo sapiens
agacgccgagcaccugggcuccc

SEQ ID NO: 11001 - RNA, 18 nt, Homo sapiens
cccuggcggguggggggc

SEQ ID NO: 11002 - RNA, 17 nt, Homo sapiens
gacggcgucggcagagg

SEQ ID NO: 11003 - RNA, 20 nt, Homo sapiens
accacagcccccucccccuc

SEQ ID NO: 11004 - RNA, 22 nt, Homo sapiens
cuggaauagugguguggcauua

SEQ ID NO: 11005 - RNA, 20 nt, Homo sapiens
gaaugcugccgaagggcaug

SEQ ID NO: 11006 - RNA, 18 nt, Homo sapiens
gcccccucccccucuccc

SEQ ID NO: 11007 - RNA, 23 nt, Homo sapiens
uauacauagggucaaaggcaaag

SEQ ID NO: 11008 - RNA, 17 nt, Homo sapiens
ucugaaagagauaggcc

SEQ ID NO: 11009 - RNA, 17 nt, Homo sapiens
ugccagcuuuaaauggu

SEQ ID NO: 11010 - RNA, 23 nt, Homo sapiens
caagaagaggcacaaaggucauu

SEQ ID NO: 11011 - RNA, 20 nt, Homo sapiens
cagcucggguggucccuccc

SEQ ID NO: 11012 - RNA, 17 nt, Homo sapiens
ccggcgcgcgccccgcc

SEQ ID NO: 11013 - RNA, 15 nt, Homo sapiens
ccgucgcagcucggg

SEQ ID NO: 11014 - RNA, 20 nt, Homo sapiens
ugcaagaagaggcacaaagg

SEQ ID NO: 11015 - RNA, 17 nt, Homo sapiens
uucucuaaaaugcggac

SEQ ID NO: 11016 - RNA, 18 nt, Homo sapiens
agcauuauauaagaagga

SEQ ID NO: 11017 - RNA, 23 nt, Homo sapiens
ccuggaagagcugguuggcaggg

SEQ ID NO: 11018 - RNA, 20 nt, Homo sapiens
cuaaagaggcauuucagguu

SEQ ID NO: 11019 - RNA, 18 nt, Homo sapiens
cuccauuagcuggauuaa

SEQ ID NO: 11020 - RNA, 16 nt, Homo sapiens
gggccagccgauuuau

SEQ ID NO: 11021 - RNA, 20 nt, Homo sapiens
ucucacagcuuugcaauuuu

SEQ ID NO: 11022 - RNA, 21 nt, Homo sapiens
uguagagacuucuggaguaga

SEQ ID NO: 11023 - RNA, 21 nt, Homo sapiens
uuacucauuuuuuucagguuu

SEQ ID NO: 11024 - RNA, 19 nt, Homo sapiens
agcgccacacaccacacuc

SEQ ID NO: 11025 - RNA, 16 nt, Homo sapiens
augugcacgcugcuga

SEQ ID NO: 11026 - RNA, 23 nt, Homo sapiens
cacccuggaaucagacagacuuu

SEQ ID NO: 11027 - RNA, 16 nt, Homo sapiens
ccaacaaucaggccau

SEQ ID NO: 11028 - RNA, 21 nt, Homo sapiens
ccagcuucuuaugaugccuuu

SEQ ID NO: 11029 - RNA, 20 nt, Homo sapiens
ccccagcuggugagcccugg

SEQ ID NO: 11030 - RNA, 21 nt, Homo sapiens
ccccucagagccugucugcag

SEQ ID NO: 11031 - RNA, 21 nt, Homo sapiens
cccggccagccggguggguuc

SEQ ID NO: 11032 - RNA, 18 nt, Homo sapiens
cccguuagauuccaaggc

SEQ ID NO: 11033 - RNA, 19 nt, Homo sapiens
ccucucgcugaggagggcg

SEQ ID NO: 11034 - RNA, 20 nt, Homo sapiens
gaggagggcgugccccucag

SEQ ID NO: 11035 - RNA, 18 nt, Homo sapiens
gccaggggcggcccacag

SEQ ID NO: 11036 - RNA, 18 nt, Homo sapiens
ggcggcggccggguccgg

SEQ ID NO: 11037 - RNA, 19 nt, Homo sapiens
uaaguacggaggcaagccu

SEQ ID NO: 11038 - RNA, 22 nt, Homo sapiens
ucccguggugagaagcaccuga

SEQ ID NO: 11039 - RNA, 18 nt, Homo sapiens
ucugacuuguguagcauu

SEQ ID NO: 11040 - RNA, 14 nt, Homo sapiens
ugccccuuccagca

SEQ ID NO: 11041 - RNA, 19 nt, Homo sapiens
uggaaagugguaacucggg

SEQ ID NO: 11042 - RNA, 18 nt, Homo sapiens
uguggcugacuucaagau

SEQ ID NO: 11043 - RNA, 22 nt, Homo sapiens
agcgcccgaguaggggccugag

SEQ ID NO: 11044 - RNA, 21 nt, Homo sapiens
aggaggcggcggggggcggag

SEQ ID NO: 11045 - RNA, 18 nt, Homo sapiens
aggggcugccccaggguc

SEQ ID NO: 11046 - RNA, 19 nt, Homo sapiens
cagcagcugcucgcccccc

SEQ ID NO: 11047 - RNA, 19 nt, Homo sapiens
caggagacucgcguguucc

SEQ ID NO: 11048 - RNA, 18 nt, Homo sapiens
caggagggcgguccugcc

SEQ ID NO: 11049 - RNA, 18 nt, Homo sapiens
caguacaaaucacaaggu

SEQ ID NO: 11050 - RNA, 18 nt, Homo sapiens
ccugugggcugagcucua

SEQ ID NO: 11051 - RNA, 19 nt, Homo sapiens
cgaagcuggagaggucgua

SEQ ID NO: 11052 - RNA, 18 nt, Homo sapiens
gcaggacggagggggugg

SEQ ID NO: 11053 - RNA, 23 nt, Homo sapiens
gccagggacgggguggggcugcc

SEQ ID NO: 11054 - RNA, 19 nt, Homo sapiens
gccugcucacuggcuucuc

SEQ ID NO: 11055 - RNA, 19 nt, Homo sapiens
gcgccggccgccaggcgcc

SEQ ID NO: 11056 - RNA, 22 nt, Homo sapiens
gcggcggggggcggagcggggg

SEQ ID NO: 11057 - RNA, 19 nt, Homo sapiens
gcggggggcggagcggggg

SEQ ID NO: 11058 - RNA, 18 nt, Homo sapiens
ggagggacggcaagaaaa

SEQ ID NO: 11059 - RNA, 22 nt, Homo sapiens
ggagggcgagaaggaggcggcg

SEQ ID NO: 11060 - RNA, 25 nt, Homo sapiens
gggucgggaaggggccagggccggg

SEQ ID NO: 11061 - RNA, 21 nt, Homo sapiens
gguuuauaaauaagaccgucc

SEQ ID NO: 11062 - RNA, 18 nt, Homo sapiens
ugaggcacugagaggugg

SEQ ID NO: 11063 - RNA, 26 nt, Homo sapiens
ugcgagagcucuuugugccggcgcgg

SEQ ID NO: 11064 - RNA, 23 nt, Homo sapiens
uggggcugccacugguggagaag

SEQ ID NO: 11065 - RNA, 19 nt, Homo sapiens
cgggcuggcgugcagagag

SEQ ID NO: 11066 - RNA, 19 nt, Homo sapiens
gggugcgggcgggcuggcg

SEQ ID NO: 11067 - RNA, 25 nt, Homo sapiens
uauuuauuaaccaaagggaugaucc

SEQ ID NO: 11068 - RNA, 18 nt, Homo sapiens
uggguuuguagcucccug

SEQ ID NO: 11069 - RNA, 20 nt, Homo sapiens
acccagaguuccaugagguc

SEQ ID NO: 11070 - RNA, 19 nt, Homo sapiens
aggugggcccguuccucug

SEQ ID NO: 11071 - RNA, 19 nt, Homo sapiens
aguggagaggaggcaaugg

SEQ ID NO: 11072 - RNA, 21 nt, Homo sapiens
ccucagggacuagguggggga

SEQ ID NO: 11073 - RNA, 23 nt, Homo sapiens
ccuggcuacauacacucuacaca

SEQ ID NO: 11074 - RNA, 18 nt, Homo sapiens
ccuuuggccaaaagugcc

SEQ ID NO: 11075 - RNA, 17 nt, Homo sapiens
gacugggugggagggag

SEQ ID NO: 11076 - RNA, 16 nt, Homo sapiens
gccccucuccugggac

SEQ ID NO: 11077 - RNA, 14 nt, Homo sapiens
ggcaggcccugacu

SEQ ID NO: 11078 - RNA, 18 nt, Homo sapiens
ggcaggcgucugcagugg

SEQ ID NO: 11079 - RNA, 17 nt, Homo sapiens
uguuccugguuuuccag

SEQ ID NO: 11080 - RNA, 22 nt, Homo sapiens
acaaaaacuuugcccgaguguu

SEQ ID NO: 11081 - RNA, 23 nt, Homo sapiens
agaauuacucuuacaacugaaga

SEQ ID NO: 11082 - RNA, 19 nt, Homo sapiens
aggagacgcggggcgaaaa

SEQ ID NO: 11083 - RNA, 18 nt, Homo sapiens
auaacacaaacaaccucu

SEQ ID NO: 11084 - RNA, 16 nt, Homo sapiens
gcuuucuaucuuucaa

SEQ ID NO: 11085 - RNA, 20 nt, Homo sapiens
guuuuacugauaagaggggg

SEQ ID NO: 11086 - RNA, 20 nt, Homo sapiens
uagagugauaaaaucacaaa

SEQ ID NO: 11087 - RNA, 16 nt, Homo sapiens
ugagaaaaaaacauac

SEQ ID NO: 11088 - RNA, 19 nt, Homo sapiens
ugcuuguaagaaacaaggc

SEQ ID NO: 11089 - RNA, 18 nt, Homo sapiens
uugggcuuuuucuuuuaa

SEQ ID NO: 11090 - RNA, 19 nt, Homo sapiens
aagcuuccagaaguauucg

SEQ ID NO: 11091 - RNA, 18 nt, Homo sapiens
aggguucuuuuccugcuc

SEQ ID NO: 11092 - RNA, 19 nt, Homo sapiens
caaaggcuggauaugguug

SEQ ID NO: 11093 - RNA, 18 nt, Homo sapiens
cgcggcgguggcggcggc

SEQ ID NO: 11094 - RNA, 20 nt, Homo sapiens
cggcggcggcggccgcugcc

SEQ ID NO: 11095 - RNA, 16 nt, Homo sapiens
gcgcggcgguggcggc

SEQ ID NO: 11096 - RNA, 18 nt, Homo sapiens
ggcgguggcggcggcggc

SEQ ID NO: 11097 - RNA, 22 nt, Homo sapiens
guggggguuuuaucuccuaugc

SEQ ID NO: 11098 - RNA, 19 nt, Homo sapiens
ugaugacagcccuggcgcc

SEQ ID NO: 11099 - RNA, 22 nt, Homo sapiens
ugguauagggcagaaaguaagg

SEQ ID NO: 11100 - RNA, 19 nt, Homo sapiens
uguuaagcuuccagaagua

SEQ ID NO: 11101 - RNA, 18 nt, Homo sapiens
uucaaaugccauuuuaca

SEQ ID NO: 11102 - RNA, 17 nt, Homo sapiens
uucaaauguuaauuuuc

SEQ ID NO: 11103 - RNA, 18 nt, Homo sapiens
accccgccgugucauuug

SEQ ID NO: 11104 - RNA, 17 nt, Homo sapiens
agggcgcgggcggcugg

SEQ ID NO: 11105 - RNA, 17 nt, Homo sapiens
auuucaaaccaucuucc

SEQ ID NO: 11106 - RNA, 20 nt, Homo sapiens
ccggccgaguggagcgcugc

SEQ ID NO: 11107 - RNA, 19 nt, Homo sapiens
ccgugcccccgccccgggc

SEQ ID NO: 11108 - RNA, 17 nt, Homo sapiens
ccucccuccggggcgca

SEQ ID NO: 11109 - RNA, 18 nt, Homo sapiens
cgggcguggggcgcgggg

SEQ ID NO: 11110 - RNA, 21 nt, Homo sapiens
gcagugagcugagaucgugcc

SEQ ID NO: 11111 - RNA, 18 nt, Homo sapiens
gcgcggggggcgggcgcc

SEQ ID NO: 11112 - RNA, 17 nt, Homo sapiens
gcucugcuccccucucc

SEQ ID NO: 11113 - RNA, 19 nt, Homo sapiens
ggcggcugguggcugcggc

SEQ ID NO: 11114 - RNA, 21 nt, Homo sapiens
ggcguggggcgcggggggcgg

SEQ ID NO: 11115 - RNA, 18 nt, Homo sapiens
gggcguggggcgcggggg

SEQ ID NO: 11116 - RNA, 20 nt, Homo sapiens
cagggucccugugacccgcc

SEQ ID NO: 11117 - RNA, 24 nt, Homo sapiens
gaaggagggggaccucagcagaau

SEQ ID NO: 11118 - RNA, 19 nt, Homo sapiens
gaucugagcucuugucacu

SEQ ID NO: 11119 - RNA, 22 nt, Homo sapiens
gcucuugucacuucccgcuccc

SEQ ID NO: 11120 - RNA, 22 nt, Homo sapiens
ggaggagacuucggaggugggg

SEQ ID NO: 11121 - RNA, 17 nt, Homo sapiens
gggagagguggaacccu

SEQ ID NO: 11122 - RNA, 15 nt, Homo sapiens
uacacagaucggucu

SEQ ID NO: 11123 - RNA, 20 nt, Homo sapiens
uauauauauauuuauauaaa

SEQ ID NO: 11124 - RNA, 24 nt, Homo sapiens
uauauauauuuauauaaaacauau

SEQ ID NO: 11125 - RNA, 18 nt, Homo sapiens
ucaaaugguccuuuuaua

SEQ ID NO: 11126 - RNA, 21 nt, Homo sapiens
agcgguuguccuucuuccagc

SEQ ID NO: 11127 - RNA, 20 nt, Homo sapiens
caucgcuuggccucuuuccg

SEQ ID NO: 11128 - RNA, 19 nt, Homo sapiens
ccugcgagcgcccuagccc

SEQ ID NO: 11129 - RNA, 19 nt, Homo sapiens
uaaguggcagguguguggc

SEQ ID NO: 11130 - RNA, 18 nt, Homo sapiens
ugaggaggggagaggaga

SEQ ID NO: 11131 - RNA, 21 nt, Homo sapiens
ugugacuugaauccgucccag

SEQ ID NO: 11132 - RNA, 19 nt, Homo sapiens
ugugcuuagcacugccuuu

SEQ ID NO: 11133 - RNA, 24 nt, Homo sapiens
cgcagcacggcacagggcaggggc

SEQ ID NO: 11134 - RNA, 19 nt, Homo sapiens
gccgggggggcggugcugc

SEQ ID NO: 11135 - RNA, 19 nt, Homo sapiens
gcggggcaggcuugggggc

SEQ ID NO: 11136 - RNA, 15 nt, Homo sapiens
ggccagggcggccug

SEQ ID NO: 11137 - RNA, 24 nt, Homo sapiens
ggguugaggggaagagggcggggc

SEQ ID NO: 11138 - RNA, 19 nt, Homo sapiens
ugaccgcgggguggcgccc

SEQ ID NO: 11139 - RNA, 26 nt, Homo sapiens
ugaggcgcgagaagccgggggggcgg

SEQ ID NO: 11140 - RNA, 21 nt, Homo sapiens
cccaggauuuucaacagaaaa

SEQ ID NO: 11141 - RNA, 18 nt, Homo sapiens
acuauuguaggaacauua

SEQ ID NO: 11142 - RNA, 19 nt, Homo sapiens
aguaagcgauuuuauaccg

SEQ ID NO: 11143 - RNA, 20 nt, Homo sapiens
gacuaaaagaguaccugagc

SEQ ID NO: 11144 - RNA, 17 nt, Homo sapiens
agaccauuacaaguuuc

SEQ ID NO: 11145 - RNA, 16 nt, Homo sapiens
auaugacucaagggua

SEQ ID NO: 11146 - RNA, 18 nt, Homo sapiens
caccgcuuuucagucccc

SEQ ID NO: 11147 - RNA, 22 nt, Homo sapiens
cauuuuuccugaauaaauacuu

SEQ ID NO: 11148 - RNA, 20 nt, Homo sapiens
cccacuggucuuucucuucu

SEQ ID NO: 11149 - RNA, 18 nt, Homo sapiens
uaaaaugcaaaguccacu

SEQ ID NO: 11150 - RNA, 19 nt, Homo sapiens
ucuaaccaacuccugugag

SEQ ID NO: 11151 - RNA, 16 nt, Homo sapiens
uuugcaaauagguugu

SEQ ID NO: 11152 - RNA, 17 nt, Homo sapiens
caaguggacacaaggau

SEQ ID NO: 11153 - RNA, 16 nt, Homo sapiens
cagccgcgcaguggac

SEQ ID NO: 11154 - RNA, 20 nt, Homo sapiens
cugggagcuucuccuccccc

SEQ ID NO: 11155 - RNA, 22 nt, Homo sapiens
ucacaauauacuuaagagucug

SEQ ID NO: 11156 - RNA, 18 nt, Homo sapiens
uuccggccugggggcguc

SEQ ID NO: 11157 - RNA, 19 nt, Homo sapiens
aaagugaaagguucagggc

SEQ ID NO: 11158 - RNA, 21 nt, Homo sapiens
agccuggggaggcuccaaggg

SEQ ID NO: 11159 - RNA, 18 nt, Homo sapiens
ccaaggggacccaguguc

SEQ ID NO: 11160 - RNA, 18 nt, Homo sapiens
ccaggcaggccccuccuu

SEQ ID NO: 11161 - RNA, 17 nt, Homo sapiens
ccuguuugucugaaggc

SEQ ID NO: 11162 - RNA, 21 nt, Homo sapiens
cgccucgguggccccucgugc

SEQ ID NO: 11163 - RNA, 18 nt, Homo sapiens
gcgggagaggaggagagg

SEQ ID NO: 11164 - RNA, 20 nt, Homo sapiens
ggaaccacgggggccggggg

SEQ ID NO: 11165 - RNA, 19 nt, Homo sapiens
ggcggcgaagaggcggcgg

SEQ ID NO: 11166 - RNA, 20 nt, Homo sapiens
ucacgcuacccaggacacgc

SEQ ID NO: 11167 - RNA, 22 nt, Homo sapiens
ucccuggagucugagguauugg

SEQ ID NO: 11168 - RNA, 19 nt, Homo sapiens
ucgugggcgggaaggugcc

SEQ ID NO: 11169 - RNA, 19 nt, Homo sapiens
ucucacaguucccagaucu

SEQ ID NO: 11170 - RNA, 24 nt, Homo sapiens
ugaguuggguuuuuucugcucccu

SEQ ID NO: 11171 - RNA, 24 nt, Homo sapiens
ugggaccucacuagccacugauaa

SEQ ID NO: 11172 - RNA, 21 nt, Homo sapiens
aacuggcugaggacaaggcca

SEQ ID NO: 11173 - RNA, 16 nt, Homo sapiens
caccaucaccauggca

SEQ ID NO: 11174 - RNA, 20 nt, Homo sapiens
uagcaaggcuaugggggcgc

SEQ ID NO: 11175 - RNA, 17 nt, Homo sapiens
ucagggccggcggcggc

SEQ ID NO: 11176 - RNA, 21 nt, Homo sapiens
ucuugugagaucuguucuaaa

SEQ ID NO: 11177 - RNA, 19 nt, Homo sapiens
agaggcucagggacagcca

SEQ ID NO: 11178 - RNA, 15 nt, Homo sapiens
ccccacccccucggu

SEQ ID NO: 11179 - RNA, 18 nt, Homo sapiens
cccgggggcgguuggcgg

SEQ ID NO: 11180 - RNA, 20 nt, Homo sapiens
cccuacugggcaucagguuc

SEQ ID NO: 11181 - RNA, 17 nt, Homo sapiens
cggggagggcucuggcc

SEQ ID NO: 11182 - RNA, 16 nt, Homo sapiens
cuccgcgucccacugg

SEQ ID NO: 11183 - RNA, 16 nt, Homo sapiens
gcccgggggcgguugg

SEQ ID NO: 11184 - RNA, 22 nt, Homo sapiens
gcgcggggagggcucuggccgc

SEQ ID NO: 11185 - RNA, 27 nt, Homo sapiens
gcgcgguggugguucuggccgcggacg

SEQ ID NO: 11186 - RNA, 18 nt, Homo sapiens
ggaacucccggggcuuuu

SEQ ID NO: 11187 - RNA, 14 nt, Homo sapiens
ggagcgcggcgcgg

SEQ ID NO: 11188 - RNA, 20 nt, Homo sapiens
gggcaucagguucugaaaag

SEQ ID NO: 11189 - RNA, 17 nt, Homo sapiens
gggggcgguuggcgggg

SEQ ID NO: 11190 - RNA, 19 nt, Homo sapiens
guggggguggggcuggagc

SEQ ID NO: 11191 - RNA, 21 nt, Homo sapiens
acagggcgagagcucuuuugg

SEQ ID NO: 11192 - RNA, 19 nt, Homo sapiens
acuucaugugacuuacuga

SEQ ID NO: 11193 - RNA, 19 nt, Homo sapiens
agcggcggggcgcgcgggg

SEQ ID NO: 11194 - RNA, 20 nt, Homo sapiens
aggaauuuccuaaauggauc

SEQ ID NO: 11195 - RNA, 24 nt, Homo sapiens
caaauauuccugaccauauugaug

SEQ ID NO: 11196 - RNA, 20 nt, Homo sapiens
ccacuuauauggaaacucaa

SEQ ID NO: 11197 - RNA, 21 nt, Homo sapiens
cccggagcuggaccuucucgg

SEQ ID NO: 11198 - RNA, 20 nt, Homo sapiens
ccgcgcagguggaaagaccc

SEQ ID NO: 11199 - RNA, 18 nt, Homo sapiens
ccgggcgccuccgcccgc

SEQ ID NO: 11200 - RNA, 23 nt, Homo sapiens
cuuccacuguuaagacagugguc

SEQ ID NO: 11201 - RNA, 16 nt, Homo sapiens
cuuuaaaauguagacu

SEQ ID NO: 11202 - RNA, 19 nt, Homo sapiens
gcgagcggcggggcgcgcg

SEQ ID NO: 11203 - RNA, 19 nt, Homo sapiens
ggagcccggagcuggaccu

SEQ ID NO: 11204 - RNA, 20 nt, Homo sapiens
ggcgguuuucccuggcuccc

SEQ ID NO: 11205 - RNA, 18 nt, Homo sapiens
ggcugcgugcugcaccug

SEQ ID NO: 11206 - RNA, 21 nt, Homo sapiens
gguggguucgggagcccggag

SEQ ID NO: 11207 - RNA, 17 nt, Homo sapiens
guggauagagucgggug

SEQ ID NO: 11208 - RNA, 18 nt, Homo sapiens
acuugcuguccuuggugu

SEQ ID NO: 11209 - RNA, 20 nt, Homo sapiens
agaagcgccugacuuacugg

SEQ ID NO: 11210 - RNA, 23 nt, Homo sapiens
agccacgccguuucccggcaacc

SEQ ID NO: 11211 - RNA, 21 nt, Homo sapiens
cauucucuccccagcuacaca

SEQ ID NO: 11212 - RNA, 22 nt, Homo sapiens
ccccuggagaaucccacugggc

SEQ ID NO: 11213 - RNA, 23 nt, Homo sapiens
ccccugguccuacaucaccuacc

SEQ ID NO: 11214 - RNA, 21 nt, Homo sapiens
cugguccccaucucugcagcc

SEQ ID NO: 11215 - RNA, 18 nt, Homo sapiens
ggaaagcuucuacccaca

SEQ ID NO: 11216 - RNA, 16 nt, Homo sapiens
ggagccgccgcagaag

SEQ ID NO: 11217 - RNA, 18 nt, Homo sapiens
ggcagugucugaggccca

SEQ ID NO: 11218 - RNA, 19 nt, Homo sapiens
gggcuggagggggcugagg

SEQ ID NO: 11219 - RNA, 17 nt, Homo sapiens
gugguucuugcucaugg

SEQ ID NO: 11220 - RNA, 16 nt, Homo sapiens
uccgggaccagggcgc

SEQ ID NO: 11221 - RNA, 23 nt, Homo sapiens
ucuugcucaugggauaaauugug

SEQ ID NO: 11222 - RNA, 24 nt, Homo sapiens
ugagugcggggcacucugagaagg

SEQ ID NO: 11223 - RNA, 20 nt, Homo sapiens
uggggaggcugggccaaggg

SEQ ID NO: 11224 - RNA, 18 nt, Homo sapiens
ugggugaggguccugcag

SEQ ID NO: 11225 - RNA, 20 nt, Homo sapiens
uguggaggugagagccccag

SEQ ID NO: 11226 - RNA, 25 nt, Homo sapiens
ugugggagacuuuuucccuuuuugc

SEQ ID NO: 11227 - RNA, 17 nt, Homo sapiens
ccggcugguccacgcgc

SEQ ID NO: 11228 - RNA, 18 nt, Homo sapiens
gggccgcgucgcucgugc

SEQ ID NO: 11229 - RNA, 16 nt, Homo sapiens
gguuuuaccuccauua

SEQ ID NO: 11230 - RNA, 18 nt, Homo sapiens
uaagucuuucucucauuu

SEQ ID NO: 11231 - RNA, 19 nt, Homo sapiens
uaagucuuucucuccuuua

SEQ ID NO: 11232 - RNA, 21 nt, Homo sapiens
uaccuagcagaaguuauuuuc

SEQ ID NO: 11233 - RNA, 22 nt, Homo sapiens
ucaugcacuuuuuaaagcagga

SEQ ID NO: 11234 - RNA, 17 nt, Homo sapiens
cacagaaauguauguag

SEQ ID NO: 11235 - RNA, 21 nt, Homo sapiens
gcuuaaaaccucaguguuucu

SEQ ID NO: 11236 - RNA, 18 nt, Homo sapiens
ugagauuuauucacacuu

SEQ ID NO: 11237 - RNA, 14 nt, Homo sapiens
ugcuauucaaggug

SEQ ID NO: 11238 - RNA, 21 nt, Homo sapiens
ugcuauucaagguguucauuu

SEQ ID NO: 11239 - RNA, 18 nt, Homo sapiens
auuucucccuacccuggg

SEQ ID NO: 11240 - RNA, 19 nt, Homo sapiens
ccugggcugcggaugcccu

SEQ ID NO: 11241 - RNA, 21 nt, Homo sapiens
gcuggcacaaguccccuuggg

SEQ ID NO: 11242 - RNA, 19 nt, Homo sapiens
uggcacaaguccccuuggg

SEQ ID NO: 11243 - RNA, 16 nt, Homo sapiens
acgccgggcccccucc

SEQ ID NO: 11244 - RNA, 18 nt, Homo sapiens
cagccucccuccuucccc

SEQ ID NO: 11245 - RNA, 19 nt, Homo sapiens
ccaugucacgugcccgcug

SEQ ID NO: 11246 - RNA, 17 nt, Homo sapiens
ggguuuggggagggaac

SEQ ID NO: 11247 - RNA, 19 nt, Homo sapiens
cucuggccucaaggcuacc

SEQ ID NO: 11248 - RNA, 16 nt, Homo sapiens
gcacaggucacaucuu

SEQ ID NO: 11249 - RNA, 22 nt, Homo sapiens
ccgagaguccagcugcugucuc

SEQ ID NO: 11250 - RNA, 19 nt, Homo sapiens
gcccagccuucccuccucc

SEQ ID NO: 11251 - RNA, 22 nt, Homo sapiens
uagaaaauagcuucuguuuucc

SEQ ID NO: 11252 - RNA, 22 nt, Homo sapiens
ucgauuccguuucaucccgaga

SEQ ID NO: 11253 - RNA, 16 nt, Homo sapiens
ucucuuguuguucgug

SEQ ID NO: 11254 - RNA, 16 nt, Homo sapiens
uggacuugcccucucu

SEQ ID NO: 11255 - RNA, 18 nt, Homo sapiens
aagagaaagagaggaaaa

SEQ ID NO: 11256 - RNA, 18 nt, Homo sapiens
agaggaaaauggagcugg

SEQ ID NO: 11257 - RNA, 15 nt, Homo sapiens
cgcuuccucuccccu

SEQ ID NO: 11258 - RNA, 19 nt, Homo sapiens
uauaugcauuauuugccaa

SEQ ID NO: 11259 - RNA, 19 nt, Homo sapiens
ugccaaauuuuaaaugugu

SEQ ID NO: 11260 - RNA, 21 nt, Homo sapiens
agccagccucaggcacagccc

SEQ ID NO: 11261 - RNA, 18 nt, Homo sapiens
agccuugguuaagcuugg

SEQ ID NO: 11262 - RNA, 19 nt, Homo sapiens
aggaggaggagggagaaga

SEQ ID NO: 11263 - RNA, 21 nt, Homo sapiens
agggcccacggugcugcagac

SEQ ID NO: 11264 - RNA, 15 nt, Homo sapiens
cagagucccuuccgc

SEQ ID NO: 11265 - RNA, 18 nt, Homo sapiens
gagaggcgggcgaugggc

SEQ ID NO: 11266 - RNA, 23 nt, Homo sapiens
gcaaggugugugugugugccuug

SEQ ID NO: 11267 - RNA, 24 nt, Homo sapiens
ggaggagacagguucagcgacaag

SEQ ID NO: 11268 - RNA, 18 nt, Homo sapiens
ggguccccagagugggca

SEQ ID NO: 11269 - RNA, 17 nt, Homo sapiens
ugcaaggugugugugug

SEQ ID NO: 11270 - RNA, 19 nt, Homo sapiens
uggggugagaggcgggcga

SEQ ID NO: 11271 - RNA, 20 nt, Homo sapiens
uuugcaaggugugugugugu

SEQ ID NO: 11272 - RNA, 17 nt, Homo sapiens
aaggggccagaggguga

SEQ ID NO: 11273 - RNA, 18 nt, Homo sapiens
aaggggguggggggagga

SEQ ID NO: 11274 - RNA, 18 nt, Homo sapiens
agaaaagguagaguuugg

SEQ ID NO: 11275 - RNA, 18 nt, Homo sapiens
agcccccgccccuggcag

SEQ ID NO: 11276 - RNA, 22 nt, Homo sapiens
aggccaguucacacagagucac

SEQ ID NO: 11277 - RNA, 17 nt, Homo sapiens
aggcuuuaggaccgaag

SEQ ID NO: 11278 - RNA, 23 nt, Homo sapiens
agugguuugggguccgacacgag

SEQ ID NO: 11279 - RNA, 18 nt, Homo sapiens
cacauucaugcuggggaa

SEQ ID NO: 11280 - RNA, 23 nt, Homo sapiens
cagcacaacaggucucugggaca

SEQ ID NO: 11281 - RNA, 22 nt, Homo sapiens
ccucugccucucugaucuuucc

SEQ ID NO: 11282 - RNA, 22 nt, Homo sapiens
gaaagaaggggguggggggagg

SEQ ID NO: 11283 - RNA, 19 nt, Homo sapiens
gcacaguaggugcagaggc

SEQ ID NO: 11284 - RNA, 19 nt, Homo sapiens
ggaggugcaaagggcuggu

SEQ ID NO: 11285 - RNA, 17 nt, Homo sapiens
gggguggggggaggacg

SEQ ID NO: 11286 - RNA, 20 nt, Homo sapiens
gucaucucaucccagguggc

SEQ ID NO: 11287 - RNA, 21 nt, Homo sapiens
gugcccuggcugugccuuggg

SEQ ID NO: 11288 - RNA, 21 nt, Homo sapiens
uacagcagagacccuguccag

SEQ ID NO: 11289 - RNA, 19 nt, Homo sapiens
ucagugguaggagugucuu

SEQ ID NO: 11290 - RNA, 17 nt, Homo sapiens
ugagccaaggggagcug

SEQ ID NO: 11291 - RNA, 24 nt, Homo sapiens
ugagguggaacaggaggcuuuagg

SEQ ID NO: 11292 - RNA, 19 nt, Homo sapiens
ugccuggggaggugcaaag

SEQ ID NO: 11293 - RNA, 21 nt, Homo sapiens
uggguuugugacagacagacc

SEQ ID NO: 11294 - RNA, 19 nt, Homo sapiens
uuaaaaggcacauucaugc

SEQ ID NO: 11295 - RNA, 19 nt, Homo sapiens
uuugacccugagugccaca

SEQ ID NO: 11296 - RNA, 22 nt, Homo sapiens
ccgggcugacggcggucgcccg

SEQ ID NO: 11297 - RNA, 23 nt, Homo sapiens
uuagauauguuauuaaaauacau

SEQ ID NO: 11298 - RNA, 19 nt, Homo sapiens
accucggcggggcggcccc

SEQ ID NO: 11299 - RNA, 20 nt, Homo sapiens
gcggccgggacagcgcagcg

SEQ ID NO: 11300 - RNA, 21 nt, Homo sapiens
ggcgggccgggcuccgaggcg

SEQ ID NO: 11301 - RNA, 16 nt, Homo sapiens
ggggauuguagccgga

SEQ ID NO: 11302 - RNA, 18 nt, Homo sapiens
agagacggaguuucagca

SEQ ID NO: 11303 - RNA, 21 nt, Homo sapiens
gaggcaugcaggucacuuugc

SEQ ID NO: 11304 - RNA, 17 nt, Homo sapiens
cacggcagcucgcacgg

SEQ ID NO: 11305 - RNA, 18 nt, Homo sapiens
cacuuccgagugcgcccc

SEQ ID NO: 11306 - RNA, 19 nt, Homo sapiens
cgcaguuguccccagcugu

SEQ ID NO: 11307 - RNA, 19 nt, Homo sapiens
cuccgcgugcucguccggc

SEQ ID NO: 11308 - RNA, 22 nt, Homo sapiens
cugccguccagauguugguggc

SEQ ID NO: 11309 - RNA, 22 nt, Homo sapiens
gagcgcugcugcuccucguggg

SEQ ID NO: 11310 - RNA, 19 nt, Homo sapiens
gagugcgcccccuacuggc

SEQ ID NO: 11311 - RNA, 17 nt, Homo sapiens
gcaccuguggugguuug

SEQ ID NO: 11312 - RNA, 18 nt, Homo sapiens
gccaccgugcacaguccc

SEQ ID NO: 11313 - RNA, 17 nt, Homo sapiens
ggaaccgauggccgccc

SEQ ID NO: 11314 - RNA, 21 nt, Homo sapiens
ggccucuuccccaccagggcc

SEQ ID NO: 11315 - RNA, 21 nt, Homo sapiens
ggggaggagcugggugacagg

SEQ ID NO: 11316 - RNA, 22 nt, Homo sapiens
uagagacaugacguggccgugc

SEQ ID NO: 11317 - RNA, 14 nt, Homo sapiens
uccguggaggcgag

SEQ ID NO: 11318 - RNA, 15 nt, Homo sapiens
ucuccaggcggaggg

SEQ ID NO: 11319 - RNA, 22 nt, Homo sapiens
ucuguuuuaaauggugaaucca

SEQ ID NO: 11320 - RNA, 21 nt, Homo sapiens
uuagaaagaagcgugauucuc

SEQ ID NO: 11321 - RNA, 19 nt, Homo sapiens
agcaggcgggucuggcggc

SEQ ID NO: 11322 - RNA, 18 nt, Homo sapiens
ugagaggagcggaagagc

SEQ ID NO: 11323 - RNA, 16 nt, Homo sapiens
gacaaaaaagguugau

SEQ ID NO: 11324 - RNA, 22 nt, Homo sapiens
ugguguuacggugagcacgcca

SEQ ID NO: 11325 - RNA, 22 nt, Homo sapiens
agcggggaggggggucuggagg

SEQ ID NO: 11326 - RNA, 21 nt, Homo sapiens
aggccuggggaggcucucggg

SEQ ID NO: 11327 - RNA, 18 nt, Homo sapiens
aggggucugacccccaug

SEQ ID NO: 11328 - RNA, 24 nt, Homo sapiens
caccgggaccacggcggggacgcg

SEQ ID NO: 11329 - RNA, 18 nt, Homo sapiens
ccgcccaggccucgccgc

SEQ ID NO: 11330 - RNA, 20 nt, Homo sapiens
cgccgcgcgcgcccgggccg

SEQ ID NO: 11331 - RNA, 16 nt, Homo sapiens
cgcgcgggcagcgccc

SEQ ID NO: 11332 - RNA, 21 nt, Homo sapiens
cggagcagcccgcgccgcccg

SEQ ID NO: 11333 - RNA, 18 nt, Homo sapiens
cggggacgcgaggacugg

SEQ ID NO: 11334 - RNA, 24 nt, Homo sapiens
cggggccuaccggugagcgcuucg

SEQ ID NO: 11335 - RNA, 21 nt, Homo sapiens
gcgcccgggccgcgccgcccg

SEQ ID NO: 11336 - RNA, 22 nt, Homo sapiens
gcugugggacaggugccaccug

SEQ ID NO: 11337 - RNA, 20 nt, Homo sapiens
ggaggaggcagggguggggg

SEQ ID NO: 11338 - RNA, 16 nt, Homo sapiens
ggcugccccaagccug

SEQ ID NO: 11339 - RNA, 21 nt, Homo sapiens
gugggggugucugccucggac

SEQ ID NO: 11340 - RNA, 16 nt, Homo sapiens
ucgccgcgcgcgcccg

SEQ ID NO: 11341 - RNA, 19 nt, Homo sapiens
agugagcuuucccauugcc

SEQ ID NO: 11342 - RNA, 20 nt, Homo sapiens
uucacaauccugucaaggac

SEQ ID NO: 11343 - RNA, 18 nt, Homo sapiens
aaccuugaggcugucaau

SEQ ID NO: 11344 - RNA, 19 nt, Homo sapiens
auugccuuuuuucuggggg

SEQ ID NO: 11345 - RNA, 22 nt, Homo sapiens
acuaaccaaguuugugcaguau

SEQ ID NO: 11346 - RNA, 19 nt, Homo sapiens
agcgggcggcaaucgccgg

SEQ ID NO: 11347 - RNA, 18 nt, Homo sapiens
ccgggcccggcuccgagc

SEQ ID NO: 11348 - RNA, 19 nt, Homo sapiens
cuucuaaaauuacucaauu

SEQ ID NO: 11349 - RNA, 24 nt, Homo sapiens
gcgggcggcaaucgccgggguccg

SEQ ID NO: 11350 - RNA, 25 nt, Homo sapiens
uaacaaugucauguuccagguuuaa

SEQ ID NO: 11351 - RNA, 22 nt, Homo sapiens
uaagcgcuggcucccuccacac

SEQ ID NO: 11352 - RNA, 15 nt, Homo sapiens
uccaugaguaacugc

SEQ ID NO: 11353 - RNA, 18 nt, Homo sapiens
ucgccgggguccgggccc

SEQ ID NO: 11354 - RNA, 18 nt, Homo sapiens
ucgcuccggccuaagcgc

SEQ ID NO: 11355 - RNA, 20 nt, Homo sapiens
uguagaaaauauaaauagac

SEQ ID NO: 11356 - RNA, 20 nt, Homo sapiens
acucuaugggggacagagga

SEQ ID NO: 11357 - RNA, 23 nt, Homo sapiens
agaggaaggagaacuggaaaaga

SEQ ID NO: 11358 - RNA, 20 nt, Homo sapiens
gaaaaacacagucacgaugu

SEQ ID NO: 11359 - RNA, 20 nt, Homo sapiens
gcagggcgggagagccgggc

SEQ ID NO: 11360 - RNA, 16 nt, Homo sapiens
ggagaggaagggggag

SEQ ID NO: 11361 - RNA, 20 nt, Homo sapiens
gggagccccgaaaccgccua

SEQ ID NO: 11362 - RNA, 26 nt, Homo sapiens
uccccauccccccagcccaggccccu

SEQ ID NO: 11363 - RNA, 17 nt, Homo sapiens
ggcgggggaggcacagc

SEQ ID NO: 11364 - RNA, 15 nt, Homo sapiens
ggagguagagaggga

SEQ ID NO: 11365 - RNA, 16 nt, Homo sapiens
gguccgaggugcagcc

SEQ ID NO: 11366 - RNA, 21 nt, Homo sapiens
uccguggccaacauccgcugg

SEQ ID NO: 11367 - RNA, 19 nt, Homo sapiens
gaucugggcccccaguccu

SEQ ID NO: 11368 - RNA, 19 nt, Homo sapiens
gcagagcagaagugcccca

SEQ ID NO: 11369 - RNA, 17 nt, Homo sapiens
gccaggcucuccucccc

SEQ ID NO: 11370 - RNA, 17 nt, Homo sapiens
gcucacuccguggggcc

SEQ ID NO: 11371 - RNA, 19 nt, Homo sapiens
ggucacgcuccuuccuucc

SEQ ID NO: 11372 - RNA, 14 nt, Homo sapiens
gugggauguccuag

SEQ ID NO: 11373 - RNA, 17 nt, Homo sapiens
uggcucagcguguggug

SEQ ID NO: 11374 - RNA, 17 nt, Homo sapiens
uggugggauguccuagc

SEQ ID NO: 11375 - RNA, 22 nt, Homo sapiens
aucaucuauuuuaaacaauaga

SEQ ID NO: 11376 - RNA, 17 nt, Homo sapiens
ccccguuauaaucaucu

SEQ ID NO: 11377 - RNA, 17 nt, Homo sapiens
cccugcuugaaggauuu

SEQ ID NO: 11378 - RNA, 21 nt, Homo sapiens
ccgccgcgcuccccuagcccg

SEQ ID NO: 11379 - RNA, 17 nt, Homo sapiens
ccgcgcuccccuagccc

SEQ ID NO: 11380 - RNA, 23 nt, Homo sapiens
ccgguggcuuuuuuucucuaacu

SEQ ID NO: 11381 - RNA, 17 nt, Homo sapiens
cgcuggggcgagcgagg

SEQ ID NO: 11382 - RNA, 20 nt, Homo sapiens
gcuauaacuguuacuuccga

SEQ ID NO: 11383 - RNA, 19 nt, Homo sapiens
gcuccgggccccguccgcg

SEQ ID NO: 11384 - RNA, 16 nt, Homo sapiens
gggagggucgcucugg

SEQ ID NO: 11385 - RNA, 17 nt, Homo sapiens
guguaaaaugaagagua

SEQ ID NO: 11386 - RNA, 19 nt, Homo sapiens
uaaacuccuuaaggaucca

SEQ ID NO: 11387 - RNA, 18 nt, Homo sapiens
uagcuauagugaaaauca

SEQ ID NO: 11388 - RNA, 19 nt, Homo sapiens
ucccacuguugccuauuaa

SEQ ID NO: 11389 - RNA, 16 nt, Homo sapiens
agcaucuuugcccucg

SEQ ID NO: 11390 - RNA, 17 nt, Homo sapiens
uacagagcugaagcagg

SEQ ID NO: 11391 - RNA, 16 nt, Homo sapiens
acucuccuuauaggag

SEQ ID NO: 11392 - RNA, 21 nt, Homo sapiens
agaggaaggacgauggucaag

SEQ ID NO: 11393 - RNA, 18 nt, Homo sapiens
agggcacacccaugcuca

SEQ ID NO: 11394 - RNA, 19 nt, Homo sapiens
aggggacgcugagucccug

SEQ ID NO: 11395 - RNA, 17 nt, Homo sapiens
cagggcucucagcugcc

SEQ ID NO: 11396 - RNA, 17 nt, Homo sapiens
ccccaccucccuagccc

SEQ ID NO: 11397 - RNA, 18 nt, Homo sapiens
ccuggaggacccggaccc

SEQ ID NO: 11398 - RNA, 22 nt, Homo sapiens
ccuuugacccccuucgcucucc

SEQ ID NO: 11399 - RNA, 17 nt, Homo sapiens
cgggcgagcggcggagg

SEQ ID NO: 11400 - RNA, 19 nt, Homo sapiens
gcccucugugcuucaaguc

SEQ ID NO: 11401 - RNA, 18 nt, Homo sapiens
gccggaggggagcaagcc

SEQ ID NO: 11402 - RNA, 21 nt, Homo sapiens
gcggcgcgcgggcgagcggcg

SEQ ID NO: 11403 - RNA, 19 nt, Homo sapiens
ggaaguuagcaggcgugcc

SEQ ID NO: 11404 - RNA, 18 nt, Homo sapiens
ggcgcgcgggcgagcggc

SEQ ID NO: 11405 - RNA, 22 nt, Homo sapiens
gggcgcaggcggggagcgcgcg

SEQ ID NO: 11406 - RNA, 17 nt, Homo sapiens
uacagggagcgagccac

SEQ ID NO: 11407 - RNA, 18 nt, Homo sapiens
uagcccucugugcuucaa

SEQ ID NO: 11408 - RNA, 20 nt, Homo sapiens
ucuugggcuaagugccaguc

SEQ ID NO: 11409 - RNA, 19 nt, Homo sapiens
ugagugaaggaaugaguga

SEQ ID NO: 11410 - RNA, 22 nt, Homo sapiens
uggcugugaccacaaauggggu

SEQ ID NO: 11411 - RNA, 16 nt, Homo sapiens
uguguaacaccaaaga

SEQ ID NO: 11412 - RNA, 20 nt, Homo sapiens
gcggggugcgguggcagcgg

SEQ ID NO: 11413 - RNA, 22 nt, Homo sapiens
uugaugugugaucuuuauuuug

SEQ ID NO: 11414 - RNA, 20 nt, Homo sapiens
aucauuuacaaauuauucca

SEQ ID NO: 11415 - RNA, 19 nt, Homo sapiens
cauggagugucccccuuca

SEQ ID NO: 11416 - RNA, 16 nt, Homo sapiens
ccccaaaagcuacauu

SEQ ID NO: 11417 - RNA, 20 nt, Homo sapiens
gaaugcccucccauuuacuu

SEQ ID NO: 11418 - RNA, 18 nt, Homo sapiens
uagagugcagauagcugc

SEQ ID NO: 11419 - RNA, 24 nt, Homo sapiens
ugugcuccaauacuaugcauaaaa

SEQ ID NO: 11420 - RNA, 18 nt, Homo sapiens
agagguagaacauuucca

SEQ ID NO: 11421 - RNA, 22 nt, Homo sapiens
aggaaguucuguugaacaguac

SEQ ID NO: 11422 - RNA, 23 nt, Homo sapiens
agugaaggauguaauuuuaaggc

SEQ ID NO: 11423 - RNA, 20 nt, Homo sapiens
auaggcgcgauaaaaucgug

SEQ ID NO: 11424 - RNA, 17 nt, Homo sapiens
cauaagacggagcaagg

SEQ ID NO: 11425 - RNA, 17 nt, Homo sapiens
ccggggugggcgcgggg

SEQ ID NO: 11426 - RNA, 18 nt, Homo sapiens
ccggggugggcgcgggga

SEQ ID NO: 11427 - RNA, 22 nt, Homo sapiens
cgcggucccgggccugcgggga

SEQ ID NO: 11428 - RNA, 21 nt, Homo sapiens
gcacuccaauacaguagccac

SEQ ID NO: 11429 - RNA, 17 nt, Homo sapiens
gcagccgggcgggcgcc

SEQ ID NO: 11430 - RNA, 21 nt, Homo sapiens
gcccgcccucccgccuccgcc

SEQ ID NO: 11431 - RNA, 19 nt, Homo sapiens
ggagcuggcggcgagugag

SEQ ID NO: 11432 - RNA, 20 nt, Homo sapiens
gggccggggcgggggucggg

SEQ ID NO: 11433 - RNA, 20 nt, Homo sapiens
gggcgggggucggggcuggg

SEQ ID NO: 11434 - RNA, 20 nt, Homo sapiens
gugcucagcguacacagcca

SEQ ID NO: 11435 - RNA, 17 nt, Homo sapiens
ugaccgaggugaggugc

SEQ ID NO: 11436 - RNA, 16 nt, Homo sapiens
aagauuaacuccacca

SEQ ID NO: 11437 - RNA, 20 nt, Homo sapiens
aauguucuacgugaagauac

SEQ ID NO: 11438 - RNA, 18 nt, Homo sapiens
agcacaaaccaaagacac

SEQ ID NO: 11439 - RNA, 23 nt, Homo sapiens
aggucacagugaagguaaaaaua

SEQ ID NO: 11440 - RNA, 18 nt, Homo sapiens
aguuuccaccgcgguggc

SEQ ID NO: 11441 - RNA, 22 nt, Homo sapiens
caccacuaucaucacuuuuugc

SEQ ID NO: 11442 - RNA, 15 nt, Homo sapiens
cagagaaaagaggaa

SEQ ID NO: 11443 - RNA, 15 nt, Homo sapiens
cggccgggcuggagc

SEQ ID NO: 11444 - RNA, 19 nt, Homo sapiens
gauuacaggcacgcgccac

SEQ ID NO: 11445 - RNA, 21 nt, Homo sapiens
ucaauguuuguugggaauuuc

SEQ ID NO: 11446 - RNA, 22 nt, Homo sapiens
ugaggagagaaauggggugggg

SEQ ID NO: 11447 - RNA, 22 nt, Homo sapiens
uggagauuaaaaaaaaaagugg

SEQ ID NO: 11448 - RNA, 14 nt, Homo sapiens
uggcagagaaaaga

SEQ ID NO: 11449 - RNA, 23 nt, Homo sapiens
acguguguugggggaauccuggg

SEQ ID NO: 11450 - RNA, 19 nt, Homo sapiens
agaccagccuguacaacau

SEQ ID NO: 11451 - RNA, 19 nt, Homo sapiens
cucagggcugccggagaac

SEQ ID NO: 11452 - RNA, 18 nt, Homo sapiens
gagacugaggcaggagga

SEQ ID NO: 11453 - RNA, 27 nt, Homo sapiens
gaggauggagaagaccauaggauauac

SEQ ID NO: 11454 - RNA, 17 nt, Homo sapiens
gagggcaaaaugcacug

SEQ ID NO: 11455 - RNA, 21 nt, Homo sapiens
ggcagccgcuuuagcagccag

SEQ ID NO: 11456 - RNA, 20 nt, Homo sapiens
ucugagguuccuuuccucuu

SEQ ID NO: 11457 - RNA, 18 nt, Homo sapiens
guuucgcugauugcauuu

SEQ ID NO: 11458 - RNA, 18 nt, Homo sapiens
gcaccggccgcggccgcc

SEQ ID NO: 11459 - RNA, 15 nt, Homo sapiens
gccgcggccgccgcg

SEQ ID NO: 11460 - RNA, 19 nt, Homo sapiens
aggcuggggccgggcccgg

SEQ ID NO: 11461 - RNA, 18 nt, Homo sapiens
ccccgcgccauccgcccc

SEQ ID NO: 11462 - RNA, 16 nt, Homo sapiens
cccgccgccccgcgcc

SEQ ID NO: 11463 - RNA, 16 nt, Homo sapiens
gcgaggggcaggaugc

SEQ ID NO: 11464 - RNA, 18 nt, Homo sapiens
ggagcuccuccgcugugg

SEQ ID NO: 11465 - RNA, 20 nt, Homo sapiens
gggcugaggcuggggccggg

SEQ ID NO: 11466 - RNA, 22 nt, Homo sapiens
gucccgggcugagaccugcgag

SEQ ID NO: 11467 - RNA, 22 nt, Homo sapiens
uccgccccgagacgcucagggc

SEQ ID NO: 11468 - RNA, 18 nt, Homo sapiens
caucuuucuuugauaguu

SEQ ID NO: 11469 - RNA, 21 nt, Homo sapiens
aggacacucgguuacaugaaa

SEQ ID NO: 11470 - RNA, 14 nt, Homo sapiens
ccagaggccugggc

SEQ ID NO: 11471 - RNA, 19 nt, Homo sapiens
ccgccgccgggccgggacc

SEQ ID NO: 11472 - RNA, 16 nt, Homo sapiens
cugccuuccaggggcu

SEQ ID NO: 11473 - RNA, 20 nt, Homo sapiens
cugcucgacuuucuggagga

SEQ ID NO: 11474 - RNA, 20 nt, Homo sapiens
ggucugugcagccagcagcc

SEQ ID NO: 11475 - RNA, 18 nt, Homo sapiens
uccagcgauccuccugcc

SEQ ID NO: 11476 - RNA, 18 nt, Homo sapiens
uggcauggaggcaggguu

SEQ ID NO: 11477 - RNA, 15 nt, Homo sapiens
acaauggcauggccu

SEQ ID NO: 11478 - RNA, 27 nt, Homo sapiens
acaguugugcaaaucuguguugguuuu

SEQ ID NO: 11479 - RNA, 22 nt, Homo sapiens
ccuguuucuuauuuuuuuuucu

SEQ ID NO: 11480 - RNA, 18 nt, Homo sapiens
gagaaaacagaagucauu

SEQ ID NO: 11481 - RNA, 19 nt, Homo sapiens
gcgccgggcgccgggcgcc

SEQ ID NO: 11482 - RNA, 17 nt, Homo sapiens
gcuccgcgccgggcgcc

SEQ ID NO: 11483 - RNA, 14 nt, Homo sapiens
guagagcccagagu

SEQ ID NO: 11484 - RNA, 20 nt, Homo sapiens
ccaccgcuccucacuggccc

SEQ ID NO: 11485 - RNA, 18 nt, Homo sapiens
guguuaaugugugugugc

SEQ ID NO: 11486 - RNA, 18 nt, Homo sapiens
caacagcaaugcgggguu

SEQ ID NO: 11487 - RNA, 17 nt, Homo sapiens
gagcucuuggcuggacg

SEQ ID NO: 11488 - RNA, 19 nt, Homo sapiens
uagcagaugaagagcucuu

SEQ ID NO: 11489 - RNA, 21 nt, Homo sapiens
ucuagaccgauggcacugacg

SEQ ID NO: 11490 - RNA, 18 nt, Homo sapiens
aggguguacgcagcccgg

SEQ ID NO: 11491 - RNA, 21 nt, Homo sapiens
caugugguuuugcuuuugugg

SEQ ID NO: 11492 - RNA, 19 nt, Homo sapiens
ccugggugacccaggcugc

SEQ ID NO: 11493 - RNA, 19 nt, Homo sapiens
cuuuugugguguuacugcc

SEQ ID NO: 11494 - RNA, 21 nt, Homo sapiens
acauguuuaguguuuccucgc

SEQ ID NO: 11495 - RNA, 20 nt, Homo sapiens
accuuauauuggaaaacuag

SEQ ID NO: 11496 - RNA, 18 nt, Homo sapiens
uauucuguguucucagau

SEQ ID NO: 11497 - RNA, 18 nt, Homo sapiens
ucacagagauguucugca

SEQ ID NO: 11498 - RNA, 21 nt, Homo sapiens
uguuugaagaaagaguuccau

SEQ ID NO: 11499 - RNA, 22 nt, Homo sapiens
uuagugaucuugccaguuuugu

SEQ ID NO: 11500 - RNA, 19 nt, Homo sapiens
ucucucccucauuccuuau

SEQ ID NO: 11501 - RNA, 22 nt, Homo sapiens
ucugaacuauuauucaggauaa

SEQ ID NO: 11502 - RNA, 17 nt, Homo sapiens
uugggaggccaaggugg

SEQ ID NO: 11503 - RNA, 26 nt, Homo sapiens
agggagcguggaggaggcaaauccug

SEQ ID NO: 11504 - RNA, 20 nt, Homo sapiens
auguggcuggcuggcuguug

SEQ ID NO: 11505 - RNA, 14 nt, Homo sapiens
caucuggcuggggu

SEQ ID NO: 11506 - RNA, 21 nt, Homo sapiens
cguggaggaggcaaauccugu

SEQ ID NO: 11507 - RNA, 19 nt, Homo sapiens
cucccucccaaguacagac

SEQ ID NO: 11508 - RNA, 19 nt, Homo sapiens
gaggcccaacccaggaucu

SEQ ID NO: 11509 - RNA, 21 nt, Homo sapiens
gcacugagaggcaagaccgug

SEQ ID NO: 11510 - RNA, 15 nt, Homo sapiens
ucugagcuauuugcc

SEQ ID NO: 11511 - RNA, 18 nt, Homo sapiens
agaggcuggugggcucua

SEQ ID NO: 11512 - RNA, 15 nt, Homo sapiens
caccccggaacucag

SEQ ID NO: 11513 - RNA, 17 nt, Homo sapiens
cagggucccggcaggcc

SEQ ID NO: 11514 - RNA, 18 nt, Homo sapiens
caucagcuguguuucccc

SEQ ID NO: 11515 - RNA, 21 nt, Homo sapiens
ugccugugagcagggucccgg

SEQ ID NO: 11516 - RNA, 21 nt, Homo sapiens
acaguugugugcuagagacag

SEQ ID NO: 11517 - RNA, 19 nt, Homo sapiens
gaguagucucgaggggauc

SEQ ID NO: 11518 - RNA, 17 nt, Homo sapiens
ugacugagggcuggugu

SEQ ID NO: 11519 - RNA, 18 nt, Homo sapiens
gccgcaccggccaccgcc

SEQ ID NO: 11520 - RNA, 17 nt, Homo sapiens
gcgugcgcucacccagc

SEQ ID NO: 11521 - RNA, 24 nt, Homo sapiens
accuggccggccccguccugggca

SEQ ID NO: 11522 - RNA, 18 nt, Homo sapiens
agcugggagggguaggag

SEQ ID NO: 11523 - RNA, 19 nt, Homo sapiens
aggggcgggagggcugugc

SEQ ID NO: 11524 - RNA, 18 nt, Homo sapiens
cagccaagccccgcagug

SEQ ID NO: 11525 - RNA, 15 nt, Homo sapiens
cagccccugaaguca

SEQ ID NO: 11526 - RNA, 19 nt, Homo sapiens
ccgccgccgccgccgcucc

SEQ ID NO: 11527 - RNA, 17 nt, Homo sapiens
cgcgcggcgcucggccg

SEQ ID NO: 11528 - RNA, 15 nt, Homo sapiens
gacugucagcuggga

SEQ ID NO: 11529 - RNA, 17 nt, Homo sapiens
gagggugcgccaaccca

SEQ ID NO: 11530 - RNA, 15 nt, Homo sapiens
gcgccgggcagcggc

SEQ ID NO: 11531 - RNA, 18 nt, Homo sapiens
gcgcucggccgcgcccga

SEQ ID NO: 11532 - RNA, 18 nt, Homo sapiens
gcucgcgcggcgcucggc

SEQ ID NO: 11533 - RNA, 19 nt, Homo sapiens
gcugcccgcccaccuggcc

SEQ ID NO: 11534 - RNA, 20 nt, Homo sapiens
gcugcccgcccaccuggccg

SEQ ID NO: 11535 - RNA, 21 nt, Homo sapiens
ggcggcacugacaggacgugg

SEQ ID NO: 11536 - RNA, 22 nt, Homo sapiens
gggcagauggggucgcacccag

SEQ ID NO: 11537 - RNA, 18 nt, Homo sapiens
gggcagcggcuggguugg

SEQ ID NO: 11538 - RNA, 21 nt, Homo sapiens
gugcugcccgcccaccuggcc

SEQ ID NO: 11539 - RNA, 17 nt, Homo sapiens
uauggcccaaccugcag

SEQ ID NO: 11540 - RNA, 17 nt, Homo sapiens
ucagggaagugggagug

SEQ ID NO: 11541 - RNA, 18 nt, Homo sapiens
ucggggaaggggcgggag

SEQ ID NO: 11542 - RNA, 17 nt, Homo sapiens
ugccaggccuaacacug

SEQ ID NO: 11543 - RNA, 18 nt, Homo sapiens
agagguugcagugagcca

SEQ ID NO: 11544 - RNA, 15 nt, Homo sapiens
agcugccugggccug

SEQ ID NO: 11545 - RNA, 23 nt, Homo sapiens
aggaaacacaaauaauauuugug

SEQ ID NO: 11546 - RNA, 17 nt, Homo sapiens
ccgccgcgcgcaccggc

SEQ ID NO: 11547 - RNA, 15 nt, Homo sapiens
ccugcggagcucggg

SEQ ID NO: 11548 - RNA, 18 nt, Homo sapiens
gaagagaguaacaaaaau

SEQ ID NO: 11549 - RNA, 19 nt, Homo sapiens
uaacuuuguauuuggggaa

SEQ ID NO: 11550 - RNA, 19 nt, Homo sapiens
uacagguuuaaaguuuuga

SEQ ID NO: 11551 - RNA, 22 nt, Homo sapiens
ugaagaaaguagguaagcagug

SEQ ID NO: 11552 - RNA, 22 nt, Homo sapiens
uguaauuuugauaccauuuuua

SEQ ID NO: 11553 - RNA, 26 nt, Homo sapiens
uguccgaagccauuuuuaccgcuggg

SEQ ID NO: 11554 - RNA, 15 nt, Homo sapiens
uuaguucucuaacuu

SEQ ID NO: 11555 - RNA, 20 nt, Homo sapiens
uuuuuggagacggagcucgg

SEQ ID NO: 11556 - RNA, 20 nt, Homo sapiens
agcuuagcaagagcaccuuu

SEQ ID NO: 11557 - RNA, 16 nt, Homo sapiens
aguuccaaugguuuuu

SEQ ID NO: 11558 - RNA, 21 nt, Homo sapiens
ggcaggcaggcgugcaggugg

SEQ ID NO: 11559 - RNA, 19 nt, Homo sapiens
ucaggcacuuucauuaaca

SEQ ID NO: 11560 - RNA, 17 nt, Homo sapiens
uuggacaaaaugguggc

SEQ ID NO: 11561 - RNA, 16 nt, Homo sapiens
agccaccaucccuaug

SEQ ID NO: 11562 - RNA, 18 nt, Homo sapiens
ugagagguuacucaugaa

SEQ ID NO: 11563 - RNA, 19 nt, Homo sapiens
acccagcggugauggcagc

SEQ ID NO: 11564 - RNA, 19 nt, Homo sapiens
cagcggcaacggcgccgcc

SEQ ID NO: 11565 - RNA, 15 nt, Homo sapiens
uggcagcgagcgugc

SEQ ID NO: 11566 - RNA, 18 nt, Homo sapiens
gagaguucgcugguggca

SEQ ID NO: 11567 - RNA, 18 nt, Homo sapiens
uuauguaugugugucuau

SEQ ID NO: 11568 - RNA, 15 nt, Homo sapiens
accugguagauuuug

SEQ ID NO: 11569 - RNA, 21 nt, Homo sapiens
cgcuccccagacccccgccca

SEQ ID NO: 11570 - RNA, 20 nt, Homo sapiens
acaugacaucauuuuguucc

SEQ ID NO: 11571 - RNA, 18 nt, Homo sapiens
aggccagggcagcugacc

SEQ ID NO: 11572 - RNA, 19 nt, Homo sapiens
cacccaaccugcguccaug

SEQ ID NO: 11573 - RNA, 18 nt, Homo sapiens
agacgguggggcacgcgg

SEQ ID NO: 11574 - RNA, 16 nt, Homo sapiens
agucccaggcucagcc

SEQ ID NO: 11575 - RNA, 16 nt, Homo sapiens
agucucugggguuggg

SEQ ID NO: 11576 - RNA, 19 nt, Homo sapiens
caggugcagggguguggaa

SEQ ID NO: 11577 - RNA, 23 nt, Homo sapiens
gaggcaggguggggguugggugc

SEQ ID NO: 11578 - RNA, 24 nt, Homo sapiens
gagggcccaugggcucuggguugc

SEQ ID NO: 11579 - RNA, 19 nt, Homo sapiens
ggcacuggggggcaggaag

SEQ ID NO: 11580 - RNA, 18 nt, Homo sapiens
ggguguggaaugauccua

SEQ ID NO: 11581 - RNA, 19 nt, Homo sapiens
ggguugccggaagcuucuc

SEQ ID NO: 11582 - RNA, 21 nt, Homo sapiens
uaagacgguggggcacgcggu

SEQ ID NO: 11583 - RNA, 18 nt, Homo sapiens
uggaucuggugaccugga

SEQ ID NO: 11584 - RNA, 17 nt, Homo sapiens
uuggucaggugcagggg

SEQ ID NO: 11585 - RNA, 25 nt, Homo sapiens
aacaccguaguuaagauccccgugg

SEQ ID NO: 11586 - RNA, 26 nt, Homo sapiens
acuagucauuucccauuggugacacc

SEQ ID NO: 11587 - RNA, 18 nt, Homo sapiens
caucgacaucuagaaagc

SEQ ID NO: 11588 - RNA, 15 nt, Homo sapiens
cccgccgcugccgcc

SEQ ID NO: 11589 - RNA, 16 nt, Homo sapiens
cucccgccgcugccgc

SEQ ID NO: 11590 - RNA, 21 nt, Homo sapiens
gacaagaaauauaaaauuuag

SEQ ID NO: 11591 - RNA, 19 nt, Homo sapiens
ucacugcaucaauccagaa

SEQ ID NO: 11592 - RNA, 22 nt, Homo sapiens
ugggggagacaccagggagagg

SEQ ID NO: 11593 - RNA, 17 nt, Homo sapiens
uucaaacuacauuucuc

SEQ ID NO: 11594 - RNA, 25 nt, Homo sapiens
uuuuugcguuuuuucuucauuuuuc

SEQ ID NO: 11595 - RNA, 20 nt, Homo sapiens
acaaacacagauacuguuga

SEQ ID NO: 11596 - RNA, 23 nt, Homo sapiens
agcaaugcauguaucaaugacaa

SEQ ID NO: 11597 - RNA, 19 nt, Homo sapiens
agcuacaauggaaaggaaa

SEQ ID NO: 11598 - RNA, 18 nt, Homo sapiens
cgaagagcagagcgcgca

SEQ ID NO: 11599 - RNA, 23 nt, Homo sapiens
gcgcagcggggcuggcggcggcg

SEQ ID NO: 11600 - RNA, 17 nt, Homo sapiens
ggcggcggcgcggagga

SEQ ID NO: 11601 - RNA, 14 nt, Homo sapiens
uacaccaucuauuu

SEQ ID NO: 11602 - RNA, 24 nt, Homo sapiens
uagaggagcuguuuuuauaguguu

SEQ ID NO: 11603 - RNA, 22 nt, Homo sapiens
ucaaguacaagagucuccacag

SEQ ID NO: 11604 - RNA, 18 nt, Homo sapiens
agcagacaacacaguggc

SEQ ID NO: 11605 - RNA, 18 nt, Homo sapiens
uuccuggccuagggcugu

SEQ ID NO: 11606 - RNA, 19 nt, Homo sapiens
ucuguccuuggugucugug

SEQ ID NO: 11607 - RNA, 19 nt, Homo sapiens
gcagccucccuguagaacc

SEQ ID NO: 11608 - RNA, 17 nt, Homo sapiens
ucgugguugauugguuu

SEQ ID NO: 11609 - RNA, 21 nt, Homo sapiens
agucuuggccuggucauuucc

SEQ ID NO: 11610 - RNA, 21 nt, Homo sapiens
ccuccagcuucugcucagugc

SEQ ID NO: 11611 - RNA, 20 nt, Homo sapiens
cugaggguugucuggaggac

SEQ ID NO: 11612 - RNA, 17 nt, Homo sapiens
cuggugcguugugccuc

SEQ ID NO: 11613 - RNA, 19 nt, Homo sapiens
cuuuuccuagcaacccugg

SEQ ID NO: 11614 - RNA, 22 nt, Homo sapiens
ugugucugcugauuucuuuucc

SEQ ID NO: 11615 - RNA, 17 nt, Homo sapiens
agaaucuuugggucccc

SEQ ID NO: 11616 - RNA, 14 nt, Homo sapiens
agggagaaagaugg

SEQ ID NO: 11617 - RNA, 19 nt, Homo sapiens
auugagcuugccaguuugg

SEQ ID NO: 11618 - RNA, 17 nt, Homo sapiens
cagagcccuccacagcc

SEQ ID NO: 11619 - RNA, 17 nt, Homo sapiens
cauccagcagagccugg

SEQ ID NO: 11620 - RNA, 18 nt, Homo sapiens
gauaacagagacaaaugc

SEQ ID NO: 11621 - RNA, 20 nt, Homo sapiens
gccugcuuggugcgugacug

SEQ ID NO: 11622 - RNA, 20 nt, Homo sapiens
gcuguuuguuuucuuacuau

SEQ ID NO: 11623 - RNA, 16 nt, Homo sapiens
ggaacggagcuggagc

SEQ ID NO: 11624 - RNA, 19 nt, Homo sapiens
ggugcgugacuguguuuuu

SEQ ID NO: 11625 - RNA, 29 nt, Homo sapiens
ugcuuguuugccacgcgugugcgcgcggc

SEQ ID NO: 11626 - RNA, 21 nt, Homo sapiens
ugggaacugacagcaugacag

SEQ ID NO: 11627 - RNA, 19 nt, Homo sapiens
aggcggcggaggaggugga

SEQ ID NO: 11628 - RNA, 20 nt, Homo sapiens
ccucggugccgugcgccccg

SEQ ID NO: 11629 - RNA, 16 nt, Homo sapiens
gccggcggggggcgcc

SEQ ID NO: 11630 - RNA, 21 nt, Homo sapiens
gcgcggggccggcgcgggggg

SEQ ID NO: 11631 - RNA, 22 nt, Homo sapiens
gcgcggggccggcgcggggggg

SEQ ID NO: 11632 - RNA, 19 nt, Homo sapiens
gcgcgggggggcagggggc

SEQ ID NO: 11633 - RNA, 20 nt, Homo sapiens
gcggaggagguggaugcggc

SEQ ID NO: 11634 - RNA, 23 nt, Homo sapiens
ggagguggaugcggcgggggcgg

SEQ ID NO: 11635 - RNA, 19 nt, Homo sapiens
gggcccgccgcucuccguc

SEQ ID NO: 11636 - RNA, 17 nt, Homo sapiens
gggggggcagggggcgg

SEQ ID NO: 11637 - RNA, 24 nt, Homo sapiens
acggggcugcauggcggcuccaag

SEQ ID NO: 11638 - RNA, 16 nt, Homo sapiens
agucaauggcuagaug

SEQ ID NO: 11639 - RNA, 18 nt, Homo sapiens
cuauuagagauuggggaa

SEQ ID NO: 11640 - RNA, 18 nt, Homo sapiens
gccauguguauugcaccc

SEQ ID NO: 11641 - RNA, 19 nt, Homo sapiens
ggacucaagcaugagggac

SEQ ID NO: 11642 - RNA, 19 nt, Homo sapiens
ggcagcccuuguccccagc

SEQ ID NO: 11643 - RNA, 20 nt, Homo sapiens
ggggguggaaugaggggugu

SEQ ID NO: 11644 - RNA, 21 nt, Homo sapiens
gguuccuaccacccuuagggc

SEQ ID NO: 11645 - RNA, 24 nt, Homo sapiens
guccucucuggaccaaggguuucc

SEQ ID NO: 11646 - RNA, 16 nt, Homo sapiens
acacucuuugcaggga

SEQ ID NO: 11647 - RNA, 20 nt, Homo sapiens
auagaaagaaaaaccuaaag

SEQ ID NO: 11648 - RNA, 21 nt, Homo sapiens
aucaugccauugcauuccagc

SEQ ID NO: 11649 - RNA, 17 nt, Homo sapiens
auguuugugccauuucc

SEQ ID NO: 11650 - RNA, 24 nt, Homo sapiens
caggcgugguggcgugcaccugua

SEQ ID NO: 11651 - RNA, 18 nt, Homo sapiens
cggugguggggcgcgccc

SEQ ID NO: 11652 - RNA, 19 nt, Homo sapiens
gaaaggaggggacugauga

SEQ ID NO: 11653 - RNA, 16 nt, Homo sapiens
gaacccaggaggcgga

SEQ ID NO: 11654 - RNA, 17 nt, Homo sapiens
gagagcuugcuuuccug

SEQ ID NO: 11655 - RNA, 18 nt, Homo sapiens
gcauuccagccuggguua

SEQ ID NO: 11656 - RNA, 16 nt, Homo sapiens
gccagugccugcagcc

SEQ ID NO: 11657 - RNA, 22 nt, Homo sapiens
gguagcaacagcagcagacaug

SEQ ID NO: 11658 - RNA, 18 nt, Homo sapiens
ugagugcucugcuucaag

SEQ ID NO: 11659 - RNA, 23 nt, Homo sapiens
ugccuguaaucccaacacuuugg

SEQ ID NO: 11660 - RNA, 17 nt, Homo sapiens
uugggaggcugaggugg

SEQ ID NO: 11661 - RNA, 23 nt, Homo sapiens
uuggguagcaacagcagcagaca

SEQ ID NO: 11662 - RNA, 19 nt, Homo sapiens
agcggguguuggaagagcg

SEQ ID NO: 11663 - RNA, 17 nt, Homo sapiens
ggcggcgggcgcggcgc

SEQ ID NO: 11664 - RNA, 27 nt, Homo sapiens
aggaaaaaggaggggaggcaggggagg

SEQ ID NO: 11665 - RNA, 19 nt, Homo sapiens
aguggaaaauccuaaguag

SEQ ID NO: 11666 - RNA, 16 nt, Homo sapiens
caauggggcaagacaa

SEQ ID NO: 11667 - RNA, 23 nt, Homo sapiens
cagcagcugcuuucuggggacag

SEQ ID NO: 11668 - RNA, 21 nt, Homo sapiens
cagggcccuggccacacuugc

SEQ ID NO: 11669 - RNA, 21 nt, Homo sapiens
ccaagaucacuuacugccccc

SEQ ID NO: 11670 - RNA, 21 nt, Homo sapiens
ccauguaaaacagggagaggg

SEQ ID NO: 11671 - RNA, 18 nt, Homo sapiens
ccccgcuccccccggccc

SEQ ID NO: 11672 - RNA, 16 nt, Homo sapiens
ccggcucccuccuucc

SEQ ID NO: 11673 - RNA, 18 nt, Homo sapiens
ggccacacuugcauggag

SEQ ID NO: 11674 - RNA, 18 nt, Homo sapiens
gggcaguggcagucuggu

SEQ ID NO: 11675 - RNA, 23 nt, Homo sapiens
gggcauguggacaugaucccucg

SEQ ID NO: 11676 - RNA, 22 nt, Homo sapiens
gggcccugaccuuagcagguua

SEQ ID NO: 11677 - RNA, 19 nt, Homo sapiens
guggacaggaaaaaggagg

SEQ ID NO: 11678 - RNA, 20 nt, Homo sapiens
ugaagaugguggggaaggau

SEQ ID NO: 11679 - RNA, 17 nt, Homo sapiens
ugcccuggcccacuccc

SEQ ID NO: 11680 - RNA, 18 nt, Homo sapiens
uuuaugagaagugaguga

SEQ ID NO: 11681 - RNA, 20 nt, Homo sapiens
aggccuguggcuauggggga

SEQ ID NO: 11682 - RNA, 17 nt, Homo sapiens
gggaggggcgcgggcac

SEQ ID NO: 11683 - RNA, 17 nt, Homo sapiens
uagcaccacccgaagcc

SEQ ID NO: 11684 - RNA, 18 nt, Homo sapiens
gcagugccuccucucucu

SEQ ID NO: 11685 - RNA, 15 nt, Homo sapiens
ggaggcagugccucc

SEQ ID NO: 11686 - RNA, 17 nt, Homo sapiens
gggggagcugggggcgg

SEQ ID NO: 11687 - RNA, 15 nt, Homo sapiens
ggggggagggcaggg

SEQ ID NO: 11688 - RNA, 19 nt, Homo sapiens
ugcuguaguggaggcagug

SEQ ID NO: 11689 - RNA, 16 nt, Homo sapiens
uggcugcagugaccug

SEQ ID NO: 11690 - RNA, 18 nt, Homo sapiens
agcagcaguagcagcucc

SEQ ID NO: 11691 - RNA, 16 nt, Homo sapiens
cccgcccagcccucuc

SEQ ID NO: 11692 - RNA, 18 nt, Homo sapiens
gggguggaggagggggag

SEQ ID NO: 11693 - RNA, 15 nt, Homo sapiens
gugaagguugaggga

SEQ ID NO: 11694 - RNA, 21 nt, Homo sapiens
uuggugaagguugagggaccu

SEQ ID NO: 11695 - RNA, 18 nt, Homo sapiens
gccgcagaugccaccgcc

SEQ ID NO: 11696 - RNA, 22 nt, Homo sapiens
ggaacagccagaagggaaaggg

SEQ ID NO: 11697 - RNA, 19 nt, Homo sapiens
gugcagcugcagaacguga

SEQ ID NO: 11698 - RNA, 25 nt, Homo sapiens
aggauggggggaguggggugggggg

SEQ ID NO: 11699 - RNA, 22 nt, Homo sapiens
aguggggugggggggcaggagg

SEQ ID NO: 11700 - RNA, 14 nt, Homo sapiens
cacuggggcacugu

SEQ ID NO: 11701 - RNA, 20 nt, Homo sapiens
ccgaaggucagucccggagg

SEQ ID NO: 11702 - RNA, 23 nt, Homo sapiens
ccuggagcgcagcgugggcggcc

SEQ ID NO: 11703 - RNA, 16 nt, Homo sapiens
gcuccuggagcgcagc

SEQ ID NO: 11704 - RNA, 21 nt, Homo sapiens
ggagguggggcaccuguagcc

SEQ ID NO: 11705 - RNA, 21 nt, Homo sapiens
ggaguggggugggggggcagg

SEQ ID NO: 11706 - RNA, 19 nt, Homo sapiens
gggcacuguguucccaggg

SEQ ID NO: 11707 - RNA, 24 nt, Homo sapiens
gggggaguggggugggggggcagg

SEQ ID NO: 11708 - RNA, 22 nt, Homo sapiens
ggggggaguggggugggggggc

SEQ ID NO: 11709 - RNA, 19 nt, Homo sapiens
gguaggauggggggagugg

SEQ ID NO: 11710 - RNA, 25 nt, Homo sapiens
uaggauggggggagugggguggggg

SEQ ID NO: 11711 - RNA, 20 nt, Homo sapiens
uccaaguucuuucccagccc

SEQ ID NO: 11712 - RNA, 19 nt, Homo sapiens
uggggugggggggcaggag

SEQ ID NO: 11713 - RNA, 18 nt, Homo sapiens
ggaggggagcgggcaggg

SEQ ID NO: 11714 - RNA, 22 nt, Homo sapiens
cgagaagcgccccgcguccccg

SEQ ID NO: 11715 - RNA, 14 nt, Homo sapiens
ucgcggccgggagg

SEQ ID NO: 11716 - RNA, 17 nt, Homo sapiens
gcggggugagaggggag

SEQ ID NO: 11717 - RNA, 18 nt, Homo sapiens
gggaggaggagggugagc

SEQ ID NO: 11718 - RNA, 22 nt, Homo sapiens
ggggacugguggggauggcggg

SEQ ID NO: 11719 - RNA, 22 nt, Homo sapiens
uccaggugaggaggggggcagu

SEQ ID NO: 11720 - RNA, 21 nt, Homo sapiens
cacagcuggacgacccgcccc

SEQ ID NO: 11721 - RNA, 21 nt, Homo sapiens
ccgcgccccgcccaccgcccg

SEQ ID NO: 11722 - RNA, 20 nt, Homo sapiens
ccugccgccgccaucuuggu

SEQ ID NO: 11723 - RNA, 19 nt, Homo sapiens
cugccgccgccaucuuggu

SEQ ID NO: 11724 - RNA, 16 nt, Homo sapiens
gagaaucgggaacagg

SEQ ID NO: 11725 - RNA, 21 nt, Homo sapiens
gccccucccugcuugcaacuc

SEQ ID NO: 11726 - RNA, 21 nt, Homo sapiens
gagacauaggaagggaggugg

SEQ ID NO: 11727 - RNA, 23 nt, Homo sapiens
ugagagacauaggaagggaggug

SEQ ID NO: 11728 - RNA, 16 nt, Homo sapiens
ugguggcgccgcgggc

SEQ ID NO: 11729 - RNA, 20 nt, Homo sapiens
aacaccagucuaugggguac

SEQ ID NO: 11730 - RNA, 16 nt, Homo sapiens
gcggcgcgccccuggc

SEQ ID NO: 11731 - RNA, 15 nt, Homo sapiens
ggcaguucccccaug

SEQ ID NO: 11732 - RNA, 17 nt, Homo sapiens
ggguacugcauugcuuu

SEQ ID NO: 11733 - RNA, 18 nt, Homo sapiens
guggcugcggcgcgcccc

SEQ ID NO: 11734 - RNA, 14 nt, Homo sapiens
ucaagacuaguagg

SEQ ID NO: 11735 - RNA, 17 nt, Homo sapiens
ugaaagagccaaaaaac

SEQ ID NO: 11736 - RNA, 23 nt, Homo sapiens
acugcgugugcacguuugugugu

SEQ ID NO: 11737 - RNA, 16 nt, Homo sapiens
aggagcauccacagga

SEQ ID NO: 11738 - RNA, 18 nt, Homo sapiens
cugcuagaggauuuucag

SEQ ID NO: 11739 - RNA, 16 nt, Homo sapiens
gcgcggggcgaguccg

SEQ ID NO: 11740 - RNA, 20 nt, Homo sapiens
ugggaaggcgaaugggggaa

SEQ ID NO: 11741 - RNA, 18 nt, Homo sapiens
ugggugggugggucagug

SEQ ID NO: 11742 - RNA, 19 nt, Homo sapiens
cuuuuuuuccuuccucaca

SEQ ID NO: 11743 - RNA, 20 nt, Homo sapiens
agagaaauguggcgacuugg

SEQ ID NO: 11744 - RNA, 19 nt, Homo sapiens
cccaacaucagucaugcac

SEQ ID NO: 11745 - RNA, 21 nt, Homo sapiens
ggcuuccaaguucuuagauaa

SEQ ID NO: 11746 - RNA, 18 nt, Homo sapiens
acuguuuaucugucaguu

SEQ ID NO: 11747 - RNA, 19 nt, Homo sapiens
ccucccucucucucccauc

SEQ ID NO: 11748 - RNA, 22 nt, Homo sapiens
uguugaaguccaaagacaagaa

SEQ ID NO: 11749 - RNA, 17 nt, Homo sapiens
acgaaguucagcucguc

SEQ ID NO: 11750 - RNA, 24 nt, Homo sapiens
aggcggccgacuccgggucccggg

SEQ ID NO: 11751 - RNA, 22 nt, Homo sapiens
agggucuggaaacuggggccca

SEQ ID NO: 11752 - RNA, 18 nt, Homo sapiens
auauauauauauauauau

SEQ ID NO: 11753 - RNA, 20 nt, Homo sapiens
auauauauauauauaucuac

SEQ ID NO: 11754 - RNA, 23 nt, Homo sapiens
auauuuauauauauauauauaua

SEQ ID NO: 11755 - RNA, 21 nt, Homo sapiens
cagugguggugagcuccaaga

SEQ ID NO: 11756 - RNA, 19 nt, Homo sapiens
ccgcugcggcugcggcucc

SEQ ID NO: 11757 - RNA, 16 nt, Homo sapiens
cggcuccucugccgcg

SEQ ID NO: 11758 - RNA, 19 nt, Homo sapiens
cguugauauagauacaaag

SEQ ID NO: 11759 - RNA, 16 nt, Homo sapiens
cugccgcugccgcugg

SEQ ID NO: 11760 - RNA, 18 nt, Homo sapiens
uauauauauauauauaua

SEQ ID NO: 11761 - RNA, 21 nt, Homo sapiens
uauauauauauauauauauaa

SEQ ID NO: 11762 - RNA, 21 nt, Homo sapiens
uauauauauauaucuaccuau

SEQ ID NO: 11763 - RNA, 25 nt, Homo sapiens
uauauauuuauauauauauauauau

SEQ ID NO: 11764 - RNA, 25 nt, Homo sapiens
uauauuuauauauauauauauauau

SEQ ID NO: 11765 - RNA, 15 nt, Homo sapiens
uggcaccaggcggcc

SEQ ID NO: 11766 - RNA, 15 nt, Homo sapiens
uggcaucuacauggu

SEQ ID NO: 11767 - RNA, 16 nt, Homo sapiens
agccuccguugccuug

SEQ ID NO: 11768 - RNA, 19 nt, Homo sapiens
cacacuucuagucgcggga

SEQ ID NO: 11769 - RNA, 17 nt, Homo sapiens
cggccucguuccggggc

SEQ ID NO: 11770 - RNA, 20 nt, Homo sapiens
ggaggcgggagggggguugg

SEQ ID NO: 11771 - RNA, 19 nt, Homo sapiens
gggccuuuucccccacaag

SEQ ID NO: 11772 - RNA, 17 nt, Homo sapiens
ugccugggaggcgggag

SEQ ID NO: 11773 - RNA, 20 nt, Homo sapiens
gggucccuacugggcgccgc

SEQ ID NO: 11774 - RNA, 17 nt, Homo sapiens
aacuuguuuaauuggcu

SEQ ID NO: 11775 - RNA, 19 nt, Homo sapiens
aggagcuugcugaggaaaa

SEQ ID NO: 11776 - RNA, 19 nt, Homo sapiens
aggcuuccaagauguuuaa

SEQ ID NO: 11777 - RNA, 21 nt, Homo sapiens
auaaaaugauuuuuuuucaug

SEQ ID NO: 11778 - RNA, 17 nt, Homo sapiens
caacacuggaaaaauac

SEQ ID NO: 11779 - RNA, 26 nt, Homo sapiens
cacaaacauuccugauuuauacuggg

SEQ ID NO: 11780 - RNA, 24 nt, Homo sapiens
ggaaaggguacaccuaggacaaag

SEQ ID NO: 11781 - RNA, 24 nt, Homo sapiens
ugaggaaaaggaaaucacaguugu

SEQ ID NO: 11782 - RNA, 19 nt, Homo sapiens
ugauuggucaacuggcugu

SEQ ID NO: 11783 - RNA, 17 nt, Homo sapiens
uugggaggccgaggugg

SEQ ID NO: 11784 - RNA, 21 nt, Homo sapiens
ccaggaaggugucaaacgagg

SEQ ID NO: 11785 - RNA, 22 nt, Homo sapiens
cucaagaguggggacugcaggg

SEQ ID NO: 11786 - RNA, 19 nt, Homo sapiens
ggaaggaguggugugccac

SEQ ID NO: 11787 - RNA, 18 nt, Homo sapiens
ggcucgaguuuagguuug

SEQ ID NO: 11788 - RNA, 19 nt, Homo sapiens
uggagguggguccugauca

SEQ ID NO: 11789 - RNA, 15 nt, Homo sapiens
agcgggggaggggga

SEQ ID NO: 11790 - RNA, 20 nt, Homo sapiens
ugaggagggggaaggggacc

SEQ ID NO: 11791 - RNA, 17 nt, Homo sapiens
uaucagguuuuuacccu

SEQ ID NO: 11792 - RNA, 16 nt, Homo sapiens
ugagagaaggucccgg

SEQ ID NO: 11793 - RNA, 18 nt, Homo sapiens
ccggcgcuggcgggggcg

SEQ ID NO: 11794 - RNA, 19 nt, Homo sapiens
gcgcaggguagguagcugc

SEQ ID NO: 11795 - RNA, 18 nt, Homo sapiens
ggcgcuggcgggggcggc

SEQ ID NO: 11796 - RNA, 26 nt, Homo sapiens
ggcgcuggcgggggcggccacggggc

SEQ ID NO: 11797 - RNA, 18 nt, Homo sapiens
ggggaccuggccgggcgc

SEQ ID NO: 11798 - RNA, 16 nt, Homo sapiens
ugagagggagagaaag

SEQ ID NO: 11799 - RNA, 22 nt, Homo sapiens
uuccaaaguggagugugaaaau

SEQ ID NO: 11800 - RNA, 18 nt, Homo sapiens
acgcggcgcggccagaac

SEQ ID NO: 11801 - RNA, 19 nt, Homo sapiens
ccgcccgcccgccgccgcc

SEQ ID NO: 11802 - RNA, 20 nt, Homo sapiens
ccgcccgccgccgccgcagc

SEQ ID NO: 11803 - RNA, 23 nt, Homo sapiens
ccgccgcagcgucacagcggccg

SEQ ID NO: 11804 - RNA, 22 nt, Homo sapiens
cugcgugugugcagaugugugu

SEQ ID NO: 11805 - RNA, 18 nt, Homo sapiens
gcagauuucaaagaaaag

SEQ ID NO: 11806 - RNA, 17 nt, Homo sapiens
gcccgcccgccgccgcc

SEQ ID NO: 11807 - RNA, 19 nt, Homo sapiens
gggagcuuucuagaaacug

SEQ ID NO: 11808 - RNA, 18 nt, Homo sapiens
uccacaucucucucuucu

SEQ ID NO: 11809 - RNA, 20 nt, Homo sapiens
aagcugggccuggggcagga

SEQ ID NO: 11810 - RNA, 19 nt, Homo sapiens
gaaggcaggagagaagcug

SEQ ID NO: 11811 - RNA, 19 nt, Homo sapiens
uccuggcuugcuuugcuug

SEQ ID NO: 11812 - RNA, 19 nt, Homo sapiens
agaggaaggacggggaaag

SEQ ID NO: 11813 - RNA, 19 nt, Homo sapiens
cagggacccgagguggggg

SEQ ID NO: 11814 - RNA, 17 nt, Homo sapiens
ccucuggguggcugugg

SEQ ID NO: 11815 - RNA, 18 nt, Homo sapiens
cggcagcccuggcagagc

SEQ ID NO: 11816 - RNA, 18 nt, Homo sapiens
cgggccuugcgcccaccu

SEQ ID NO: 11817 - RNA, 21 nt, Homo sapiens
gagccgcagagucggggaggg

SEQ ID NO: 11818 - RNA, 17 nt, Homo sapiens
gaggaggaggaacagaa

SEQ ID NO: 11819 - RNA, 21 nt, Homo sapiens
gagucggggaggguugaaagg

SEQ ID NO: 11820 - RNA, 20 nt, Homo sapiens
ggcaggcuggggagaccgcu

SEQ ID NO: 11821 - RNA, 20 nt, Homo sapiens
ggcgggcugggguggugggc

SEQ ID NO: 11822 - RNA, 21 nt, Homo sapiens
gggcuggguuggacgcagcug

SEQ ID NO: 11823 - RNA, 18 nt, Homo sapiens
ugucccugggguuuugug

SEQ ID NO: 11824 - RNA, 17 nt, Homo sapiens
uugcacgguguuucuuu

SEQ ID NO: 11825 - RNA, 17 nt, Homo sapiens
uuuucacguugcacggu

SEQ ID NO: 11826 - RNA, 18 nt, Homo sapiens
aaaucuagcucuagccau

SEQ ID NO: 11827 - RNA, 19 nt, Homo sapiens
aaauuguguauucuuuaac

SEQ ID NO: 11828 - RNA, 24 nt, Homo sapiens
acuauugguuauauauuugguuuu

SEQ ID NO: 11829 - RNA, 21 nt, Homo sapiens
agguugggaaaaggggaaggg

SEQ ID NO: 11830 - RNA, 20 nt, Homo sapiens
cccugaaagagguaccugag

SEQ ID NO: 11831 - RNA, 22 nt, Homo sapiens
cuucucuuugcuaguucacaca

SEQ ID NO: 11832 - RNA, 18 nt, Homo sapiens
gaagggaggggaaguucu

SEQ ID NO: 11833 - RNA, 22 nt, Homo sapiens
uacagguagacaacccugacag

SEQ ID NO: 11834 - RNA, 22 nt, Homo sapiens
ucagaggcuguuaaaagaggcu

SEQ ID NO: 11835 - RNA, 18 nt, Homo sapiens
ucuuugcuaguucacaca

SEQ ID NO: 11836 - RNA, 24 nt, Homo sapiens
uggaugagggaaaguaugcacagu

SEQ ID NO: 11837 - RNA, 22 nt, Homo sapiens
ugguuuucuucucuuugcuagu

SEQ ID NO: 11838 - RNA, 23 nt, Homo sapiens
uuucuuauuuucuauuuggagcc

SEQ ID NO: 11839 - RNA, 20 nt, Homo sapiens
uaaaugaacuguagccauuu

SEQ ID NO: 11840 - RNA, 16 nt, Homo sapiens
ucugugcuucguguuc

SEQ ID NO: 11841 - RNA, 23 nt, Homo sapiens
caccccgccuucgcggcccgucu

SEQ ID NO: 11842 - RNA, 19 nt, Homo sapiens
ccagucuggcuucuguagc

SEQ ID NO: 11843 - RNA, 19 nt, Homo sapiens
ccuaggcugggguugcccc

SEQ ID NO: 11844 - RNA, 17 nt, Homo sapiens
cgggacccagucuggcu

SEQ ID NO: 11845 - RNA, 18 nt, Homo sapiens
gccagcacggggggugcc

SEQ ID NO: 11846 - RNA, 21 nt, Homo sapiens
gcccucuacaaaugaagcggc

SEQ ID NO: 11847 - RNA, 19 nt, Homo sapiens
ggcgcaggcgggcgcggcc

SEQ ID NO: 11848 - RNA, 23 nt, Homo sapiens
ucgcggcccgucugggauggcac

SEQ ID NO: 11849 - RNA, 21 nt, Homo sapiens
uggcuuucugccggcagcaga

SEQ ID NO: 11850 - RNA, 18 nt, Homo sapiens
aaagccacccccaggucc

SEQ ID NO: 11851 - RNA, 18 nt, Homo sapiens
agauauuuuuccccuagc

SEQ ID NO: 11852 - RNA, 20 nt, Homo sapiens
gaaacagaaacauuucuaug

SEQ ID NO: 11853 - RNA, 19 nt, Homo sapiens
gcugcgcagcacgauggcc

SEQ ID NO: 11854 - RNA, 21 nt, Homo sapiens
ggcccacuggugucgaucugc

SEQ ID NO: 11855 - RNA, 15 nt, Homo sapiens
uccaaacacagggau

SEQ ID NO: 11856 - RNA, 25 nt, Homo sapiens
ugacauuuaggucaucacuuguucu

SEQ ID NO: 11857 - RNA, 22 nt, Homo sapiens
uguaucagugaaagaccucuug

SEQ ID NO: 11858 - RNA, 20 nt, Homo sapiens
uugaagaaggaacugaaaau

SEQ ID NO: 11859 - RNA, 16 nt, Homo sapiens
caccacgacacccccc

SEQ ID NO: 11860 - RNA, 19 nt, Homo sapiens
ccaaacucagcuugcuaca

SEQ ID NO: 11861 - RNA, 22 nt, Homo sapiens
ccgcccggccgggcugcccccg

SEQ ID NO: 11862 - RNA, 19 nt, Homo sapiens
ccuuaugcuacagacaucc

SEQ ID NO: 11863 - RNA, 22 nt, Homo sapiens
cggagcgcggccgcuguggccc

SEQ ID NO: 11864 - RNA, 19 nt, Homo sapiens
gagguguagaaaugguaug

SEQ ID NO: 11865 - RNA, 17 nt, Homo sapiens
gcccuuggcgugagcag

SEQ ID NO: 11866 - RNA, 16 nt, Homo sapiens
gccggagcgcggccgc

SEQ ID NO: 11867 - RNA, 18 nt, Homo sapiens
gggaggaggguaggaaga

SEQ ID NO: 11868 - RNA, 20 nt, Homo sapiens
gguuuuugggggaggagggu

SEQ ID NO: 11869 - RNA, 17 nt, Homo sapiens
uccaaggcagaaugugu

SEQ ID NO: 11870 - RNA, 15 nt, Homo sapiens
ucuaacccuguggcg

SEQ ID NO: 11871 - RNA, 19 nt, Homo sapiens
uuagaaaauauucuaaaau

SEQ ID NO: 11872 - RNA, 17 nt, Homo sapiens
uuucugcaguuaccaga

SEQ ID NO: 11873 - RNA, 21 nt, Homo sapiens
ggcagagggggcaggcggccg

SEQ ID NO: 11874 - RNA, 21 nt, Homo sapiens
ggccccaaagggucugaauuc

SEQ ID NO: 11875 - RNA, 18 nt, Homo sapiens
cccugccgugccaccucc

SEQ ID NO: 11876 - RNA, 20 nt, Homo sapiens
ccgccacucauagggagccc

SEQ ID NO: 11877 - RNA, 16 nt, Homo sapiens
cgccgccguacccgcc

SEQ ID NO: 11878 - RNA, 21 nt, Homo sapiens
cgggcggcgggcggcggggcg

SEQ ID NO: 11879 - RNA, 16 nt, Homo sapiens
gccucaggcgcggucc

SEQ ID NO: 11880 - RNA, 21 nt, Homo sapiens
gccucugcagggcccgaucca

SEQ ID NO: 11881 - RNA, 16 nt, Homo sapiens
gcggcgggcggcgggg

SEQ ID NO: 11882 - RNA, 17 nt, Homo sapiens
ggcggcggggcggggcg

SEQ ID NO: 11883 - RNA, 21 nt, Homo sapiens
ggcgggacgggcgggcagccg

SEQ ID NO: 11884 - RNA, 17 nt, Homo sapiens
gggcgcucagcuggggc

SEQ ID NO: 11885 - RNA, 16 nt, Homo sapiens
ggggcgcucagcgggc

SEQ ID NO: 11886 - RNA, 18 nt, Homo sapiens
ugacacuccugcuugagc

SEQ ID NO: 11887 - RNA, 16 nt, Homo sapiens
acgcguccgcccacgc

SEQ ID NO: 11888 - RNA, 18 nt, Homo sapiens
cugcucagucuuuacaca

SEQ ID NO: 11889 - RNA, 17 nt, Homo sapiens
gaaucuuuuguuuccug

SEQ ID NO: 11890 - RNA, 18 nt, Homo sapiens
uagacucgcuagagccga

SEQ ID NO: 11891 - RNA, 19 nt, Homo sapiens
ugcagucugaaaaugugcu

SEQ ID NO: 11892 - RNA, 20 nt, Homo sapiens
cagcagcagcagcagccgcu

SEQ ID NO: 11893 - RNA, 20 nt, Homo sapiens
cuagcucuggaaaaucgggg

SEQ ID NO: 11894 - RNA, 19 nt, Homo sapiens
ucaauaaugauuucuugaa

SEQ ID NO: 11895 - RNA, 20 nt, Homo sapiens
ugucauugugguggugguug

SEQ ID NO: 11896 - RNA, 18 nt, Homo sapiens
uugcauuucuucuuagcc

SEQ ID NO: 11897 - RNA, 16 nt, Homo sapiens
uugcugcuuauucuug

SEQ ID NO: 11898 - RNA, 23 nt, Homo sapiens
agagcugccaaaaccucaaggcc

SEQ ID NO: 11899 - RNA, 16 nt, Homo sapiens
cugcagccuuagcccu

SEQ ID NO: 11900 - RNA, 19 nt, Homo sapiens
uacaaguacauguccaugc

SEQ ID NO: 11901 - RNA, 22 nt, Homo sapiens
cacacagcuuagagucggauac

SEQ ID NO: 11902 - RNA, 14 nt, Homo sapiens
guugauugucacgu

SEQ ID NO: 11903 - RNA, 15 nt, Homo sapiens
ccuauuccucgccgg

SEQ ID NO: 11904 - RNA, 16 nt, Homo sapiens
uggcacugacuccggc

SEQ ID NO: 11905 - RNA, 16 nt, Homo sapiens
agcagccaccccgggc

SEQ ID NO: 11906 - RNA, 18 nt, Homo sapiens
aggaggcggcaggagaga

SEQ ID NO: 11907 - RNA, 17 nt, Homo sapiens
cucggaccuccccagcu

SEQ ID NO: 11908 - RNA, 17 nt, Homo sapiens
gcugagaggaagagagg

SEQ ID NO: 11909 - RNA, 20 nt, Homo sapiens
ggcgcuggggcucggcggcg

SEQ ID NO: 11910 - RNA, 19 nt, Homo sapiens
ggggcggcgugcgggggcg

SEQ ID NO: 11911 - RNA, 18 nt, Homo sapiens
gucuuguaaaauuuccag

SEQ ID NO: 11912 - RNA, 17 nt, Homo sapiens
uaaaaauuuagguaugu

SEQ ID NO: 11913 - RNA, 20 nt, Homo sapiens
uauggcacugucacuuaaaa

SEQ ID NO: 11914 - RNA, 21 nt, Homo sapiens
uuaaaaaugccaagauaagaa

SEQ ID NO: 11915 - RNA, 17 nt, Homo sapiens
aggaguaucugucuuca

SEQ ID NO: 11916 - RNA, 20 nt, Homo sapiens
uuacaaauaagaccagcuau

SEQ ID NO: 11917 - RNA, 17 nt, Homo sapiens
aagauguugccauuggg

SEQ ID NO: 11918 - RNA, 20 nt, Homo sapiens
gaauaacauucuugaaauga

SEQ ID NO: 11919 - RNA, 18 nt, Homo sapiens
gcgagaaucuuucuacuu

SEQ ID NO: 11920 - RNA, 25 nt, Homo sapiens
ggacacggcuggggugugggggugg

SEQ ID NO: 11921 - RNA, 17 nt, Homo sapiens
gggggaggcugggugaa

SEQ ID NO: 11922 - RNA, 17 nt, Homo sapiens
gggggggguggggggug

SEQ ID NO: 11923 - RNA, 18 nt, Homo sapiens
gggguggggggugggagg

SEQ ID NO: 11924 - RNA, 16 nt, Homo sapiens
ucccucggucacccag

SEQ ID NO: 11925 - RNA, 17 nt, Homo sapiens
uccuggggaucccugug

SEQ ID NO: 11926 - RNA, 19 nt, Homo sapiens
ucuggaacucuugaccuca

SEQ ID NO: 11927 - RNA, 18 nt, Homo sapiens
ugccauugggggaggcug

SEQ ID NO: 11928 - RNA, 18 nt, Homo sapiens
ugcuuuugagacagagcc

SEQ ID NO: 11929 - RNA, 17 nt, Homo sapiens
ugggggggggugggggg

SEQ ID NO: 11930 - RNA, 19 nt, Homo sapiens
uggugugugggggggggug

SEQ ID NO: 11931 - RNA, 15 nt, Homo sapiens
gcauguugcuauuua

SEQ ID NO: 11932 - RNA, 16 nt, Homo sapiens
uggagcucagagaagc

SEQ ID NO: 11933 - RNA, 20 nt, Homo sapiens
uuucaugaagcauguugcua

SEQ ID NO: 11934 - RNA, 21 nt, Homo sapiens
ugaggaaggacaaguuucuuc

SEQ ID NO: 11935 - RNA, 22 nt, Homo sapiens
ccuuccaugugugugauccacu

SEQ ID NO: 11936 - RNA, 18 nt, Homo sapiens
gaccuuuccauuuuauug

SEQ ID NO: 11937 - RNA, 22 nt, Homo sapiens
uggaaguuugggguggguggug

SEQ ID NO: 11938 - RNA, 25 nt, Homo sapiens
caucugaaguuugagacauccucug

SEQ ID NO: 11939 - RNA, 21 nt, Homo sapiens
gcgguggcagcggcggcggcg

SEQ ID NO: 11940 - RNA, 20 nt, Homo sapiens
uaggaaggaaagggaggagu

SEQ ID NO: 11941 - RNA, 19 nt, Homo sapiens
ugaguccugcucucuuucc

SEQ ID NO: 11942 - RNA, 18 nt, Homo sapiens
aagccgcuuugucuugca

SEQ ID NO: 11943 - RNA, 22 nt, Homo sapiens
cccaaauucauuuucucuguag

SEQ ID NO: 11944 - RNA, 16 nt, Homo sapiens
ccuggaaaagccugag

SEQ ID NO: 11945 - RNA, 18 nt, Homo sapiens
cuucuuuucgaucccccc

SEQ ID NO: 11946 - RNA, 17 nt, Homo sapiens
uccugggaggauggaga

SEQ ID NO: 11947 - RNA, 20 nt, Homo sapiens
ugauauguucgguuccuggg

SEQ ID NO: 11948 - RNA, 20 nt, Homo sapiens
aagggaagaaaacauggagg

SEQ ID NO: 11949 - RNA, 19 nt, Homo sapiens
acacaaccacucagcucgc

SEQ ID NO: 11950 - RNA, 18 nt, Homo sapiens
gcauauuuuuuugacagu

SEQ ID NO: 11951 - RNA, 24 nt, Homo sapiens
uggcuuccagaucugaaggaagcu

SEQ ID NO: 11952 - RNA, 19 nt, Homo sapiens
uuccagaucugaaggaagc

SEQ ID NO: 11953 - RNA, 23 nt, Homo sapiens
cggugauguuggccgccgcugcg

SEQ ID NO: 11954 - RNA, 23 nt, Homo sapiens
uauggcaguuacugaguuaguua

SEQ ID NO: 11955 - RNA, 17 nt, Homo sapiens
uguaaggaaauguaaca

SEQ ID NO: 11956 - RNA, 21 nt, Homo sapiens
uugcuugcuuaaaacauacuu

SEQ ID NO: 11957 - RNA, 17 nt, Homo sapiens
uugggaggccgaggugg

SEQ ID NO: 11958 - RNA, 18 nt, Homo sapiens
agcaagcaggcagguggu

SEQ ID NO: 11959 - RNA, 17 nt, Homo sapiens
agcaggcaggugguggg

SEQ ID NO: 11960 - RNA, 21 nt, Homo sapiens
aggcaggugguggggggcagg

SEQ ID NO: 11961 - RNA, 18 nt, Homo sapiens
auugaacaucugcagggg

SEQ ID NO: 11962 - RNA, 19 nt, Homo sapiens
gcauggggcaggaagacgc

SEQ ID NO: 11963 - RNA, 15 nt, Homo sapiens
gguggggggcagggg

SEQ ID NO: 11964 - RNA, 18 nt, Homo sapiens
cagggcccggcgcgcugc

SEQ ID NO: 11965 - RNA, 23 nt, Homo sapiens
ccucguguccuuugagagcgacu

SEQ ID NO: 11966 - RNA, 17 nt, Homo sapiens
cuccgcgcugcgcucgg

SEQ ID NO: 11967 - RNA, 16 nt, Homo sapiens
gccucguguccuuuga

SEQ ID NO: 11968 - RNA, 22 nt, Homo sapiens
ggccagggcccggcgcgcugcu

SEQ ID NO: 11969 - RNA, 15 nt, Homo sapiens
uacagauuuaaagcu

SEQ ID NO: 11970 - RNA, 22 nt, Homo sapiens
ucccugcauuuuuuuuuccuga

SEQ ID NO: 11971 - RNA, 21 nt, Homo sapiens
uccgcgcugcgcucggcuggg

SEQ ID NO: 11972 - RNA, 20 nt, Homo sapiens
uucccaguuggcucauggga

SEQ ID NO: 11973 - RNA, 23 nt, Homo sapiens
agcaacuggggcauguuuauuuc

SEQ ID NO: 11974 - RNA, 18 nt, Homo sapiens
aggcggugagggggcggg

SEQ ID NO: 11975 - RNA, 21 nt, Homo sapiens
ccgcggcccucgugucgcccg

SEQ ID NO: 11976 - RNA, 18 nt, Homo sapiens
ccgcucccgggccucccg

SEQ ID NO: 11977 - RNA, 17 nt, Homo sapiens
ccguggacagagcuugu

SEQ ID NO: 11978 - RNA, 17 nt, Homo sapiens
ccucggggcauggaggc

SEQ ID NO: 11979 - RNA, 16 nt, Homo sapiens
ggugugugcagggccu

SEQ ID NO: 11980 - RNA, 20 nt, Homo sapiens
agucaccauccaccagcuga

SEQ ID NO: 11981 - RNA, 17 nt, Homo sapiens
gcacuguguguagaaug

SEQ ID NO: 11982 - RNA, 19 nt, Homo sapiens
gcggccgcucgcgaucuag

SEQ ID NO: 11983 - RNA, 17 nt, Homo sapiens
gggugcggcgggcggcg

SEQ ID NO: 11984 - RNA, 17 nt, Homo sapiens
uguagaaugugcaaaaa

SEQ ID NO: 11985 - RNA, 19 nt, Homo sapiens
uuuuucucaucugauccuu

SEQ ID NO: 11986 - RNA, 17 nt, Homo sapiens
cauuuuccccuggggaa

SEQ ID NO: 11987 - RNA, 21 nt, Homo sapiens
uagaaaaauaaaaauuucuga

SEQ ID NO: 11988 - RNA, 17 nt, Homo sapiens
uuaauauaauaggccau

SEQ ID NO: 11989 - RNA, 23 nt, Homo sapiens
cgcuggaggggggcgguggcugg

SEQ ID NO: 11990 - RNA, 24 nt, Homo sapiens
cgcuggaggggggcgguggcuggg

SEQ ID NO: 11991 - RNA, 20 nt, Homo sapiens
gaggagguuucccugggcug

SEQ ID NO: 11992 - RNA, 23 nt, Homo sapiens
gaggcugcugaccuaaagcgagu

SEQ ID NO: 11993 - RNA, 22 nt, Homo sapiens
gcauaacagacgguugcaagug

SEQ ID NO: 11994 - RNA, 17 nt, Homo sapiens
ggcgcuggaggggggcg

SEQ ID NO: 11995 - RNA, 19 nt, Homo sapiens
uacccuggaauucuucccu

SEQ ID NO: 11996 - RNA, 20 nt, Homo sapiens
ugaaauuggcaccaggaaaa

SEQ ID NO: 11997 - RNA, 19 nt, Homo sapiens
ugaagguuuaagaaaaguc

SEQ ID NO: 11998 - RNA, 16 nt, Homo sapiens
ugcuguauuagcaacu

SEQ ID NO: 11999 - RNA, 16 nt, Homo sapiens
uggcccggacgugugc

SEQ ID NO: 12000 - RNA, 20 nt, Homo sapiens
uuaaacauuuuuauugugca

SEQ ID NO: 12001 - RNA, 22 nt, Homo sapiens
uucaauucauaaauuguugcug

SEQ ID NO: 12002 - RNA, 18 nt, Homo sapiens
aacacaggaaaaggagga

SEQ ID NO: 12003 - RNA, 15 nt, Homo sapiens
accauguuuucccac

SEQ ID NO: 12004 - RNA, 17 nt, Homo sapiens
aggaaguuugcugguuu

SEQ ID NO: 12005 - RNA, 19 nt, Homo sapiens
aguuuguccgagaucugcu

SEQ ID NO: 12006 - RNA, 19 nt, Homo sapiens
auuccauacuucugauccu

SEQ ID NO: 12007 - RNA, 20 nt, Homo sapiens
caaaaaugaaagugaauaua

SEQ ID NO: 12008 - RNA, 20 nt, Homo sapiens
caagauacauaaauaucugg

SEQ ID NO: 12009 - RNA, 17 nt, Homo sapiens
caaggcagaaaucugca

SEQ ID NO: 12010 - RNA, 18 nt, Homo sapiens
caccacgcugcgaaaccc

SEQ ID NO: 12011 - RNA, 20 nt, Homo sapiens
caccagcuugacaguucccc

SEQ ID NO: 12012 - RNA, 22 nt, Homo sapiens
cagcgccgccuuggcugugggu

SEQ ID NO: 12013 - RNA, 18 nt, Homo sapiens
cauaaacaggagaaaggc

SEQ ID NO: 12014 - RNA, 19 nt, Homo sapiens
caugugucaaaaucagcag

SEQ ID NO: 12015 - RNA, 19 nt, Homo sapiens
cccagggcccgggaucccg

SEQ ID NO: 12016 - RNA, 18 nt, Homo sapiens
cccggaggcgaaggcggc

SEQ ID NO: 12017 - RNA, 20 nt, Homo sapiens
ccuacaucucucuuucuucu

SEQ ID NO: 12018 - RNA, 21 nt, Homo sapiens
ccucgaggugcgucgccucgg

SEQ ID NO: 12019 - RNA, 18 nt, Homo sapiens
ccuuggagugacccucag

SEQ ID NO: 12020 - RNA, 19 nt, Homo sapiens
gaauacaguaguuaaaaau

SEQ ID NO: 12021 - RNA, 16 nt, Homo sapiens
gaccuacagcgagauc

SEQ ID NO: 12022 - RNA, 19 nt, Homo sapiens
gagauccuggccgucgggc

SEQ ID NO: 12023 - RNA, 22 nt, Homo sapiens
gcguccccugggugcuggggcc

SEQ ID NO: 12024 - RNA, 23 nt, Homo sapiens
gcuauuagcuguuuacaaaagug

SEQ ID NO: 12025 - RNA, 14 nt, Homo sapiens
ggagauauuggggg

SEQ ID NO: 12026 - RNA, 15 nt, Homo sapiens
ggcugcgcgggccug

SEQ ID NO: 12027 - RNA, 20 nt, Homo sapiens
gugggggcuggcuuaaauag

SEQ ID NO: 12028 - RNA, 19 nt, Homo sapiens
ucaacgaauuuuaagaggu

SEQ ID NO: 12029 - RNA, 18 nt, Homo sapiens
ucugggauauucucucau

SEQ ID NO: 12030 - RNA, 21 nt, Homo sapiens
ucugguggcccuuaaauugcu

SEQ ID NO: 12031 - RNA, 17 nt, Homo sapiens
uggaacuagauugaccu

SEQ ID NO: 12032 - RNA, 19 nt, Homo sapiens
ugguuggcaaugucucugu

SEQ ID NO: 12033 - RNA, 23 nt, Homo sapiens
ugugauucguccugccugcugac

SEQ ID NO: 12034 - RNA, 23 nt, Homo sapiens
uuacauuugcugacauuuuaugg

SEQ ID NO: 12035 - RNA, 19 nt, Homo sapiens
uuuugcacauucauuuccc

SEQ ID NO: 12036 - RNA, 15 nt, Homo sapiens
acugccuaagguuga

SEQ ID NO: 12037 - RNA, 17 nt, Homo sapiens
aguaguacauuagugag

SEQ ID NO: 12038 - RNA, 20 nt, Homo sapiens
ggggcgcgcggaacaccugc

SEQ ID NO: 12039 - RNA, 22 nt, Homo sapiens
uauuuucaucaauuacaauuuu

SEQ ID NO: 12040 - RNA, 24 nt, Homo sapiens
aagaggcagaacagagccuccagu

SEQ ID NO: 12041 - RNA, 16 nt, Homo sapiens
acccgcauggaguuua

SEQ ID NO: 12042 - RNA, 25 nt, Homo sapiens
agggaggcgaggauugggugguggg

SEQ ID NO: 12043 - RNA, 17 nt, Homo sapiens
aggggaaaaacuucaag

SEQ ID NO: 12044 - RNA, 18 nt, Homo sapiens
aggggaaagacggagggg

SEQ ID NO: 12045 - RNA, 23 nt, Homo sapiens
aggggaggaguauucagcaugac

SEQ ID NO: 12046 - RNA, 16 nt, Homo sapiens
auuggguggugggcga

SEQ ID NO: 12047 - RNA, 15 nt, Homo sapiens
gagaccgcccugccu

SEQ ID NO: 12048 - RNA, 21 nt, Homo sapiens
gcugcuugcugcagguucauc

SEQ ID NO: 12049 - RNA, 18 nt, Homo sapiens
uaccaaagaacgccagau

SEQ ID NO: 12050 - RNA, 18 nt, Homo sapiens
uagaaaaagaccaggaua

SEQ ID NO: 12051 - RNA, 17 nt, Homo sapiens
uagaaggacccaggggc

SEQ ID NO: 12052 - RNA, 18 nt, Homo sapiens
ugcugagcaaagcuggcu

SEQ ID NO: 12053 - RNA, 21 nt, Homo sapiens
uggaaaguuacagacuguaaa

SEQ ID NO: 12054 - RNA, 15 nt, Homo sapiens
uggccaaaagagggg

SEQ ID NO: 12055 - RNA, 20 nt, Homo sapiens
uguauaaaauaauucuucaa

SEQ ID NO: 12056 - RNA, 18 nt, Homo sapiens
uugcaccucgguuucucu

SEQ ID NO: 12057 - RNA, 17 nt, Homo sapiens
uuguacuccuuccccau

SEQ ID NO: 12058 - RNA, 21 nt, Homo sapiens
aggcagggcgggagugcgggc

SEQ ID NO: 12059 - RNA, 19 nt, Homo sapiens
ccuucaggcuuagaugugg

SEQ ID NO: 12060 - RNA, 16 nt, Homo sapiens
gcccgcgcgcgcgcgc

SEQ ID NO: 12061 - RNA, 22 nt, Homo sapiens
gcgcggggcgcgggucuggcgc

SEQ ID NO: 12062 - RNA, 18 nt, Homo sapiens
gcggggcgcgggucuggc

SEQ ID NO: 12063 - RNA, 18 nt, Homo sapiens
ggagagcgcggggcgcgg

SEQ ID NO: 12064 - RNA, 14 nt, Homo sapiens
ggugggggggggcg

SEQ ID NO: 12065 - RNA, 22 nt, Homo sapiens
uaucaugcauuaaauuuuagag

SEQ ID NO: 12066 - RNA, 16 nt, Homo sapiens
uguggugugguuccug

SEQ ID NO: 12067 - RNA, 17 nt, Homo sapiens
uuaggaaagaccugugu

SEQ ID NO: 12068 - RNA, 18 nt, Homo sapiens
acccaggucacacgugcc

SEQ ID NO: 12069 - RNA, 19 nt, Homo sapiens
agaguaaacagaaguggau

SEQ ID NO: 12070 - RNA, 17 nt, Homo sapiens
auccgggaggcggaggu

SEQ ID NO: 12071 - RNA, 19 nt, Homo sapiens
cacauacgaacgccucugg

SEQ ID NO: 12072 - RNA, 20 nt, Homo sapiens
cccuuuccaugcaggagcag

SEQ ID NO: 12073 - RNA, 15 nt, Homo sapiens
cgucgcugccgccgg

SEQ ID NO: 12074 - RNA, 15 nt, Homo sapiens
gagacacggaaggga

SEQ ID NO: 12075 - RNA, 17 nt, Homo sapiens
gccucccucccacgggc

SEQ ID NO: 12076 - RNA, 19 nt, Homo sapiens
gcggaucacuugaggucau

SEQ ID NO: 12077 - RNA, 18 nt, Homo sapiens
ucccggcacggggcucug

SEQ ID NO: 12078 - RNA, 23 nt, Homo sapiens
ugccuguaaucccagcacuuugg

SEQ ID NO: 12079 - RNA, 17 nt, Homo sapiens
uggaugaggggacagug

SEQ ID NO: 12080 - RNA, 18 nt, Homo sapiens
uggcaaggcaguccucgc

SEQ ID NO: 12081 - RNA, 19 nt, Homo sapiens
ugggacagagcucuaaaac

SEQ ID NO: 12082 - RNA, 19 nt, Homo sapiens
uucuuucuuacauuugcag

SEQ ID NO: 12083 - RNA, 18 nt, Homo sapiens
aauguguguaaaaucagg

SEQ ID NO: 12084 - RNA, 18 nt, Homo sapiens
uggcagagcugguauuug

SEQ ID NO: 12085 - RNA, 18 nt, Homo sapiens
ugugauggagcucucuga

SEQ ID NO: 12086 - RNA, 23 nt, Homo sapiens
aagugcauguuugggacagcagu

SEQ ID NO: 12087 - RNA, 20 nt, Homo sapiens
agugcauguuugggacagca

SEQ ID NO: 12088 - RNA, 19 nt, Homo sapiens
agugguucuuauuuccuua

SEQ ID NO: 12089 - RNA, 20 nt, Homo sapiens
aguugagcagaggccagggc

SEQ ID NO: 12090 - RNA, 23 nt, Homo sapiens
ccugagcugggagacaagguccc

SEQ ID NO: 12091 - RNA, 20 nt, Homo sapiens
gagggauucauuuuccaggg

SEQ ID NO: 12092 - RNA, 18 nt, Homo sapiens
ucagagauucaagagggc

SEQ ID NO: 12093 - RNA, 22 nt, Homo sapiens
ucucugggcuuuagccuccccc

SEQ ID NO: 12094 - RNA, 23 nt, Homo sapiens
ugagugguucuuauuuccuuauc

SEQ ID NO: 12095 - RNA, 20 nt, Homo sapiens
agggcuaacuuagccugggc

SEQ ID NO: 12096 - RNA, 18 nt, Homo sapiens
cauugcaggauuucugcu

SEQ ID NO: 12097 - RNA, 18 nt, Homo sapiens
ggacuggcgggaccuggc

SEQ ID NO: 12098 - RNA, 19 nt, Homo sapiens
uacaaaugucaauauugaa

SEQ ID NO: 12099 - RNA, 19 nt, Homo sapiens
cagcagcuccggguggaga

SEQ ID NO: 12100 - RNA, 18 nt, Homo sapiens
gugugugugugugugugu

SEQ ID NO: 12101 - RNA, 19 nt, Homo sapiens
ugcgugugugugugugugu

SEQ ID NO: 12102 - RNA, 20 nt, Homo sapiens
ugggcuuucccucagaggca

SEQ ID NO: 12103 - RNA, 21 nt, Homo sapiens
ugugcgugugugugugugugu

SEQ ID NO: 12104 - RNA, 21 nt, Homo sapiens
ugugugugcgugugugugugu

SEQ ID NO: 12105 - RNA, 19 nt, Homo sapiens
ugugugugugcgugugugu

SEQ ID NO: 12106 - RNA, 23 nt, Homo sapiens
uucguuucuguccuuuucugggc

SEQ ID NO: 12107 - RNA, 19 nt, Homo sapiens
acgcgcucuucccgccccc

SEQ ID NO: 12108 - RNA, 22 nt, Homo sapiens
acgcgcucuucccgcccccucc

SEQ ID NO: 12109 - RNA, 20 nt, Homo sapiens
agaggaggggguaggggaag

SEQ ID NO: 12110 - RNA, 20 nt, Homo sapiens
aggaggggguaggggaaggg

SEQ ID NO: 12111 - RNA, 18 nt, Homo sapiens
agugggggcagggguggg

SEQ ID NO: 12112 - RNA, 18 nt, Homo sapiens
caagaacagccucugagg

SEQ ID NO: 12113 - RNA, 19 nt, Homo sapiens
cccgcccccuccgcccggg

SEQ ID NO: 12114 - RNA, 16 nt, Homo sapiens
ccucugaggugugugc

SEQ ID NO: 12115 - RNA, 21 nt, Homo sapiens
cucaagguguagggccccaag

SEQ ID NO: 12116 - RNA, 19 nt, Homo sapiens
cuggucccaugguccugcc

SEQ ID NO: 12117 - RNA, 22 nt, Homo sapiens
gcccuggccuccaccguuuucc

SEQ ID NO: 12118 - RNA, 21 nt, Homo sapiens
gcuuucccccgucacacguuu

SEQ ID NO: 12119 - RNA, 19 nt, Homo sapiens
ggaagugggggcaggggug

SEQ ID NO: 12120 - RNA, 18 nt, Homo sapiens
ggggagggggagguggga

SEQ ID NO: 12121 - RNA, 27 nt, Homo sapiens
ggugcagcugcaugugcgcacgugugc

SEQ ID NO: 12122 - RNA, 18 nt, Homo sapiens
ugagcuauagcccuggcc

SEQ ID NO: 12123 - RNA, 17 nt, Homo sapiens
ugcggcagagaggaggg

SEQ ID NO: 12124 - RNA, 18 nt, Homo sapiens
uuccuguauugcggcaga

SEQ ID NO: 12125 - RNA, 17 nt, Homo sapiens
caaggaaaacuuccccu

SEQ ID NO: 12126 - RNA, 19 nt, Homo sapiens
uaauaggagaaaaggcaua

SEQ ID NO: 12127 - RNA, 18 nt, Homo sapiens
uaggagaaaaggcauaca

SEQ ID NO: 12128 - RNA, 19 nt, Homo sapiens
ucacacucgucaagacugg

SEQ ID NO: 12129 - RNA, 21 nt, Homo sapiens
cagccgccgccgccguuacag

SEQ ID NO: 12130 - RNA, 21 nt, Homo sapiens
aagaucuucuggccuugaagu

SEQ ID NO: 12131 - RNA, 20 nt, Homo sapiens
augacagccaaaacuaaugc

SEQ ID NO: 12132 - RNA, 18 nt, Homo sapiens
cucccgccgcggcuccgg

SEQ ID NO: 12133 - RNA, 20 nt, Homo sapiens
cugcgccccccggccccucg

SEQ ID NO: 12134 - RNA, 17 nt, Homo sapiens
ggggcucucuagcugcg

SEQ ID NO: 12135 - RNA, 21 nt, Homo sapiens
uggcugcgcguuccucucccg

SEQ ID NO: 12136 - RNA, 17 nt, Homo sapiens
aaaaacagcuuauaauu

SEQ ID NO: 12137 - RNA, 19 nt, Homo sapiens
cuuugcuggagcucuuguu

SEQ ID NO: 12138 - RNA, 15 nt, Homo sapiens
uacacgaucauccca

SEQ ID NO: 12139 - RNA, 24 nt, Homo sapiens
ugauuuaggaaagucacaaaccua

SEQ ID NO: 12140 - RNA, 21 nt, Homo sapiens
uggcaaauuucucuaaaaaga

SEQ ID NO: 12141 - RNA, 25 nt, Homo sapiens
uaccaugggaaguucuuggggggag

SEQ ID NO: 12142 - RNA, 14 nt, Homo sapiens
ugccuggcuggcuc

SEQ ID NO: 12143 - RNA, 21 nt, Homo sapiens
aaacaggagcuccggccagcc

SEQ ID NO: 12144 - RNA, 21 nt, Homo sapiens
cagucccuguaggcuggggcc

SEQ ID NO: 12145 - RNA, 21 nt, Homo sapiens
uccggccagccuggcuggggc

SEQ ID NO: 12146 - RNA, 18 nt, Homo sapiens
ccccgccccgccgacacc

SEQ ID NO: 12147 - RNA, 20 nt, Homo sapiens
ccccuccgucuccucucccc

SEQ ID NO: 12148 - RNA, 20 nt, Homo sapiens
cugcaggaaagaggguaaag

SEQ ID NO: 12149 - RNA, 20 nt, Homo sapiens
gaggccagcgggcgggcggg

SEQ ID NO: 12150 - RNA, 24 nt, Homo sapiens
ucggccgcgcgccaccggcgcccg

SEQ ID NO: 12151 - RNA, 18 nt, Homo sapiens
ugcccugggcuccaaccu

SEQ ID NO: 12152 - RNA, 19 nt, Homo sapiens
uggagggaagcuugggcug

SEQ ID NO: 12153 - RNA, 22 nt, Homo sapiens
uguggcucagagcagcuugaca

SEQ ID NO: 12154 - RNA, 17 nt, Homo sapiens
aaagaaguuagaaauua

SEQ ID NO: 12155 - RNA, 15 nt, Homo sapiens
acagagucauccaca

SEQ ID NO: 12156 - RNA, 20 nt, Homo sapiens
caaaacagaaauaaggggau

SEQ ID NO: 12157 - RNA, 20 nt, Homo sapiens
cguccuagaaaagaggaggg

SEQ ID NO: 12158 - RNA, 20 nt, Homo sapiens
gggagggggaaggggggggc

SEQ ID NO: 12159 - RNA, 21 nt, Homo sapiens
ggggaaggggggggccauacc

SEQ ID NO: 12160 - RNA, 21 nt, Homo sapiens
uacuggaucuacucaagggug

SEQ ID NO: 12161 - RNA, 20 nt, Homo sapiens
ucuucagcugcauucuagga

SEQ ID NO: 12162 - RNA, 16 nt, Homo sapiens
ugagcugcaaaucuau

SEQ ID NO: 12163 - RNA, 20 nt, Homo sapiens
ugucccagauuacucuccag

SEQ ID NO: 12164 - RNA, 19 nt, Homo sapiens
uucauuuggugcauuucaa

SEQ ID NO: 12165 - RNA, 20 nt, Homo sapiens
agcaagcacugugcuaguag

SEQ ID NO: 12166 - RNA, 25 nt, Homo sapiens
ccccacccccuucuugaccguuugg

SEQ ID NO: 12167 - RNA, 14 nt, Homo sapiens
cccuuccccucccc

SEQ ID NO: 12168 - RNA, 23 nt, Homo sapiens
cccuuucuuuccuuuccuuuuuu

SEQ ID NO: 12169 - RNA, 19 nt, Homo sapiens
cggcggcggcggcggcgga

SEQ ID NO: 12170 - RNA, 22 nt, Homo sapiens
aggcuucuggaaacuuggccuc

SEQ ID NO: 12171 - RNA, 19 nt, Homo sapiens
caccaggaggccuaagaag

SEQ ID NO: 12172 - RNA, 19 nt, Homo sapiens
gaaugggaggcauuggggu

SEQ ID NO: 12173 - RNA, 20 nt, Homo sapiens
ccucugcucaguccugcucc

SEQ ID NO: 12174 - RNA, 18 nt, Homo sapiens
cgcugugggggugggugc

SEQ ID NO: 12175 - RNA, 20 nt, Homo sapiens
cggugcugggcagcggccgg

SEQ ID NO: 12176 - RNA, 17 nt, Homo sapiens
gcagggcgcuguggggg

SEQ ID NO: 12177 - RNA, 23 nt, Homo sapiens
gcgcggugcugggcagcggccgg

SEQ ID NO: 12178 - RNA, 20 nt, Homo sapiens
gggcagcggccgggugcagg

SEQ ID NO: 12179 - RNA, 21 nt, Homo sapiens
ggugcagggcgcugugggggu

SEQ ID NO: 12180 - RNA, 20 nt, Homo sapiens
ggugcugggcagcggccggg

SEQ ID NO: 12181 - RNA, 19 nt, Homo sapiens
gugggggugggugcucaug

SEQ ID NO: 12182 - RNA, 21 nt, Homo sapiens
ugggggugggugcucaugcua

SEQ ID NO: 12183 - RNA, 22 nt, Homo sapiens
caagucaagcuguccaggccuu

SEQ ID NO: 12184 - RNA, 22 nt, Homo sapiens
cauuucccugaaugugguucag

SEQ ID NO: 12185 - RNA, 19 nt, Homo sapiens
cccuugcagugugaggggc

SEQ ID NO: 12186 - RNA, 23 nt, Homo sapiens
gagguguaaagacacauggcucg

SEQ ID NO: 12187 - RNA, 18 nt, Homo sapiens
gccuguggggcugaggga

SEQ ID NO: 12188 - RNA, 22 nt, Homo sapiens
ggaaugggcugcagagaauccu

SEQ ID NO: 12189 - RNA, 17 nt, Homo sapiens
gggcugcaggggguuug

SEQ ID NO: 12190 - RNA, 19 nt, Homo sapiens
ggggguggguguggaggug

SEQ ID NO: 12191 - RNA, 19 nt, Homo sapiens
gguggguguggagguggcc

SEQ ID NO: 12192 - RNA, 19 nt, Homo sapiens
gucacuccugaucuccacu

SEQ ID NO: 12193 - RNA, 19 nt, Homo sapiens
guuuggguccccaggccca

SEQ ID NO: 12194 - RNA, 22 nt, Homo sapiens
ugcagugugaggggcuuugccc

SEQ ID NO: 12195 - RNA, 20 nt, Homo sapiens
ugccauuuuuggaggcugug

SEQ ID NO: 12196 - RNA, 18 nt, Homo sapiens
gacuggugcuaaacuugc

SEQ ID NO: 12197 - RNA, 18 nt, Homo sapiens
ugcgcuggcgaaugucaa

SEQ ID NO: 12198 - RNA, 20 nt, Homo sapiens
uuguggggcccugcgcuggc

SEQ ID NO: 12199 - RNA, 17 nt, Homo sapiens
acauuguggcagcagga

SEQ ID NO: 12200 - RNA, 21 nt, Homo sapiens
ccagcgagucgggucagcccg

SEQ ID NO: 12201 - RNA, 21 nt, Homo sapiens
ccagugguuuuguuuuacuug

SEQ ID NO: 12202 - RNA, 21 nt, Homo sapiens
cuagaaggugaguguuuaagg

SEQ ID NO: 12203 - RNA, 16 nt, Homo sapiens
gagguggacgucagag

SEQ ID NO: 12204 - RNA, 16 nt, Homo sapiens
gcccuggagcgggggc

SEQ ID NO: 12205 - RNA, 21 nt, Homo sapiens
uacaaaaccccaaggugcaca

SEQ ID NO: 12206 - RNA, 21 nt, Homo sapiens
ugccuguagaagggacaaaca

SEQ ID NO: 12207 - RNA, 21 nt, Homo sapiens
uuggccaacuugaaacaaugu

SEQ ID NO: 12208 - RNA, 17 nt, Homo sapiens
aaagcuaccuuaaagcc

SEQ ID NO: 12209 - RNA, 18 nt, Homo sapiens
uaaguuuucccuaaugca

SEQ ID NO: 12210 - RNA, 18 nt, Homo sapiens
uacauauuuuacaugugu

SEQ ID NO: 12211 - RNA, 19 nt, Homo sapiens
uuuuccauuauuugccuuu

SEQ ID NO: 12212 - RNA, 19 nt, Homo sapiens
uuuuuggcuauuucccuca

SEQ ID NO: 12213 - RNA, 16 nt, Homo sapiens
cggcuccccagcccga

SEQ ID NO: 12214 - RNA, 17 nt, Homo sapiens
agcugggggcgagggag

SEQ ID NO: 12215 - RNA, 22 nt, Homo sapiens
cugcgcgcgcgucucacugcug

SEQ ID NO: 12216 - RNA, 22 nt, Homo sapiens
ugagcgagccaaggagcugggg

SEQ ID NO: 12217 - RNA, 17 nt, Homo sapiens
ggaggaggagguggggc

SEQ ID NO: 12218 - RNA, 17 nt, Homo sapiens
uugaaaagagaagaaaa

SEQ ID NO: 12219 - RNA, 22 nt, Homo sapiens
cacucuuguggccucuugauac

SEQ ID NO: 12220 - RNA, 18 nt, Homo sapiens
gaggggagccccuggggu

SEQ ID NO: 12221 - RNA, 20 nt, Homo sapiens
acccguugcagggacggggg

SEQ ID NO: 12222 - RNA, 21 nt, Homo sapiens
ccccuguggagggcauggaac

SEQ ID NO: 12223 - RNA, 18 nt, Homo sapiens
ccccuuggugauugugaa

SEQ ID NO: 12224 - RNA, 20 nt, Homo sapiens
ccugucuuggggccgguagc

SEQ ID NO: 12225 - RNA, 15 nt, Homo sapiens
cuucauggagcugcu

SEQ ID NO: 12226 - RNA, 18 nt, Homo sapiens
gaggggagccccuggggu

SEQ ID NO: 12227 - RNA, 24 nt, Homo sapiens
ggagggcauggaacuggccuccug

SEQ ID NO: 12228 - RNA, 18 nt, Homo sapiens
ggagugggguggcaaagg

SEQ ID NO: 12229 - RNA, 18 nt, Homo sapiens
uccaccacagucuucuuc

SEQ ID NO: 12230 - RNA, 18 nt, Homo sapiens
ucgggggagaugggagug

SEQ ID NO: 12231 - RNA, 19 nt, Homo sapiens
ccugcucgggcugccgggu

SEQ ID NO: 12232 - RNA, 23 nt, Homo sapiens
uccugcucgggcugccggguccg

SEQ ID NO: 12233 - RNA, 21 nt, Homo sapiens
ucugaaaauuauuuucaggcc

SEQ ID NO: 12234 - RNA, 21 nt, Homo sapiens
ccggaauaccaggccgcggcc

SEQ ID NO: 12235 - RNA, 20 nt, Homo sapiens
uacauauauacauacauaua

SEQ ID NO: 12236 - RNA, 19 nt, Homo sapiens
uaccaggccgcggccaagc

SEQ ID NO: 12237 - RNA, 18 nt, Homo sapiens
ucucaggcgacugccgcg

SEQ ID NO: 12238 - RNA, 18 nt, Homo sapiens
ugaauugaaauuaagcug

SEQ ID NO: 12239 - RNA, 23 nt, Homo sapiens
gcugagaaaagaggugaagaauu

SEQ ID NO: 12240 - RNA, 18 nt, Homo sapiens
uaagcuucugagauugcu

SEQ ID NO: 12241 - RNA, 19 nt, Homo sapiens
cugagacaaacauuuuucc

SEQ ID NO: 12242 - RNA, 18 nt, Homo sapiens
gguauauaaauggugucu

SEQ ID NO: 12243 - RNA, 24 nt, Homo sapiens
gugauuaugcuguaauaaaaucug

SEQ ID NO: 12244 - RNA, 17 nt, Homo sapiens
cccgccgcacccacacc

SEQ ID NO: 12245 - RNA, 18 nt, Homo sapiens
ggagguaccugcgaggca

SEQ ID NO: 12246 - RNA, 18 nt, Homo sapiens
ggcgcucgccgccgcccg

SEQ ID NO: 12247 - RNA, 20 nt, Homo sapiens
uauaaaacauuccuucaucu

SEQ ID NO: 12248 - RNA, 17 nt, Homo sapiens
uggggcgugcugggggc

SEQ ID NO: 12249 - RNA, 18 nt, Homo sapiens
uggggugcccgauggggc

SEQ ID NO: 12250 - RNA, 15 nt, Homo sapiens
uuuauccauuugugu

SEQ ID NO: 12251 - RNA, 15 nt, Homo sapiens
cgggugugggccggg

SEQ ID NO: 12252 - RNA, 19 nt, Homo sapiens
gcggccgggcgggggcggg

SEQ ID NO: 12253 - RNA, 21 nt, Homo sapiens
gcggccgggcgggggcggggg

SEQ ID NO: 12254 - RNA, 21 nt, Homo sapiens
ggcggcggcgggcgggcggcc

SEQ ID NO: 12255 - RNA, 19 nt, Homo sapiens
ggcggcgggcgggcggccg

SEQ ID NO: 12256 - RNA, 20 nt, Homo sapiens
ggcgggcggccgggcggggg

SEQ ID NO: 12257 - RNA, 16 nt, Homo sapiens
uaggaagcagcagggc

SEQ ID NO: 12258 - RNA, 18 nt, Homo sapiens
uaguuuauuucagcauca

SEQ ID NO: 12259 - RNA, 22 nt, Homo sapiens
agugagggagcaggacucuggu

SEQ ID NO: 12260 - RNA, 18 nt, Homo sapiens
gcggggcgaggagugagg

SEQ ID NO: 12261 - RNA, 17 nt, Homo sapiens
ggaaaagaagaggaccc

SEQ ID NO: 12262 - RNA, 18 nt, Homo sapiens
gggcgaggagugagggag

SEQ ID NO: 12263 - RNA, 22 nt, Homo sapiens
ggggcggggcgaggagugaggg

SEQ ID NO: 12264 - RNA, 17 nt, Homo sapiens
gggggcggggcgaggag

SEQ ID NO: 12265 - RNA, 19 nt, Homo sapiens
ccugguuccuccccaaccc

SEQ ID NO: 12266 - RNA, 17 nt, Homo sapiens
ucacuuggcuugugacu

SEQ ID NO: 12267 - RNA, 18 nt, Homo sapiens
uggccugcuggcuaugcu

SEQ ID NO: 12268 - RNA, 22 nt, Homo sapiens
aagugguaggcaagaagcagga

SEQ ID NO: 12269 - RNA, 16 nt, Homo sapiens
ccuuggcaacaugaag

SEQ ID NO: 12270 - RNA, 25 nt, Homo sapiens
augagccuuuguuguggugcaugug

SEQ ID NO: 12271 - RNA, 19 nt, Homo sapiens
cucaguaaaaucacaguac

SEQ ID NO: 12272 - RNA, 15 nt, Homo sapiens
gagagagagagagag

SEQ ID NO: 12273 - RNA, 19 nt, Homo sapiens
uuaaaaccaagcuucauug

SEQ ID NO: 12274 - RNA, 18 nt, Homo sapiens
uuguuguggugcaugugu

SEQ ID NO: 12275 - RNA, 21 nt, Homo sapiens
aaggaguaaaaguuucuugag

SEQ ID NO: 12276 - RNA, 21 nt, Homo sapiens
aggcagggaggugugcgcggg

SEQ ID NO: 12277 - RNA, 17 nt, Homo sapiens
caaauacaaagaugccc

SEQ ID NO: 12278 - RNA, 20 nt, Homo sapiens
cacgcugccacgugacgccc

SEQ ID NO: 12279 - RNA, 17 nt, Homo sapiens
ccccugauguugguuca

SEQ ID NO: 12280 - RNA, 19 nt, Homo sapiens
cccgcggccgcccaccugg

SEQ ID NO: 12281 - RNA, 18 nt, Homo sapiens
ccucgcgcuggccgcccc

SEQ ID NO: 12282 - RNA, 18 nt, Homo sapiens
ccugcuccuuuggguuga

SEQ ID NO: 12283 - RNA, 19 nt, Homo sapiens
gauaauaugaauuucguuc

SEQ ID NO: 12284 - RNA, 19 nt, Homo sapiens
gcccagugcccaaauuggc

SEQ ID NO: 12285 - RNA, 16 nt, Homo sapiens
gcccucggggcgaggc

SEQ ID NO: 12286 - RNA, 21 nt, Homo sapiens
gccgcaucgcgcccgcggccg

SEQ ID NO: 12287 - RNA, 22 nt, Homo sapiens
gcuggguuuucuguuauuugca

SEQ ID NO: 12288 - RNA, 19 nt, Homo sapiens
ggcacuuagugaaaaggaa

SEQ ID NO: 12289 - RNA, 22 nt, Homo sapiens
ggggggaagacccuggaagucc

SEQ ID NO: 12290 - RNA, 18 nt, Homo sapiens
uaugcuccaauaguucau

SEQ ID NO: 12291 - RNA, 22 nt, Homo sapiens
ucaaaauaaggaugugucccuu

SEQ ID NO: 12292 - RNA, 22 nt, Homo sapiens
ugaaaaagaaauagcaacggga

SEQ ID NO: 12293 - RNA, 15 nt, Homo sapiens
uggcaggcugggggc

SEQ ID NO: 12294 - RNA, 19 nt, Homo sapiens
ccuggaggcuggggccugg

SEQ ID NO: 12295 - RNA, 18 nt, Homo sapiens
aggagguggccagcccgg

SEQ ID NO: 12296 - RNA, 28 nt, Homo sapiens
gccagcccgggagaugcgcugguggccc

SEQ ID NO: 12297 - RNA, 20 nt, Homo sapiens
ccuccccuuccucuuccucc

SEQ ID NO: 12298 - RNA, 22 nt, Homo sapiens
ugaggcuacucuugggaagcuu

SEQ ID NO: 12299 - RNA, 20 nt, Homo sapiens
cccagagaggcugccugagc

SEQ ID NO: 12300 - RNA, 16 nt, Homo sapiens
ccucgggccacccggg

SEQ ID NO: 12301 - RNA, 18 nt, Homo sapiens
cgccgcgccggcuggagc

SEQ ID NO: 12302 - RNA, 18 nt, Homo sapiens
gcgccggcuggagccgcc

SEQ ID NO: 12303 - RNA, 23 nt, Homo sapiens
ggcuggggggcggcaggcccggg

SEQ ID NO: 12304 - RNA, 16 nt, Homo sapiens
ugcuggggggaggggg

SEQ ID NO: 12305 - RNA, 17 nt, Homo sapiens
ccugcgcccggcaccug

SEQ ID NO: 12306 - RNA, 17 nt, Homo sapiens
gguuggaagauauggcu

SEQ ID NO: 12307 - RNA, 19 nt, Homo sapiens
uaaauuacuaauauauaua

SEQ ID NO: 12308 - RNA, 18 nt, Homo sapiens
ucacacaucagugcauug

SEQ ID NO: 12309 - RNA, 25 nt, Homo sapiens
uccugcgguccaugcgaugcccugc

SEQ ID NO: 12310 - RNA, 17 nt, Homo sapiens
ugcuguuaacaaaaaga

SEQ ID NO: 12311 - RNA, 15 nt, Homo sapiens
uuucuccuucagcaa

SEQ ID NO: 12312 - RNA, 22 nt, Homo sapiens
agggacaacguggggcaguggg

SEQ ID NO: 12313 - RNA, 17 nt, Homo sapiens
ccuuucgguccucggcc

SEQ ID NO: 12314 - RNA, 15 nt, Homo sapiens
cggcuucagggcugc

SEQ ID NO: 12315 - RNA, 21 nt, Homo sapiens
gaguugaacaaugugaguugu

SEQ ID NO: 12316 - RNA, 18 nt, Homo sapiens
gaugcaaauuccuuuggu

SEQ ID NO: 12317 - RNA, 19 nt, Homo sapiens
gcacaccggcagggcggcc

SEQ ID NO: 12318 - RNA, 19 nt, Homo sapiens
gcggagcgcggagcccugg

SEQ ID NO: 12319 - RNA, 18 nt, Homo sapiens
ggagaacauggagcuggc

SEQ ID NO: 12320 - RNA, 17 nt, Homo sapiens
uaagugcugcugcugga

SEQ ID NO: 12321 - RNA, 18 nt, Homo sapiens
uaagugcugcugcuggau

SEQ ID NO: 12322 - RNA, 18 nt, Homo sapiens
ucccaccccgagaaggga

SEQ ID NO: 12323 - RNA, 19 nt, Homo sapiens
ugaugggggccagggcugc

SEQ ID NO: 12324 - RNA, 17 nt, Homo sapiens
ugucccggcgcacugca

SEQ ID NO: 12325 - RNA, 15 nt, Homo sapiens
ggugacuguugugag

SEQ ID NO: 12326 - RNA, 23 nt, Homo sapiens
aaguaacuguuaggugaggauug

SEQ ID NO: 12327 - RNA, 22 nt, Homo sapiens
aggcagcagcguuguguccugg

SEQ ID NO: 12328 - RNA, 24 nt, Homo sapiens
cucagggcugagccccggaggacc

SEQ ID NO: 12329 - RNA, 23 nt, Homo sapiens
gaggacccugcacaaagcaggca

SEQ ID NO: 12330 - RNA, 25 nt, Homo sapiens
ggaggacaggguuuggccucgcuga

SEQ ID NO: 12331 - RNA, 20 nt, Homo sapiens
guggggaacccaggugaggc

SEQ ID NO: 12332 - RNA, 24 nt, Homo sapiens
uagcaccguuaaucucgagggucu

SEQ ID NO: 12333 - RNA, 21 nt, Homo sapiens
aggaggcgugggggcagugag

SEQ ID NO: 12334 - RNA, 15 nt, Homo sapiens
augcugcucugccuu

SEQ ID NO: 12335 - RNA, 24 nt, Homo sapiens
cccggcucugcagccugguucccc

SEQ ID NO: 12336 - RNA, 23 nt, Homo sapiens
agcagcagucaccuaguaggucc

SEQ ID NO: 12337 - RNA, 21 nt, Homo sapiens
cacccaucagugcucuaccuc

SEQ ID NO: 12338 - RNA, 20 nt, Homo sapiens
gcagggcccgggccucccga

SEQ ID NO: 12339 - RNA, 18 nt, Homo sapiens
gcauagaccucaguauug

SEQ ID NO: 12340 - RNA, 18 nt, Homo sapiens
gggaggcagggaaggaag

SEQ ID NO: 12341 - RNA, 20 nt, Homo sapiens
ugcucuaccuccccuucccc

SEQ ID NO: 12342 - RNA, 16 nt, Homo sapiens
augcugggcuuacagg

SEQ ID NO: 12343 - RNA, 24 nt, Homo sapiens
ccgaggggcagccaggggcgcucc

SEQ ID NO: 12344 - RNA, 24 nt, Homo sapiens
ccugccacacccccgcuccuucau

SEQ ID NO: 12345 - RNA, 23 nt, Homo sapiens
ccuggacgucacccgccugccac

SEQ ID NO: 12346 - RNA, 14 nt, Homo sapiens
ugcuuccucacguu

SEQ ID NO: 12347 - RNA, 23 nt, Homo sapiens
uggaugagaaugagcaccauauu

SEQ ID NO: 12348 - RNA, 17 nt, Homo sapiens
aagaaaacaugaaggac

SEQ ID NO: 12349 - RNA, 17 nt, Homo sapiens
agcaguccuguuucugu

SEQ ID NO: 12350 - RNA, 20 nt, Homo sapiens
agcgcuggcccgcgcgcucg

SEQ ID NO: 12351 - RNA, 20 nt, Homo sapiens
auggauguacgugaaagaaa

SEQ ID NO: 12352 - RNA, 22 nt, Homo sapiens
cuaguuucagauuauuuggagu

SEQ ID NO: 12353 - RNA, 22 nt, Homo sapiens
cucuuaaccuauguugggaugc

SEQ ID NO: 12354 - RNA, 14 nt, Homo sapiens
gaucugaguccucu

SEQ ID NO: 12355 - RNA, 18 nt, Homo sapiens
gcgcgcggcuagucgagc

SEQ ID NO: 12356 - RNA, 18 nt, Homo sapiens
gcggcgcucggcagcggc

SEQ ID NO: 12357 - RNA, 18 nt, Homo sapiens
gggguugggggaggagag

SEQ ID NO: 12358 - RNA, 28 nt, Homo sapiens
uaaaaggaggauauaacugucugaagga

SEQ ID NO: 12359 - RNA, 24 nt, Homo sapiens
uggaaaaaaaauccaauuauacaa

SEQ ID NO: 12360 - RNA, 19 nt, Homo sapiens
uuagagucugauagcauca

SEQ ID NO: 12361 - RNA, 23 nt, Homo sapiens
uucuaaacacugacuuuauaaga

SEQ ID NO: 12362 - RNA, 18 nt, Homo sapiens
aaagggcagauaguuuug

SEQ ID NO: 12363 - RNA, 16 nt, Homo sapiens
ccugggacuaaacggg

SEQ ID NO: 12364 - RNA, 24 nt, Homo sapiens
aaagaugcuuaaaauuaggaaaaa

SEQ ID NO: 12365 - RNA, 24 nt, Homo sapiens
aacagaugagacagacugcagaaa

SEQ ID NO: 12366 - RNA, 24 nt, Homo sapiens
aacauuuaucuccaaaauguacuu

SEQ ID NO: 12367 - RNA, 18 nt, Homo sapiens
acaguguuucuaauugua

SEQ ID NO: 12368 - RNA, 18 nt, Homo sapiens
acuuuguaauaugcauca

SEQ ID NO: 12369 - RNA, 18 nt, Homo sapiens
acuuuuguaaauagugau

SEQ ID NO: 12370 - RNA, 20 nt, Homo sapiens
aggcaaaaagauaaacaacc

SEQ ID NO: 12371 - RNA, 19 nt, Homo sapiens
augcuggguguuugggcuc

SEQ ID NO: 12372 - RNA, 18 nt, Homo sapiens
caacauccucaugcccag

SEQ ID NO: 12373 - RNA, 21 nt, Homo sapiens
cauacaagauacaaauucaau

SEQ ID NO: 12374 - RNA, 22 nt, Homo sapiens
cauauccaguccugugguuuuc

SEQ ID NO: 12375 - RNA, 20 nt, Homo sapiens
cccagcauuucuugcugccc

SEQ ID NO: 12376 - RNA, 17 nt, Homo sapiens
gaugaugaggguuugac

SEQ ID NO: 12377 - RNA, 21 nt, Homo sapiens
gcagauaaguuguaagcguuu

SEQ ID NO: 12378 - RNA, 21 nt, Homo sapiens
guuacgguuagaaguaauggu

SEQ ID NO: 12379 - RNA, 17 nt, Homo sapiens
uacagagcugaggcagg

SEQ ID NO: 12380 - RNA, 21 nt, Homo sapiens
uagagugggugugaacucuuu

SEQ ID NO: 12381 - RNA, 14 nt, Homo sapiens
ucaaagcauuaugc

SEQ ID NO: 12382 - RNA, 24 nt, Homo sapiens
uccuuuguuuugaugguggcuucu

SEQ ID NO: 12383 - RNA, 23 nt, Homo sapiens
ucuagauuucugcaacauccuca

SEQ ID NO: 12384 - RNA, 19 nt, Homo sapiens
ugacgagauguuuagcaau

SEQ ID NO: 12385 - RNA, 18 nt, Homo sapiens
ugaggcaggaaaaaguau

SEQ ID NO: 12386 - RNA, 21 nt, Homo sapiens
ugauacucccuuuucaugcag

SEQ ID NO: 12387 - RNA, 14 nt, Homo sapiens
uggaaauaaacaca

SEQ ID NO: 12388 - RNA, 20 nt, Homo sapiens
uguauuucuguuaguuugcu

SEQ ID NO: 12389 - RNA, 20 nt, Homo sapiens
uguggauacagccuuguuuc

SEQ ID NO: 12390 - RNA, 19 nt, Homo sapiens
uguuuugaugguggcuucu

SEQ ID NO: 12391 - RNA, 21 nt, Homo sapiens
uuuauaagccaaauaucaaau

SEQ ID NO: 12392 - RNA, 20 nt, Homo sapiens
uuuccuuuguugagcuguac

SEQ ID NO: 12393 - RNA, 29 nt, Homo sapiens
uuuggucugagcacuaguugcaaaugauc

SEQ ID NO: 12394 - RNA, 18 nt, Homo sapiens
agaaaaaacaauuuggga

SEQ ID NO: 12395 - RNA, 18 nt, Homo sapiens
agacgggguuuccccaug

SEQ ID NO: 12396 - RNA, 19 nt, Homo sapiens
gugugugugugugugugua

SEQ ID NO: 12397 - RNA, 24 nt, Homo sapiens
uccuuaagagaaaugggaaucuca

SEQ ID NO: 12398 - RNA, 20 nt, Homo sapiens
ucuguugagcaggggugugu

SEQ ID NO: 12399 - RNA, 18 nt, Homo sapiens
ugugugugugugugugug

SEQ ID NO: 12400 - RNA, 19 nt, Homo sapiens
ugugugugugugugugugu

SEQ ID NO: 12401 - RNA, 15 nt, Homo sapiens
uuaguucagagacug

SEQ ID NO: 12402 - RNA, 21 nt, Homo sapiens
cuguuuggcauaacagguuuc

SEQ ID NO: 12403 - RNA, 16 nt, Homo sapiens
gccgccacugcccgcc

SEQ ID NO: 12404 - RNA, 17 nt, Homo sapiens
ccugggguggggaucac

SEQ ID NO: 12405 - RNA, 24 nt, Homo sapiens
cggcuucagcucccucccaggagg

SEQ ID NO: 12406 - RNA, 18 nt, Homo sapiens
agcgguaccagggaauac

SEQ ID NO: 12407 - RNA, 18 nt, Homo sapiens
cggcggggcuggggcugg

SEQ ID NO: 12408 - RNA, 22 nt, Homo sapiens
cggggcuggggcuggggcuggg

SEQ ID NO: 12409 - RNA, 18 nt, Homo sapiens
gacagcuggggacgcggc

SEQ ID NO: 12410 - RNA, 19 nt, Homo sapiens
gaggaggcgguccagaccc

SEQ ID NO: 12411 - RNA, 26 nt, Homo sapiens
gggcuggggcuggggcuggggcuggg

SEQ ID NO: 12412 - RNA, 21 nt, Homo sapiens
ggggcuggggcuggggcuggg

SEQ ID NO: 12413 - RNA, 25 nt, Homo sapiens
ggggcuggggcuggggcuggggcug

SEQ ID NO: 12414 - RNA, 23 nt, Homo sapiens
uaguauggcauaugaguucuagu

SEQ ID NO: 12415 - RNA, 18 nt, Homo sapiens
acuucguuauggugcuac

SEQ ID NO: 12416 - RNA, 20 nt, Homo sapiens
cuacugaaaguaaguaaaag

SEQ ID NO: 12417 - RNA, 18 nt, Homo sapiens
uaacaugggacuuaaaug

SEQ ID NO: 12418 - RNA, 18 nt, Homo sapiens
ugccccacuguauaucac

SEQ ID NO: 12419 - RNA, 18 nt, Homo sapiens
uuuuauuuuauuguauua

SEQ ID NO: 12420 - RNA, 22 nt, Homo sapiens
cagcccgcgcacuggggccacc

SEQ ID NO: 12421 - RNA, 19 nt, Homo sapiens
ccaaaacugggggagagug

SEQ ID NO: 12422 - RNA, 24 nt, Homo sapiens
ugagaaaguugugaaucaguuccu

SEQ ID NO: 12423 - RNA, 19 nt, Homo sapiens
cggcggcggcggcggugga

SEQ ID NO: 12424 - RNA, 24 nt, Homo sapiens
gcggcagcggcagcggcagcggcg

SEQ ID NO: 12425 - RNA, 24 nt, Homo sapiens
uuguuuauagccauggccuggcuu

SEQ ID NO: 12426 - RNA, 25 nt, Homo sapiens
acccugcucugggcugguuuggggc

SEQ ID NO: 12427 - RNA, 18 nt, Homo sapiens
cgccgucgccgggucguc

SEQ ID NO: 12428 - RNA, 17 nt, Homo sapiens
gacugcugacuugggga

SEQ ID NO: 12429 - RNA, 23 nt, Homo sapiens
gggacggagggggcagugaagca

SEQ ID NO: 12430 - RNA, 15 nt, Homo sapiens
gggcuucggccgcgg

SEQ ID NO: 12431 - RNA, 22 nt, Homo sapiens
uuggggcuaggacugcugacuu

SEQ ID NO: 12432 - RNA, 22 nt, Homo sapiens
cugugaauugcugucccugagu

SEQ ID NO: 12433 - RNA, 18 nt, Homo sapiens
gaggagucggggaacggc

SEQ ID NO: 12434 - RNA, 18 nt, Homo sapiens
uccugcgggguggauucu

SEQ ID NO: 12435 - RNA, 15 nt, Homo sapiens
acuguuguacugcag

SEQ ID NO: 12436 - RNA, 14 nt, Homo sapiens
uccuugauuucccu

SEQ ID NO: 12437 - RNA, 22 nt, Homo sapiens
ggaacaacauucccaauucaau

SEQ ID NO: 12438 - RNA, 21 nt, Homo sapiens
ucuuucaagguuucaaguucc

SEQ ID NO: 12439 - RNA, 18 nt, Homo sapiens
acaggggagcugugcagg

SEQ ID NO: 12440 - RNA, 15 nt, Homo sapiens
ccccuuggcugccgc

SEQ ID NO: 12441 - RNA, 22 nt, Homo sapiens
ggaugggcaaaugccugcagac

SEQ ID NO: 12442 - RNA, 22 nt, Homo sapiens
ggccacaccauugccuggcugc

SEQ ID NO: 12443 - RNA, 21 nt, Homo sapiens
gguggaggaggacaggggagc

SEQ ID NO: 12444 - RNA, 19 nt, Homo sapiens
ugacagcccugggauaagg

SEQ ID NO: 12445 - RNA, 24 nt, Homo sapiens
ugccuaaucuguggacuaggcaga

SEQ ID NO: 12446 - RNA, 14 nt, Homo sapiens
uggaguccaagggc

SEQ ID NO: 12447 - RNA, 15 nt, Homo sapiens
uggcuggggagggga

SEQ ID NO: 12448 - RNA, 17 nt, Homo sapiens
cucaccaagagcagaag

SEQ ID NO: 12449 - RNA, 18 nt, Homo sapiens
gaagcuggagaucaagug

SEQ ID NO: 12450 - RNA, 18 nt, Homo sapiens
gcgcucuuucuccucacc

SEQ ID NO: 12451 - RNA, 21 nt, Homo sapiens
gugugugugagugugugugca

SEQ ID NO: 12452 - RNA, 18 nt, Homo sapiens
gugugugugugugugugu

SEQ ID NO: 12453 - RNA, 23 nt, Homo sapiens
ugugagagugugugugugugugu

SEQ ID NO: 12454 - RNA, 19 nt, Homo sapiens
ugugagugugugugcagaa

SEQ ID NO: 12455 - RNA, 18 nt, Homo sapiens
ugugugugugugugugug

SEQ ID NO: 12456 - RNA, 19 nt, Homo sapiens
ugugugugugugugugugu

SEQ ID NO: 12457 - RNA, 18 nt, Homo sapiens
cacagccuccagagcgcc

SEQ ID NO: 12458 - RNA, 19 nt, Homo sapiens
uuugcuuuccaacuacaaa

SEQ ID NO: 12459 - RNA, 21 nt, Homo sapiens
aagucuggagagaagcaaguu

SEQ ID NO: 12460 - RNA, 22 nt, Homo sapiens
gaaaauuuagcuuaagaaaaag

SEQ ID NO: 12461 - RNA, 21 nt, Homo sapiens
aaaaggcaucauauuuccagu

SEQ ID NO: 12462 - RNA, 18 nt, Homo sapiens
cugaagacuguucaugcc

SEQ ID NO: 12463 - RNA, 20 nt, Homo sapiens
gacggaggccucggggcucc

SEQ ID NO: 12464 - RNA, 16 nt, Homo sapiens
gcugaagacuguucau

SEQ ID NO: 12465 - RNA, 19 nt, Homo sapiens
uggggagaaacaaaugcug

SEQ ID NO: 12466 - RNA, 14 nt, Homo sapiens
uucacaauuacaga

SEQ ID NO: 12467 - RNA, 15 nt, Homo sapiens
ggccgcagugcagcc

SEQ ID NO: 12468 - RNA, 21 nt, Homo sapiens
ucccggccgcuuccugggucu

SEQ ID NO: 12469 - RNA, 23 nt, Homo sapiens
ucugcuuuucuucccagccccgu

SEQ ID NO: 12470 - RNA, 26 nt, Homo sapiens
aggcggggcgggccguggcaccugcu

SEQ ID NO: 12471 - RNA, 17 nt, Homo sapiens
auggagaggcagaggag

SEQ ID NO: 12472 - RNA, 19 nt, Homo sapiens
ccagcccugacuccaggcu

SEQ ID NO: 12473 - RNA, 19 nt, Homo sapiens
ggaaaaacgaagggcaaag

SEQ ID NO: 12474 - RNA, 22 nt, Homo sapiens
ggcuggcaggcggggcgggccg

SEQ ID NO: 12475 - RNA, 18 nt, Homo sapiens
agcggcagcggcggcggc

SEQ ID NO: 12476 - RNA, 19 nt, Homo sapiens
gcagcagccgggauugagg

SEQ ID NO: 12477 - RNA, 17 nt, Homo sapiens
gcuucugaaguguuuca

SEQ ID NO: 12478 - RNA, 23 nt, Homo sapiens
ggacgguggaggaacaauggugg

SEQ ID NO: 12479 - RNA, 20 nt, Homo sapiens
ggugggaaugggaagaaguc

SEQ ID NO: 12480 - RNA, 21 nt, Homo sapiens
uaccagcuauggagcacagca

SEQ ID NO: 12481 - RNA, 22 nt, Homo sapiens
ugaacuaaaaauaaaaguauaa

SEQ ID NO: 12482 - RNA, 18 nt, Homo sapiens
uggagaucuggcagucac

SEQ ID NO: 12483 - RNA, 18 nt, Homo sapiens
cccgucgcuuuccagucu

SEQ ID NO: 12484 - RNA, 16 nt, Homo sapiens
cggcggcggcgcggcg

SEQ ID NO: 12485 - RNA, 20 nt, Homo sapiens
gagucuguggucagcuaguu

SEQ ID NO: 12486 - RNA, 17 nt, Homo sapiens
gcgcggggcgcagaggg

SEQ ID NO: 12487 - RNA, 19 nt, Homo sapiens
ggcgcggggcgcagagggu

SEQ ID NO: 12488 - RNA, 18 nt, Homo sapiens
ggcggcggcgcggcgggg

SEQ ID NO: 12489 - RNA, 19 nt, Homo sapiens
ggcggcggcgcggcggggg

SEQ ID NO: 12490 - RNA, 18 nt, Homo sapiens
gggggcggcgcggggcgc

SEQ ID NO: 12491 - RNA, 22 nt, Homo sapiens
ggggggcggcgcggggcgcaga

SEQ ID NO: 12492 - RNA, 30 nt, Homo sapiens
caggguacuuccuucuccuugcacucggug

SEQ ID NO: 12493 - RNA, 21 nt, Homo sapiens
cccagcugccugcccuagucc

SEQ ID NO: 12494 - RNA, 21 nt, Homo sapiens
ugaauauauuauccuauuggc

SEQ ID NO: 12495 - RNA, 19 nt, Homo sapiens
gggugggaguggguggugg

SEQ ID NO: 12496 - RNA, 17 nt, Homo sapiens
uagaagcaagaaggaag

SEQ ID NO: 12497 - RNA, 24 nt, Homo sapiens
acuacagugggugggagugggugg

SEQ ID NO: 12498 - RNA, 17 nt, Homo sapiens
uagaagcaagaaggaag

SEQ ID NO: 12499 - RNA, 15 nt, Homo sapiens
accacauuuccuacc

SEQ ID NO: 12500 - RNA, 19 nt, Homo sapiens
cacuggggcuacaggcagg

SEQ ID NO: 12501 - RNA, 21 nt, Homo sapiens
gcgcggggccuggagcgcugg

SEQ ID NO: 12502 - RNA, 26 nt, Homo sapiens
gcggagcggagggcgcgguggcggcg

SEQ ID NO: 12503 - RNA, 21 nt, Homo sapiens
ggagcggagggcgcgguggcg

SEQ ID NO: 12504 - RNA, 22 nt, Homo sapiens
uaauauacauucuggugcugug

SEQ ID NO: 12505 - RNA, 19 nt, Homo sapiens
uacauauauauauauauau

SEQ ID NO: 12506 - RNA, 20 nt, Homo sapiens
uacauauauauauauauaua

SEQ ID NO: 12507 - RNA, 17 nt, Homo sapiens
uauacauucuggugcug

SEQ ID NO: 12508 - RNA, 22 nt, Homo sapiens
uggggcuacaggcaggucagug

SEQ ID NO: 12509 - RNA, 23 nt, Homo sapiens
uggucacacucucaacaaauaaa

SEQ ID NO: 12510 - RNA, 18 nt, Homo sapiens
uguuuugacggacuguca

SEQ ID NO: 12511 - RNA, 20 nt, Homo sapiens
ccuucagaggcaaacauaga

SEQ ID NO: 12512 - RNA, 18 nt, Homo sapiens
gaagagaggaaaagaaca

SEQ ID NO: 12513 - RNA, 22 nt, Homo sapiens
uaaagcacgcagguagagccga

SEQ ID NO: 12514 - RNA, 19 nt, Homo sapiens
ugaccuguaauuauaacau

SEQ ID NO: 12515 - RNA, 20 nt, Homo sapiens
aaccauuuuuuauaaccgca

SEQ ID NO: 12516 - RNA, 21 nt, Homo sapiens
agauaccagcccaccccucga

SEQ ID NO: 12517 - RNA, 20 nt, Homo sapiens
guagcaguauucacuauaac

SEQ ID NO: 12518 - RNA, 20 nt, Homo sapiens
uaaaaaaaaaaaaaaaaaaa

SEQ ID NO: 12519 - RNA, 21 nt, Homo sapiens
uaaaaauuagaaauugcugua

SEQ ID NO: 12520 - RNA, 22 nt, Homo sapiens
uacccuacccauacauauccca

SEQ ID NO: 12521 - RNA, 18 nt, Homo sapiens
gagcagggucggagggag

SEQ ID NO: 12522 - RNA, 19 nt, Homo sapiens
cugccauucauuccaacag

SEQ ID NO: 12523 - RNA, 22 nt, Homo sapiens
ggaggaggggugggggccccgg

SEQ ID NO: 12524 - RNA, 16 nt, Homo sapiens
gggccccggccucggc

SEQ ID NO: 12525 - RNA, 15 nt, Homo sapiens
aggccggaggccaac

SEQ ID NO: 12526 - RNA, 20 nt, Homo sapiens
agggcccgggaggacggccu

SEQ ID NO: 12527 - RNA, 18 nt, Homo sapiens
gaggccgugcgcuuccuc

SEQ ID NO: 12528 - RNA, 22 nt, Homo sapiens
gccucauccucaacgggcccgg

SEQ ID NO: 12529 - RNA, 20 nt, Homo sapiens
gcucagcccagcgggcgcug

SEQ ID NO: 12530 - RNA, 17 nt, Homo sapiens
gcuggcgcgcggacgcc

SEQ ID NO: 12531 - RNA, 17 nt, Homo sapiens
ggagggcccgggaggac

SEQ ID NO: 12532 - RNA, 22 nt, Homo sapiens
ggcgcugguagggccggggagg

SEQ ID NO: 12533 - RNA, 15 nt, Homo sapiens
ggccuguguccccga

SEQ ID NO: 12534 - RNA, 16 nt, Homo sapiens
gcugcgggcagagccc

SEQ ID NO: 12535 - RNA, 21 nt, Homo sapiens
uagggugguccacagccaguu

SEQ ID NO: 12536 - RNA, 19 nt, Homo sapiens
uggcaaaggcaggcugggg

SEQ ID NO: 12537 - RNA, 18 nt, Homo sapiens
uaguagugauaagaguuu

SEQ ID NO: 12538 - RNA, 20 nt, Homo sapiens
uuuuguuucuaaugucggaa

SEQ ID NO: 12539 - RNA, 20 nt, Homo sapiens
agccacagccagcagcagcg

SEQ ID NO: 12540 - RNA, 20 nt, Homo sapiens
cacagaaaaggcauccucug

SEQ ID NO: 12541 - RNA, 23 nt, Homo sapiens
cagccccagggggcucuagccac

SEQ ID NO: 12542 - RNA, 17 nt, Homo sapiens
cggagaaacgagaagca

SEQ ID NO: 12543 - RNA, 19 nt, Homo sapiens
gccagucccuccccucucc

SEQ ID NO: 12544 - RNA, 20 nt, Homo sapiens
gcccgccugcugccagagcc

SEQ ID NO: 12545 - RNA, 21 nt, Homo sapiens
ggagggagccccagcaggaag

SEQ ID NO: 12546 - RNA, 18 nt, Homo sapiens
ugcguuguuuauguauuc

SEQ ID NO: 12547 - RNA, 19 nt, Homo sapiens
ugcguuguuuauguauucu

SEQ ID NO: 12548 - RNA, 18 nt, Homo sapiens
uguuuauguauucucaaa

SEQ ID NO: 12549 - RNA, 17 nt, Homo sapiens
uuucuuggagaaccaua

SEQ ID NO: 12550 - RNA, 24 nt, Homo sapiens
aaaugaucauuaugaaaccuucau

SEQ ID NO: 12551 - RNA, 20 nt, Homo sapiens
cagugacaaauauugugccu

SEQ ID NO: 12552 - RNA, 21 nt, Homo sapiens
uacaggcgugagccaccaggc

SEQ ID NO: 12553 - RNA, 21 nt, Homo sapiens
uauccauaauuacuauuagac

SEQ ID NO: 12554 - RNA, 23 nt, Homo sapiens
ucgaacuccugaccucaggugau

SEQ ID NO: 12555 - RNA, 18 nt, Homo sapiens
ugaguagcugggacuaua

SEQ ID NO: 12556 - RNA, 19 nt, Homo sapiens
uggccaggguggucucgaa

SEQ ID NO: 12557 - RNA, 18 nt, Homo sapiens
caaagcggaaacuacagc

SEQ ID NO: 12558 - RNA, 18 nt, Homo sapiens
agaggagggggagggcag

SEQ ID NO: 12559 - RNA, 18 nt, Homo sapiens
gcucugggggcagcuggc

SEQ ID NO: 12560 - RNA, 17 nt, Homo sapiens
ucuaaauaaaaagagga

SEQ ID NO: 12561 - RNA, 21 nt, Homo sapiens
uggcucugggggcagcuggcu

SEQ ID NO: 12562 - RNA, 21 nt, Homo sapiens
ggcguucccagcaugacauuc

SEQ ID NO: 12563 - RNA, 21 nt, Homo sapiens
ugaagcuaacaccaccgauga

SEQ ID NO: 12564 - RNA, 18 nt, Homo sapiens
caauguaugggacacacg

SEQ ID NO: 12565 - RNA, 19 nt, Homo sapiens
gaggaaacaaaguugaugg

SEQ ID NO: 12566 - RNA, 19 nt, Homo sapiens
agaaggggguggagguggg

SEQ ID NO: 12567 - RNA, 20 nt, Homo sapiens
gaacaaaucaaacaaagcau

SEQ ID NO: 12568 - RNA, 19 nt, Homo sapiens
ugauggugaagugugccuc

SEQ ID NO: 12569 - RNA, 19 nt, Homo sapiens
acaugguccccggggguuu

SEQ ID NO: 12570 - RNA, 20 nt, Homo sapiens
agguagaagaggcaucuuga

SEQ ID NO: 12571 - RNA, 19 nt, Homo sapiens
caccacuagguacuaacac

SEQ ID NO: 12572 - RNA, 19 nt, Homo sapiens
gagaagcaaaaucaucuuu

SEQ ID NO: 12573 - RNA, 18 nt, Homo sapiens
gagauugugccaagacga

SEQ ID NO: 12574 - RNA, 20 nt, Homo sapiens
gggacagggagaagacuggu

SEQ ID NO: 12575 - RNA, 16 nt, Homo sapiens
ucaaacgucagcagcc

SEQ ID NO: 12576 - RNA, 16 nt, Homo sapiens
uggaagagguagaaga

SEQ ID NO: 12577 - RNA, 19 nt, Homo sapiens
gggaaagggguuccggggg

SEQ ID NO: 12578 - RNA, 15 nt, Homo sapiens
uggcaagaccaaggg

SEQ ID NO: 12579 - RNA, 22 nt, Homo sapiens
caaagccuccauaaaaacaauu

SEQ ID NO: 12580 - RNA, 23 nt, Homo sapiens
gcgcguccugcaccgcugcuccg

SEQ ID NO: 12581 - RNA, 21 nt, Homo sapiens
uacaaugcuuucccaucaccc

SEQ ID NO: 12582 - RNA, 21 nt, Homo sapiens
uccuucaaguuaagauuugug

SEQ ID NO: 12583 - RNA, 18 nt, Homo sapiens
ggaaagguugggugaagg

SEQ ID NO: 12584 - RNA, 18 nt, Homo sapiens
cacgguggggggagggug

SEQ ID NO: 12585 - RNA, 18 nt, Homo sapiens
caggaucuccaaguuucc

SEQ ID NO: 12586 - RNA, 17 nt, Homo sapiens
gcaccuggaacuuuugc

SEQ ID NO: 12587 - RNA, 16 nt, Homo sapiens
gcucuggguggcaggc

SEQ ID NO: 12588 - RNA, 21 nt, Homo sapiens
ggcacgguggggggagggugg

SEQ ID NO: 12589 - RNA, 14 nt, Homo sapiens
ggggaaggggcaag

SEQ ID NO: 12590 - RNA, 21 nt, Homo sapiens
gggggaggagaaaagcagggg

SEQ ID NO: 12591 - RNA, 16 nt, Homo sapiens
ggggggaggguggggg

SEQ ID NO: 12592 - RNA, 22 nt, Homo sapiens
gggugcuccaagguccaaugua

SEQ ID NO: 12593 - RNA, 21 nt, Homo sapiens
ggguugggcaugggggaggag

SEQ ID NO: 12594 - RNA, 18 nt, Homo sapiens
uggcucuggguggcaggc

SEQ ID NO: 12595 - RNA, 19 nt, Homo sapiens
caaguuucuuuaaaagcaa

SEQ ID NO: 12596 - RNA, 20 nt, Homo sapiens
ccugaguucuuucucccccu

SEQ ID NO: 12597 - RNA, 23 nt, Homo sapiens
ugccuguaaucccagcacuuugg

SEQ ID NO: 12598 - RNA, 17 nt, Homo sapiens
aaaaacaaaaccugaaa

SEQ ID NO: 12599 - RNA, 14 nt, Homo sapiens
agugcuugauggcu

SEQ ID NO: 12600 - RNA, 21 nt, Homo sapiens
auggcuuguggacuugacuau

SEQ ID NO: 12601 - RNA, 17 nt, Homo sapiens
guggugggaauuggauc

SEQ ID NO: 12602 - RNA, 19 nt, Homo sapiens
ucacuaaacacacacuaga

SEQ ID NO: 12603 - RNA, 21 nt, Homo sapiens
ucucuguucuuuuccuuucuc

SEQ ID NO: 12604 - RNA, 24 nt, Homo sapiens
uugcuucaauucgagaaguaaacu

SEQ ID NO: 12605 - RNA, 21 nt, Homo sapiens
uuguauaaaucugugguugaa

SEQ ID NO: 12606 - RNA, 20 nt, Homo sapiens
uuguggacuugacuauguag

SEQ ID NO: 12607 - RNA, 20 nt, Homo sapiens
cugugugucuguaaggcuca

SEQ ID NO: 12608 - RNA, 18 nt, Homo sapiens
aacuuaugaggggaagug

SEQ ID NO: 12609 - RNA, 18 nt, Homo sapiens
agcuacaggcauggaagc

SEQ ID NO: 12610 - RNA, 20 nt, Homo sapiens
ccgcgcggccgcccgacccc

SEQ ID NO: 12611 - RNA, 15 nt, Homo sapiens
ccuguuccuucucag

SEQ ID NO: 12612 - RNA, 18 nt, Homo sapiens
cuuaugaggggaaguggg

SEQ ID NO: 12613 - RNA, 18 nt, Homo sapiens
gagaggaggcggcgaggc

SEQ ID NO: 12614 - RNA, 20 nt, Homo sapiens
gcccgcccgcgcggccgccc

SEQ ID NO: 12615 - RNA, 22 nt, Homo sapiens
uacaaguuguaacaguucagaa

SEQ ID NO: 12616 - RNA, 21 nt, Homo sapiens
uacauggcuucucaaucuuug

SEQ ID NO: 12617 - RNA, 20 nt, Homo sapiens
ucaucaaauccagcacugga

SEQ ID NO: 12618 - RNA, 28 nt, Homo sapiens
ucguuuuggugaggugggugggauuaua

SEQ ID NO: 12619 - RNA, 19 nt, Homo sapiens
ugaggggaagugggguuug

SEQ ID NO: 12620 - RNA, 19 nt, Homo sapiens
uggcaaagguggguggcac

SEQ ID NO: 12621 - RNA, 22 nt, Homo sapiens
uuacuacagaugggucacagaa

SEQ ID NO: 12622 - RNA, 21 nt, Homo sapiens
acccagucaauagaggauuua

SEQ ID NO: 12623 - RNA, 20 nt, Homo sapiens
accuuuaaucucuccuuuuc

SEQ ID NO: 12624 - RNA, 20 nt, Homo sapiens
guuccagaagcacuccaugu

SEQ ID NO: 12625 - RNA, 18 nt, Homo sapiens
uauugcuacuucacugag

SEQ ID NO: 12626 - RNA, 27 nt, Homo sapiens
ugaucauaaaaaaaaguaaaaaaugca

SEQ ID NO: 12627 - RNA, 27 nt, Homo sapiens
aaggcuguggagguuuuaagaucuccu

SEQ ID NO: 12628 - RNA, 19 nt, Homo sapiens
cacccuggcauuguuuugc

SEQ ID NO: 12629 - RNA, 18 nt, Homo sapiens
uaaugcaaacaaaauaca

SEQ ID NO: 12630 - RNA, 17 nt, Homo sapiens
uaccaaguccagugugu

SEQ ID NO: 12631 - RNA, 18 nt, Homo sapiens
uauuaguauuccuuucau

SEQ ID NO: 12632 - RNA, 20 nt, Homo sapiens
ucacgcagucauaauuugca

SEQ ID NO: 12633 - RNA, 16 nt, Homo sapiens
ucaggcacauagcauu

SEQ ID NO: 12634 - RNA, 15 nt, Homo sapiens
ucccuugguccaacu

SEQ ID NO: 12635 - RNA, 20 nt, Homo sapiens
ugugccuaccauugggucag

SEQ ID NO: 12636 - RNA, 14 nt, Homo sapiens
uuuguaccaagucc

SEQ ID NO: 12637 - RNA, 17 nt, Homo sapiens
gcccgcccgccgccucc

SEQ ID NO: 12638 - RNA, 19 nt, Homo sapiens
gcccgcccgccgccucccc

SEQ ID NO: 12639 - RNA, 17 nt, Homo sapiens
cccgcgggucgggaccg

SEQ ID NO: 12640 - RNA, 18 nt, Homo sapiens
gggccgcacgucgucugc

SEQ ID NO: 12641 - RNA, 21 nt, Homo sapiens
ucgcgcacagcgguccacugc

SEQ ID NO: 12642 - RNA, 19 nt, Homo sapiens
ucaaagcgauccuucagcc

SEQ ID NO: 12643 - RNA, 15 nt, Homo sapiens
uggaagccagugaag

SEQ ID NO: 12644 - RNA, 17 nt, Homo sapiens
ccaggcuggacuggagc

SEQ ID NO: 12645 - RNA, 22 nt, Homo sapiens
gcccuggccacuucucuccucc

SEQ ID NO: 12646 - RNA, 16 nt, Homo sapiens
gcugugggccagcagc

SEQ ID NO: 12647 - RNA, 18 nt, Homo sapiens
gggaccaaggccccgguc

SEQ ID NO: 12648 - RNA, 18 nt, Homo sapiens
aagggaagccacaggaaa

SEQ ID NO: 12649 - RNA, 16 nt, Homo sapiens
acugcuuaaaagagca

SEQ ID NO: 12650 - RNA, 20 nt, Homo sapiens
aguaggugauuagucguaga

SEQ ID NO: 12651 - RNA, 19 nt, Homo sapiens
gaaagaagaaauauggaga

SEQ ID NO: 12652 - RNA, 19 nt, Homo sapiens
ugaaaauacauacaaauuc

SEQ ID NO: 12653 - RNA, 19 nt, Homo sapiens
uuuaaaaaauaaggccauc

SEQ ID NO: 12654 - RNA, 23 nt, Homo sapiens
aggggucaggcauaugauggaga

SEQ ID NO: 12655 - RNA, 17 nt, Homo sapiens
cagcccggggcuggagc

SEQ ID NO: 12656 - RNA, 17 nt, Homo sapiens
caggggacaccguugcg

SEQ ID NO: 12657 - RNA, 17 nt, Homo sapiens
ccggggcuggagcugca

SEQ ID NO: 12658 - RNA, 14 nt, Homo sapiens
cgccgcggcugcgg

SEQ ID NO: 12659 - RNA, 19 nt, Homo sapiens
cggcugcggaggcuggggc

SEQ ID NO: 12660 - RNA, 18 nt, Homo sapiens
gcggcggcggaagcuggc

SEQ ID NO: 12661 - RNA, 19 nt, Homo sapiens
gcugcggcggcggauggcg

SEQ ID NO: 12662 - RNA, 22 nt, Homo sapiens
ggcggcggauggcggcggcggc

SEQ ID NO: 12663 - RNA, 21 nt, Homo sapiens
ggcgggggggugcagcccggg

SEQ ID NO: 12664 - RNA, 15 nt, Homo sapiens
gggcgcgggcgggcg

SEQ ID NO: 12665 - RNA, 20 nt, Homo sapiens
gugaagaacuuggacauggc

SEQ ID NO: 12666 - RNA, 18 nt, Homo sapiens
uaaaauagaaccacaaaa

SEQ ID NO: 12667 - RNA, 22 nt, Homo sapiens
uauuuugcucccaaagccuccc

SEQ ID NO: 12668 - RNA, 21 nt, Homo sapiens
ucacuuuguuuaagcaaacac

SEQ ID NO: 12669 - RNA, 18 nt, Homo sapiens
ugagaagcgugcaggcgg

SEQ ID NO: 12670 - RNA, 19 nt, Homo sapiens
ugcggcggcggaagcuggc

SEQ ID NO: 12671 - RNA, 15 nt, Homo sapiens
uggacgcgccgcggc

SEQ ID NO: 12672 - RNA, 19 nt, Homo sapiens
uggagagcuggugucgggg

SEQ ID NO: 12673 - RNA, 18 nt, Homo sapiens
cagcgcacagaccuaggc

SEQ ID NO: 12674 - RNA, 18 nt, Homo sapiens
cgagcuggugcugaauag

SEQ ID NO: 12675 - RNA, 23 nt, Homo sapiens
gccuuggccugccccagccuguc

SEQ ID NO: 12676 - RNA, 19 nt, Homo sapiens
gcgccggcuguggggcgcc

SEQ ID NO: 12677 - RNA, 16 nt, Homo sapiens
ggaagaagagcgggga

SEQ ID NO: 12678 - RNA, 21 nt, Homo sapiens
ugccuauucacuggguggucu

SEQ ID NO: 12679 - RNA, 15 nt, Homo sapiens
uggggcgcccggggc

SEQ ID NO: 12680 - RNA, 18 nt, Homo sapiens
uguccggcgagcuggugc

SEQ ID NO: 12681 - RNA, 17 nt, Homo sapiens
aucauuuuuauugaugu

SEQ ID NO: 12682 - RNA, 23 nt, Homo sapiens
caggguuuugcuauguugcccag

SEQ ID NO: 12683 - RNA, 21 nt, Homo sapiens
cauuacucuaucacagaauug

SEQ ID NO: 12684 - RNA, 17 nt, Homo sapiens
ucauuagcuauuauggu

SEQ ID NO: 12685 - RNA, 20 nt, Homo sapiens
uguaugauucauaagauuuc

SEQ ID NO: 12686 - RNA, 19 nt, Homo sapiens
uuaguucauagacauuugg

SEQ ID NO: 12687 - RNA, 18 nt, Homo sapiens
uuuguugguuuuuuguuu

SEQ ID NO: 12688 - RNA, 19 nt, Homo sapiens
uauuucugauccguuauga

SEQ ID NO: 12689 - RNA, 20 nt, Homo sapiens
uucaaacuucauuaagacau

SEQ ID NO: 12690 - RNA, 22 nt, Homo sapiens
aauguaauuaugauguuacauu

SEQ ID NO: 12691 - RNA, 22 nt, Homo sapiens
agcaaagacaaugcuguaaaaa

SEQ ID NO: 12692 - RNA, 19 nt, Homo sapiens
aucagaaucacuaauauua

SEQ ID NO: 12693 - RNA, 17 nt, Homo sapiens
cugaguaacauuaagag

SEQ ID NO: 12694 - RNA, 22 nt, Homo sapiens
gcuagaaaacuguaugcaucau

SEQ ID NO: 12695 - RNA, 22 nt, Homo sapiens
uaagaaguacaaauuccuucua

SEQ ID NO: 12696 - RNA, 21 nt, Homo sapiens
uccuucaccaauguuacauga

SEQ ID NO: 12697 - RNA, 14 nt, Homo sapiens
uuuugaagaggcuu

SEQ ID NO: 12698 - RNA, 17 nt, Homo sapiens
ccccuccccucuccucc

SEQ ID NO: 12699 - RNA, 18 nt, Homo sapiens
cccucuccuccucuuccc

SEQ ID NO: 12700 - RNA, 18 nt, Homo sapiens
ccucuccuccucuucccu

SEQ ID NO: 12701 - RNA, 19 nt, Homo sapiens
gugaggggagaagaggagg

SEQ ID NO: 12702 - RNA, 19 nt, Homo sapiens
uccccucuccuccucuucc

SEQ ID NO: 12703 - RNA, 18 nt, Homo sapiens
gagcgacgccgcgcgcgg

SEQ ID NO: 12704 - RNA, 17 nt, Homo sapiens
ucagaaacucuggaauu

SEQ ID NO: 12705 - RNA, 20 nt, Homo sapiens
uggugggauccucauuucca

SEQ ID NO: 12706 - RNA, 22 nt, Homo sapiens
agcaagaccucccaccccaguc

SEQ ID NO: 12707 - RNA, 22 nt, Homo sapiens
agggaaccuaggguuggggaga

SEQ ID NO: 12708 - RNA, 18 nt, Homo sapiens
agugagagguugcucugg

SEQ ID NO: 12709 - RNA, 21 nt, Homo sapiens
aguggcggcggcggcugcggc

SEQ ID NO: 12710 - RNA, 22 nt, Homo sapiens
gagcugccggcggaggcgcacg

SEQ ID NO: 12711 - RNA, 23 nt, Homo sapiens
gcggcugcggcucccgggcggcg

SEQ ID NO: 12712 - RNA, 18 nt, Homo sapiens
ggcaguggcggcggcggc

SEQ ID NO: 12713 - RNA, 18 nt, Homo sapiens
ggcggcggcggcugcggc

SEQ ID NO: 12714 - RNA, 18 nt, Homo sapiens
gguggcgguggcgguggc

SEQ ID NO: 12715 - RNA, 22 nt, Homo sapiens
guggcgguggcgacggcggcgc

SEQ ID NO: 12716 - RNA, 24 nt, Homo sapiens
ucgggacugcagacucagacggug

SEQ ID NO: 12717 - RNA, 18 nt, Homo sapiens
ugagggaagagagaaaga

SEQ ID NO: 12718 - RNA, 18 nt, Homo sapiens
uucacauuucuaguuucu

SEQ ID NO: 12719 - RNA, 20 nt, Homo sapiens
aagcugcagugcaggaaagc

SEQ ID NO: 12720 - RNA, 21 nt, Homo sapiens
accccaccuccugccccuccc

SEQ ID NO: 12721 - RNA, 22 nt, Homo sapiens
agccacccagaguccugcucgu

SEQ ID NO: 12722 - RNA, 21 nt, Homo sapiens
agggaggcggaaggcccagcu

SEQ ID NO: 12723 - RNA, 19 nt, Homo sapiens
agggggugcgugggugugc

SEQ ID NO: 12724 - RNA, 17 nt, Homo sapiens
cccgggcuggcgcgucc

SEQ ID NO: 12725 - RNA, 18 nt, Homo sapiens
ccgcuucgccuucuccug

SEQ ID NO: 12726 - RNA, 17 nt, Homo sapiens
ccugccccucccaaccc

SEQ ID NO: 12727 - RNA, 18 nt, Homo sapiens
cgcccgccgggucacucg

SEQ ID NO: 12728 - RNA, 22 nt, Homo sapiens
cucucccuuucuuccuccuguc

SEQ ID NO: 12729 - RNA, 18 nt, Homo sapiens
gagcuggggccuguuccc

SEQ ID NO: 12730 - RNA, 20 nt, Homo sapiens
gaguaugggagggcugggug

SEQ ID NO: 12731 - RNA, 20 nt, Homo sapiens
gcaaaaggcuuggaagcucg

SEQ ID NO: 12732 - RNA, 17 nt, Homo sapiens
gcggcaaacaugaacuc

SEQ ID NO: 12733 - RNA, 18 nt, Homo sapiens
ggaagcucgggguuugcg

SEQ ID NO: 12734 - RNA, 18 nt, Homo sapiens
uauuuccaccccaccucc

SEQ ID NO: 12735 - RNA, 15 nt, Homo sapiens
ucccaccccugcauc

SEQ ID NO: 12736 - RNA, 23 nt, Homo sapiens
ucccucgcggaggcugagcuggg

SEQ ID NO: 12737 - RNA, 18 nt, Homo sapiens
ugccuggcccucucuccc

SEQ ID NO: 12738 - RNA, 21 nt, Homo sapiens
ugugagggggugcgugggugu

SEQ ID NO: 12739 - RNA, 15 nt, Homo sapiens
cccgccgcucaagcc

SEQ ID NO: 12740 - RNA, 19 nt, Homo sapiens
ccgagcugccuccggccgg

SEQ ID NO: 12741 - RNA, 20 nt, Homo sapiens
gccuccggccgggccgcggg

SEQ ID NO: 12742 - RNA, 16 nt, Homo sapiens
aggcggagggagcggc

SEQ ID NO: 12743 - RNA, 20 nt, Homo sapiens
gaggaggcggagggagcggc

SEQ ID NO: 12744 - RNA, 19 nt, Homo sapiens
gggaggaggcggagggagc

SEQ ID NO: 12745 - RNA, 19 nt, Homo sapiens
gggcucggggcggggagga

SEQ ID NO: 12746 - RNA, 19 nt, Homo sapiens
ggggaggaggcggagggag

SEQ ID NO: 12747 - RNA, 22 nt, Homo sapiens
ggggaggaggcggagggagcgg

SEQ ID NO: 12748 - RNA, 18 nt, Homo sapiens
ucucuaaauccagauaaa

SEQ ID NO: 12749 - RNA, 16 nt, Homo sapiens
uguuuccaucaugcaa

SEQ ID NO: 12750 - RNA, 18 nt, Homo sapiens
uuccaucaugcaagggag

SEQ ID NO: 12751 - RNA, 20 nt, Homo sapiens
uuuauaggugaaaaacauga

SEQ ID NO: 12752 - RNA, 15 nt, Homo sapiens
cacagauuuuaagcu

SEQ ID NO: 12753 - RNA, 21 nt, Homo sapiens
ccggcccgggggccccuaggc

SEQ ID NO: 12754 - RNA, 20 nt, Homo sapiens
cucaaacuccuugccucagg

SEQ ID NO: 12755 - RNA, 22 nt, Homo sapiens
ggacuggggaaaaggggcuggg

SEQ ID NO: 12756 - RNA, 15 nt, Homo sapiens
ggcugcugcggcgac

SEQ ID NO: 12757 - RNA, 21 nt, Homo sapiens
gggaccugggagagagaggga

SEQ ID NO: 12758 - RNA, 16 nt, Homo sapiens
gugagauaauguaggu

SEQ ID NO: 12759 - RNA, 18 nt, Homo sapiens
ccagcacggccagcgugg

SEQ ID NO: 12760 - RNA, 19 nt, Homo sapiens
ccucaagggaaagacugca

SEQ ID NO: 12761 - RNA, 26 nt, Homo sapiens
aauauauauauauaauagauauauau

SEQ ID NO: 12762 - RNA, 17 nt, Homo sapiens
auauauauauauaauag

SEQ ID NO: 12763 - RNA, 23 nt, Homo sapiens
uauauauauauaauagauauaua

SEQ ID NO: 12764 - RNA, 16 nt, Homo sapiens
acagugguuggacaga

SEQ ID NO: 12765 - RNA, 21 nt, Homo sapiens
aguggcugcuguccuggucug

SEQ ID NO: 12766 - RNA, 17 nt, Homo sapiens
ggcaggugggaggcagc

SEQ ID NO: 12767 - RNA, 23 nt, Homo sapiens
agugaguuccuaaccccggcucc

SEQ ID NO: 12768 - RNA, 22 nt, Homo sapiens
caagugaguuccuaaccccggc

SEQ ID NO: 12769 - RNA, 22 nt, Homo sapiens
ccugggucuccagcggccggac

SEQ ID NO: 12770 - RNA, 17 nt, Homo sapiens
cuccggugggggagggg

SEQ ID NO: 12771 - RNA, 20 nt, Homo sapiens
gcucccugggucuccagcgg

SEQ ID NO: 12772 - RNA, 18 nt, Homo sapiens
ggagcgcgaccgcggcgg

SEQ ID NO: 12773 - RNA, 23 nt, Homo sapiens
gggagaaagaaaggccgggugcc

SEQ ID NO: 12774 - RNA, 21 nt, Homo sapiens
gagagagaaagagagaaagag

SEQ ID NO: 12775 - RNA, 21 nt, Homo sapiens
gagagggagagagagaaagag

SEQ ID NO: 12776 - RNA, 18 nt, Homo sapiens
accaggcuccccuagucc

SEQ ID NO: 12777 - RNA, 15 nt, Homo sapiens
aggcuuucucaaagc

SEQ ID NO: 12778 - RNA, 21 nt, Homo sapiens
auuucaaauagaccuaacucc

SEQ ID NO: 12779 - RNA, 18 nt, Homo sapiens
caggaguugcugggugcg

SEQ ID NO: 12780 - RNA, 17 nt, Homo sapiens
ccguuggggccugggag

SEQ ID NO: 12781 - RNA, 17 nt, Homo sapiens
ccugggagaccaagccc

SEQ ID NO: 12782 - RNA, 20 nt, Homo sapiens
cgccucuaacccagaccacu

SEQ ID NO: 12783 - RNA, 19 nt, Homo sapiens
cucuuucaguuugagcccu

SEQ ID NO: 12784 - RNA, 19 nt, Homo sapiens
gaauacaaaccacggcgga

SEQ ID NO: 12785 - RNA, 22 nt, Homo sapiens
gggggacagcagggacaaagga

SEQ ID NO: 12786 - RNA, 19 nt, Homo sapiens
gucuguucccaggaaucug

SEQ ID NO: 12787 - RNA, 23 nt, Homo sapiens
uccugggcccaagcuuagcaguu

SEQ ID NO: 12788 - RNA, 19 nt, Homo sapiens
ucuuucaguuugagcccug

SEQ ID NO: 12789 - RNA, 23 nt, Homo sapiens
uggcauuucaaauagaccuaacu

SEQ ID NO: 12790 - RNA, 19 nt, Homo sapiens
ugggacagguggucuaccu

SEQ ID NO: 12791 - RNA, 24 nt, Homo sapiens
cagagcgcagggugcccacgggua

SEQ ID NO: 12792 - RNA, 20 nt, Homo sapiens
cagccgccgcucgcaagccc

SEQ ID NO: 12793 - RNA, 16 nt, Homo sapiens
cccuccccgcgguccc

SEQ ID NO: 12794 - RNA, 17 nt, Homo sapiens
ccgccgcucgcaagccc

SEQ ID NO: 12795 - RNA, 16 nt, Homo sapiens
cggucccucagccgcc

SEQ ID NO: 12796 - RNA, 20 nt, Homo sapiens
gcacaguggcgcgaucucgg

SEQ ID NO: 12797 - RNA, 17 nt, Homo sapiens
gcucccauaaaaagcag

SEQ ID NO: 12798 - RNA, 18 nt, Homo sapiens
gcuggagccgcucggcgc

SEQ ID NO: 12799 - RNA, 21 nt, Homo sapiens
ugacauucauuuauuacugua

SEQ ID NO: 12800 - RNA, 18 nt, Homo sapiens
uggagcaaauguaguggc

SEQ ID NO: 12801 - RNA, 21 nt, Homo sapiens
cucuccuguaagacccgcggg

SEQ ID NO: 12802 - RNA, 18 nt, Homo sapiens
uaauguacauguacuacu

SEQ ID NO: 12803 - RNA, 18 nt, Homo sapiens
aaaaccucaaaauacugg

SEQ ID NO: 12804 - RNA, 19 nt, Homo sapiens
aggacgcagcgcacccugg

SEQ ID NO: 12805 - RNA, 16 nt, Homo sapiens
uaauagcacauccugg

SEQ ID NO: 12806 - RNA, 21 nt, Homo sapiens
ucuaagacagggaggaaagaa

SEQ ID NO: 12807 - RNA, 21 nt, Homo sapiens
ugaggacgcagcgcacccugg

SEQ ID NO: 12808 - RNA, 17 nt, Homo sapiens
ucauggacuccuggugc

SEQ ID NO: 12809 - RNA, 23 nt, Homo sapiens
agagguuuaagcagccucgugcc

SEQ ID NO: 12810 - RNA, 20 nt, Homo sapiens
agggugcuguugggggcacu

SEQ ID NO: 12811 - RNA, 15 nt, Homo sapiens
cuggggugcugagga

SEQ ID NO: 12812 - RNA, 19 nt, Homo sapiens
gagagggugcuguuggggu

SEQ ID NO: 12813 - RNA, 17 nt, Homo sapiens
gcgggcacaaucacagc

SEQ ID NO: 12814 - RNA, 17 nt, Homo sapiens
gcugccuccguuugggu

SEQ ID NO: 12815 - RNA, 25 nt, Homo sapiens
gggaaggcaggggccauagaggagc

SEQ ID NO: 12816 - RNA, 16 nt, Homo sapiens
gggucuucagggucuu

SEQ ID NO: 12817 - RNA, 20 nt, Homo sapiens
augggagugugucuggcugg

SEQ ID NO: 12818 - RNA, 17 nt, Homo sapiens
ggagugugucuggcugg

SEQ ID NO: 12819 - RNA, 20 nt, Homo sapiens
gcaguguggaugcugguggc

SEQ ID NO: 12820 - RNA, 20 nt, Homo sapiens
ggccugcagaggccaccagc

SEQ ID NO: 12821 - RNA, 22 nt, Homo sapiens
ucaggcccggugcggaccccgg

SEQ ID NO: 12822 - RNA, 21 nt, Homo sapiens
aaaaagcagccacaaaaauau

SEQ ID NO: 12823 - RNA, 18 nt, Homo sapiens
aagaauuguuauccauag

SEQ ID NO: 12824 - RNA, 18 nt, Homo sapiens
acacaaaucaaaauacca

SEQ ID NO: 12825 - RNA, 21 nt, Homo sapiens
acauuuuuacauaaaaucauu

SEQ ID NO: 12826 - RNA, 18 nt, Homo sapiens
acccgccgggccgcggcg

SEQ ID NO: 12827 - RNA, 17 nt, Homo sapiens
agggagaaaggauggaa

SEQ ID NO: 12828 - RNA, 18 nt, Homo sapiens
aucuuuccauagcuauua

SEQ ID NO: 12829 - RNA, 18 nt, Homo sapiens
auguuucauucauacaga

SEQ ID NO: 12830 - RNA, 20 nt, Homo sapiens
auuuccccauaauuauuuuu

SEQ ID NO: 12831 - RNA, 16 nt, Homo sapiens
cacaucagaguaaaaa

SEQ ID NO: 12832 - RNA, 19 nt, Homo sapiens
cccaagcugcagcgcccgg

SEQ ID NO: 12833 - RNA, 24 nt, Homo sapiens
ccccuacucgcucggguuuucugg

SEQ ID NO: 12834 - RNA, 25 nt, Homo sapiens
ccgcggacgccgccuggggagagcc

SEQ ID NO: 12835 - RNA, 22 nt, Homo sapiens
ccggcggcccgggaccuggggu

SEQ ID NO: 12836 - RNA, 17 nt, Homo sapiens
ccugggguucacggaug

SEQ ID NO: 12837 - RNA, 16 nt, Homo sapiens
cuccgcggacgccgcc

SEQ ID NO: 12838 - RNA, 19 nt, Homo sapiens
gaucaacccucccaccuca

SEQ ID NO: 12839 - RNA, 21 nt, Homo sapiens
gcagguuugcaaggcuuccuc

SEQ ID NO: 12840 - RNA, 23 nt, Homo sapiens
gccaucacaaacaguuaaacauu

SEQ ID NO: 12841 - RNA, 19 nt, Homo sapiens
uacuagguaaaugaagaau

SEQ ID NO: 12842 - RNA, 16 nt, Homo sapiens
uaggcugcugcuguau

SEQ ID NO: 12843 - RNA, 19 nt, Homo sapiens
uaucuguucauaguuaacu

SEQ ID NO: 12844 - RNA, 21 nt, Homo sapiens
ucuagguaagcuucacugggu

SEQ ID NO: 12845 - RNA, 20 nt, Homo sapiens
ucuccgcggacgccgccugg

SEQ ID NO: 12846 - RNA, 19 nt, Homo sapiens
ugccacgugagagcagagc

SEQ ID NO: 12847 - RNA, 20 nt, Homo sapiens
uguaauugaagaaaaacaca

SEQ ID NO: 12848 - RNA, 17 nt, Homo sapiens
uuauuauugauuuguac

SEQ ID NO: 12849 - RNA, 25 nt, Homo sapiens
uuguacaucucuuuucccccagaag

SEQ ID NO: 12850 - RNA, 21 nt, Homo sapiens
uuuauacugcaguugaaaaau

SEQ ID NO: 12851 - RNA, 22 nt, Homo sapiens
uuuuuaauuggcuuaaaaaugu

SEQ ID NO: 12852 - RNA, 16 nt, Homo sapiens
cgggagcgcacggccg

SEQ ID NO: 12853 - RNA, 14 nt, Homo sapiens
ggggcagagcugcg

SEQ ID NO: 12854 - RNA, 26 nt, Homo sapiens
uucccgaggcugaggcaaggguccuc

SEQ ID NO: 12855 - RNA, 23 nt, Homo sapiens
agaagaaagaaaacaguccacuu

SEQ ID NO: 12856 - RNA, 18 nt, Homo sapiens
caagacauagucacauuu

SEQ ID NO: 12857 - RNA, 21 nt, Homo sapiens
ccccuuauucuuaacugcauc

SEQ ID NO: 12858 - RNA, 18 nt, Homo sapiens
ccucaagccuucaugaca

SEQ ID NO: 12859 - RNA, 22 nt, Homo sapiens
gaacagauagucugcuaggcac

SEQ ID NO: 12860 - RNA, 21 nt, Homo sapiens
guguggcuugauuaucugaca

SEQ ID NO: 12861 - RNA, 20 nt, Homo sapiens
guuuuuacauauuuguauug

SEQ ID NO: 12862 - RNA, 20 nt, Homo sapiens
uacccuuuccacuugagcag

SEQ ID NO: 12863 - RNA, 23 nt, Homo sapiens
uccauaguuaguguggcuugauu

SEQ ID NO: 12864 - RNA, 20 nt, Homo sapiens
caagaauaaacaauaaugau

SEQ ID NO: 12865 - RNA, 19 nt, Homo sapiens
cucccagcuccagccggcc

SEQ ID NO: 12866 - RNA, 18 nt, Homo sapiens
auagagggucuaagcagg

SEQ ID NO: 12867 - RNA, 27 nt, Homo sapiens
ccuaggauaccuucuuucucuuucucu

SEQ ID NO: 12868 - RNA, 18 nt, Homo sapiens
cggggccggagcgccgcc

SEQ ID NO: 12869 - RNA, 17 nt, Homo sapiens
gagaggcgggggggcgg

SEQ ID NO: 12870 - RNA, 18 nt, Homo sapiens
gcgcggggccggagcgcc

SEQ ID NO: 12871 - RNA, 20 nt, Homo sapiens
gcgcggggccggagcgccgc

SEQ ID NO: 12872 - RNA, 16 nt, Homo sapiens
ggagcgcggggccgga

SEQ ID NO: 12873 - RNA, 18 nt, Homo sapiens
ggccggagcgccgccugg

SEQ ID NO: 12874 - RNA, 19 nt, Homo sapiens
gggagaggcgggggggcgg

SEQ ID NO: 12875 - RNA, 19 nt, Homo sapiens
ggggagaggcgggggggcg

SEQ ID NO: 12876 - RNA, 17 nt, Homo sapiens
ggggccggagcgccgcc

SEQ ID NO: 12877 - RNA, 19 nt, Homo sapiens
uacaggauggugagaugaa

SEQ ID NO: 12878 - RNA, 19 nt, Homo sapiens
aaaucuccccaauuuuuaa

SEQ ID NO: 12879 - RNA, 18 nt, Homo sapiens
aaauucccuccuuccacu

SEQ ID NO: 12880 - RNA, 20 nt, Homo sapiens
accaagccauuuaaacauaa

SEQ ID NO: 12881 - RNA, 17 nt, Homo sapiens
acccccgccccuccccc

SEQ ID NO: 12882 - RNA, 18 nt, Homo sapiens
aggaucugaaaaucuuuu

SEQ ID NO: 12883 - RNA, 21 nt, Homo sapiens
agggaguuggugaaagacauc

SEQ ID NO: 12884 - RNA, 18 nt, Homo sapiens
augcuuuuaauaacagua

SEQ ID NO: 12885 - RNA, 17 nt, Homo sapiens
cucaugugaauucugug

SEQ ID NO: 12886 - RNA, 20 nt, Homo sapiens
cugccccaaauaccuguggu

SEQ ID NO: 12887 - RNA, 21 nt, Homo sapiens
cugccccaaauaccugugguu

SEQ ID NO: 12888 - RNA, 17 nt, Homo sapiens
gccggggcagagccugc

SEQ ID NO: 12889 - RNA, 20 nt, Homo sapiens
ggaaaguaauaaaacauaau

SEQ ID NO: 12890 - RNA, 21 nt, Homo sapiens
uaagauuuuaacagugauuuu

SEQ ID NO: 12891 - RNA, 22 nt, Homo sapiens
uacauggccaccccuggccaca

SEQ ID NO: 12892 - RNA, 21 nt, Homo sapiens
ugcucuccccagcggcgcgcc

SEQ ID NO: 12893 - RNA, 18 nt, Homo sapiens
ugguggcuguucaaugaa

SEQ ID NO: 12894 - RNA, 18 nt, Homo sapiens
uguaagaauuuuaaguug

SEQ ID NO: 12895 - RNA, 20 nt, Homo sapiens
ugucuguaaguacaucaaca

SEQ ID NO: 12896 - RNA, 17 nt, Homo sapiens
uuuccagacagaccaga

SEQ ID NO: 12897 - RNA, 17 nt, Homo sapiens
cgccgcucucgcugccg

SEQ ID NO: 12898 - RNA, 18 nt, Homo sapiens
gagcagguggugucaccu

SEQ ID NO: 12899 - RNA, 19 nt, Homo sapiens
ucucgcugccgggccgcgc

SEQ ID NO: 12900 - RNA, 19 nt, Homo sapiens
uggagcagguggugucacc

SEQ ID NO: 12901 - RNA, 16 nt, Homo sapiens
acaaggauaaauuuga

SEQ ID NO: 12902 - RNA, 18 nt, Homo sapiens
acgugaugcauuggguga

SEQ ID NO: 12903 - RNA, 15 nt, Homo sapiens
agacuugcacauggu

SEQ ID NO: 12904 - RNA, 17 nt, Homo sapiens
agccgccgccgcugccg

SEQ ID NO: 12905 - RNA, 19 nt, Homo sapiens
aggagccaaaaguaugggc

SEQ ID NO: 12906 - RNA, 23 nt, Homo sapiens
caauuuucagugcuauuuuaaug

SEQ ID NO: 12907 - RNA, 18 nt, Homo sapiens
cacaggugguuugcguau

SEQ ID NO: 12908 - RNA, 16 nt, Homo sapiens
ccuuuuccuccucaca

SEQ ID NO: 12909 - RNA, 16 nt, Homo sapiens
cgccgccgccggcccc

SEQ ID NO: 12910 - RNA, 16 nt, Homo sapiens
cgcuccgagccgccgc

SEQ ID NO: 12911 - RNA, 16 nt, Homo sapiens
cucaggccagccagug

SEQ ID NO: 12912 - RNA, 19 nt, Homo sapiens
ggggaggagccgagaggag

SEQ ID NO: 12913 - RNA, 19 nt, Homo sapiens
gguuacuuagagcucaggu

SEQ ID NO: 12914 - RNA, 19 nt, Homo sapiens
ucuccucaggacugcauuu

SEQ ID NO: 12915 - RNA, 17 nt, Homo sapiens
ugacugacuuccugugu

SEQ ID NO: 12916 - RNA, 20 nt, Homo sapiens
uugaaaaauuuauggaagga

SEQ ID NO: 12917 - RNA, 21 nt, Homo sapiens
cacagggucaggugcugaagg

SEQ ID NO: 12918 - RNA, 19 nt, Homo sapiens
uaaccccucccuguggugc

SEQ ID NO: 12919 - RNA, 19 nt, Homo sapiens
ucugggaaggcaccuguua

SEQ ID NO: 12920 - RNA, 18 nt, Homo sapiens
cucuuguaauuucuggug

SEQ ID NO: 12921 - RNA, 18 nt, Homo sapiens
gggaagcgagaggguggc

SEQ ID NO: 12922 - RNA, 21 nt, Homo sapiens
ugagaucugugaaaauaguuu

SEQ ID NO: 12923 - RNA, 18 nt, Homo sapiens
auuuggcuaauagcaguu

SEQ ID NO: 12924 - RNA, 18 nt, Homo sapiens
ccugaauuuggcuaauag

SEQ ID NO: 12925 - RNA, 20 nt, Homo sapiens
uaauagcaguuaugauggag

SEQ ID NO: 12926 - RNA, 18 nt, Homo sapiens
ugauggagagcagaggag

SEQ ID NO: 12927 - RNA, 21 nt, Homo sapiens
agugagcuucugccuaugucc

SEQ ID NO: 12928 - RNA, 25 nt, Homo sapiens
ccagcacaggcaagauuuggcugcc

SEQ ID NO: 12929 - RNA, 18 nt, Homo sapiens
cuggccuuuccucuucug

SEQ ID NO: 12930 - RNA, 18 nt, Homo sapiens
ggagccaagaacguaguc

SEQ ID NO: 12931 - RNA, 22 nt, Homo sapiens
uauuaucaucaugcuggugacc

SEQ ID NO: 12932 - RNA, 19 nt, Homo sapiens
uccaacaguccuugccccu

SEQ ID NO: 12933 - RNA, 18 nt, Homo sapiens
ugguaagcaaagucuggc

SEQ ID NO: 12934 - RNA, 21 nt, Homo sapiens
ugguguucacaugcagaugcu

SEQ ID NO: 12935 - RNA, 20 nt, Homo sapiens
uuggcccauugcagaugcug

SEQ ID NO: 12936 - RNA, 21 nt, Homo sapiens
acuaauguuugacaggguuug

SEQ ID NO: 12937 - RNA, 22 nt, Homo sapiens
cccccuggcagcggcgccuccg

SEQ ID NO: 12938 - RNA, 18 nt, Homo sapiens
ccgccgcccgcgcucgcc

SEQ ID NO: 12939 - RNA, 14 nt, Homo sapiens
cuaugacgugaaau

SEQ ID NO: 12940 - RNA, 19 nt, Homo sapiens
gaugugugcaagguaccaa

SEQ ID NO: 12941 - RNA, 23 nt, Homo sapiens
gauuauuaugcauacauggaaau

SEQ ID NO: 12942 - RNA, 19 nt, Homo sapiens
gggcagacaaaauuaaaaa

SEQ ID NO: 12943 - RNA, 22 nt, Homo sapiens
uaacagaacacuuucuauagau

SEQ ID NO: 12944 - RNA, 20 nt, Homo sapiens
uauaacaucuuagagugaag

SEQ ID NO: 12945 - RNA, 18 nt, Homo sapiens
aagaacacuagcaggaaa

SEQ ID NO: 12946 - RNA, 20 nt, Homo sapiens
accccaggugaggauuuaca

SEQ ID NO: 12947 - RNA, 22 nt, Homo sapiens
accuccgggaugcaaauuugca

SEQ ID NO: 12948 - RNA, 22 nt, Homo sapiens
accugcuguuucuaucauggac

SEQ ID NO: 12949 - RNA, 19 nt, Homo sapiens
aggcggcggcggcgggcgg

SEQ ID NO: 12950 - RNA, 18 nt, Homo sapiens
agugugugugugugugua

SEQ ID NO: 12951 - RNA, 19 nt, Homo sapiens
aguguguguguguguguau

SEQ ID NO: 12952 - RNA, 23 nt, Homo sapiens
aguguuuggaugcauaaguguug

SEQ ID NO: 12953 - RNA, 18 nt, Homo sapiens
caccugcuguuucuauca

SEQ ID NO: 12954 - RNA, 17 nt, Homo sapiens
caucaagaucuagaggc

SEQ ID NO: 12955 - RNA, 23 nt, Homo sapiens
ccacagauacaaccacuaccacc

SEQ ID NO: 12956 - RNA, 19 nt, Homo sapiens
cccagcuaaaaguguccgg

SEQ ID NO: 12957 - RNA, 18 nt, Homo sapiens
cgagcugguuguuaaaca

SEQ ID NO: 12958 - RNA, 21 nt, Homo sapiens
cggcagccgcugcgggcucag

SEQ ID NO: 12959 - RNA, 18 nt, Homo sapiens
cggcggcagcggcggcgg

SEQ ID NO: 12960 - RNA, 18 nt, Homo sapiens
cggcggcggcgggcgggc

SEQ ID NO: 12961 - RNA, 19 nt, Homo sapiens
cggcggcgggcgggcgccu

SEQ ID NO: 12962 - RNA, 19 nt, Homo sapiens
cggggcagaggcagcggcg

SEQ ID NO: 12963 - RNA, 20 nt, Homo sapiens
cuggcuguuuugcaacuggg

SEQ ID NO: 12964 - RNA, 22 nt, Homo sapiens
cuguuccugaugguucugcucc

SEQ ID NO: 12965 - RNA, 21 nt, Homo sapiens
gagaaaugaaaaaaaaaagau

SEQ ID NO: 12966 - RNA, 19 nt, Homo sapiens
gaugugggauuucaagaag

SEQ ID NO: 12967 - RNA, 20 nt, Homo sapiens
gcacgggccccaggguuuua

SEQ ID NO: 12968 - RNA, 16 nt, Homo sapiens
gcggcggcggcagcgg

SEQ ID NO: 12969 - RNA, 19 nt, Homo sapiens
gcggcggcgggcgggcgcc

SEQ ID NO: 12970 - RNA, 23 nt, Homo sapiens
gcgggccggcggcggcagcggcg

SEQ ID NO: 12971 - RNA, 17 nt, Homo sapiens
ggcagcggcggcggggg

SEQ ID NO: 12972 - RNA, 15 nt, Homo sapiens
ggcgccugucccuga

SEQ ID NO: 12973 - RNA, 19 nt, Homo sapiens
ggcggcagccgcugcgggc

SEQ ID NO: 12974 - RNA, 18 nt, Homo sapiens
ggcggcggcggcagcggc

SEQ ID NO: 12975 - RNA, 19 nt, Homo sapiens
ggcggcggcgggcgggcgc

SEQ ID NO: 12976 - RNA, 20 nt, Homo sapiens
gggcggcagcggcggcggcg

SEQ ID NO: 12977 - RNA, 21 nt, Homo sapiens
uaauuuaaaaauuuaaaaagu

SEQ ID NO: 12978 - RNA, 18 nt, Homo sapiens
uacagaaacaucugaaga

SEQ ID NO: 12979 - RNA, 20 nt, Homo sapiens
uaccagcagguaauuaccag

SEQ ID NO: 12980 - RNA, 20 nt, Homo sapiens
uagacauguugcacaugcag

SEQ ID NO: 12981 - RNA, 18 nt, Homo sapiens
uauaacacugucucaucu

SEQ ID NO: 12982 - RNA, 20 nt, Homo sapiens
ucaccaagccuccaucaaga

SEQ ID NO: 12983 - RNA, 20 nt, Homo sapiens
uccuucaccaaaaauaucag

SEQ ID NO: 12984 - RNA, 16 nt, Homo sapiens
ucuagaguguagcauu

SEQ ID NO: 12985 - RNA, 22 nt, Homo sapiens
ugaaaacugguccacugucugg

SEQ ID NO: 12986 - RNA, 19 nt, Homo sapiens
uguacuugcucagauggag

SEQ ID NO: 12987 - RNA, 21 nt, Homo sapiens
ugugagugugugugugugugu

SEQ ID NO: 12988 - RNA, 21 nt, Homo sapiens
ugugugugagugugugugugu

SEQ ID NO: 12989 - RNA, 19 nt, Homo sapiens
ugugugugugagugugugu

SEQ ID NO: 12990 - RNA, 22 nt, Homo sapiens
uucauccuccauguuuaauuag

SEQ ID NO: 12991 - RNA, 19 nt, Homo sapiens
uuugcccagauuucauucc

SEQ ID NO: 12992 - RNA, 16 nt, Homo sapiens
aaugugagugugcaga

SEQ ID NO: 12993 - RNA, 20 nt, Homo sapiens
cagcacccaaggagcaucag

SEQ ID NO: 12994 - RNA, 17 nt, Homo sapiens
uauuacaaaaccguucu

SEQ ID NO: 12995 - RNA, 16 nt, Homo sapiens
ucccugcuuacugaac

SEQ ID NO: 12996 - RNA, 17 nt, Homo sapiens
ugcaguuauuacugcua

SEQ ID NO: 12997 - RNA, 18 nt, Homo sapiens
aaaagacaacacagucuu

SEQ ID NO: 12998 - RNA, 22 nt, Homo sapiens
aagaaagauagaaacccccaga

SEQ ID NO: 12999 - RNA, 17 nt, Homo sapiens
agaggcagcaaauggcc

SEQ ID NO: 13000 - RNA, 20 nt, Homo sapiens
agguaauacauagcccaaua

SEQ ID NO: 13001 - RNA, 20 nt, Homo sapiens
caccccacgcugccaccacc

SEQ ID NO: 13002 - RNA, 24 nt, Homo sapiens
cagaggggguuuugacacaacgug

SEQ ID NO: 13003 - RNA, 18 nt, Homo sapiens
caucuuggugggacccaa

SEQ ID NO: 13004 - RNA, 18 nt, Homo sapiens
cggcaccccacgcugcca

SEQ ID NO: 13005 - RNA, 21 nt, Homo sapiens
gggaggagugaggcagguggg

SEQ ID NO: 13006 - RNA, 17 nt, Homo sapiens
gugggcuuggagucugg

SEQ ID NO: 13007 - RNA, 17 nt, Homo sapiens
guuuucacgguacauga

SEQ ID NO: 13008 - RNA, 22 nt, Homo sapiens
uagaggcagcaaauggccaggu

SEQ ID NO: 13009 - RNA, 19 nt, Homo sapiens
uggagagcuggugaggagg

SEQ ID NO: 13010 - RNA, 17 nt, Homo sapiens
accuauuucucagacuu

SEQ ID NO: 13011 - RNA, 21 nt, Homo sapiens
auggcuuuaccaucauuguag

SEQ ID NO: 13012 - RNA, 19 nt, Homo sapiens
cggcuugcuuucuguggcu

SEQ ID NO: 13013 - RNA, 15 nt, Homo sapiens
guaggccaaagggua

SEQ ID NO: 13014 - RNA, 18 nt, Homo sapiens
ucaguccagcagcugggu

SEQ ID NO: 13015 - RNA, 23 nt, Homo sapiens
ugcagcaaguccuaccuggagag

SEQ ID NO: 13016 - RNA, 22 nt, Homo sapiens
ccaccgcccuggcccucgcuca

SEQ ID NO: 13017 - RNA, 22 nt, Homo sapiens
ucugcuuuauuuucacaucugu

SEQ ID NO: 13018 - RNA, 21 nt, Homo sapiens
aggucacacccacagugaugc

SEQ ID NO: 13019 - RNA, 22 nt, Homo sapiens
cagcaggggaggcuccuggcag

SEQ ID NO: 13020 - RNA, 18 nt, Homo sapiens
ccaggccccaugccggcc

SEQ ID NO: 13021 - RNA, 16 nt, Homo sapiens
cgcccgggggcagggc

SEQ ID NO: 13022 - RNA, 16 nt, Homo sapiens
cugugccucccagcgg

SEQ ID NO: 13023 - RNA, 19 nt, Homo sapiens
uggcaaggucucugggagc

SEQ ID NO: 13024 - RNA, 22 nt, Homo sapiens
ugggaaagugaggucccuggca

SEQ ID NO: 13025 - RNA, 16 nt, Homo sapiens
agagagagagagagag

SEQ ID NO: 13026 - RNA, 18 nt, Homo sapiens
aggcugccuuuccccaug

SEQ ID NO: 13027 - RNA, 17 nt, Homo sapiens
ccaacucaucuugaaua

SEQ ID NO: 13028 - RNA, 18 nt, Homo sapiens
ccucaagauuucuuuaug

SEQ ID NO: 13029 - RNA, 21 nt, Homo sapiens
cuggacuuaaucucuaggggg

SEQ ID NO: 13030 - RNA, 15 nt, Homo sapiens
gagagagagagagag

SEQ ID NO: 13031 - RNA, 18 nt, Homo sapiens
gcgcggcgggcgggcgcc

SEQ ID NO: 13032 - RNA, 19 nt, Homo sapiens
uacaaaaauauuacagcag

SEQ ID NO: 13033 - RNA, 20 nt, Homo sapiens
aggaggaaaaggaagagaua

SEQ ID NO: 13034 - RNA, 18 nt, Homo sapiens
gcuggaggagcagugcaa

SEQ ID NO: 13035 - RNA, 18 nt, Homo sapiens
ggaagggagaaaagauga

SEQ ID NO: 13036 - RNA, 16 nt, Homo sapiens
aggucccagggcccuu

SEQ ID NO: 13037 - RNA, 20 nt, Homo sapiens
guaugaaauauuuauaaaaa

SEQ ID NO: 13038 - RNA, 18 nt, Homo sapiens
ucgcccccgcccgcacuc

SEQ ID NO: 13039 - RNA, 24 nt, Homo sapiens
aacaauguaaugacacuugaggaa

SEQ ID NO: 13040 - RNA, 19 nt, Homo sapiens
uaaugcuguguauucaaua

SEQ ID NO: 13041 - RNA, 23 nt, Homo sapiens
uggaaaugugaaauuuguagaau

SEQ ID NO: 13042 - RNA, 22 nt, Homo sapiens
ugucguauuuccugcagcaccu

SEQ ID NO: 13043 - RNA, 18 nt, Homo sapiens
gcuucucugagagaugag

SEQ ID NO: 13044 - RNA, 18 nt, Homo sapiens
uccaguagcugcugcauu

SEQ ID NO: 13045 - RNA, 19 nt, Homo sapiens
cacacuguuugacuuggga

SEQ ID NO: 13046 - RNA, 20 nt, Homo sapiens
cuccaccucuuuucuggaau

SEQ ID NO: 13047 - RNA, 18 nt, Homo sapiens
ggggaggguggggaugug

SEQ ID NO: 13048 - RNA, 19 nt, Homo sapiens
ggggaggguggggaugugg

SEQ ID NO: 13049 - RNA, 18 nt, Homo sapiens
uccaccucuuuucuggaa

SEQ ID NO: 13050 - RNA, 20 nt, Homo sapiens
uuaagccacacuguuugacu

SEQ ID NO: 13051 - RNA, 16 nt, Homo sapiens
cccuaggccccucccc

SEQ ID NO: 13052 - RNA, 17 nt, Homo sapiens
ggagauucaguguggug

SEQ ID NO: 13053 - RNA, 18 nt, Homo sapiens
uguggcucggcuggcgac

SEQ ID NO: 13054 - RNA, 18 nt, Homo sapiens
acgagaaccuucaaagca

SEQ ID NO: 13055 - RNA, 19 nt, Homo sapiens
agcgcaaguggucaaaagu

SEQ ID NO: 13056 - RNA, 16 nt, Homo sapiens
cggggcgcaggaggcc

SEQ ID NO: 13057 - RNA, 19 nt, Homo sapiens
gagcgaacagauuugcaca

SEQ ID NO: 13058 - RNA, 16 nt, Homo sapiens
gccgggucgccgccgc

SEQ ID NO: 13059 - RNA, 22 nt, Homo sapiens
ggaggcggcggcgggcaaggag

SEQ ID NO: 13060 - RNA, 23 nt, Homo sapiens
ggaggcggcggcgggcaaggaga

SEQ ID NO: 13061 - RNA, 23 nt, Homo sapiens
gugacgcggcgccgggucgccgc

SEQ ID NO: 13062 - RNA, 22 nt, Homo sapiens
ugaagauaaaauacggucccug

SEQ ID NO: 13063 - RNA, 18 nt, Homo sapiens
aauaugcuaauagacagc

SEQ ID NO: 13064 - RNA, 19 nt, Homo sapiens
aggcgcggggagcggcgga

SEQ ID NO: 13065 - RNA, 17 nt, Homo sapiens
cuaucugucccaagcca

SEQ ID NO: 13066 - RNA, 19 nt, Homo sapiens
gagcagaggcaauauacau

SEQ ID NO: 13067 - RNA, 21 nt, Homo sapiens
gcagauccguugugcggccgg

SEQ ID NO: 13068 - RNA, 21 nt, Homo sapiens
gcgcgccgcuggcugaugccc

SEQ ID NO: 13069 - RNA, 19 nt, Homo sapiens
gcgggggaggagguccaag

SEQ ID NO: 13070 - RNA, 18 nt, Homo sapiens
gggagcggcggacgcgga

SEQ ID NO: 13071 - RNA, 22 nt, Homo sapiens
gggcagcggcggccgccgggag

SEQ ID NO: 13072 - RNA, 21 nt, Homo sapiens
ggggagcggcggacgcggagc

SEQ ID NO: 13073 - RNA, 21 nt, Homo sapiens
uaaaaauaaauuauuucugaa

SEQ ID NO: 13074 - RNA, 18 nt, Homo sapiens
ucgccacccacccucacc

SEQ ID NO: 13075 - RNA, 19 nt, Homo sapiens
uggcugcgguggcuuccug

SEQ ID NO: 13076 - RNA, 16 nt, Homo sapiens
ugggacgcgggcucuc

SEQ ID NO: 13077 - RNA, 22 nt, Homo sapiens
uguacauuucuacaacguccau

SEQ ID NO: 13078 - RNA, 18 nt, Homo sapiens
guuguccagaauucuggc

SEQ ID NO: 13079 - RNA, 21 nt, Homo sapiens
uauuuuacaaaagcuuugaag

SEQ ID NO: 13080 - RNA, 18 nt, Homo sapiens
acgggcccagggacagca

SEQ ID NO: 13081 - RNA, 18 nt, Homo sapiens
cauccgggagugcccggu

SEQ ID NO: 13082 - RNA, 19 nt, Homo sapiens
ccccaccugggcagcgguc

SEQ ID NO: 13083 - RNA, 21 nt, Homo sapiens
ccgcccggcuccggccccucg

SEQ ID NO: 13084 - RNA, 20 nt, Homo sapiens
ccguccccuccuuuucucua

SEQ ID NO: 13085 - RNA, 21 nt, Homo sapiens
cgggcccgcccggcuccggcc

SEQ ID NO: 13086 - RNA, 18 nt, Homo sapiens
cuuuugucucagaguagg

SEQ ID NO: 13087 - RNA, 19 nt, Homo sapiens
ggcuggcggggcuuacagg

SEQ ID NO: 13088 - RNA, 17 nt, Homo sapiens
gggcugcuaaggguuug

SEQ ID NO: 13089 - RNA, 19 nt, Homo sapiens
ggggaggggagggacucgg

SEQ ID NO: 13090 - RNA, 17 nt, Homo sapiens
ucaaagcaggcaccagc

SEQ ID NO: 13091 - RNA, 18 nt, Homo sapiens
ucagagagggaagccaga

SEQ ID NO: 13092 - RNA, 19 nt, Homo sapiens
ucgggaaaugcugggcugc

SEQ ID NO: 13093 - RNA, 24 nt, Homo sapiens
ccggaacccgcgcggggagggaag

SEQ ID NO: 13094 - RNA, 22 nt, Homo sapiens
cgcggggagggaagggcggucc

SEQ ID NO: 13095 - RNA, 17 nt, Homo sapiens
gagagagaaggaaaaua

SEQ ID NO: 13096 - RNA, 19 nt, Homo sapiens
gcccucucgccgggcccgg

SEQ ID NO: 13097 - RNA, 20 nt, Homo sapiens
gccucggcugucgucgcgcc

SEQ ID NO: 13098 - RNA, 22 nt, Homo sapiens
uacaauauaaguuauaugcaau

SEQ ID NO: 13099 - RNA, 18 nt, Homo sapiens
ucgguggggggaugggaa

SEQ ID NO: 13100 - RNA, 17 nt, Homo sapiens
ugauuugcuuucggugg

SEQ ID NO: 13101 - RNA, 16 nt, Homo sapiens
ugggaggucggggggc

SEQ ID NO: 13102 - RNA, 17 nt, Homo sapiens
uugagagagaaggaaaa

SEQ ID NO: 13103 - RNA, 18 nt, Homo sapiens
uugagagagaaggaaaau

SEQ ID NO: 13104 - RNA, 19 nt, Homo sapiens
uuuucuuuuuuuuauuuuc

SEQ ID NO: 13105 - RNA, 17 nt, Homo sapiens
acuccggaaaaucccaa

SEQ ID NO: 13106 - RNA, 20 nt, Homo sapiens
caggggacaaggacaucuug

SEQ ID NO: 13107 - RNA, 21 nt, Homo sapiens
ccggcagcagggggaaggcac

SEQ ID NO: 13108 - RNA, 16 nt, Homo sapiens
ccuccaagucccaggu

SEQ ID NO: 13109 - RNA, 20 nt, Homo sapiens
cgacuucaaguuucuuccca

SEQ ID NO: 13110 - RNA, 19 nt, Homo sapiens
cgggcuggagcaggggucc

SEQ ID NO: 13111 - RNA, 21 nt, Homo sapiens
gaagggugggcucccuccagu

SEQ ID NO: 13112 - RNA, 19 nt, Homo sapiens
gcucccggcuucggugucc

SEQ ID NO: 13113 - RNA, 20 nt, Homo sapiens
uucccaguuguuguucugga

SEQ ID NO: 13114 - RNA, 18 nt, Homo sapiens
acuaucauaagcuuuaac

SEQ ID NO: 13115 - RNA, 21 nt, Homo sapiens
agagguaaaugcaucuuuguu

SEQ ID NO: 13116 - RNA, 18 nt, Homo sapiens
cacguggcuagcagguga

SEQ ID NO: 13117 - RNA, 20 nt, Homo sapiens
cacuuucauauuuuaaagcu

SEQ ID NO: 13118 - RNA, 19 nt, Homo sapiens
aggagggaggggagcagcu

SEQ ID NO: 13119 - RNA, 23 nt, Homo sapiens
aggggagcagcuggggugguggg

SEQ ID NO: 13120 - RNA, 19 nt, Homo sapiens
cagaggcuggggcggccug

SEQ ID NO: 13121 - RNA, 20 nt, Homo sapiens
cugggcaggugacugcccca

SEQ ID NO: 13122 - RNA, 16 nt, Homo sapiens
gaguucaaggucagcc

SEQ ID NO: 13123 - RNA, 15 nt, Homo sapiens
ggcuggggcggccug

SEQ ID NO: 13124 - RNA, 25 nt, Homo sapiens
ggggagcagcuggggugguggggag

SEQ ID NO: 13125 - RNA, 21 nt, Homo sapiens
ggugggugccgucuggcaggc

SEQ ID NO: 13126 - RNA, 19 nt, Homo sapiens
gugcacugggguggacgug

SEQ ID NO: 13127 - RNA, 17 nt, Homo sapiens
ugagucaucgcucagga

SEQ ID NO: 13128 - RNA, 19 nt, Homo sapiens
uggggagagggaaggaccc

SEQ ID NO: 13129 - RNA, 21 nt, Homo sapiens
ccggcuccggcuacugcggcc

SEQ ID NO: 13130 - RNA, 17 nt, Homo sapiens
cgccgcgcggcuggagc

SEQ ID NO: 13131 - RNA, 20 nt, Homo sapiens
cggcggcugggcggcggcgg

SEQ ID NO: 13132 - RNA, 18 nt, Homo sapiens
gcugcggcuccggcuccg

SEQ ID NO: 13133 - RNA, 21 nt, Homo sapiens
ggcugcggcuccggcuccggc

SEQ ID NO: 13134 - RNA, 23 nt, Homo sapiens
uaaugaauuuuuuuuggaaauaa

SEQ ID NO: 13135 - RNA, 22 nt, Homo sapiens
ucauauugaaggaaauuacagg

SEQ ID NO: 13136 - RNA, 19 nt, Homo sapiens
uggauugauauggaggcaa

SEQ ID NO: 13137 - RNA, 15 nt, Homo sapiens
aagcaggauguaugu

SEQ ID NO: 13138 - RNA, 16 nt, Homo sapiens
cagugcugcugugugu

SEQ ID NO: 13139 - RNA, 24 nt, Homo sapiens
ccucugggcuccuggaaguggcag

SEQ ID NO: 13140 - RNA, 15 nt, Homo sapiens
gggaaccccaagggc

SEQ ID NO: 13141 - RNA, 18 nt, Homo sapiens
uaugugugugugugugug

SEQ ID NO: 13142 - RNA, 18 nt, Homo sapiens
ucacagcaauaaagaaaa

SEQ ID NO: 13143 - RNA, 18 nt, Homo sapiens
ugagagaagacaggggag

SEQ ID NO: 13144 - RNA, 19 nt, Homo sapiens
ugcugcugugugucaccau

SEQ ID NO: 13145 - RNA, 18 nt, Homo sapiens
uguaugugugugugugug

SEQ ID NO: 13146 - RNA, 18 nt, Homo sapiens
ugugugugugugugugug

SEQ ID NO: 13147 - RNA, 20 nt, Homo sapiens
ugugugugugugugugugua

SEQ ID NO: 13148 - RNA, 20 nt, Homo sapiens
cauccagaagaaaaccaaga

SEQ ID NO: 13149 - RNA, 16 nt, Homo sapiens
gaccuuucacagaauu

SEQ ID NO: 13150 - RNA, 20 nt, Homo sapiens
agcuuucugggagagggcga

SEQ ID NO: 13151 - RNA, 18 nt, Homo sapiens
aggggacagacagcggcc

SEQ ID NO: 13152 - RNA, 20 nt, Homo sapiens
auagggaaaaaaaggagggu

SEQ ID NO: 13153 - RNA, 21 nt, Homo sapiens
cagacagcggccggcccgggg

SEQ ID NO: 13154 - RNA, 17 nt, Homo sapiens
cagcuggagcgcgaccc

SEQ ID NO: 13155 - RNA, 19 nt, Homo sapiens
gcuuugggcaguuacacag

SEQ ID NO: 13156 - RNA, 17 nt, Homo sapiens
guagaugaaaugaagga

SEQ ID NO: 13157 - RNA, 19 nt, Homo sapiens
uacauuuaaauauaaaaau

SEQ ID NO: 13158 - RNA, 20 nt, Homo sapiens
ucgccgagcaggcgggcggg

SEQ ID NO: 13159 - RNA, 16 nt, Homo sapiens
cccgccgccuccagcc

SEQ ID NO: 13160 - RNA, 22 nt, Homo sapiens
aggcggggcgggccggcccggg

SEQ ID NO: 13161 - RNA, 21 nt, Homo sapiens
ccccggccugcgugcugggcg

SEQ ID NO: 13162 - RNA, 19 nt, Homo sapiens
ccgccucggccgccgcccg

SEQ ID NO: 13163 - RNA, 15 nt, Homo sapiens
gcccgccgcggcccc

SEQ ID NO: 13164 - RNA, 15 nt, Homo sapiens
agaaagguccuucug

SEQ ID NO: 13165 - RNA, 20 nt, Homo sapiens
ggagaaauuugaauuaucua

SEQ ID NO: 13166 - RNA, 20 nt, Homo sapiens
ggcagacagcaacgggcggc

SEQ ID NO: 13167 - RNA, 17 nt, Homo sapiens
gugggguggggagugcu

SEQ ID NO: 13168 - RNA, 18 nt, Homo sapiens
guugcugcaagacucuag

SEQ ID NO: 13169 - RNA, 22 nt, Homo sapiens
uuauguuauuuccaaagccauc

SEQ ID NO: 13170 - RNA, 17 nt, Homo sapiens
acaggacacauuuugca

SEQ ID NO: 13171 - RNA, 23 nt, Homo sapiens
ccagcagcgacucugaaugugac

SEQ ID NO: 13172 - RNA, 16 nt, Homo sapiens
uaaauggcuguaagga

SEQ ID NO: 13173 - RNA, 19 nt, Homo sapiens
agaggaaaugugcugggac

SEQ ID NO: 13174 - RNA, 18 nt, Homo sapiens
ccgcccggucgcgcgucc

SEQ ID NO: 13175 - RNA, 21 nt, Homo sapiens
ccgccgcccggucgcgcgucc

SEQ ID NO: 13176 - RNA, 27 nt, Homo sapiens
ggcagggcgggugucuagcggcgcgcg

SEQ ID NO: 13177 - RNA, 19 nt, Homo sapiens
uccgcugcagcccgccggc

SEQ ID NO: 13178 - RNA, 18 nt, Homo sapiens
agggucccagcagggccu

SEQ ID NO: 13179 - RNA, 18 nt, Homo sapiens
cagggucccagcagggcc

SEQ ID NO: 13180 - RNA, 15 nt, Homo sapiens
gacaccccguggguu

SEQ ID NO: 13181 - RNA, 17 nt, Homo sapiens
gagagggagggagaucu

SEQ ID NO: 13182 - RNA, 22 nt, Homo sapiens
gcccccuguuuucugccccugg

SEQ ID NO: 13183 - RNA, 16 nt, Homo sapiens
uagcacgcguuggggc

SEQ ID NO: 13184 - RNA, 19 nt, Homo sapiens
uccggcagugccucuccuc

SEQ ID NO: 13185 - RNA, 18 nt, Homo sapiens
uccguaaauauuuauguu

SEQ ID NO: 13186 - RNA, 18 nt, Homo sapiens
ugccaucuccagaugugu

SEQ ID NO: 13187 - RNA, 18 nt, Homo sapiens
uggcaagggcuccggcag

SEQ ID NO: 13188 - RNA, 21 nt, Homo sapiens
ugggacaggaaggcccagauc

SEQ ID NO: 13189 - RNA, 16 nt, Homo sapiens
ugggcuuguagugacc

SEQ ID NO: 13190 - RNA, 21 nt, Homo sapiens
ugucccgcgaggcuggcgcag

SEQ ID NO: 13191 - RNA, 17 nt, Homo sapiens
ugugugcaugugugugu

SEQ ID NO: 13192 - RNA, 21 nt, Homo sapiens
ugugugugcaugugugugugu

SEQ ID NO: 13193 - RNA, 24 nt, Homo sapiens
uguuguauugguuuuugcugcaua

SEQ ID NO: 13194 - RNA, 18 nt, Homo sapiens
uucucuuucccccguaca

SEQ ID NO: 13195 - RNA, 18 nt, Homo sapiens
acagagcagcaacgagaa

SEQ ID NO: 13196 - RNA, 22 nt, Homo sapiens
agcauuucuacagcaugcgauu

SEQ ID NO: 13197 - RNA, 26 nt, Homo sapiens
aggagugcggggggcggggcgggggg

SEQ ID NO: 13198 - RNA, 21 nt, Homo sapiens
ccacucccggccccgcucccc

SEQ ID NO: 13199 - RNA, 18 nt, Homo sapiens
cccggccccgcuccccac

SEQ ID NO: 13200 - RNA, 24 nt, Homo sapiens
ccgccgccgccgccgccuccgucc

SEQ ID NO: 13201 - RNA, 19 nt, Homo sapiens
ccgccgccucggccgccgc

SEQ ID NO: 13202 - RNA, 19 nt, Homo sapiens
ccgccucggccgccgcucg

SEQ ID NO: 13203 - RNA, 18 nt, Homo sapiens
ccucccucucucucccuc

SEQ ID NO: 13204 - RNA, 16 nt, Homo sapiens
gagcauuucuacagca

SEQ ID NO: 13205 - RNA, 21 nt, Homo sapiens
gcaggugcgcgccggcgaggc

SEQ ID NO: 13206 - RNA, 15 nt, Homo sapiens
gcggggggcggggcg

SEQ ID NO: 13207 - RNA, 17 nt, Homo sapiens
ggggggcggggcggggg

SEQ ID NO: 13208 - RNA, 19 nt, Homo sapiens
uaucuugcauccagcuucc

SEQ ID NO: 13209 - RNA, 21 nt, Homo sapiens
uauuuucaaaacauugauuug

SEQ ID NO: 13210 - RNA, 16 nt, Homo sapiens
uccagucccgccgcgg

SEQ ID NO: 13211 - RNA, 17 nt, Homo sapiens
ucgcggccugacgcgcc

SEQ ID NO: 13212 - RNA, 18 nt, Homo sapiens
ucggccgccgcucggcag

SEQ ID NO: 13213 - RNA, 15 nt, Homo sapiens
ugccacaaaacaggg

SEQ ID NO: 13214 - RNA, 21 nt, Homo sapiens
ugcgggcaggugcgcgccggc

SEQ ID NO: 13215 - RNA, 16 nt, Homo sapiens
aaagguagaaaaagga

SEQ ID NO: 13216 - RNA, 21 nt, Homo sapiens
aggcugugaggacugugggga

SEQ ID NO: 13217 - RNA, 19 nt, Homo sapiens
cggcgggggguuggggggg

SEQ ID NO: 13218 - RNA, 19 nt, Homo sapiens
gaacaccugaaugagaugg

SEQ ID NO: 13219 - RNA, 21 nt, Homo sapiens
gagaaagcaugaauaagaaga

SEQ ID NO: 13220 - RNA, 19 nt, Homo sapiens
gaucuggauaauccuucuu

SEQ ID NO: 13221 - RNA, 19 nt, Homo sapiens
gcccgcgcccgcccgucac

SEQ ID NO: 13222 - RNA, 17 nt, Homo sapiens
ggacuguggggagggaa

SEQ ID NO: 13223 - RNA, 21 nt, Homo sapiens
ucagcugcgacgcccgcgccc

SEQ ID NO: 13224 - RNA, 17 nt, Homo sapiens
caccacauagaagcacg

SEQ ID NO: 13225 - RNA, 20 nt, Homo sapiens
gccgguuuaaacagaggcug

SEQ ID NO: 13226 - RNA, 21 nt, Homo sapiens
ugcuuugaccuccaaaggcuc

SEQ ID NO: 13227 - RNA, 22 nt, Homo sapiens
uggggccgguuuaaacagaggc

SEQ ID NO: 13228 - RNA, 18 nt, Homo sapiens
ugucaugauuaaauaucc

SEQ ID NO: 13229 - RNA, 20 nt, Homo sapiens
aaggcaggcgaggccaggcc

SEQ ID NO: 13230 - RNA, 22 nt, Homo sapiens
agccaaggucccggcgcgcgcg

SEQ ID NO: 13231 - RNA, 23 nt, Homo sapiens
agcuggggggagggcuaggcagc

SEQ ID NO: 13232 - RNA, 17 nt, Homo sapiens
aggaggcggggaggaag

SEQ ID NO: 13233 - RNA, 18 nt, Homo sapiens
aguccccagcccacccug

SEQ ID NO: 13234 - RNA, 18 nt, Homo sapiens
agugggaggaggcgggga

SEQ ID NO: 13235 - RNA, 19 nt, Homo sapiens
agugggaggaggcggggag

SEQ ID NO: 13236 - RNA, 14 nt, Homo sapiens
caccgugaacaggg

SEQ ID NO: 13237 - RNA, 16 nt, Homo sapiens
cagccaccagcauccc

SEQ ID NO: 13238 - RNA, 17 nt, Homo sapiens
cccgcccgcgccucucc

SEQ ID NO: 13239 - RNA, 18 nt, Homo sapiens
ccucagcccucggggucc

SEQ ID NO: 13240 - RNA, 20 nt, Homo sapiens
cggcggcggcgcggggcgcg

SEQ ID NO: 13241 - RNA, 18 nt, Homo sapiens
cggcggcggcggcggcgc

SEQ ID NO: 13242 - RNA, 19 nt, Homo sapiens
cggcggcggcggcggcgcg

SEQ ID NO: 13243 - RNA, 19 nt, Homo sapiens
cgggguccuccaacagccc

SEQ ID NO: 13244 - RNA, 21 nt, Homo sapiens
cuugccuguguugggggcucc

SEQ ID NO: 13245 - RNA, 19 nt, Homo sapiens
gcccagcuuccccuccucc

SEQ ID NO: 13246 - RNA, 21 nt, Homo sapiens
gcgcgcgcggcucgcggucca

SEQ ID NO: 13247 - RNA, 20 nt, Homo sapiens
gcgcgcggggugcgaggucc

SEQ ID NO: 13248 - RNA, 23 nt, Homo sapiens
gcgguccagaggcggcggcggcc

SEQ ID NO: 13249 - RNA, 24 nt, Homo sapiens
gcugacacugagcgguggggggac

SEQ ID NO: 13250 - RNA, 21 nt, Homo sapiens
gcuggggggugggccagggcu

SEQ ID NO: 13251 - RNA, 18 nt, Homo sapiens
gcuuuugggcacacuggc

SEQ ID NO: 13252 - RNA, 21 nt, Homo sapiens
ggagcuggggggagggcuagg

SEQ ID NO: 13253 - RNA, 19 nt, Homo sapiens
ggccucugucccuggggcc

SEQ ID NO: 13254 - RNA, 23 nt, Homo sapiens
ggcggcggcgcggggcgcgcggg

SEQ ID NO: 13255 - RNA, 19 nt, Homo sapiens
ggcggcggcggcggcgcgg

SEQ ID NO: 13256 - RNA, 17 nt, Homo sapiens
gguggacuugccugugu

SEQ ID NO: 13257 - RNA, 20 nt, Homo sapiens
guuguauuuuuggcaaaguc

SEQ ID NO: 13258 - RNA, 19 nt, Homo sapiens
uccaaggugggcccugcgg

SEQ ID NO: 13259 - RNA, 23 nt, Homo sapiens
ucucucggauccuggccgggucc

SEQ ID NO: 13260 - RNA, 17 nt, Homo sapiens
ugacaggaggucaccag

SEQ ID NO: 13261 - RNA, 18 nt, Homo sapiens
uggaggcugggggguggg

SEQ ID NO: 13262 - RNA, 21 nt, Homo sapiens
ugggagcaggcggguccuggc

SEQ ID NO: 13263 - RNA, 17 nt, Homo sapiens
ugggaggagcgaacagc

SEQ ID NO: 13264 - RNA, 23 nt, Homo sapiens
ugggaggaggcggggaggaaggc

SEQ ID NO: 13265 - RNA, 25 nt, Homo sapiens
uuuuuggcaaagucaguccuuggcc

SEQ ID NO: 13266 - RNA, 16 nt, Homo sapiens
accaggcugugggagc

SEQ ID NO: 13267 - RNA, 19 nt, Homo sapiens
agaggcagaccuaucuggg

SEQ ID NO: 13268 - RNA, 21 nt, Homo sapiens
cagucugggaagggccagggc

SEQ ID NO: 13269 - RNA, 18 nt, Homo sapiens
cgcacacaggaaggggcg

SEQ ID NO: 13270 - RNA, 22 nt, Homo sapiens
gcugagggacggaggacacugg

SEQ ID NO: 13271 - RNA, 20 nt, Homo sapiens
ggaauguuugaggguugacc

SEQ ID NO: 13272 - RNA, 18 nt, Homo sapiens
gucccagggauggcccag

SEQ ID NO: 13273 - RNA, 19 nt, Homo sapiens
uauugcugggcacaugugu

SEQ ID NO: 13274 - RNA, 19 nt, Homo sapiens
ugcuggugggggccucggg

SEQ ID NO: 13275 - RNA, 21 nt, Homo sapiens
ugcuggugggggccucgggcu

SEQ ID NO: 13276 - RNA, 22 nt, Homo sapiens
acacaaucacgcauaccuguag

SEQ ID NO: 13277 - RNA, 20 nt, Homo sapiens
cugaucccuggccaccgucc

SEQ ID NO: 13278 - RNA, 19 nt, Homo sapiens
gagcugguuuuuccuuugg

SEQ ID NO: 13279 - RNA, 19 nt, Homo sapiens
ggcaucccugcccaggggc

SEQ ID NO: 13280 - RNA, 20 nt, Homo sapiens
ugaggggugagggcacgucc

SEQ ID NO: 13281 - RNA, 23 nt, Homo sapiens
cagcaggccaugggaccuuccuc

SEQ ID NO: 13282 - RNA, 21 nt, Homo sapiens
gcagguuugcaggcaggccgu

SEQ ID NO: 13283 - RNA, 19 nt, Homo sapiens
uccccucguccagccgacc

SEQ ID NO: 13284 - RNA, 17 nt, Homo sapiens
uggaaggcuccaagggc

SEQ ID NO: 13285 - RNA, 19 nt, Homo sapiens
aaagugagagggucacagg

SEQ ID NO: 13286 - RNA, 17 nt, Homo sapiens
aagggagggaggagggc

SEQ ID NO: 13287 - RNA, 19 nt, Homo sapiens
gugacccggccagguguuc

SEQ ID NO: 13288 - RNA, 23 nt, Homo sapiens
ucacuuucuuuaaauaauugcuu

SEQ ID NO: 13289 - RNA, 15 nt, Homo sapiens
agggcacccuccgag

SEQ ID NO: 13290 - RNA, 18 nt, Homo sapiens
agggcugcagagucuuca

SEQ ID NO: 13291 - RNA, 23 nt, Homo sapiens
cacaaacaccccuguggauaggg

SEQ ID NO: 13292 - RNA, 19 nt, Homo sapiens
cgguccuugggcagcagca

SEQ ID NO: 13293 - RNA, 15 nt, Homo sapiens
gaguggggucccgag

SEQ ID NO: 13294 - RNA, 21 nt, Homo sapiens
ggguccacugaaacggggagg

SEQ ID NO: 13295 - RNA, 20 nt, Homo sapiens
agugggucuuaagagccauu

SEQ ID NO: 13296 - RNA, 21 nt, Homo sapiens
gggaaggagugaccggagaag

SEQ ID NO: 13297 - RNA, 16 nt, Homo sapiens
gggucuuaagagccau

SEQ ID NO: 13298 - RNA, 18 nt, Homo sapiens
ugaggauugagagugacu

SEQ ID NO: 13299 - RNA, 18 nt, Homo sapiens
gacgggaagcccuuggag

SEQ ID NO: 13300 - RNA, 15 nt, Homo sapiens
gcccuuggagcgcgc

SEQ ID NO: 13301 - RNA, 20 nt, Homo sapiens
aaguaacuggugguuuuucc

SEQ ID NO: 13302 - RNA, 19 nt, Homo sapiens
cagcauuaaguucucccac

SEQ ID NO: 13303 - RNA, 18 nt, Homo sapiens
uauguugggguguuaggu

SEQ ID NO: 13304 - RNA, 19 nt, Homo sapiens
caaugacuguuccucuuga

SEQ ID NO: 13305 - RNA, 16 nt, Homo sapiens
cacaguauugugcagg

SEQ ID NO: 13306 - RNA, 20 nt, Homo sapiens
cccggccggagaggaguggg

SEQ ID NO: 13307 - RNA, 21 nt, Homo sapiens
ccuuuguaacaugugcacaca

SEQ ID NO: 13308 - RNA, 15 nt, Homo sapiens
cugccggcuccgugg

SEQ ID NO: 13309 - RNA, 25 nt, Homo sapiens
gacggcacgaacucggcggcgugga

SEQ ID NO: 13310 - RNA, 16 nt, Homo sapiens
gagugggcaacgcuga

SEQ ID NO: 13311 - RNA, 20 nt, Homo sapiens
gcccggcccgggggcuucca

SEQ ID NO: 13312 - RNA, 23 nt, Homo sapiens
uccgugguuauuggcggcgccgc

SEQ ID NO: 13313 - RNA, 19 nt, Homo sapiens
ugagggaaggcggcggggc

SEQ ID NO: 13314 - RNA, 19 nt, Homo sapiens
ugugugguggacagagagc

SEQ ID NO: 13315 - RNA, 18 nt, Homo sapiens
aaaaacacagcaaagaca

SEQ ID NO: 13316 - RNA, 20 nt, Homo sapiens
ccgcccccuuccugcgccuc

SEQ ID NO: 13317 - RNA, 21 nt, Homo sapiens
gcggcggcggcggcagcggcg

SEQ ID NO: 13318 - RNA, 21 nt, Homo sapiens
uaacagggaacaucacauugc

SEQ ID NO: 13319 - RNA, 16 nt, Homo sapiens
uccgccucggccggcc

SEQ ID NO: 13320 - RNA, 24 nt, Homo sapiens
ccgacccggguuccuuucgucucc

SEQ ID NO: 13321 - RNA, 18 nt, Homo sapiens
uggcgugcgcgucccucg

SEQ ID NO: 13322 - RNA, 23 nt, Homo sapiens
ggugcagccaguuugcauaaaga

SEQ ID NO: 13323 - RNA, 17 nt, Homo sapiens
uacaggcagcaugcagg

SEQ ID NO: 13324 - RNA, 21 nt, Homo sapiens
ccugcuguuccccccaaaugu

SEQ ID NO: 13325 - RNA, 18 nt, Homo sapiens
gagcugauguuguccugc

SEQ ID NO: 13326 - RNA, 16 nt, Homo sapiens
ucucccaccuccgugg

SEQ ID NO: 13327 - RNA, 19 nt, Homo sapiens
uuuccuugcuuccccagcc

SEQ ID NO: 13328 - RNA, 16 nt, Homo sapiens
aggccacauccucaug

SEQ ID NO: 13329 - RNA, 18 nt, Homo sapiens
aggccacauccucaugcc

SEQ ID NO: 13330 - RNA, 19 nt, Homo sapiens
cacgagcuggcuccugaag

SEQ ID NO: 13331 - RNA, 18 nt, Homo sapiens
agucaacugguggagagc

SEQ ID NO: 13332 - RNA, 22 nt, Homo sapiens
gguguggucagcugcugucccu

SEQ ID NO: 13333 - RNA, 21 nt, Homo sapiens
ugaggaagguuacaauaagaa

SEQ ID NO: 13334 - RNA, 17 nt, Homo sapiens
uggagagcuuguugaag

SEQ ID NO: 13335 - RNA, 19 nt, Homo sapiens
uggucagcugcugucccuu

SEQ ID NO: 13336 - RNA, 24 nt, Homo sapiens
uuuauauucauuccuuaucuccuu

SEQ ID NO: 13337 - RNA, 16 nt, Homo sapiens
aucucaggcugggucc

SEQ ID NO: 13338 - RNA, 18 nt, Homo sapiens
aaagagagaagggagaau

SEQ ID NO: 13339 - RNA, 19 nt, Homo sapiens
aaagagcacuucugccaca

SEQ ID NO: 13340 - RNA, 20 nt, Homo sapiens
accagcaggugacuaucagg

SEQ ID NO: 13341 - RNA, 22 nt, Homo sapiens
agacaaaacacagcucagugac

SEQ ID NO: 13342 - RNA, 16 nt, Homo sapiens
caagaugucagcugga

SEQ ID NO: 13343 - RNA, 16 nt, Homo sapiens
cagcagcugugguccc

SEQ ID NO: 13344 - RNA, 18 nt, Homo sapiens
caucagcagcagcccggc

SEQ ID NO: 13345 - RNA, 21 nt, Homo sapiens
ccgcccggcacggcagucccc

SEQ ID NO: 13346 - RNA, 20 nt, Homo sapiens
ccggccccagcugccgccuc

SEQ ID NO: 13347 - RNA, 21 nt, Homo sapiens
cucagagcugcugacauaacc

SEQ ID NO: 13348 - RNA, 20 nt, Homo sapiens
cugcugucccugacuggugg

SEQ ID NO: 13349 - RNA, 15 nt, Homo sapiens
cuugccuggcucgcc

SEQ ID NO: 13350 - RNA, 23 nt, Homo sapiens
gacugguggguggagaacgacag

SEQ ID NO: 13351 - RNA, 22 nt, Homo sapiens
gaggcugcugucccugacuggu

SEQ ID NO: 13352 - RNA, 15 nt, Homo sapiens
gccucaggcucagcc

SEQ ID NO: 13353 - RNA, 18 nt, Homo sapiens
gcgggggaggcgggaggc

SEQ ID NO: 13354 - RNA, 21 nt, Homo sapiens
ggaagcgggggagggacaaag

SEQ ID NO: 13355 - RNA, 19 nt, Homo sapiens
gggcagaagggaugcuggg

SEQ ID NO: 13356 - RNA, 18 nt, Homo sapiens
gggggaggcgggaggcgg

SEQ ID NO: 13357 - RNA, 20 nt, Homo sapiens
guuauaauucaguagcuucc

SEQ ID NO: 13358 - RNA, 19 nt, Homo sapiens
uacauucacaguguuauuu

SEQ ID NO: 13359 - RNA, 18 nt, Homo sapiens
uacggaagaauggugauu

SEQ ID NO: 13360 - RNA, 21 nt, Homo sapiens
uccauuuuuucccuuuaauuu

SEQ ID NO: 13361 - RNA, 19 nt, Homo sapiens
uccguaggcagguccacgu

SEQ ID NO: 13362 - RNA, 22 nt, Homo sapiens
ucgggccgacucgcggcgccgc

SEQ ID NO: 13363 - RNA, 18 nt, Homo sapiens
ucugggugucuggagggg

SEQ ID NO: 13364 - RNA, 19 nt, Homo sapiens
ugagcaggggcucccuuuc

SEQ ID NO: 13365 - RNA, 20 nt, Homo sapiens
ugaggguggacaguaacaaa

SEQ ID NO: 13366 - RNA, 17 nt, Homo sapiens
uggcuacaggagaggga

SEQ ID NO: 13367 - RNA, 19 nt, Homo sapiens
ugggugaagucauuuuuac

SEQ ID NO: 13368 - RNA, 19 nt, Homo sapiens
ugucugcugggaaggaugc

SEQ ID NO: 13369 - RNA, 18 nt, Homo sapiens
uguguguaaaauuauaga

SEQ ID NO: 13370 - RNA, 22 nt, Homo sapiens
uuccuucuucucacuccuacac

SEQ ID NO: 13371 - RNA, 18 nt, Homo sapiens
cucggcccuuucucacug

SEQ ID NO: 13372 - RNA, 17 nt, Homo sapiens
uucccucuugccagucc

SEQ ID NO: 13373 - RNA, 15 nt, Homo sapiens
uuguauccuauugug

SEQ ID NO: 13374 - RNA, 18 nt, Homo sapiens
auauacauauauaauaua

SEQ ID NO: 13375 - RNA, 18 nt, Homo sapiens
augucagaaaaaugugcu

SEQ ID NO: 13376 - RNA, 18 nt, Homo sapiens
ccgcuccccggucccccg

SEQ ID NO: 13377 - RNA, 22 nt, Homo sapiens
ccggucccccgcuccguccgcc

SEQ ID NO: 13378 - RNA, 19 nt, Homo sapiens
uaaauuauauauauauauu

SEQ ID NO: 13379 - RNA, 15 nt, Homo sapiens
ucccaggaguccugg

SEQ ID NO: 13380 - RNA, 24 nt, Homo sapiens
agugauguggggauacccagcccc

SEQ ID NO: 13381 - RNA, 19 nt, Homo sapiens
cccuugaccccccaaauga

SEQ ID NO: 13382 - RNA, 21 nt, Homo sapiens
uccaccaaaguuuauuucucu

SEQ ID NO: 13383 - RNA, 24 nt, Homo sapiens
ugagugauguggggauacccagcc

SEQ ID NO: 13384 - RNA, 17 nt, Homo sapiens
ugauguggggauaccca

SEQ ID NO: 13385 - RNA, 15 nt, Homo sapiens
ugaagacuguggaga

SEQ ID NO: 13386 - RNA, 16 nt, Homo sapiens
agugaaggagggaggg

SEQ ID NO: 13387 - RNA, 18 nt, Homo sapiens
cagugcaaaaacacacuc

SEQ ID NO: 13388 - RNA, 22 nt, Homo sapiens
ccucguuuugcaaaauguucaa

SEQ ID NO: 13389 - RNA, 18 nt, Homo sapiens
ccugccucgaaccccucg

SEQ ID NO: 13390 - RNA, 19 nt, Homo sapiens
cucuugcuguuaucuacag

SEQ ID NO: 13391 - RNA, 15 nt, Homo sapiens
gcucuagcguacaau

SEQ ID NO: 13392 - RNA, 18 nt, Homo sapiens
gggaaaauauccuacguc

SEQ ID NO: 13393 - RNA, 18 nt, Homo sapiens
uaagcucgaacaugaagc

SEQ ID NO: 13394 - RNA, 19 nt, Homo sapiens
uaguacucuuacuuaucug

SEQ ID NO: 13395 - RNA, 18 nt, Homo sapiens
ucaaauuuuuuccccuua

SEQ ID NO: 13396 - RNA, 15 nt, Homo sapiens
ucucuguacaacauu

SEQ ID NO: 13397 - RNA, 17 nt, Homo sapiens
ugaaggagggaggggau

SEQ ID NO: 13398 - RNA, 22 nt, Homo sapiens
ugagggaaggggaacaacaaaa

SEQ ID NO: 13399 - RNA, 17 nt, Homo sapiens
ugugucagugauagggc

SEQ ID NO: 13400 - RNA, 21 nt, Homo sapiens
cuucauacuuacuugcagccu

SEQ ID NO: 13401 - RNA, 17 nt, Homo sapiens
gugagcucccccauggc

SEQ ID NO: 13402 - RNA, 20 nt, Homo sapiens
gugagcucccccauggcucc

SEQ ID NO: 13403 - RNA, 18 nt, Homo sapiens
uggaacaggaaaggugau

SEQ ID NO: 13404 - RNA, 15 nt, Homo sapiens
cagagugguauucag

SEQ ID NO: 13405 - RNA, 16 nt, Homo sapiens
caggcaagguuagugg

SEQ ID NO: 13406 - RNA, 20 nt, Homo sapiens
uuugugcugugcaccaacaa

SEQ ID NO: 13407 - RNA, 18 nt, Homo sapiens
cuucccucacggggcucc

SEQ ID NO: 13408 - RNA, 15 nt, Homo sapiens
uccgcguccaccugg

SEQ ID NO: 13409 - RNA, 19 nt, Homo sapiens
uuagcaaaauaauugccug

SEQ ID NO: 13410 - RNA, 22 nt, Homo sapiens
caggaacugaggaugcugaagg

SEQ ID NO: 13411 - RNA, 23 nt, Homo sapiens
cccugcuauaaaaacaacagaac

SEQ ID NO: 13412 - RNA, 22 nt, Homo sapiens
ugaaacucagggcuuuuggagg

SEQ ID NO: 13413 - RNA, 19 nt, Homo sapiens
uggucauggccgugucaac

SEQ ID NO: 13414 - RNA, 24 nt, Homo sapiens
agucucagccuggucccugguccc

SEQ ID NO: 13415 - RNA, 20 nt, Homo sapiens
gaaggaggcaguggggagaa

SEQ ID NO: 13416 - RNA, 17 nt, Homo sapiens
ggaaggaggguaggaag

SEQ ID NO: 13417 - RNA, 18 nt, Homo sapiens
ggaaggaggguaggaaga

SEQ ID NO: 13418 - RNA, 17 nt, Homo sapiens
ggagcagucccacagga

SEQ ID NO: 13419 - RNA, 17 nt, Homo sapiens
gcugcaguagccuauag

SEQ ID NO: 13420 - RNA, 19 nt, Homo sapiens
aggcaggcuggcuuucugg

SEQ ID NO: 13421 - RNA, 15 nt, Homo sapiens
ccagggggaccgugu

SEQ ID NO: 13422 - RNA, 17 nt, Homo sapiens
ccccuuugggggagggg

SEQ ID NO: 13423 - RNA, 21 nt, Homo sapiens
ccuagaauccuucucuccccu

SEQ ID NO: 13424 - RNA, 19 nt, Homo sapiens
cgugggucuguguguaucc

SEQ ID NO: 13425 - RNA, 18 nt, Homo sapiens
gagcuccgugggucugug

SEQ ID NO: 13426 - RNA, 21 nt, Homo sapiens
ggggaggggucgggccuuggg

SEQ ID NO: 13427 - RNA, 15 nt, Homo sapiens
ucuguguguauccaa

SEQ ID NO: 13428 - RNA, 18 nt, Homo sapiens
uggggugggaaggguggc

SEQ ID NO: 13429 - RNA, 18 nt, Homo sapiens
gccuggguugggagagcc

SEQ ID NO: 13430 - RNA, 25 nt, Homo sapiens
acuuuccccuuuuccuauuauuaaa

SEQ ID NO: 13431 - RNA, 17 nt, Homo sapiens
caauggugggggagggg

SEQ ID NO: 13432 - RNA, 16 nt, Homo sapiens
cggaagggaccccccc

SEQ ID NO: 13433 - RNA, 23 nt, Homo sapiens
ggauuaaacgcuaauucaguaau

SEQ ID NO: 13434 - RNA, 17 nt, Homo sapiens
ggcugcuggggggggcg

SEQ ID NO: 13435 - RNA, 23 nt, Homo sapiens
ggggagggggcugcugggggggg

SEQ ID NO: 13436 - RNA, 24 nt, Homo sapiens
gggggagggggcugcugggggggg

SEQ ID NO: 13437 - RNA, 18 nt, Homo sapiens
aaggccauugccguucuc

SEQ ID NO: 13438 - RNA, 14 nt, Homo sapiens
acgccggacccccc

SEQ ID NO: 13439 - RNA, 17 nt, Homo sapiens
gccccccuccuccgggg

SEQ ID NO: 13440 - RNA, 17 nt, Homo sapiens
ggaacaagggguggaag

SEQ ID NO: 13441 - RNA, 17 nt, Homo sapiens
gggggaagggaaggagc

SEQ ID NO: 13442 - RNA, 21 nt, Homo sapiens
uccauacugucauguguguuu

SEQ ID NO: 13443 - RNA, 23 nt, Homo sapiens
ucucccggaccuguuuuuuuuuu

SEQ ID NO: 13444 - RNA, 18 nt, Homo sapiens
caccucaacugcugcccc

SEQ ID NO: 13445 - RNA, 18 nt, Homo sapiens
cucagcuugaccccacug

SEQ ID NO: 13446 - RNA, 18 nt, Homo sapiens
cugacccagacuaucccc

SEQ ID NO: 13447 - RNA, 21 nt, Homo sapiens
gagaguucacauuaaacaugc

SEQ ID NO: 13448 - RNA, 21 nt, Homo sapiens
ggccaaauauggggggggggu

SEQ ID NO: 13449 - RNA, 18 nt, Homo sapiens
ggcggcggcagagcgggg

SEQ ID NO: 13450 - RNA, 19 nt, Homo sapiens
gggcuggggguggcacggg

SEQ ID NO: 13451 - RNA, 20 nt, Homo sapiens
ggggguggcacgggcucuug

SEQ ID NO: 13452 - RNA, 21 nt, Homo sapiens
uaccccaccucaacugcugcc

SEQ ID NO: 13453 - RNA, 18 nt, Homo sapiens
ugaggagggaggaggagg

SEQ ID NO: 13454 - RNA, 26 nt, Homo sapiens
ugggggggggguuggggggguggggg

SEQ ID NO: 13455 - RNA, 18 nt, Homo sapiens
uuuggagggcuugauuug

SEQ ID NO: 13456 - RNA, 20 nt, Homo sapiens
agggucccuggaaagcgggc

SEQ ID NO: 13457 - RNA, 17 nt, Homo sapiens
gaggacccuggagggag

SEQ ID NO: 13458 - RNA, 19 nt, Homo sapiens
gcccuggaggcugcgcagc

SEQ ID NO: 13459 - RNA, 16 nt, Homo sapiens
gcgguggcguggggcc

SEQ ID NO: 13460 - RNA, 18 nt, Homo sapiens
gcugagugggcccgccac

SEQ ID NO: 13461 - RNA, 21 nt, Homo sapiens
cgucgcagucgagcgacuggg

SEQ ID NO: 13462 - RNA, 18 nt, Homo sapiens
uuucucugugucucuccu

SEQ ID NO: 13463 - RNA, 17 nt, Homo sapiens
uagcauagcccugacag

SEQ ID NO: 13464 - RNA, 17 nt, Homo sapiens
uauucuccauugccuua

SEQ ID NO: 13465 - RNA, 22 nt, Homo sapiens
ccuuugugcccacggaggcggg

SEQ ID NO: 13466 - RNA, 19 nt, Homo sapiens
gaccgaugguugggcuggu

SEQ ID NO: 13467 - RNA, 20 nt, Homo sapiens
gcggcgguucccacgugcgc

SEQ ID NO: 13468 - RNA, 19 nt, Homo sapiens
gcugggugcugcuggggcu

SEQ ID NO: 13469 - RNA, 21 nt, Homo sapiens
uacaaucagguacuguccaga

SEQ ID NO: 13470 - RNA, 18 nt, Homo sapiens
uaccccuguacauccuac

SEQ ID NO: 13471 - RNA, 17 nt, Homo sapiens
ucaaaaguacuugugcu

SEQ ID NO: 13472 - RNA, 18 nt, Homo sapiens
ucugggccgccuuauucc

SEQ ID NO: 13473 - RNA, 22 nt, Homo sapiens
uggagguggguuuggcugggug

SEQ ID NO: 13474 - RNA, 20 nt, Homo sapiens
uggggauuuagaagcacaga

SEQ ID NO: 13475 - RNA, 19 nt, Homo sapiens
uuucugguuucuguuguau

SEQ ID NO: 13476 - RNA, 18 nt, Homo sapiens
cgccgcuccucccggcug

SEQ ID NO: 13477 - RNA, 21 nt, Homo sapiens
gcagccauggguggcgccucc

SEQ ID NO: 13478 - RNA, 21 nt, Homo sapiens
uccacugcagccauggguggc

SEQ ID NO: 13479 - RNA, 21 nt, Homo sapiens
auuacauaaauuuuaaaaaua

SEQ ID NO: 13480 - RNA, 21 nt, Homo sapiens
uggcuaaauaugaagaacaua

SEQ ID NO: 13481 - RNA, 19 nt, Homo sapiens
caauagauagauaauuaga

SEQ ID NO: 13482 - RNA, 24 nt, Homo sapiens
uaaaauuuaaauaaauaaaaauaa

SEQ ID NO: 13483 - RNA, 22 nt, Homo sapiens
uaauauauauucauauauauau

SEQ ID NO: 13484 - RNA, 25 nt, Homo sapiens
uauauaauauauauucauauauaua

SEQ ID NO: 13485 - RNA, 25 nt, Homo sapiens
uauauauaauauauauucauauaua

SEQ ID NO: 13486 - RNA, 21 nt, Homo sapiens
uccuggcuuuacugagcuggg

SEQ ID NO: 13487 - RNA, 21 nt, Homo sapiens
uccaaccagcggugaggggcc

SEQ ID NO: 13488 - RNA, 22 nt, Homo sapiens
aggaggagggggaacacugcag

SEQ ID NO: 13489 - RNA, 17 nt, Homo sapiens
aggccgggaggcucugg

SEQ ID NO: 13490 - RNA, 17 nt, Homo sapiens
aggggaagggacgugca

SEQ ID NO: 13491 - RNA, 26 nt, Homo sapiens
gacuucaaguuugaggccuucgaaaa

SEQ ID NO: 13492 - RNA, 18 nt, Homo sapiens
gcccuccgcuccuccccc

SEQ ID NO: 13493 - RNA, 17 nt, Homo sapiens
ggcugggauguggguuu

SEQ ID NO: 13494 - RNA, 22 nt, Homo sapiens
ucugaaacaaaacccugaggcu

SEQ ID NO: 13495 - RNA, 20 nt, Homo sapiens
aauuuccauuuauuguagaa

SEQ ID NO: 13496 - RNA, 18 nt, Homo sapiens
agugaccauggaagcucu

SEQ ID NO: 13497 - RNA, 18 nt, Homo sapiens
augaaaaauacaaaaguu

SEQ ID NO: 13498 - RNA, 16 nt, Homo sapiens
augaagacugggggga

SEQ ID NO: 13499 - RNA, 19 nt, Homo sapiens
auguuuccccauuucccuu

SEQ ID NO: 13500 - RNA, 17 nt, Homo sapiens
cucaaggccacuaagac

SEQ ID NO: 13501 - RNA, 17 nt, Homo sapiens
ggauagacaauguagaa

SEQ ID NO: 13502 - RNA, 19 nt, Homo sapiens
gguuuuuaauauuguaccc

SEQ ID NO: 13503 - RNA, 23 nt, Homo sapiens
guggauuuauauacacagauaua

SEQ ID NO: 13504 - RNA, 19 nt, Homo sapiens
uaaguaauuaaugaaugau

SEQ ID NO: 13505 - RNA, 17 nt, Homo sapiens
uaccgggauaagggcuu

SEQ ID NO: 13506 - RNA, 18 nt, Homo sapiens
uagaugccgucaggcuag

SEQ ID NO: 13507 - RNA, 23 nt, Homo sapiens
ugaaaacuuucauauuuuucauu

SEQ ID NO: 13508 - RNA, 18 nt, Homo sapiens
ugagacaugguuuguucu

SEQ ID NO: 13509 - RNA, 17 nt, Homo sapiens
ugauuuuuaaaaggguc

SEQ ID NO: 13510 - RNA, 18 nt, Homo sapiens
uguacagacacaaaauug

SEQ ID NO: 13511 - RNA, 19 nt, Homo sapiens
uugggaagcugagagggcg

SEQ ID NO: 13512 - RNA, 21 nt, Homo sapiens
uuguguuuguggagauauaag

SEQ ID NO: 13513 - RNA, 15 nt, Homo sapiens
uuuguguuuguggag

SEQ ID NO: 13514 - RNA, 17 nt, Homo sapiens
agagagauagagagaga

SEQ ID NO: 13515 - RNA, 21 nt, Homo sapiens
caggaagaguggucaaagcaa

SEQ ID NO: 13516 - RNA, 18 nt, Homo sapiens
ugcagacuguguaguggg

SEQ ID NO: 13517 - RNA, 20 nt, Homo sapiens
cacgacagguucacacaggc

SEQ ID NO: 13518 - RNA, 20 nt, Homo sapiens
cacauuuugcauaauaggga

SEQ ID NO: 13519 - RNA, 23 nt, Homo sapiens
uaauauacuaauaaauacauaaa

SEQ ID NO: 13520 - RNA, 20 nt, Homo sapiens
uaucauugugauccuaaaaa

SEQ ID NO: 13521 - RNA, 15 nt, Homo sapiens
ugagaaagggauucc

SEQ ID NO: 13522 - RNA, 19 nt, Homo sapiens
uguuauguuucccaggcug

SEQ ID NO: 13523 - RNA, 21 nt, Homo sapiens
uuacuuaaauauuuaaauagc

SEQ ID NO: 13524 - RNA, 20 nt, Homo sapiens
caacggugacaaacacacuc

SEQ ID NO: 13525 - RNA, 18 nt, Homo sapiens
caccaggcugagcccugg

SEQ ID NO: 13526 - RNA, 16 nt, Homo sapiens
ggcagacaggagcggc

SEQ ID NO: 13527 - RNA, 19 nt, Homo sapiens
uccaagugccagcagccac

SEQ ID NO: 13528 - RNA, 18 nt, Homo sapiens
uccugggguccacugcuu

SEQ ID NO: 13529 - RNA, 18 nt, Homo sapiens
agcuugcuccuggagccc

SEQ ID NO: 13530 - RNA, 16 nt, Homo sapiens
cgcuuccuugcaccuc

SEQ ID NO: 13531 - RNA, 20 nt, Homo sapiens
gcaguccgugagauccugcu

SEQ ID NO: 13532 - RNA, 23 nt, Homo sapiens
aagaggaggaaauacuauauccg

SEQ ID NO: 13533 - RNA, 18 nt, Homo sapiens
uccucagggccauuaucu

SEQ ID NO: 13534 - RNA, 21 nt, Homo sapiens
ugguacucagucaaaccuucc

SEQ ID NO: 13535 - RNA, 19 nt, Homo sapiens
uguggugccuugaucagac

SEQ ID NO: 13536 - RNA, 18 nt, Homo sapiens
cacccugccccgugcccc

SEQ ID NO: 13537 - RNA, 19 nt, Homo sapiens
gcccugcuuuuccuccccc

SEQ ID NO: 13538 - RNA, 17 nt, Homo sapiens
ugauucaagcucacaag

SEQ ID NO: 13539 - RNA, 19 nt, Homo sapiens
uugguugauucaagcucac

SEQ ID NO: 13540 - RNA, 19 nt, Homo sapiens
agcccccucuucucucccu

SEQ ID NO: 13541 - RNA, 17 nt, Homo sapiens
aggcgcuggagcccccc

SEQ ID NO: 13542 - RNA, 17 nt, Homo sapiens
ccaggcugggaagaagc

SEQ ID NO: 13543 - RNA, 21 nt, Homo sapiens
ccccaccaccgugccccugcc

SEQ ID NO: 13544 - RNA, 23 nt, Homo sapiens
ccccgccauuuccuccugcgguc

SEQ ID NO: 13545 - RNA, 18 nt, Homo sapiens
cccgccccgcccccgccc

SEQ ID NO: 13546 - RNA, 19 nt, Homo sapiens
cccuccgugccccaccacc

SEQ ID NO: 13547 - RNA, 18 nt, Homo sapiens
ccgccccgccccgccccc

SEQ ID NO: 13548 - RNA, 18 nt, Homo sapiens
ccgccgagcugcgcuccc

SEQ ID NO: 13549 - RNA, 18 nt, Homo sapiens
ccgcgcccgcgcccgccc

SEQ ID NO: 13550 - RNA, 22 nt, Homo sapiens
ccgcgcggcagggaaggggcgc

SEQ ID NO: 13551 - RNA, 19 nt, Homo sapiens
ccgugccccugccuugcac

SEQ ID NO: 13552 - RNA, 19 nt, Homo sapiens
ccuccccgccauuuccucc

SEQ ID NO: 13553 - RNA, 20 nt, Homo sapiens
ccucgcccucacugccucgc

SEQ ID NO: 13554 - RNA, 19 nt, Homo sapiens
cgggucacugccgcacggg

SEQ ID NO: 13555 - RNA, 20 nt, Homo sapiens
cgucucugucuuugugcuuu

SEQ ID NO: 13556 - RNA, 17 nt, Homo sapiens
cugcggcgggcgcugcg

SEQ ID NO: 13557 - RNA, 18 nt, Homo sapiens
gaggggacaccccccauc

SEQ ID NO: 13558 - RNA, 17 nt, Homo sapiens
gcccccucuucucuccc

SEQ ID NO: 13559 - RNA, 19 nt, Homo sapiens
gcgcggcuuggcgcggcgc

SEQ ID NO: 13560 - RNA, 20 nt, Homo sapiens
ggcccgaggggcgcgccggg

SEQ ID NO: 13561 - RNA, 18 nt, Homo sapiens
ggcgguucggccggcggc

SEQ ID NO: 13562 - RNA, 18 nt, Homo sapiens
gggaagguggcgaaagag

SEQ ID NO: 13563 - RNA, 19 nt, Homo sapiens
gggcaguggcgcggagcaa

SEQ ID NO: 13564 - RNA, 21 nt, Homo sapiens
ggguggcaggaugcgucuggc

SEQ ID NO: 13565 - RNA, 17 nt, Homo sapiens
ggugcccgggagagccg

SEQ ID NO: 13566 - RNA, 17 nt, Homo sapiens
ucauucccacccguccc

SEQ ID NO: 13567 - RNA, 21 nt, Homo sapiens
uguagaaaaauaucucaggcc

SEQ ID NO: 13568 - RNA, 21 nt, Homo sapiens
ugucaguugaggguucucgcu

SEQ ID NO: 13569 - RNA, 24 nt, Homo sapiens
aaacggaagcggcggggagcagga

SEQ ID NO: 13570 - RNA, 18 nt, Homo sapiens
aggacgaggguuggggag

SEQ ID NO: 13571 - RNA, 20 nt, Homo sapiens
gcaccggauccgagcuuggc

SEQ ID NO: 13572 - RNA, 19 nt, Homo sapiens
aagagcugucgguuguaca

SEQ ID NO: 13573 - RNA, 15 nt, Homo sapiens
agggcccuggggacc

SEQ ID NO: 13574 - RNA, 16 nt, Homo sapiens
auaauguauguagaaa

SEQ ID NO: 13575 - RNA, 21 nt, Homo sapiens
cggcggcugcgggacucgcgu

SEQ ID NO: 13576 - RNA, 17 nt, Homo sapiens
cgggcgcggcggcugcg

SEQ ID NO: 13577 - RNA, 21 nt, Homo sapiens
gccccggcggcccucagugcc

SEQ ID NO: 13578 - RNA, 18 nt, Homo sapiens
gcccgggcgcggcggcug

SEQ ID NO: 13579 - RNA, 23 nt, Homo sapiens
gcggcugcgggacucgcguggcg

SEQ ID NO: 13580 - RNA, 14 nt, Homo sapiens
aggagacaccuccg

SEQ ID NO: 13581 - RNA, 17 nt, Homo sapiens
cacccgaccuauccaug

SEQ ID NO: 13582 - RNA, 21 nt, Homo sapiens
gcuuccucccugggcgcacga

SEQ ID NO: 13583 - RNA, 18 nt, Homo sapiens
ucucuuucuggcacuacu

SEQ ID NO: 13584 - RNA, 20 nt, Homo sapiens
acuuuuuccuuuguaccgcg

SEQ ID NO: 13585 - RNA, 18 nt, Homo sapiens
agcauagcagauuagaag

SEQ ID NO: 13586 - RNA, 17 nt, Homo sapiens
ggagauccagcaggcuc

SEQ ID NO: 13587 - RNA, 22 nt, Homo sapiens
gggaugggaugggauaggaaga

SEQ ID NO: 13588 - RNA, 19 nt, Homo sapiens
uaaguguugcuagggugug

SEQ ID NO: 13589 - RNA, 18 nt, Homo sapiens
ccugcggaacgggcugga

SEQ ID NO: 13590 - RNA, 22 nt, Homo sapiens
cugcgcccucagcucacgucug

SEQ ID NO: 13591 - RNA, 18 nt, Homo sapiens
gcuccgggccgagucagg

SEQ ID NO: 13592 - RNA, 20 nt, Homo sapiens
aaugacaugaaaaguggcaa

SEQ ID NO: 13593 - RNA, 20 nt, Homo sapiens
agagagagaaaacagucauu

SEQ ID NO: 13594 - RNA, 23 nt, Homo sapiens
cggcggcggcagacucggcgcgg

SEQ ID NO: 13595 - RNA, 20 nt, Homo sapiens
cugcggcggcggcagacucg

SEQ ID NO: 13596 - RNA, 20 nt, Homo sapiens
gcggaggcgcugcggcggcg

SEQ ID NO: 13597 - RNA, 18 nt, Homo sapiens
uccacagugaaauggugg

SEQ ID NO: 13598 - RNA, 19 nt, Homo sapiens
uggcaaaauagagguaacc

SEQ ID NO: 13599 - RNA, 19 nt, Homo sapiens
agguuacugccagucagcc

SEQ ID NO: 13600 - RNA, 17 nt, Homo sapiens
caccucccccacccccc

SEQ ID NO: 13601 - RNA, 18 nt, Homo sapiens
gacucugaaguuuauaga

SEQ ID NO: 13602 - RNA, 17 nt, Homo sapiens
gugaaauccugagagug

SEQ ID NO: 13603 - RNA, 20 nt, Homo sapiens
uaaaauauacacaaguggaa

SEQ ID NO: 13604 - RNA, 18 nt, Homo sapiens
ugguguuucucaaagugu

SEQ ID NO: 13605 - RNA, 15 nt, Homo sapiens
aaaugggccuuagga

SEQ ID NO: 13606 - RNA, 19 nt, Homo sapiens
ccaggcuggcacagaaagc

SEQ ID NO: 13607 - RNA, 21 nt, Homo sapiens
aaggggaaguugggugggagg

SEQ ID NO: 13608 - RNA, 19 nt, Homo sapiens
cagguccuugggguccugu

SEQ ID NO: 13609 - RNA, 19 nt, Homo sapiens
gcccucccgcccgcccgcc

SEQ ID NO: 13610 - RNA, 16 nt, Homo sapiens
ugccccugaggaagcc

SEQ ID NO: 13611 - RNA, 18 nt, Homo sapiens
uuucagacgucucccaga

SEQ ID NO: 13612 - RNA, 23 nt, Homo sapiens
auaauaucgauacaaauauaaaa

SEQ ID NO: 13613 - RNA, 16 nt, Homo sapiens
ggucaugugacuggug

SEQ ID NO: 13614 - RNA, 23 nt, Homo sapiens
ugacaggcuagugaucaggucau

SEQ ID NO: 13615 - RNA, 20 nt, Homo sapiens
acaggugugugccaccacgc

SEQ ID NO: 13616 - RNA, 16 nt, Homo sapiens
cccagccccggcccuc

SEQ ID NO: 13617 - RNA, 19 nt, Homo sapiens
gacuacaggugugugccac

SEQ ID NO: 13618 - RNA, 20 nt, Homo sapiens
gagacggagucucgcugugu

SEQ ID NO: 13619 - RNA, 18 nt, Homo sapiens
ggaagguucaggcagagg

SEQ ID NO: 13620 - RNA, 17 nt, Homo sapiens
guuucgccaggcuggcc

SEQ ID NO: 13621 - RNA, 19 nt, Homo sapiens
uauuggauaaauacaugca

SEQ ID NO: 13622 - RNA, 15 nt, Homo sapiens
uccgggcccgugccc

SEQ ID NO: 13623 - RNA, 19 nt, Homo sapiens
uccugaguccaguucuggg

SEQ ID NO: 13624 - RNA, 24 nt, Homo sapiens
uccuuggccucccaaagugcuggg

SEQ ID NO: 13625 - RNA, 19 nt, Homo sapiens
ugacacaggucacauuugc

SEQ ID NO: 13626 - RNA, 19 nt, Homo sapiens
ugcuuggcacuggggcucc

SEQ ID NO: 13627 - RNA, 21 nt, Homo sapiens
uuggauaaauacaugcaggca

SEQ ID NO: 13628 - RNA, 18 nt, Homo sapiens
uuuggacagaauuucaca

SEQ ID NO: 13629 - RNA, 17 nt, Homo sapiens
agaaaaguaauuuauau

SEQ ID NO: 13630 - RNA, 20 nt, Homo sapiens
cauaaaaauuuuacauuuca

SEQ ID NO: 13631 - RNA, 23 nt, Homo sapiens
uaagguccaaauuuggacugcuu

SEQ ID NO: 13632 - RNA, 18 nt, Homo sapiens
ugaggaacugugaauaaa

SEQ ID NO: 13633 - RNA, 19 nt, Homo sapiens
ggacaguuuugccaagcuc

SEQ ID NO: 13634 - RNA, 16 nt, Homo sapiens
gugcccauguuccaga

SEQ ID NO: 13635 - RNA, 20 nt, Homo sapiens
cacaguggggacaaagcugc

SEQ ID NO: 13636 - RNA, 14 nt, Homo sapiens
cacaugucagguga

SEQ ID NO: 13637 - RNA, 18 nt, Homo sapiens
gcccuuugcccccucccc

SEQ ID NO: 13638 - RNA, 18 nt, Homo sapiens
ggcaaaaccccuggcauc

SEQ ID NO: 13639 - RNA, 16 nt, Homo sapiens
ugggaacgcuggggcc

SEQ ID NO: 13640 - RNA, 16 nt, Homo sapiens
aagcacaggaggagga

SEQ ID NO: 13641 - RNA, 16 nt, Homo sapiens
acccuuggagcucagc

SEQ ID NO: 13642 - RNA, 17 nt, Homo sapiens
cacacuacauuggggaa

SEQ ID NO: 13643 - RNA, 19 nt, Homo sapiens
cauguaugcaggcaggguu

SEQ ID NO: 13644 - RNA, 15 nt, Homo sapiens
cuuccuagggggcuc

SEQ ID NO: 13645 - RNA, 14 nt, Homo sapiens
gcagagaaacucaa

SEQ ID NO: 13646 - RNA, 20 nt, Homo sapiens
gcaggcacggucuuccaggc

SEQ ID NO: 13647 - RNA, 21 nt, Homo sapiens
gcccccugggcucuccggugg

SEQ ID NO: 13648 - RNA, 19 nt, Homo sapiens
gggccagggagggcguggg

SEQ ID NO: 13649 - RNA, 22 nt, Homo sapiens
gggcgcgugugugaccuuuagc

SEQ ID NO: 13650 - RNA, 16 nt, Homo sapiens
ggggccagggagggcg

SEQ ID NO: 13651 - RNA, 15 nt, Homo sapiens
guggacagaugcaga

SEQ ID NO: 13652 - RNA, 15 nt, Homo sapiens
guuuugugccccaac

SEQ ID NO: 13653 - RNA, 16 nt, Homo sapiens
uaaggcuuguuucaga

SEQ ID NO: 13654 - RNA, 23 nt, Homo sapiens
uagcaagucggcccacacaggag

SEQ ID NO: 13655 - RNA, 15 nt, Homo sapiens
uauauacacaugggg

SEQ ID NO: 13656 - RNA, 15 nt, Homo sapiens
ucgugcuccaccggg

SEQ ID NO: 13657 - RNA, 19 nt, Homo sapiens
ucuccgguggggaggcccc

SEQ ID NO: 13658 - RNA, 21 nt, Homo sapiens
ucuuacagggccagggcugcu

SEQ ID NO: 13659 - RNA, 17 nt, Homo sapiens
ugacacuaaaggcaagc

SEQ ID NO: 13660 - RNA, 19 nt, Homo sapiens
uggcaagccccaaggagca

SEQ ID NO: 13661 - RNA, 22 nt, Homo sapiens
ugucuuguagugcaguucagga

SEQ ID NO: 13662 - RNA, 21 nt, Homo sapiens
aggauggaagcggaacaccca

SEQ ID NO: 13663 - RNA, 20 nt, Homo sapiens
aguaucuuugaaacuaaagu

SEQ ID NO: 13664 - RNA, 20 nt, Homo sapiens
auguugguucagaugaagaa

SEQ ID NO: 13665 - RNA, 17 nt, Homo sapiens
caccagcuucaaagaag

SEQ ID NO: 13666 - RNA, 21 nt, Homo sapiens
gccgguuugggggagcagggc

SEQ ID NO: 13667 - RNA, 16 nt, Homo sapiens
gcggcuuucucucucc

SEQ ID NO: 13668 - RNA, 20 nt, Homo sapiens
ucccuuuaaaaaauucauua

SEQ ID NO: 13669 - RNA, 21 nt, Homo sapiens
ucuuucagaagaauaacaugu

SEQ ID NO: 13670 - RNA, 19 nt, Homo sapiens
ugguucaagugcaaaucag

SEQ ID NO: 13671 - RNA, 27 nt, Homo sapiens
uucaucuuuauauggauguauauaguu

SEQ ID NO: 13672 - RNA, 18 nt, Homo sapiens
aacaauuugaauaagaga

SEQ ID NO: 13673 - RNA, 19 nt, Homo sapiens
cccucuccgcucccaccuc

SEQ ID NO: 13674 - RNA, 20 nt, Homo sapiens
ccuccuucccucuccgcucc

SEQ ID NO: 13675 - RNA, 18 nt, Homo sapiens
ccucgccgcccucucucc

SEQ ID NO: 13676 - RNA, 17 nt, Homo sapiens
ccugccgcucccugccc

SEQ ID NO: 13677 - RNA, 20 nt, Homo sapiens
cucccugcccucuccagccu

SEQ ID NO: 13678 - RNA, 22 nt, Homo sapiens
gcuccuccuccuccuccuuccc

SEQ ID NO: 13679 - RNA, 24 nt, Homo sapiens
ucauguauuaaucucaauauauuu

SEQ ID NO: 13680 - RNA, 20 nt, Homo sapiens
ucggccgucacagcgccggc

SEQ ID NO: 13681 - RNA, 16 nt, Homo sapiens
ugcaugcagacauauc

SEQ ID NO: 13682 - RNA, 16 nt, Homo sapiens
uuuccuggggcuuacu

SEQ ID NO: 13683 - RNA, 18 nt, Homo sapiens
aacuacccacaaggagga

SEQ ID NO: 13684 - RNA, 19 nt, Homo sapiens
agaggcagguccugggagc

SEQ ID NO: 13685 - RNA, 17 nt, Homo sapiens
agucaccaggccaccug

SEQ ID NO: 13686 - RNA, 24 nt, Homo sapiens
cguacaacucuuccccaggaagcc

SEQ ID NO: 13687 - RNA, 17 nt, Homo sapiens
cucaggccaaaggauuu

SEQ ID NO: 13688 - RNA, 18 nt, Homo sapiens
cugaggcacggagggagc

SEQ ID NO: 13689 - RNA, 18 nt, Homo sapiens
gccagcuggcugggccac

SEQ ID NO: 13690 - RNA, 16 nt, Homo sapiens
gcccagggcguggggg

SEQ ID NO: 13691 - RNA, 17 nt, Homo sapiens
uaacuacccacaaggag

SEQ ID NO: 13692 - RNA, 18 nt, Homo sapiens
ucuggcagagugggagug

SEQ ID NO: 13693 - RNA, 17 nt, Homo sapiens
ugcacuggcuacagcag

SEQ ID NO: 13694 - RNA, 22 nt, Homo sapiens
aaggccacuaggugcaggaaaa

SEQ ID NO: 13695 - RNA, 20 nt, Homo sapiens
cgccgcccaccaaaccggcu

SEQ ID NO: 13696 - RNA, 17 nt, Homo sapiens
ugcccuuggaccgcacc

SEQ ID NO: 13697 - RNA, 18 nt, Homo sapiens
ugggcagggugggaaagc

SEQ ID NO: 13698 - RNA, 14 nt, Homo sapiens
uguuucagauuuca

SEQ ID NO: 13699 - RNA, 16 nt, Homo sapiens
acgcguggacaguugc

SEQ ID NO: 13700 - RNA, 18 nt, Homo sapiens
aggccacaccaucagcca

SEQ ID NO: 13701 - RNA, 17 nt, Homo sapiens
caaauauacagagugcu

SEQ ID NO: 13702 - RNA, 20 nt, Homo sapiens
cagcgcccgcccgcccuccg

SEQ ID NO: 13703 - RNA, 18 nt, Homo sapiens
cagcuccggcucgcuggc

SEQ ID NO: 13704 - RNA, 16 nt, Homo sapiens
caggugcgucaacagc

SEQ ID NO: 13705 - RNA, 14 nt, Homo sapiens
cccaccgagggccc

SEQ ID NO: 13706 - RNA, 16 nt, Homo sapiens
cccgccgccgccgccc

SEQ ID NO: 13707 - RNA, 18 nt, Homo sapiens
ccgcccggccccgccgcc

SEQ ID NO: 13708 - RNA, 23 nt, Homo sapiens
ccgccgcccgcgcccggcuccca

SEQ ID NO: 13709 - RNA, 18 nt, Homo sapiens
ccgccgccgcccgcgccc

SEQ ID NO: 13710 - RNA, 21 nt, Homo sapiens
ccgcgcuccggcugcccggcc

SEQ ID NO: 13711 - RNA, 22 nt, Homo sapiens
ccuggagccacagagaaacccg

SEQ ID NO: 13712 - RNA, 17 nt, Homo sapiens
cgcccgcgcucccggca

SEQ ID NO: 13713 - RNA, 21 nt, Homo sapiens
cgcuggagcgggcguucuggg

SEQ ID NO: 13714 - RNA, 21 nt, Homo sapiens
cggccccgccgccgccgcccg

SEQ ID NO: 13715 - RNA, 16 nt, Homo sapiens
cggcggcggcgcgggc

SEQ ID NO: 13716 - RNA, 19 nt, Homo sapiens
cggcggcggcggcggcgcg

SEQ ID NO: 13717 - RNA, 19 nt, Homo sapiens
cgggccugggcggcgggcg

SEQ ID NO: 13718 - RNA, 18 nt, Homo sapiens
cggggucgagcgcagcgc

SEQ ID NO: 13719 - RNA, 18 nt, Homo sapiens
gaggaggggcggccgggg

SEQ ID NO: 13720 - RNA, 19 nt, Homo sapiens
gagggcccugggucccggc

SEQ ID NO: 13721 - RNA, 22 nt, Homo sapiens
gaggggcggccggggccggcag

SEQ ID NO: 13722 - RNA, 17 nt, Homo sapiens
gcccgcccgcccuccga

SEQ ID NO: 13723 - RNA, 19 nt, Homo sapiens
gccugggcggcgggcgugc

SEQ ID NO: 13724 - RNA, 17 nt, Homo sapiens
gcgcagcaggaagggca

SEQ ID NO: 13725 - RNA, 19 nt, Homo sapiens
gcgccgcggcgcgcgggcc

SEQ ID NO: 13726 - RNA, 27 nt, Homo sapiens
gcggcagcggcagaggcggcggcggcg

SEQ ID NO: 13727 - RNA, 21 nt, Homo sapiens
gcucccagccgccgcgccggc

SEQ ID NO: 13728 - RNA, 19 nt, Homo sapiens
ggccacaccaacacagcca

SEQ ID NO: 13729 - RNA, 21 nt, Homo sapiens
ggccggcaggugggcagcgcc

SEQ ID NO: 13730 - RNA, 18 nt, Homo sapiens
ggcggcggcgcgggcggg

SEQ ID NO: 13731 - RNA, 19 nt, Homo sapiens
ggcggcggcgcgggcgggg

SEQ ID NO: 13732 - RNA, 25 nt, Homo sapiens
gggcggcgggcgugcaggggcggcg

SEQ ID NO: 13733 - RNA, 19 nt, Homo sapiens
ucgagcgcagcgccgcggc

SEQ ID NO: 13734 - RNA, 16 nt, Homo sapiens
ucgcuggcggccgcgc

SEQ ID NO: 13735 - RNA, 17 nt, Homo sapiens
ugcccggcccggcuccc

SEQ ID NO: 13736 - RNA, 15 nt, Homo sapiens
acagaugaugcagaa

SEQ ID NO: 13737 - RNA, 18 nt, Homo sapiens
ccaccaauuccugcuuug

SEQ ID NO: 13738 - RNA, 18 nt, Homo sapiens
cccgaaccaccagcccgg

SEQ ID NO: 13739 - RNA, 25 nt, Homo sapiens
ccgccgccuucugguaccacaggcg

SEQ ID NO: 13740 - RNA, 20 nt, Homo sapiens
ccgccgcugucaacagcgcc

SEQ ID NO: 13741 - RNA, 18 nt, Homo sapiens
cuuugcugcugcagccgc

SEQ ID NO: 13742 - RNA, 20 nt, Homo sapiens
gccgcccggacuccgacgac

SEQ ID NO: 13743 - RNA, 16 nt, Homo sapiens
gcgcggggacagcccg

SEQ ID NO: 13744 - RNA, 18 nt, Homo sapiens
ggcagcccgcaggcggcc

SEQ ID NO: 13745 - RNA, 18 nt, Homo sapiens
ggcgccgucagaccgaac

SEQ ID NO: 13746 - RNA, 19 nt, Homo sapiens
gggcagcccgcaggcggcc

SEQ ID NO: 13747 - RNA, 20 nt, Homo sapiens
gucuccgguccuccccgccg

SEQ ID NO: 13748 - RNA, 17 nt, Homo sapiens
uaguaagaagcacugag

SEQ ID NO: 13749 - RNA, 20 nt, Homo sapiens
ucuccgccgccuucuggucu

SEQ ID NO: 13750 - RNA, 20 nt, Homo sapiens
ugaauacauuuauugugaca

SEQ ID NO: 13751 - RNA, 24 nt, Homo sapiens
ugagagugauuuuaucgagcauuc

SEQ ID NO: 13752 - RNA, 20 nt, Homo sapiens
ugcaguggccggccggcggc

SEQ ID NO: 13753 - RNA, 22 nt, Homo sapiens
aggggagggcagggggcggggg

SEQ ID NO: 13754 - RNA, 19 nt, Homo sapiens
agggucccugcggggccgc

SEQ ID NO: 13755 - RNA, 18 nt, Homo sapiens
gaucgcccccucuucccc

SEQ ID NO: 13756 - RNA, 22 nt, Homo sapiens
gcugcagcgagcggcgagcucu

SEQ ID NO: 13757 - RNA, 18 nt, Homo sapiens
ggaccccagugggaggcg

SEQ ID NO: 13758 - RNA, 17 nt, Homo sapiens
gggagggcagggggcgg

SEQ ID NO: 13759 - RNA, 21 nt, Homo sapiens
gggcuggcgcgggcggguagc

SEQ ID NO: 13760 - RNA, 18 nt, Homo sapiens
ggggagggcagggggcgg

SEQ ID NO: 13761 - RNA, 17 nt, Homo sapiens
ggggagggucccugcgg

SEQ ID NO: 13762 - RNA, 19 nt, Homo sapiens
gggggggcuuguaaacguc

SEQ ID NO: 13763 - RNA, 22 nt, Homo sapiens
gggguguccguaaaggggcagg

SEQ ID NO: 13764 - RNA, 23 nt, Homo sapiens
ggucuggggagggucccugcggg

SEQ ID NO: 13765 - RNA, 17 nt, Homo sapiens
gugguuugcggcgcccc

SEQ ID NO: 13766 - RNA, 23 nt, Homo sapiens
ucccccagcucccagcucccugc

SEQ ID NO: 13767 - RNA, 20 nt, Homo sapiens
ucgcccccucuuccccuccc

SEQ ID NO: 13768 - RNA, 20 nt, Homo sapiens
aggcccugggggcuuagggc

SEQ ID NO: 13769 - RNA, 23 nt, Homo sapiens
aggggcggggagggggugucagg

SEQ ID NO: 13770 - RNA, 24 nt, Homo sapiens
aggggucaggggcucgguggaccu

SEQ ID NO: 13771 - RNA, 17 nt, Homo sapiens
agucugaagcuuuagug

SEQ ID NO: 13772 - RNA, 20 nt, Homo sapiens
cguugcugggggaaaacaga

SEQ ID NO: 13773 - RNA, 20 nt, Homo sapiens
gcagcugugugggugggaca

SEQ ID NO: 13774 - RNA, 15 nt, Homo sapiens
gccagggccacaggg

SEQ ID NO: 13775 - RNA, 19 nt, Homo sapiens
gcccaggacagaaaagcag

SEQ ID NO: 13776 - RNA, 20 nt, Homo sapiens
gcccugggggcuuagggcag

SEQ ID NO: 13777 - RNA, 20 nt, Homo sapiens
gcgcagggugcagcaggaag

SEQ ID NO: 13778 - RNA, 18 nt, Homo sapiens
gggccgggucggggucgg

SEQ ID NO: 13779 - RNA, 22 nt, Homo sapiens
gggggucugaaacaggaagggg

SEQ ID NO: 13780 - RNA, 19 nt, Homo sapiens
gggucggggucgggccggg

SEQ ID NO: 13781 - RNA, 25 nt, Homo sapiens
uccccaucuccccuggacggucccu

SEQ ID NO: 13782 - RNA, 17 nt, Homo sapiens
ucccuggggagugaggg

SEQ ID NO: 13783 - RNA, 21 nt, Homo sapiens
ucggcgcggucgggcggcggc

SEQ ID NO: 13784 - RNA, 26 nt, Homo sapiens
ugggggcuuagggcaguuggucggug

SEQ ID NO: 13785 - RNA, 21 nt, Homo sapiens
cacagcagcagggaggacucu

SEQ ID NO: 13786 - RNA, 20 nt, Homo sapiens
cagugaagugggaggcaggc

SEQ ID NO: 13787 - RNA, 22 nt, Homo sapiens
ggacgcuguggggagcauuuuu

SEQ ID NO: 13788 - RNA, 17 nt, Homo sapiens
aagagagagaggguaaa

SEQ ID NO: 13789 - RNA, 15 nt, Homo sapiens
agggggcacguucca

SEQ ID NO: 13790 - RNA, 21 nt, Homo sapiens
aguuguagagacacuuaaaau

SEQ ID NO: 13791 - RNA, 21 nt, Homo sapiens
auuccaaacaccauauuuucc

SEQ ID NO: 13792 - RNA, 23 nt, Homo sapiens
caccuguuucaguaugaagcagc

SEQ ID NO: 13793 - RNA, 17 nt, Homo sapiens
cagaucaggacaucuug

SEQ ID NO: 13794 - RNA, 19 nt, Homo sapiens
cucaugguggguuuacaag

SEQ ID NO: 13795 - RNA, 19 nt, Homo sapiens
cuccuuagagucucagacu

SEQ ID NO: 13796 - RNA, 17 nt, Homo sapiens
gugguucaccagcgugu

SEQ ID NO: 13797 - RNA, 18 nt, Homo sapiens
uaugucagaucaggacau

SEQ ID NO: 13798 - RNA, 20 nt, Homo sapiens
uuaguuucauuuccucccag

SEQ ID NO: 13799 - RNA, 20 nt, Homo sapiens
gcacgccccaugcucucucu

SEQ ID NO: 13800 - RNA, 18 nt, Homo sapiens
uacaaguuuaguaacaau

SEQ ID NO: 13801 - RNA, 17 nt, Homo sapiens
aacaccagugccucugu

SEQ ID NO: 13802 - RNA, 17 nt, Homo sapiens
aaccuugaaugcugcag

SEQ ID NO: 13803 - RNA, 22 nt, Homo sapiens
acagaagcugggcaugauuggg

SEQ ID NO: 13804 - RNA, 18 nt, Homo sapiens
accggcacacaggcgcgu

SEQ ID NO: 13805 - RNA, 21 nt, Homo sapiens
agacauuccuccuggcucugu

SEQ ID NO: 13806 - RNA, 15 nt, Homo sapiens
agcuggagagucagg

SEQ ID NO: 13807 - RNA, 17 nt, Homo sapiens
ccagccgcuccggaccc

SEQ ID NO: 13808 - RNA, 20 nt, Homo sapiens
cccggcucccggacgcagag

SEQ ID NO: 13809 - RNA, 21 nt, Homo sapiens
cccgugcgcccucuuuagggu

SEQ ID NO: 13810 - RNA, 19 nt, Homo sapiens
ccgcugguaccgaagcgcc

SEQ ID NO: 13811 - RNA, 18 nt, Homo sapiens
ccuccagccgcuccggac

SEQ ID NO: 13812 - RNA, 19 nt, Homo sapiens
gaguauuuggcucugagaa

SEQ ID NO: 13813 - RNA, 16 nt, Homo sapiens
gccacuaggacggcgc

SEQ ID NO: 13814 - RNA, 14 nt, Homo sapiens
gccgcagcugcagc

SEQ ID NO: 13815 - RNA, 18 nt, Homo sapiens
gcgguuccggccgccaca

SEQ ID NO: 13816 - RNA, 24 nt, Homo sapiens
ggaggugggcagguggauagaugg

SEQ ID NO: 13817 - RNA, 18 nt, Homo sapiens
gggccgcgcucucccggu

SEQ ID NO: 13818 - RNA, 21 nt, Homo sapiens
ggguccggccaaggucgcggu

SEQ ID NO: 13819 - RNA, 14 nt, Homo sapiens
uacagggcacugga

SEQ ID NO: 13820 - RNA, 17 nt, Homo sapiens
ucgcugccgccgccgca

SEQ ID NO: 13821 - RNA, 19 nt, Homo sapiens
ucuagggcuuuaagcugga

SEQ ID NO: 13822 - RNA, 22 nt, Homo sapiens
ugaggcuaugcaaauaaagacu

SEQ ID NO: 13823 - RNA, 17 nt, Homo sapiens
uggauagauggcagugg

SEQ ID NO: 13824 - RNA, 18 nt, Homo sapiens
agcucggccuccugcggg

SEQ ID NO: 13825 - RNA, 17 nt, Homo sapiens
aggagucuuacccagcc

SEQ ID NO: 13826 - RNA, 20 nt, Homo sapiens
agucuguccaggggaggguu

SEQ ID NO: 13827 - RNA, 18 nt, Homo sapiens
cccacgccguccgcgagg

SEQ ID NO: 13828 - RNA, 19 nt, Homo sapiens
cccgagccuuuucuaaaca

SEQ ID NO: 13829 - RNA, 23 nt, Homo sapiens
ccgccccgcgcccccugcagccg

SEQ ID NO: 13830 - RNA, 20 nt, Homo sapiens
ccgcgcgcgcccucgcagcc

SEQ ID NO: 13831 - RNA, 18 nt, Homo sapiens
ccuccccgcgcgcgcccc

SEQ ID NO: 13832 - RNA, 21 nt, Homo sapiens
cggggcgcgcaggcagcggcg

SEQ ID NO: 13833 - RNA, 20 nt, Homo sapiens
gcagagagcgaacuugggcu

SEQ ID NO: 13834 - RNA, 19 nt, Homo sapiens
gccgccggccucgcccggg

SEQ ID NO: 13835 - RNA, 18 nt, Homo sapiens
ggcuggcauccgggcgcc

SEQ ID NO: 13836 - RNA, 22 nt, Homo sapiens
gggaggguuggggggacacagg

SEQ ID NO: 13837 - RNA, 22 nt, Homo sapiens
ggggaggguuggggggacacag

SEQ ID NO: 13838 - RNA, 18 nt, Homo sapiens
gugccacccgugcgcuga

SEQ ID NO: 13839 - RNA, 18 nt, Homo sapiens
ucacagcgggcagcagcc

SEQ ID NO: 13840 - RNA, 20 nt, Homo sapiens
ugggcucucgugccagccag

SEQ ID NO: 13841 - RNA, 21 nt, Homo sapiens
agguaucugucucugacuuuu

SEQ ID NO: 13842 - RNA, 18 nt, Homo sapiens
gcgggcguccuggcgcgg

SEQ ID NO: 13843 - RNA, 19 nt, Homo sapiens
gcucgggguccggcgggcg

SEQ ID NO: 13844 - RNA, 18 nt, Homo sapiens
aggaggugggggcggggg

SEQ ID NO: 13845 - RNA, 16 nt, Homo sapiens
gcggggggaggaaagg

SEQ ID NO: 13846 - RNA, 19 nt, Homo sapiens
gcggggggaggaaaggggg

SEQ ID NO: 13847 - RNA, 21 nt, Homo sapiens
ggaggugggggcggggggagg

SEQ ID NO: 13848 - RNA, 22 nt, Homo sapiens
ggggcggggggaggaaaggggg

SEQ ID NO: 13849 - RNA, 21 nt, Homo sapiens
gggggcggggggaggaaaggg

SEQ ID NO: 13850 - RNA, 17 nt, Homo sapiens
uauuucuccccaguacu

SEQ ID NO: 13851 - RNA, 24 nt, Homo sapiens
ucaguguuuguucagagcucaucu

SEQ ID NO: 13852 - RNA, 15 nt, Homo sapiens
uccuggguggggggg

SEQ ID NO: 13853 - RNA, 18 nt, Homo sapiens
uguauguguauguaugug

SEQ ID NO: 13854 - RNA, 20 nt, Homo sapiens
uguucagagcucaucuuugu

SEQ ID NO: 13855 - RNA, 24 nt, Homo sapiens
agugaucugguauugugacugccc

SEQ ID NO: 13856 - RNA, 15 nt, Homo sapiens
cuuuuccuggcugcg

SEQ ID NO: 13857 - RNA, 14 nt, Homo sapiens
gcaaaaaagaaaag

SEQ ID NO: 13858 - RNA, 20 nt, Homo sapiens
gcuccggcuccagguccggc

SEQ ID NO: 13859 - RNA, 22 nt, Homo sapiens
ggucuccaccccuccgcccgcc

SEQ ID NO: 13860 - RNA, 21 nt, Homo sapiens
uacaguauuuagcagugcugu

SEQ ID NO: 13861 - RNA, 24 nt, Homo sapiens
uacauaaggcauauauauguacag

SEQ ID NO: 13862 - RNA, 19 nt, Homo sapiens
ucccggcguccgcgggucu

SEQ ID NO: 13863 - RNA, 19 nt, Homo sapiens
ucuaaaccuacauuaauga

SEQ ID NO: 13864 - RNA, 19 nt, Homo sapiens
aacaacuuguguuagucac

SEQ ID NO: 13865 - RNA, 21 nt, Homo sapiens
aacuucaugguggugguggga

SEQ ID NO: 13866 - RNA, 22 nt, Homo sapiens
aaguggaaaggggacaguggga

SEQ ID NO: 13867 - RNA, 19 nt, Homo sapiens
ccuuggaugggccgcgggg

SEQ ID NO: 13868 - RNA, 18 nt, Homo sapiens
cgggggccggggccgggg

SEQ ID NO: 13869 - RNA, 18 nt, Homo sapiens
gaacagaggcuaugaggg

SEQ ID NO: 13870 - RNA, 22 nt, Homo sapiens
ggauauguugauaucagauucc

SEQ ID NO: 13871 - RNA, 18 nt, Homo sapiens
ggcgaccaugguucuagc

SEQ ID NO: 13872 - RNA, 17 nt, Homo sapiens
gggccgcggggcagcgg

SEQ ID NO: 13873 - RNA, 20 nt, Homo sapiens
gggccggggccggggucggg

SEQ ID NO: 13874 - RNA, 19 nt, Homo sapiens
ugcuucgggggaucuccag

SEQ ID NO: 13875 - RNA, 16 nt, Homo sapiens
auguccgugcaguuuu

SEQ ID NO: 13876 - RNA, 19 nt, Homo sapiens
caggcucuggaaacacugg

SEQ ID NO: 13877 - RNA, 20 nt, Homo sapiens
ggauacgggacccacacaga

SEQ ID NO: 13878 - RNA, 16 nt, Homo sapiens
uacaauucaguccacu

SEQ ID NO: 13879 - RNA, 21 nt, Homo sapiens
ucauuuguacacaaaucaucu

SEQ ID NO: 13880 - RNA, 18 nt, Homo sapiens
cccccgcccgggccuggc

SEQ ID NO: 13881 - RNA, 26 nt, Homo sapiens
cccccgcccgggccuggcucccgccc

SEQ ID NO: 13882 - RNA, 16 nt, Homo sapiens
cccgccgcccccgccc

SEQ ID NO: 13883 - RNA, 20 nt, Homo sapiens
cccgccgccucuucuggccc

SEQ ID NO: 13884 - RNA, 22 nt, Homo sapiens
ccgcccgccgcccgcucccccg

SEQ ID NO: 13885 - RNA, 21 nt, Homo sapiens
ccgccgcccccgcccccgccc

SEQ ID NO: 13886 - RNA, 18 nt, Homo sapiens
ccgccgcccgcucccccg

SEQ ID NO: 13887 - RNA, 19 nt, Homo sapiens
cgcccgggccuggcucccg

SEQ ID NO: 13888 - RNA, 19 nt, Homo sapiens
cggagcgcggcccgccgcc

SEQ ID NO: 13889 - RNA, 18 nt, Homo sapiens
gcccgcccgccccgcucc

SEQ ID NO: 13890 - RNA, 18 nt, Homo sapiens
gccggagcgcggcccgcc

SEQ ID NO: 13891 - RNA, 18 nt, Homo sapiens
gccuggcucccgcccgcc

SEQ ID NO: 13892 - RNA, 20 nt, Homo sapiens
gcgcgcccgcccgccccgcu

SEQ ID NO: 13893 - RNA, 22 nt, Homo sapiens
gcgcggcccgccgccucuucug

SEQ ID NO: 13894 - RNA, 17 nt, Homo sapiens
gcucccgcccgccgccc

SEQ ID NO: 13895 - RNA, 16 nt, Homo sapiens
ggccccgccgcccccg

SEQ ID NO: 13896 - RNA, 19 nt, Homo sapiens
ggcucccgcccgccgcccg

SEQ ID NO: 13897 - RNA, 17 nt, Homo sapiens
aggggaguggggcugag

SEQ ID NO: 13898 - RNA, 19 nt, Homo sapiens
caucuguaaaaugggagug

SEQ ID NO: 13899 - RNA, 23 nt, Homo sapiens
ccccuuugccuuuugcucucugg

SEQ ID NO: 13900 - RNA, 24 nt, Homo sapiens
ccgcccgggccgccgccggccccc

SEQ ID NO: 13901 - RNA, 18 nt, Homo sapiens
ccugccugucccuccuuc

SEQ ID NO: 13902 - RNA, 18 nt, Homo sapiens
ccuucuuucuguccugcu

SEQ ID NO: 13903 - RNA, 19 nt, Homo sapiens
cgccccuccugcugccugc

SEQ ID NO: 13904 - RNA, 20 nt, Homo sapiens
cggcuggugcaagcaggcac

SEQ ID NO: 13905 - RNA, 15 nt, Homo sapiens
gagaugggggugcug

SEQ ID NO: 13906 - RNA, 20 nt, Homo sapiens
gcuggaggccaguuagcuug

SEQ ID NO: 13907 - RNA, 16 nt, Homo sapiens
ggagaguggugaggga

SEQ ID NO: 13908 - RNA, 21 nt, Homo sapiens
gggaugaggaaggggaguggg

SEQ ID NO: 13909 - RNA, 18 nt, Homo sapiens
ggggaugaggaaggggag

SEQ ID NO: 13910 - RNA, 22 nt, Homo sapiens
ggggugcugggggagaguggug

SEQ ID NO: 13911 - RNA, 20 nt, Homo sapiens
gggugcugggggagaguggu

SEQ ID NO: 13912 - RNA, 23 nt, Homo sapiens
gguaauuaucagcaauuauggug

SEQ ID NO: 13913 - RNA, 18 nt, Homo sapiens
ucagggcucacuacagcc

SEQ ID NO: 13914 - RNA, 17 nt, Homo sapiens
ucgccccuccugcugcc

SEQ ID NO: 13915 - RNA, 18 nt, Homo sapiens
ucuugcccugucacccag

SEQ ID NO: 13916 - RNA, 20 nt, Homo sapiens
acccucgcuccaaagauguc

SEQ ID NO: 13917 - RNA, 19 nt, Homo sapiens
agcaggaggggagcuugga

SEQ ID NO: 13918 - RNA, 21 nt, Homo sapiens
ccucuaggagcgugugaggcc

SEQ ID NO: 13919 - RNA, 17 nt, Homo sapiens
cgaagagcccauccccc

SEQ ID NO: 13920 - RNA, 19 nt, Homo sapiens
gcagggagggagagcagga

SEQ ID NO: 13921 - RNA, 19 nt, Homo sapiens
ucugcagcaagggcccugc

SEQ ID NO: 13922 - RNA, 19 nt, Homo sapiens
ccucccagaauccuggauc

SEQ ID NO: 13923 - RNA, 17 nt, Homo sapiens
ccugcccaggguccccc

SEQ ID NO: 13924 - RNA, 24 nt, Homo sapiens
gauccgggccccuaguacccucuu

SEQ ID NO: 13925 - RNA, 20 nt, Homo sapiens
gcggggaggggcaggggagg

SEQ ID NO: 13926 - RNA, 20 nt, Homo sapiens
gggacccaggaguccugccu

SEQ ID NO: 13927 - RNA, 18 nt, Homo sapiens
ggggaggggcaggggagg

SEQ ID NO: 13928 - RNA, 18 nt, Homo sapiens
uaacugagagcuggaggu

SEQ ID NO: 13929 - RNA, 18 nt, Homo sapiens
ucacacacaauggucugu

SEQ ID NO: 13930 - RNA, 22 nt, Homo sapiens
agagaaacaggcacaaacaccc

SEQ ID NO: 13931 - RNA, 21 nt, Homo sapiens
agguggagaugccacacgcuc

SEQ ID NO: 13932 - RNA, 19 nt, Homo sapiens
caccugcaggaguccggac

SEQ ID NO: 13933 - RNA, 18 nt, Homo sapiens
cgcgugggcggacgcgug

SEQ ID NO: 13934 - RNA, 16 nt, Homo sapiens
cgcucugcgacgccgc

SEQ ID NO: 13935 - RNA, 16 nt, Homo sapiens
ugagguggagaugcca

SEQ ID NO: 13936 - RNA, 14 nt, Homo sapiens
ugcccuucucagca

SEQ ID NO: 13937 - RNA, 23 nt, Homo sapiens
uggaauguguggugcacauaggc

SEQ ID NO: 13938 - RNA, 16 nt, Homo sapiens
uggccaaaaagaaggg

SEQ ID NO: 13939 - RNA, 24 nt, Homo sapiens
acacagcuucacauugaaccuccc

SEQ ID NO: 13940 - RNA, 20 nt, Homo sapiens
cccagaacucgggagccggu

SEQ ID NO: 13941 - RNA, 19 nt, Homo sapiens
gcgcggagguggaacucgc

SEQ ID NO: 13942 - RNA, 23 nt, Homo sapiens
gucagcuccccagguacugcuac

SEQ ID NO: 13943 - RNA, 16 nt, Homo sapiens
uuaaggcuuggcuugg

SEQ ID NO: 13944 - RNA, 15 nt, Homo sapiens
aaaagggacugucuu

SEQ ID NO: 13945 - RNA, 18 nt, Homo sapiens
acaaugcaaaggcgaugu

SEQ ID NO: 13946 - RNA, 17 nt, Homo sapiens
caccucccacacccccc

SEQ ID NO: 13947 - RNA, 19 nt, Homo sapiens
cagaugagaugagccaggg

SEQ ID NO: 13948 - RNA, 20 nt, Homo sapiens
caucccaggagucuauugga

SEQ ID NO: 13949 - RNA, 21 nt, Homo sapiens
ccgcaugcagccuccuagggu

SEQ ID NO: 13950 - RNA, 24 nt, Homo sapiens
cgcuugcuuucguuaugaccucuu

SEQ ID NO: 13951 - RNA, 16 nt, Homo sapiens
gaggcaccaucugcca

SEQ ID NO: 13952 - RNA, 22 nt, Homo sapiens
gcagaaagcagaguuugggaag

SEQ ID NO: 13953 - RNA, 17 nt, Homo sapiens
gcaggagcuccuccucc

SEQ ID NO: 13954 - RNA, 17 nt, Homo sapiens
gcaggcaggagcuccuc

SEQ ID NO: 13955 - RNA, 19 nt, Homo sapiens
uauauauauauuuauauau

SEQ ID NO: 13956 - RNA, 24 nt, Homo sapiens
uauauauauuuauauauuacauau

SEQ ID NO: 13957 - RNA, 17 nt, Homo sapiens
ucaggggcugcucgcca

SEQ ID NO: 13958 - RNA, 22 nt, Homo sapiens
ucgaagcaggcaggagcagccu

SEQ ID NO: 13959 - RNA, 16 nt, Homo sapiens
ugucaaagcugaaggg

SEQ ID NO: 13960 - RNA, 18 nt, Homo sapiens
ggaaagguggaacagcac

SEQ ID NO: 13961 - RNA, 17 nt, Homo sapiens
gggaccuuagacauugg

SEQ ID NO: 13962 - RNA, 22 nt, Homo sapiens
gggauaagcaaaggaguguguu

SEQ ID NO: 13963 - RNA, 20 nt, Homo sapiens
agggugggcagccucgugcc

SEQ ID NO: 13964 - RNA, 22 nt, Homo sapiens
cccgcaugcucugacuccuuug

SEQ ID NO: 13965 - RNA, 22 nt, Homo sapiens
agaccagccugggcaacauagc

SEQ ID NO: 13966 - RNA, 26 nt, Homo sapiens
uuaaaacacauuguuucacauacaug

SEQ ID NO: 13967 - RNA, 23 nt, Homo sapiens
cgguccggcuccccuuccucucc

SEQ ID NO: 13968 - RNA, 24 nt, Homo sapiens
gauggggguugggggucggguggg

SEQ ID NO: 13969 - RNA, 21 nt, Homo sapiens
gcgggggagggacccuggggg

SEQ ID NO: 13970 - RNA, 19 nt, Homo sapiens
gcuccccuuccucuccucu

SEQ ID NO: 13971 - RNA, 17 nt, Homo sapiens
ggagggugggguggggg

SEQ ID NO: 13972 - RNA, 21 nt, Homo sapiens
ggagggugggguggggggcgg

SEQ ID NO: 13973 - RNA, 23 nt, Homo sapiens
gggagggugggguggggggcggg

SEQ ID NO: 13974 - RNA, 16 nt, Homo sapiens
gggauggggguugggg

SEQ ID NO: 13975 - RNA, 22 nt, Homo sapiens
gggauggggguugggggucggg

SEQ ID NO: 13976 - RNA, 23 nt, Homo sapiens
ggugggguggggggcggggguca

SEQ ID NO: 13977 - RNA, 20 nt, Homo sapiens
guggcggcggcggcgacucc

SEQ ID NO: 13978 - RNA, 16 nt, Homo sapiens
guggcggcggcggcgc

SEQ ID NO: 13979 - RNA, 15 nt, Homo sapiens
uggggguuggggguc

SEQ ID NO: 13980 - RNA, 20 nt, Homo sapiens
uggggguugggggucgggug

SEQ ID NO: 13981 - RNA, 16 nt, Homo sapiens
aguugucagccugugg

SEQ ID NO: 13982 - RNA, 18 nt, Homo sapiens
cugcgcgcggcuccggcg

SEQ ID NO: 13983 - RNA, 17 nt, Homo sapiens
gcggcuccggcggcggc

SEQ ID NO: 13984 - RNA, 18 nt, Homo sapiens
uuuggagccuuuuguugc

SEQ ID NO: 13985 - RNA, 22 nt, Homo sapiens
acacacauauauauauauauau

SEQ ID NO: 13986 - RNA, 22 nt, Homo sapiens
auauauauguauauauauauau

SEQ ID NO: 13987 - RNA, 22 nt, Homo sapiens
auauauguauauauauauauau

SEQ ID NO: 13988 - RNA, 22 nt, Homo sapiens
auauguauauauauauauauau

SEQ ID NO: 13989 - RNA, 18 nt, Homo sapiens
uauauauauauauauaca

SEQ ID NO: 13990 - RNA, 18 nt, Homo sapiens
uauauauauguauauaua

SEQ ID NO: 13991 - RNA, 22 nt, Homo sapiens
uauauauauguauauauauaua

SEQ ID NO: 13992 - RNA, 23 nt, Homo sapiens
uauauauauguauauauauauau

SEQ ID NO: 13993 - RNA, 25 nt, Homo sapiens
uauauauauguauauauauauauau

SEQ ID NO: 13994 - RNA, 22 nt, Homo sapiens
uauauauguauauauauauaua

SEQ ID NO: 13995 - RNA, 24 nt, Homo sapiens
uauauauguauauauauauauaua

SEQ ID NO: 13996 - RNA, 22 nt, Homo sapiens
uauauguauauauauauauaua

SEQ ID NO: 13997 - RNA, 24 nt, Homo sapiens
uauauguauauauauauauauaua

SEQ ID NO: 13998 - RNA, 22 nt, Homo sapiens
uauguauauauauauauauaua

SEQ ID NO: 13999 - RNA, 18 nt, Homo sapiens
cagugacggcaacaccuc

SEQ ID NO: 14000 - RNA, 18 nt, Homo sapiens
agagagcgagcugggagc

SEQ ID NO: 14001 - RNA, 16 nt, Homo sapiens
cacagugagcugcagg

SEQ ID NO: 14002 - RNA, 18 nt, Homo sapiens
cauuggacugggaaggga

SEQ ID NO: 14003 - RNA, 20 nt, Homo sapiens
cuaggcucacagcaccuccc

SEQ ID NO: 14004 - RNA, 18 nt, Homo sapiens
cuccuggucauuuucuuc

SEQ ID NO: 14005 - RNA, 18 nt, Homo sapiens
gaagauucaccugcagau

SEQ ID NO: 14006 - RNA, 21 nt, Homo sapiens
gcagagcuagcugagguuuua

SEQ ID NO: 14007 - RNA, 18 nt, Homo sapiens
gggguaggcugggagggg

SEQ ID NO: 14008 - RNA, 21 nt, Homo sapiens
agccuuggguccagcagcccc

SEQ ID NO: 14009 - RNA, 21 nt, Homo sapiens
ucagagaggagagagauccga

SEQ ID NO: 14010 - RNA, 18 nt, Homo sapiens
ugagagcaggugcagaua

SEQ ID NO: 14011 - RNA, 20 nt, Homo sapiens
agaagguggggagaggcaga

SEQ ID NO: 14012 - RNA, 17 nt, Homo sapiens
ggccagguagcuggagc

SEQ ID NO: 14013 - RNA, 19 nt, Homo sapiens
guggggagaggcagagggg

SEQ ID NO: 14014 - RNA, 19 nt, Homo sapiens
guggggaguggcaagggac

SEQ ID NO: 14015 - RNA, 21 nt, Homo sapiens
ugaaauaaaagaccgagggac

SEQ ID NO: 14016 - RNA, 18 nt, Homo sapiens
uccagccaugcaaaugau

SEQ ID NO: 14017 - RNA, 15 nt, Homo sapiens
ugaggcagcacagac

SEQ ID NO: 14018 - RNA, 16 nt, Homo sapiens
aaggaaaaccugaccc

SEQ ID NO: 14019 - RNA, 14 nt, Homo sapiens
aggagccccauuac

SEQ ID NO: 14020 - RNA, 17 nt, Homo sapiens
ccaccaccccacaucac

SEQ ID NO: 14021 - RNA, 17 nt, Homo sapiens
cccccacuggccccucc

SEQ ID NO: 14022 - RNA, 18 nt, Homo sapiens
cccugggccugggcucug

SEQ ID NO: 14023 - RNA, 15 nt, Homo sapiens
cugcgcgaagagagg

SEQ ID NO: 14024 - RNA, 20 nt, Homo sapiens
ggcagccggccuuugugaca

SEQ ID NO: 14025 - RNA, 16 nt, Homo sapiens
ggggauugggcuacaa

SEQ ID NO: 14026 - RNA, 17 nt, Homo sapiens
cuuucuaggguggccuu

SEQ ID NO: 14027 - RNA, 19 nt, Homo sapiens
gaaggggagaggcaggaag

SEQ ID NO: 14028 - RNA, 20 nt, Homo sapiens
ggaaggggagaggcaggaag

SEQ ID NO: 14029 - RNA, 17 nt, Homo sapiens
aggcagcgggcggcggc

SEQ ID NO: 14030 - RNA, 23 nt, Homo sapiens
cagaagguaggaggaagaaaaag

SEQ ID NO: 14031 - RNA, 20 nt, Homo sapiens
ccccggacuccugcgaccgg

SEQ ID NO: 14032 - RNA, 18 nt, Homo sapiens
ccggcgcgggcggcgcgu

SEQ ID NO: 14033 - RNA, 20 nt, Homo sapiens
cgacaggcgcuggcggaggc

SEQ ID NO: 14034 - RNA, 20 nt, Homo sapiens
gcaggcagcgggcggcggcu

SEQ ID NO: 14035 - RNA, 16 nt, Homo sapiens
ggggaagagaggaggu

SEQ ID NO: 14036 - RNA, 19 nt, Homo sapiens
uauugggaggccggcgcgg

SEQ ID NO: 14037 - RNA, 19 nt, Homo sapiens
ucgcagagucauagaacca

SEQ ID NO: 14038 - RNA, 18 nt, Homo sapiens
ucuccuggcgcgagguac

SEQ ID NO: 14039 - RNA, 14 nt, Homo sapiens
aaaugcuguggcug

SEQ ID NO: 14040 - RNA, 21 nt, Homo sapiens
aaaggaggucagaaaaggaaa

SEQ ID NO: 14041 - RNA, 22 nt, Homo sapiens
agcagacagagcaaaguggccg

SEQ ID NO: 14042 - RNA, 19 nt, Homo sapiens
agugguggggggugggggg

SEQ ID NO: 14043 - RNA, 14 nt, Homo sapiens
cagaucaggcagcc

SEQ ID NO: 14044 - RNA, 22 nt, Homo sapiens
ggcagugguggggggugggggg

SEQ ID NO: 14045 - RNA, 16 nt, Homo sapiens
ggccuuggagagaggg

SEQ ID NO: 14046 - RNA, 22 nt, Homo sapiens
gggggcaguggugggggguggg

SEQ ID NO: 14047 - RNA, 21 nt, Homo sapiens
gggggcgggggugucccaggg

SEQ ID NO: 14048 - RNA, 19 nt, Homo sapiens
ugaggaggugggggcgggg

SEQ ID NO: 14049 - RNA, 18 nt, Homo sapiens
acgugauggacucggcca

SEQ ID NO: 14050 - RNA, 17 nt, Homo sapiens
agcaaagucucuggggu

SEQ ID NO: 14051 - RNA, 19 nt, Homo sapiens
agucucuggggucacugga

SEQ ID NO: 14052 - RNA, 23 nt, Homo sapiens
caggugcagaggccaggugggua

SEQ ID NO: 14053 - RNA, 18 nt, Homo sapiens
cggccaugggcuuugugg

SEQ ID NO: 14054 - RNA, 19 nt, Homo sapiens
gauggacucggccaugggc

SEQ ID NO: 14055 - RNA, 24 nt, Homo sapiens
ugacuuucuacccucaggugcaga

SEQ ID NO: 14056 - RNA, 18 nt, Homo sapiens
ugccuggcuggcuuucua

SEQ ID NO: 14057 - RNA, 19 nt, Homo sapiens
aagcuuugggggaacagaa

SEQ ID NO: 14058 - RNA, 15 nt, Homo sapiens
agagacagauaagcu

SEQ ID NO: 14059 - RNA, 18 nt, Homo sapiens
agggcucgggcgcugugg

SEQ ID NO: 14060 - RNA, 18 nt, Homo sapiens
gcggcggugccucgcuua

SEQ ID NO: 14061 - RNA, 21 nt, Homo sapiens
gcuuuguguuucuuucagugc

SEQ ID NO: 14062 - RNA, 20 nt, Homo sapiens
gugcucuuccagggcucggg

SEQ ID NO: 14063 - RNA, 21 nt, Homo sapiens
uguccauugcagacacuuugg

SEQ ID NO: 14064 - RNA, 19 nt, Homo sapiens
ccucugcucaugcgcauac

SEQ ID NO: 14065 - RNA, 19 nt, Homo sapiens
gcagccacggggacgcggc

SEQ ID NO: 14066 - RNA, 21 nt, Homo sapiens
ggacgcggcagaggaguggag

SEQ ID NO: 14067 - RNA, 21 nt, Homo sapiens
ggcugaaggggcgggcggccg

SEQ ID NO: 14068 - RNA, 18 nt, Homo sapiens
ugaaggggcgggcggccg

SEQ ID NO: 14069 - RNA, 20 nt, Homo sapiens
accccaacccuaccccuucc

SEQ ID NO: 14070 - RNA, 15 nt, Homo sapiens
agcucuucagugcau

SEQ ID NO: 14071 - RNA, 19 nt, Homo sapiens
aggccggagcggauucugg

SEQ ID NO: 14072 - RNA, 17 nt, Homo sapiens
cggcccgagcccuccuc

SEQ ID NO: 14073 - RNA, 21 nt, Homo sapiens
gagcucuucagugcauaggca

SEQ ID NO: 14074 - RNA, 21 nt, Homo sapiens
gggguaggccuugggcagggg

SEQ ID NO: 14075 - RNA, 16 nt, Homo sapiens
ucccaggucuguccag

SEQ ID NO: 14076 - RNA, 19 nt, Homo sapiens
aagagacacuuuauuagau

SEQ ID NO: 14077 - RNA, 22 nt, Homo sapiens
agcaguauaauaaucccugugu

SEQ ID NO: 14078 - RNA, 20 nt, Homo sapiens
aggaucaaaaguugagaagc

SEQ ID NO: 14079 - RNA, 20 nt, Homo sapiens
caggaacucgauagcguugg

SEQ ID NO: 14080 - RNA, 22 nt, Homo sapiens
caggaguauaucgucaaaacac

SEQ ID NO: 14081 - RNA, 19 nt, Homo sapiens
ccccgccuccgcgcuuccc

SEQ ID NO: 14082 - RNA, 18 nt, Homo sapiens
ccgcgccccgccuccgcg

SEQ ID NO: 14083 - RNA, 17 nt, Homo sapiens
ccuugaccaaugcauau

SEQ ID NO: 14084 - RNA, 18 nt, Homo sapiens
cucaucucuccaacagaa

SEQ ID NO: 14085 - RNA, 19 nt, Homo sapiens
gaccgcgcugcucgccgac

SEQ ID NO: 14086 - RNA, 22 nt, Homo sapiens
ggaucaucaagaacuaaguuac

SEQ ID NO: 14087 - RNA, 16 nt, Homo sapiens
ggcgcgggcgguggcg

SEQ ID NO: 14088 - RNA, 21 nt, Homo sapiens
ggcgcgggcgguggcggcggc

SEQ ID NO: 14089 - RNA, 21 nt, Homo sapiens
ggcuggguguggaggaaagca

SEQ ID NO: 14090 - RNA, 17 nt, Homo sapiens
guggcggcggcucgcgc

SEQ ID NO: 14091 - RNA, 14 nt, Homo sapiens
uaaaauaauggcug

SEQ ID NO: 14092 - RNA, 19 nt, Homo sapiens
uaagguaucaucuuguaaa

SEQ ID NO: 14093 - RNA, 18 nt, Homo sapiens
uacaagcugccaucuaag

SEQ ID NO: 14094 - RNA, 22 nt, Homo sapiens
ugaaaaauguaaucuuuguguc

SEQ ID NO: 14095 - RNA, 16 nt, Homo sapiens
ugcccuaagugcucag

SEQ ID NO: 14096 - RNA, 20 nt, Homo sapiens
ugcuucucuuuaaacucugu

SEQ ID NO: 14097 - RNA, 27 nt, Homo sapiens
uuaauuuagagaauggagaugcugcaa

SEQ ID NO: 14098 - RNA, 25 nt, Homo sapiens
uuccaaggaaaagaauucagggaaa

SEQ ID NO: 14099 - RNA, 21 nt, Homo sapiens
cagugccaugcauugugcuuc

SEQ ID NO: 14100 - RNA, 16 nt, Homo sapiens
cauuuuuccaugcugc

SEQ ID NO: 14101 - RNA, 18 nt, Homo sapiens
aaccccuucuuucugauc

SEQ ID NO: 14102 - RNA, 19 nt, Homo sapiens
aggggcuugcaacagauca

SEQ ID NO: 14103 - RNA, 17 nt, Homo sapiens
cauacuguucugguuuu

SEQ ID NO: 14104 - RNA, 23 nt, Homo sapiens
ccccuggaguuuagggguggcag

SEQ ID NO: 14105 - RNA, 25 nt, Homo sapiens
cccuggagcaucugugccgggcagu

SEQ ID NO: 14106 - RNA, 16 nt, Homo sapiens
cuugauuccgauucca

SEQ ID NO: 14107 - RNA, 19 nt, Homo sapiens
ggaagccacaacaagcugg

SEQ ID NO: 14108 - RNA, 19 nt, Homo sapiens
gggaggcaggguaggaaga

SEQ ID NO: 14109 - RNA, 22 nt, Homo sapiens
uccugggaggcggaggggggaa

SEQ ID NO: 14110 - RNA, 17 nt, Homo sapiens
ugcccuugacagcuggc

SEQ ID NO: 14111 - RNA, 15 nt, Homo sapiens
guuuuugcucccuua

SEQ ID NO: 14112 - RNA, 19 nt, Homo sapiens
uuuccauuuuacucagcaa

SEQ ID NO: 14113 - RNA, 14 nt, Homo sapiens
acagcaccuccaca

SEQ ID NO: 14114 - RNA, 22 nt, Homo sapiens
agcugcgugcgucuccuccggc

SEQ ID NO: 14115 - RNA, 22 nt, Homo sapiens
aggcacagaaacuugguguguc

SEQ ID NO: 14116 - RNA, 22 nt, Homo sapiens
augguguaugggggccuugcug

SEQ ID NO: 14117 - RNA, 22 nt, Homo sapiens
cugaauuugugugugugugugu

SEQ ID NO: 14118 - RNA, 21 nt, Homo sapiens
cugccuaacuaaacaggcagu

SEQ ID NO: 14119 - RNA, 17 nt, Homo sapiens
cuugccuggugggcucc

SEQ ID NO: 14120 - RNA, 18 nt, Homo sapiens
gcaggcccaggaggacuc

SEQ ID NO: 14121 - RNA, 16 nt, Homo sapiens
uagaugccuucuuggu

SEQ ID NO: 14122 - RNA, 19 nt, Homo sapiens
ucuuugugcuuugcaugug

SEQ ID NO: 14123 - RNA, 21 nt, Homo sapiens
ugaauuugugugugugugugu

SEQ ID NO: 14124 - RNA, 23 nt, Homo sapiens
ugaguaguuacucuguggacaug

SEQ ID NO: 14125 - RNA, 21 nt, Homo sapiens
uggguuccuuuuugguugccu

SEQ ID NO: 14126 - RNA, 19 nt, Homo sapiens
ugucuguguguggucagaa

SEQ ID NO: 14127 - RNA, 23 nt, Homo sapiens
uuaggaaauuguauauauguguc

SEQ ID NO: 14128 - RNA, 15 nt, Homo sapiens
ccuagcuauuuagcc

SEQ ID NO: 14129 - RNA, 16 nt, Homo sapiens
ucuuucuugcauuuau

SEQ ID NO: 14130 - RNA, 18 nt, Homo sapiens
uuccauggauagcuauuu

SEQ ID NO: 14131 - RNA, 17 nt, Homo sapiens
uugcccccacacucucu

SEQ ID NO: 14132 - RNA, 18 nt, Homo sapiens
cccgaacuggggccgcgg

SEQ ID NO: 14133 - RNA, 18 nt, Homo sapiens
gccccacugaaggauaau

SEQ ID NO: 14134 - RNA, 27 nt, Homo sapiens
uauaacacaaaucugaagguuucuuca

SEQ ID NO: 14135 - RNA, 20 nt, Homo sapiens
agucccaggcgucugcagcc

SEQ ID NO: 14136 - RNA, 16 nt, Homo sapiens
auggggacgaugggga

SEQ ID NO: 14137 - RNA, 18 nt, Homo sapiens
cacccuuggacaggcccc

SEQ ID NO: 14138 - RNA, 17 nt, Homo sapiens
cacgugggcgggacuga

SEQ ID NO: 14139 - RNA, 17 nt, Homo sapiens
cagacccuggccauccc

SEQ ID NO: 14140 - RNA, 17 nt, Homo sapiens
caucaaagaggaauuug

SEQ ID NO: 14141 - RNA, 18 nt, Homo sapiens
ccccaggccucaggaccu

SEQ ID NO: 14142 - RNA, 21 nt, Homo sapiens
ccuccccauucucucagaucc

SEQ ID NO: 14143 - RNA, 16 nt, Homo sapiens
cucaaguaccucugug

SEQ ID NO: 14144 - RNA, 21 nt, Homo sapiens
cucccggccuggcagagcugu

SEQ ID NO: 14145 - RNA, 19 nt, Homo sapiens
cuccucuugggagcaaugg

SEQ ID NO: 14146 - RNA, 20 nt, Homo sapiens
cugcugucucacccuguggu

SEQ ID NO: 14147 - RNA, 18 nt, Homo sapiens
gccgggauugaggugggg

SEQ ID NO: 14148 - RNA, 19 nt, Homo sapiens
gcuggggcgcccaagaaca

SEQ ID NO: 14149 - RNA, 21 nt, Homo sapiens
ggacagauggacaacuccggg

SEQ ID NO: 14150 - RNA, 19 nt, Homo sapiens
ggauggggguggagcagga

SEQ ID NO: 14151 - RNA, 19 nt, Homo sapiens
uagaaaucaugccagguca

SEQ ID NO: 14152 - RNA, 24 nt, Homo sapiens
ucuaaggcaggaacaucuguacca

SEQ ID NO: 14153 - RNA, 18 nt, Homo sapiens
ucuuccacucaucaaacu

SEQ ID NO: 14154 - RNA, 19 nt, Homo sapiens
ugcagccucccucuccucc

SEQ ID NO: 14155 - RNA, 20 nt, Homo sapiens
ugcugccuccuucccucccc

SEQ ID NO: 14156 - RNA, 17 nt, Homo sapiens
uggaaacuucugccaga

SEQ ID NO: 14157 - RNA, 21 nt, Homo sapiens
ugggugggagugggauggggg

SEQ ID NO: 14158 - RNA, 19 nt, Homo sapiens
acaugagaauucuuuggcu

SEQ ID NO: 14159 - RNA, 20 nt, Homo sapiens
ggaacuaacgcugcuagaua

SEQ ID NO: 14160 - RNA, 22 nt, Homo sapiens
ugauaauggucuugcaagugca

SEQ ID NO: 14161 - RNA, 17 nt, Homo sapiens
uguagcaacacuagcag

SEQ ID NO: 14162 - RNA, 23 nt, Homo sapiens
aagagucugugacaucuuugugg

SEQ ID NO: 14163 - RNA, 23 nt, Homo sapiens
acgcagguaaagcaggcaauaca

SEQ ID NO: 14164 - RNA, 16 nt, Homo sapiens
cuccguuaccucugug

SEQ ID NO: 14165 - RNA, 18 nt, Homo sapiens
uagaugaagagcacagca

SEQ ID NO: 14166 - RNA, 16 nt, Homo sapiens
ugacaucuuugugguu

SEQ ID NO: 14167 - RNA, 20 nt, Homo sapiens
ccaccgccgccggcccgggg

SEQ ID NO: 14168 - RNA, 18 nt, Homo sapiens
cgggccccagacucccca

SEQ ID NO: 14169 - RNA, 14 nt, Homo sapiens
ggaggcgggggcgg

SEQ ID NO: 14170 - RNA, 24 nt, Homo sapiens
gggcccggcggggcuggggcuggg

SEQ ID NO: 14171 - RNA, 18 nt, Homo sapiens
gggcugggggcggccggg

SEQ ID NO: 14172 - RNA, 19 nt, Homo sapiens
uaagucauggucccacggg

SEQ ID NO: 14173 - RNA, 25 nt, Homo sapiens
ugaggaggggcagggagccuugggg

SEQ ID NO: 14174 - RNA, 18 nt, Homo sapiens
uggcagguggccggccag

SEQ ID NO: 14175 - RNA, 18 nt, Homo sapiens
aggcaggugggcaggcgg

SEQ ID NO: 14176 - RNA, 21 nt, Homo sapiens
aggcgggcagauggacagacg

SEQ ID NO: 14177 - RNA, 18 nt, Homo sapiens
auaacccugucucuggca

SEQ ID NO: 14178 - RNA, 21 nt, Homo sapiens
auguucccauuuauauacaga

SEQ ID NO: 14179 - RNA, 19 nt, Homo sapiens
cauaacccugucucuggca

SEQ ID NO: 14180 - RNA, 16 nt, Homo sapiens
cggugguggaggagga

SEQ ID NO: 14181 - RNA, 17 nt, Homo sapiens
gcgcgcuuuggcggggc

SEQ ID NO: 14182 - RNA, 24 nt, Homo sapiens
ggacagacgggccuggaggccagg

SEQ ID NO: 14183 - RNA, 20 nt, Homo sapiens
ggccuggaggccaggcgccg

SEQ ID NO: 14184 - RNA, 16 nt, Homo sapiens
ggcgccgacucggggc

SEQ ID NO: 14185 - RNA, 18 nt, Homo sapiens
ggcgcgcuuuggcggggc

SEQ ID NO: 14186 - RNA, 15 nt, Homo sapiens
uggcaggagagcggc

SEQ ID NO: 14187 - RNA, 17 nt, Homo sapiens
uggcggggcggccgguc

SEQ ID NO: 14188 - RNA, 19 nt, Homo sapiens
ugguagaguggcuggcugg

SEQ ID NO: 14189 - RNA, 18 nt, Homo sapiens
ccagcacuuuagaaaagu

SEQ ID NO: 14190 - RNA, 20 nt, Homo sapiens
uuuucccacuucagaacacc

SEQ ID NO: 14191 - RNA, 18 nt, Homo sapiens
agguagcagccccccaug

SEQ ID NO: 14192 - RNA, 20 nt, Homo sapiens
auggugcucagugagcgccc

SEQ ID NO: 14193 - RNA, 17 nt, Homo sapiens
cacauggugcucaguga

SEQ ID NO: 14194 - RNA, 19 nt, Homo sapiens
caccaaaucagaaaacacg

SEQ ID NO: 14195 - RNA, 19 nt, Homo sapiens
ccaaguuucaaguaugugu

SEQ ID NO: 14196 - RNA, 17 nt, Homo sapiens
ccgccgccgcugagccc

SEQ ID NO: 14197 - RNA, 19 nt, Homo sapiens
gcucuccacgguggucccc

SEQ ID NO: 14198 - RNA, 19 nt, Homo sapiens
gggugggggccgggcuggg

SEQ ID NO: 14199 - RNA, 16 nt, Homo sapiens
ugagcucgguggcuug

SEQ ID NO: 14200 - RNA, 20 nt, Homo sapiens
uggaggguuucauuggaaga

SEQ ID NO: 14201 - RNA, 21 nt, Homo sapiens
uucaaguauguguaagugucu

SEQ ID NO: 14202 - RNA, 16 nt, Homo sapiens
aggaggcggggagggg

SEQ ID NO: 14203 - RNA, 22 nt, Homo sapiens
aggaggcggggagggggggugg

SEQ ID NO: 14204 - RNA, 26 nt, Homo sapiens
aggaggcggggagggggggugggggg

SEQ ID NO: 14205 - RNA, 20 nt, Homo sapiens
aggggggguggggggcgugg

SEQ ID NO: 14206 - RNA, 20 nt, Homo sapiens
agucuccagcccugggaacc

SEQ ID NO: 14207 - RNA, 19 nt, Homo sapiens
auuaaaacguucacguccc

SEQ ID NO: 14208 - RNA, 20 nt, Homo sapiens
ccccaguugggggguccccc

SEQ ID NO: 14209 - RNA, 23 nt, Homo sapiens
cccccuccuccuugaccguuugg

SEQ ID NO: 14210 - RNA, 22 nt, Homo sapiens
ccucgcugcucuuucccccucc

SEQ ID NO: 14211 - RNA, 19 nt, Homo sapiens
gauggagcucugggggcuc

SEQ ID NO: 14212 - RNA, 21 nt, Homo sapiens
gcggggagggggggugggggg

SEQ ID NO: 14213 - RNA, 18 nt, Homo sapiens
gcugcucuuucccccucc

SEQ ID NO: 14214 - RNA, 17 nt, Homo sapiens
ggaggcggggagggggg

SEQ ID NO: 14215 - RNA, 21 nt, Homo sapiens
ggaggcggggagggggggugg

SEQ ID NO: 14216 - RNA, 19 nt, Homo sapiens
ggaggggggguggggggcg

SEQ ID NO: 14217 - RNA, 18 nt, Homo sapiens
ggcggggagggggggugg

SEQ ID NO: 14218 - RNA, 24 nt, Homo sapiens
gggaagggcuggcuggggaggggc

SEQ ID NO: 14219 - RNA, 22 nt, Homo sapiens
gggaggaggcggggaggggggg

SEQ ID NO: 14220 - RNA, 22 nt, Homo sapiens
gggcaggaggcuuucugggggc

SEQ ID NO: 14221 - RNA, 23 nt, Homo sapiens
gggcaguccgacggggcagggcc

SEQ ID NO: 14222 - RNA, 20 nt, Homo sapiens
ggggaggggggguggggggc

SEQ ID NO: 14223 - RNA, 22 nt, Homo sapiens
gggggugccaaggagcaggcag

SEQ ID NO: 14224 - RNA, 21 nt, Homo sapiens
gggguggggggcguggaccgg

SEQ ID NO: 14225 - RNA, 18 nt, Homo sapiens
guaggggagccuuuggag

SEQ ID NO: 14226 - RNA, 22 nt, Homo sapiens
ucccccuccccgggcgaagcuc

SEQ ID NO: 14227 - RNA, 18 nt, Homo sapiens
uccuggguguggcccacc

SEQ ID NO: 14228 - RNA, 20 nt, Homo sapiens
ucgcuugccggcuugcucgc

SEQ ID NO: 14229 - RNA, 18 nt, Homo sapiens
ugccccuggaguuggggc

SEQ ID NO: 14230 - RNA, 18 nt, Homo sapiens
uuuauaagaauaucugug

SEQ ID NO: 14231 - RNA, 18 nt, Homo sapiens
cgccgcgcucacucgggc

SEQ ID NO: 14232 - RNA, 15 nt, Homo sapiens
gggggaggcgaggag

SEQ ID NO: 14233 - RNA, 16 nt, Homo sapiens
cacccgugccagcccc

SEQ ID NO: 14234 - RNA, 23 nt, Homo sapiens
cagccccagccacccugacggcg

SEQ ID NO: 14235 - RNA, 18 nt, Homo sapiens
ucugugcaugguauuucc

SEQ ID NO: 14236 - RNA, 19 nt, Homo sapiens
aggagguggcagcggaugg

SEQ ID NO: 14237 - RNA, 20 nt, Homo sapiens
caucaagcauccugcauggc

SEQ ID NO: 14238 - RNA, 18 nt, Homo sapiens
gcaguuuccccuuggauc

SEQ ID NO: 14239 - RNA, 17 nt, Homo sapiens
ggggagggcgggggcgg

SEQ ID NO: 14240 - RNA, 19 nt, Homo sapiens
gggggcggcaagcagcggg

SEQ ID NO: 14241 - RNA, 20 nt, Homo sapiens
ggggggcggcaagcagcggg

SEQ ID NO: 14242 - RNA, 20 nt, Homo sapiens
gguggggagggcgggggcgg

SEQ ID NO: 14243 - RNA, 20 nt, Homo sapiens
ucagagaguggaagggcaga

SEQ ID NO: 14244 - RNA, 18 nt, Homo sapiens
ugaucaggaguuucuuuc

SEQ ID NO: 14245 - RNA, 18 nt, Homo sapiens
aggggcauggggcucccu

SEQ ID NO: 14246 - RNA, 17 nt, Homo sapiens
agggguaugcggcucca

SEQ ID NO: 14247 - RNA, 18 nt, Homo sapiens
ccucucccaagaacucag

SEQ ID NO: 14248 - RNA, 18 nt, Homo sapiens
cgcugugccuccucaggg

SEQ ID NO: 14249 - RNA, 22 nt, Homo sapiens
ugaggccgugcccagagguggc

SEQ ID NO: 14250 - RNA, 20 nt, Homo sapiens
uucacaucuaugagauagag

SEQ ID NO: 14251 - RNA, 15 nt, Homo sapiens
ccuguuccuucgucg

SEQ ID NO: 14252 - RNA, 20 nt, Homo sapiens
uagagguaauagaggccguc

SEQ ID NO: 14253 - RNA, 18 nt, Homo sapiens
cccgagcccagagccugg

SEQ ID NO: 14254 - RNA, 18 nt, Homo sapiens
cgugcuccggugcggcgu

SEQ ID NO: 14255 - RNA, 19 nt, Homo sapiens
gacguccuugcaggugacc

SEQ ID NO: 14256 - RNA, 18 nt, Homo sapiens
ggaggggagggaaggagc

SEQ ID NO: 14257 - RNA, 18 nt, Homo sapiens
ggcagcgguggcggcggc

SEQ ID NO: 14258 - RNA, 22 nt, Homo sapiens
gggacgggacucagggccgaug

SEQ ID NO: 14259 - RNA, 15 nt, Homo sapiens
ccuguugcccaauag

SEQ ID NO: 14260 - RNA, 19 nt, Homo sapiens
ggaugggcaauccccaccu

SEQ ID NO: 14261 - RNA, 18 nt, Homo sapiens
gggagaagagcugggggc

SEQ ID NO: 14262 - RNA, 17 nt, Homo sapiens
ggggagaagagcugggg

SEQ ID NO: 14263 - RNA, 19 nt, Homo sapiens
ucuugcuaagacgacagca

SEQ ID NO: 14264 - RNA, 22 nt, Homo sapiens
aggccagccccgagacaggccc

SEQ ID NO: 14265 - RNA, 17 nt, Homo sapiens
ccccauggacaccuggg

SEQ ID NO: 14266 - RNA, 18 nt, Homo sapiens
gugugcugccgcuggcga

SEQ ID NO: 14267 - RNA, 16 nt, Homo sapiens
auguguguguucuugu

SEQ ID NO: 14268 - RNA, 21 nt, Homo sapiens
auuuaauccaagcuuugagga

SEQ ID NO: 14269 - RNA, 17 nt, Homo sapiens
gcacaucauuugacagu

SEQ ID NO: 14270 - RNA, 17 nt, Homo sapiens
ggauuauaaaacuuggc

SEQ ID NO: 14271 - RNA, 20 nt, Homo sapiens
ggcugccagauucugaguga

SEQ ID NO: 14272 - RNA, 16 nt, Homo sapiens
ucaggacggaacuggc

SEQ ID NO: 14273 - RNA, 21 nt, Homo sapiens
uuuggcaaaugguuugaaucc

SEQ ID NO: 14274 - RNA, 15 nt, Homo sapiens
acgugaggagucagg

SEQ ID NO: 14275 - RNA, 18 nt, Homo sapiens
ccugagcugggggaucgg

SEQ ID NO: 14276 - RNA, 22 nt, Homo sapiens
ccuuccugagcugggggaucgg

SEQ ID NO: 14277 - RNA, 18 nt, Homo sapiens
cggacgcagguaccagca

SEQ ID NO: 14278 - RNA, 20 nt, Homo sapiens
gcccuugaagugcaugcagc

SEQ ID NO: 14279 - RNA, 19 nt, Homo sapiens
gcgcgcucuggaccgcggc

SEQ ID NO: 14280 - RNA, 18 nt, Homo sapiens
ggaggugcaggggguggg

SEQ ID NO: 14281 - RNA, 21 nt, Homo sapiens
ggcuuuccuuccugagcuggg

SEQ ID NO: 14282 - RNA, 20 nt, Homo sapiens
uggagaggauggccguccug

SEQ ID NO: 14283 - RNA, 20 nt, Homo sapiens
cagcgcgucuggcccggagg

SEQ ID NO: 14284 - RNA, 19 nt, Homo sapiens
ccgcccgcuugccgcgggc

SEQ ID NO: 14285 - RNA, 22 nt, Homo sapiens
gaggcagccaccccugccaaau

SEQ ID NO: 14286 - RNA, 14 nt, Homo sapiens
gccgccccgcccgc

SEQ ID NO: 14287 - RNA, 17 nt, Homo sapiens
guuacuuuuccucucua

SEQ ID NO: 14288 - RNA, 21 nt, Homo sapiens
agugcuuguuuuagcacacag

SEQ ID NO: 14289 - RNA, 21 nt, Homo sapiens
caaguucaugugaugcuuuua

SEQ ID NO: 14290 - RNA, 18 nt, Homo sapiens
gcuuuuaccucaagaaau

SEQ ID NO: 14291 - RNA, 22 nt, Homo sapiens
uccaauaucagaacacuaggca

SEQ ID NO: 14292 - RNA, 17 nt, Homo sapiens
cccagccccagcccucc

SEQ ID NO: 14293 - RNA, 23 nt, Homo sapiens
ccccagcccucccuugauuucuc

SEQ ID NO: 14294 - RNA, 24 nt, Homo sapiens
gggacacaccagaguagcgcuucg

SEQ ID NO: 14295 - RNA, 19 nt, Homo sapiens
ucggggcucgggcuccggc

SEQ ID NO: 14296 - RNA, 19 nt, Homo sapiens
aaagaugucuucgucccac

SEQ ID NO: 14297 - RNA, 21 nt, Homo sapiens
cacacauuugaauguuacaca

SEQ ID NO: 14298 - RNA, 19 nt, Homo sapiens
cgucgggaggacagcgacg

SEQ ID NO: 14299 - RNA, 26 nt, Homo sapiens
gcccgggacucgcgggagggcgugcg

SEQ ID NO: 14300 - RNA, 21 nt, Homo sapiens
gccuggggcacgcggguccgc

SEQ ID NO: 14301 - RNA, 16 nt, Homo sapiens
ggaggacagcgacgag

SEQ ID NO: 14302 - RNA, 24 nt, Homo sapiens
gggagggcgugcgccgggaguggg

SEQ ID NO: 14303 - RNA, 23 nt, Homo sapiens
ugcgcgcgcgccgagaagagggg

SEQ ID NO: 14304 - RNA, 21 nt, Homo sapiens
agggaaccaggaguaagaaaa

SEQ ID NO: 14305 - RNA, 19 nt, Homo sapiens
cacuucugcuuccguuccc

SEQ ID NO: 14306 - RNA, 17 nt, Homo sapiens
guugauuccaucccucu

SEQ ID NO: 14307 - RNA, 17 nt, Homo sapiens
uaacucugacuuacaac

SEQ ID NO: 14308 - RNA, 17 nt, Homo sapiens
cgugcaagggaguugug

SEQ ID NO: 14309 - RNA, 18 nt, Homo sapiens
accaaaacaucugauuua

SEQ ID NO: 14310 - RNA, 21 nt, Homo sapiens
cacuuucacuuaaaacuugau

SEQ ID NO: 14311 - RNA, 16 nt, Homo sapiens
cugaauauuuagacuu

SEQ ID NO: 14312 - RNA, 19 nt, Homo sapiens
ugguuuucuccauguaaaa

SEQ ID NO: 14313 - RNA, 21 nt, Homo sapiens
uucaguaaguaucauuuuggu

SEQ ID NO: 14314 - RNA, 19 nt, Homo sapiens
ccccucggccgccgccgcc

SEQ ID NO: 14315 - RNA, 23 nt, Homo sapiens
cccgcgccgcccgccgccaccgc

SEQ ID NO: 14316 - RNA, 20 nt, Homo sapiens
ccgccuggcgcucgggcucc

SEQ ID NO: 14317 - RNA, 23 nt, Homo sapiens
cgggcgcgcggcggcuccucgcg

SEQ ID NO: 14318 - RNA, 18 nt, Homo sapiens
gcccccgcgccgcccgcc

SEQ ID NO: 14319 - RNA, 15 nt, Homo sapiens
gcgcgcggcggcucc

SEQ ID NO: 14320 - RNA, 19 nt, Homo sapiens
gcgcgcggcggcuccucgc

SEQ ID NO: 14321 - RNA, 18 nt, Homo sapiens
gcccagcucgcagucccc

SEQ ID NO: 14322 - RNA, 23 nt, Homo sapiens
gcuggcagggaggggcagcuggg

SEQ ID NO: 14323 - RNA, 18 nt, Homo sapiens
cccagcccugccccuucc

SEQ ID NO: 14324 - RNA, 16 nt, Homo sapiens
gcccugccccuucccc

SEQ ID NO: 14325 - RNA, 20 nt, Homo sapiens
uguaaaaggaaacagagaua

SEQ ID NO: 14326 - RNA, 20 nt, Homo sapiens
ugcaacagaucacuaaauaa

SEQ ID NO: 14327 - RNA, 27 nt, Homo sapiens
ucuaccuauuuuacuguggaguuauuu

SEQ ID NO: 14328 - RNA, 16 nt, Homo sapiens
ugccaggcccaguugc

SEQ ID NO: 14329 - RNA, 16 nt, Homo sapiens
gccgccgucugccucg

SEQ ID NO: 14330 - RNA, 21 nt, Homo sapiens
uaaaaaaauacugcccugaua

SEQ ID NO: 14331 - RNA, 18 nt, Homo sapiens
cagccgccggaggcuccc

SEQ ID NO: 14332 - RNA, 19 nt, Homo sapiens
cugccgcccuccccggggu

SEQ ID NO: 14333 - RNA, 22 nt, Homo sapiens
gaaggggggcccccacaaacuu

SEQ ID NO: 14334 - RNA, 19 nt, Homo sapiens
ggcgagacucgccggcaac

SEQ ID NO: 14335 - RNA, 18 nt, Homo sapiens
ggggaggcgcggguucgg

SEQ ID NO: 14336 - RNA, 18 nt, Homo sapiens
aacacagcagcacgggga

SEQ ID NO: 14337 - RNA, 17 nt, Homo sapiens
acccugcuagaacucag

SEQ ID NO: 14338 - RNA, 23 nt, Homo sapiens
agcaggggaugagaagggaucag

SEQ ID NO: 14339 - RNA, 15 nt, Homo sapiens
cacaaggugggcuca

SEQ ID NO: 14340 - RNA, 18 nt, Homo sapiens
cagaugaccacaugcaga

SEQ ID NO: 14341 - RNA, 15 nt, Homo sapiens
cauuuugguuuccca

SEQ ID NO: 14342 - RNA, 19 nt, Homo sapiens
cucgggguugugaaggacc

SEQ ID NO: 14343 - RNA, 16 nt, Homo sapiens
gagguccucuccuggg

SEQ ID NO: 14344 - RNA, 18 nt, Homo sapiens
gaugauggggagggacaa

SEQ ID NO: 14345 - RNA, 19 nt, Homo sapiens
gggaagcguggggaggagc

SEQ ID NO: 14346 - RNA, 18 nt, Homo sapiens
guaggaguuaagcugugg

SEQ ID NO: 14347 - RNA, 22 nt, Homo sapiens
guggcucagcuucucccuuuuu

SEQ ID NO: 14348 - RNA, 17 nt, Homo sapiens
uaaucccagguggcucc

SEQ ID NO: 14349 - RNA, 17 nt, Homo sapiens
ucacuggcuugcuuggg

SEQ ID NO: 14350 - RNA, 21 nt, Homo sapiens
ucacuggcuugcuuggggcga

SEQ ID NO: 14351 - RNA, 21 nt, Homo sapiens
uucccagucguuuggcagaga

SEQ ID NO: 14352 - RNA, 19 nt, Homo sapiens
ccaggagagcgccgggaag

SEQ ID NO: 14353 - RNA, 18 nt, Homo sapiens
ccggggcugcacgcgcgc

SEQ ID NO: 14354 - RNA, 19 nt, Homo sapiens
ccguucuuaguugguggag

SEQ ID NO: 14355 - RNA, 18 nt, Homo sapiens
cgaguccacggcaguucc

SEQ ID NO: 14356 - RNA, 18 nt, Homo sapiens
cgcaagacaggccgccgc

SEQ ID NO: 14357 - RNA, 19 nt, Homo sapiens
cguugaaccccauucguga

SEQ ID NO: 14358 - RNA, 21 nt, Homo sapiens
gcuucggcccgccggcguccc

SEQ ID NO: 14359 - RNA, 21 nt, Homo sapiens
ggcccccucaccuccuucucc

SEQ ID NO: 14360 - RNA, 18 nt, Homo sapiens
ggccgccgcgggcugugg

SEQ ID NO: 14361 - RNA, 19 nt, Homo sapiens
gggagggcggcucccuucc

SEQ ID NO: 14362 - RNA, 19 nt, Homo sapiens
gggugguggugcauggccg

SEQ ID NO: 14363 - RNA, 20 nt, Homo sapiens
uccgugggugguggugcaug

SEQ ID NO: 14364 - RNA, 18 nt, Homo sapiens
ugaggcccucggaucggc

SEQ ID NO: 14365 - RNA, 20 nt, Homo sapiens
ugccucagggcgccccgcga

SEQ ID NO: 14366 - RNA, 17 nt, Homo sapiens
ucaugcauaugggauga

SEQ ID NO: 14367 - RNA, 19 nt, Homo sapiens
ucuucuguaucacauuuag

SEQ ID NO: 14368 - RNA, 19 nt, Homo sapiens
uacggcggacacgugcagg

SEQ ID NO: 14369 - RNA, 17 nt, Homo sapiens
ugagagggcgggagagc

SEQ ID NO: 14370 - RNA, 18 nt, Homo sapiens
uuggagaggccacagugg

SEQ ID NO: 14371 - RNA, 18 nt, Homo sapiens
uaaggcaggaugaggcag

SEQ ID NO: 14372 - RNA, 19 nt, Homo sapiens
uaccuugcauagcuuauuc

SEQ ID NO: 14373 - RNA, 18 nt, Homo sapiens
uuggggcucugcacugcg

SEQ ID NO: 14374 - RNA, 16 nt, Homo sapiens
caagcauuaauacaga

SEQ ID NO: 14375 - RNA, 26 nt, Homo sapiens
uguacauuuccaugugaauaagccau

SEQ ID NO: 14376 - RNA, 16 nt, Homo sapiens
cacaacuccgcaggca

SEQ ID NO: 14377 - RNA, 16 nt, Homo sapiens
ggcccccucucugugc

SEQ ID NO: 14378 - RNA, 17 nt, Homo sapiens
acauguguuuacacgcu

SEQ ID NO: 14379 - RNA, 20 nt, Homo sapiens
auaaggcuccacugagaggg

SEQ ID NO: 14380 - RNA, 18 nt, Homo sapiens
gaaagaggagaaacgaga

SEQ ID NO: 14381 - RNA, 23 nt, Homo sapiens
gaaagcagaaacgaggcucugcu

SEQ ID NO: 14382 - RNA, 19 nt, Homo sapiens
gagggggagagugagugcu

SEQ ID NO: 14383 - RNA, 19 nt, Homo sapiens
uagagacagguccagagcu

SEQ ID NO: 14384 - RNA, 17 nt, Homo sapiens
uggaaccacccaaagcc

SEQ ID NO: 14385 - RNA, 19 nt, Homo sapiens
uacugauauauucgaucag

SEQ ID NO: 14386 - RNA, 17 nt, Homo sapiens
uauggcugucagagucc

SEQ ID NO: 14387 - RNA, 18 nt, Homo sapiens
uuucucucaucucuccuu

SEQ ID NO: 14388 - RNA, 19 nt, Homo sapiens
cuccuguaaaugucaaaac

SEQ ID NO: 14389 - RNA, 21 nt, Homo sapiens
ucacacggggcagugggugug

SEQ ID NO: 14390 - RNA, 19 nt, Homo sapiens
ugcggagccaggaguugaa

SEQ ID NO: 14391 - RNA, 21 nt, Homo sapiens
acuggugggucacaucucggg

SEQ ID NO: 14392 - RNA, 19 nt, Homo sapiens
ccaggccccaugugacacc

SEQ ID NO: 14393 - RNA, 19 nt, Homo sapiens
uggggcuggggagugagag

SEQ ID NO: 14394 - RNA, 24 nt, Homo sapiens
auggagucucgcgcuguccgccug

SEQ ID NO: 14395 - RNA, 20 nt, Homo sapiens
gguggggggagggguggcag

SEQ ID NO: 14396 - RNA, 17 nt, Homo sapiens
ucacagauccuagcucg

SEQ ID NO: 14397 - RNA, 17 nt, Homo sapiens
cagaccccgucucuauc

SEQ ID NO: 14398 - RNA, 21 nt, Homo sapiens
cagcauucuuggaagcuaagg

SEQ ID NO: 14399 - RNA, 18 nt, Homo sapiens
cccgcgcugagacccugg

SEQ ID NO: 14400 - RNA, 18 nt, Homo sapiens
cuccugccacaugcacug

SEQ ID NO: 14401 - RNA, 20 nt, Homo sapiens
gccugggaaggaaaggagaa

SEQ ID NO: 14402 - RNA, 18 nt, Homo sapiens
uaaggcaggaggaucacu

SEQ ID NO: 14403 - RNA, 18 nt, Homo sapiens
uugcaacaguuuguuugu

SEQ ID NO: 14404 - RNA, 23 nt, Homo sapiens
aguguccuguauaaaaaugauga

SEQ ID NO: 14405 - RNA, 18 nt, Homo sapiens
cgccggguucggcggcgg

SEQ ID NO: 14406 - RNA, 15 nt, Homo sapiens
augggcaaguuagga

SEQ ID NO: 14407 - RNA, 20 nt, Homo sapiens
auguacauauuuuuauauuu

SEQ ID NO: 14408 - RNA, 17 nt, Homo sapiens
gaauaugggcaaguuag

SEQ ID NO: 14409 - RNA, 23 nt, Homo sapiens
gagagagagagagagaaaaaaaa

SEQ ID NO: 14410 - RNA, 19 nt, Homo sapiens
ugauaugccugcagguuug

SEQ ID NO: 14411 - RNA, 21 nt, Homo sapiens
uuauguauuuuuuccuuccuu

SEQ ID NO: 14412 - RNA, 20 nt, Homo sapiens
uuccuuccuuuucuuucucu

SEQ ID NO: 14413 - RNA, 15 nt, Homo sapiens
aagaacuguggggcu

SEQ ID NO: 14414 - RNA, 23 nt, Homo sapiens
cauuggcauuccaggguggggcg

SEQ ID NO: 14415 - RNA, 21 nt, Homo sapiens
ccaugccuccuccuaccaguc

SEQ ID NO: 14416 - RNA, 21 nt, Homo sapiens
gaggaaaagagagagaaagag

SEQ ID NO: 14417 - RNA, 16 nt, Homo sapiens
uacuuugcagccuucc

SEQ ID NO: 14418 - RNA, 19 nt, Homo sapiens
uuggcauuccagggugggg

SEQ ID NO: 14419 - RNA, 29 nt, Homo sapiens
ggcaaggagggaagagguaugcuucuagc

SEQ ID NO: 14420 - RNA, 27 nt, Homo sapiens
ucgcaagggguggggagcaaggagcuu

SEQ ID NO: 14421 - RNA, 18 nt, Homo sapiens
ugcccuuuuucaauucag

SEQ ID NO: 14422 - RNA, 21 nt, Homo sapiens
aggcaggccgaugcagccugg

SEQ ID NO: 14423 - RNA, 24 nt, Homo sapiens
aggcggggcggggcggggcggacu

SEQ ID NO: 14424 - RNA, 21 nt, Homo sapiens
auaaacugcuaggcugcaagg

SEQ ID NO: 14425 - RNA, 16 nt, Homo sapiens
cagaaaggagggguca

SEQ ID NO: 14426 - RNA, 17 nt, Homo sapiens
cccgccgcgccccgccc

SEQ ID NO: 14427 - RNA, 18 nt, Homo sapiens
cccgccuccuuuccccgc

SEQ ID NO: 14428 - RNA, 24 nt, Homo sapiens
ccgccgcgccccgccccccggccg

SEQ ID NO: 14429 - RNA, 17 nt, Homo sapiens
ccugccauggcguccug

SEQ ID NO: 14430 - RNA, 17 nt, Homo sapiens
cgacguccuggccccga

SEQ ID NO: 14431 - RNA, 22 nt, Homo sapiens
cgccggggccggacggccgggc

SEQ ID NO: 14432 - RNA, 19 nt, Homo sapiens
cuggucaagagagcgaacg

SEQ ID NO: 14433 - RNA, 18 nt, Homo sapiens
gcagccuggggacugugg

SEQ ID NO: 14434 - RNA, 16 nt, Homo sapiens
gcccgccuccuuuccc

SEQ ID NO: 14435 - RNA, 18 nt, Homo sapiens
gcuugcccggcucccuuc

SEQ ID NO: 14436 - RNA, 20 nt, Homo sapiens
ggagaaggggucuggucaag

SEQ ID NO: 14437 - RNA, 16 nt, Homo sapiens
ggagucggcuuuccgg

SEQ ID NO: 14438 - RNA, 17 nt, Homo sapiens
ggcccgccuccuuuccc

SEQ ID NO: 14439 - RNA, 22 nt, Homo sapiens
ugagaggagccugugugucaaa

SEQ ID NO: 14440 - RNA, 23 nt, Homo sapiens
ugcccugggcuugcccggcuccc

SEQ ID NO: 14441 - RNA, 17 nt, Homo sapiens
ccucugagccaaacgcc

SEQ ID NO: 14442 - RNA, 17 nt, Homo sapiens
aagugugucaagagagu

SEQ ID NO: 14443 - RNA, 22 nt, Homo sapiens
acucaaaacuuguagaaugccu

SEQ ID NO: 14444 - RNA, 22 nt, Homo sapiens
cccggaaaaagcucagccgcgg

SEQ ID NO: 14445 - RNA, 20 nt, Homo sapiens
cguuaccugcgccuccagcg

SEQ ID NO: 14446 - RNA, 26 nt, Homo sapiens
cucaucccgggccccggggguccugg

SEQ ID NO: 14447 - RNA, 18 nt, Homo sapiens
gaaggggcgggcgggcgg

SEQ ID NO: 14448 - RNA, 21 nt, Homo sapiens
gcacggaaggggcgggcgggc

SEQ ID NO: 14449 - RNA, 19 nt, Homo sapiens
gccuuggccugucacgguc

SEQ ID NO: 14450 - RNA, 19 nt, Homo sapiens
ggcgggcgggcggcggccg

SEQ ID NO: 14451 - RNA, 19 nt, Homo sapiens
ggguccuggggcccgagac

SEQ ID NO: 14452 - RNA, 23 nt, Homo sapiens
uaaaauguaaugcuaacucaaaa

SEQ ID NO: 14453 - RNA, 17 nt, Homo sapiens
uaauaagugugucaaga

SEQ ID NO: 14454 - RNA, 19 nt, Homo sapiens
uauguccuguuuggacaaa

SEQ ID NO: 14455 - RNA, 20 nt, Homo sapiens
cacacuccaguggcaccucc

SEQ ID NO: 14456 - RNA, 19 nt, Homo sapiens
cccccacuuccaccccguc

SEQ ID NO: 14457 - RNA, 20 nt, Homo sapiens
cccggccccgauccccuccc

SEQ ID NO: 14458 - RNA, 22 nt, Homo sapiens
ccggccccgauccccucccccc

SEQ ID NO: 14459 - RNA, 18 nt, Homo sapiens
gccccgauccccuccccc

SEQ ID NO: 14460 - RNA, 21 nt, Homo sapiens
gcggcagcagcggcggcggcg

SEQ ID NO: 14461 - RNA, 21 nt, Homo sapiens
gcggcccccgggguccccggc

SEQ ID NO: 14462 - RNA, 18 nt, Homo sapiens
gcggcugcggcgggcgcc

SEQ ID NO: 14463 - RNA, 24 nt, Homo sapiens
ggcggcagcagcggcggcggcggc

SEQ ID NO: 14464 - RNA, 21 nt, Homo sapiens
ggcggcggcggcuccgcggcc

SEQ ID NO: 14465 - RNA, 14 nt, Homo sapiens
ggugggcuuuuucc

SEQ ID NO: 14466 - RNA, 18 nt, Homo sapiens
ucgccccaucccgggcuc

SEQ ID NO: 14467 - RNA, 18 nt, Homo sapiens
acaaagucauuauuaugu

SEQ ID NO: 14468 - RNA, 18 nt, Homo sapiens
aggccccacccacaccca

SEQ ID NO: 14469 - RNA, 22 nt, Homo sapiens
agggguggggaggagagagggg

SEQ ID NO: 14470 - RNA, 17 nt, Homo sapiens
augcuuccugagaggcu

SEQ ID NO: 14471 - RNA, 17 nt, Homo sapiens
cuagucccaccaccugc

SEQ ID NO: 14472 - RNA, 20 nt, Homo sapiens
cucagggccaccaggcaacc

SEQ ID NO: 14473 - RNA, 18 nt, Homo sapiens
gaugcccccuugggggua

SEQ ID NO: 14474 - RNA, 16 nt, Homo sapiens
gcccuugaccaggcag

SEQ ID NO: 14475 - RNA, 20 nt, Homo sapiens
ggugcagggcugagcaggua

SEQ ID NO: 14476 - RNA, 22 nt, Homo sapiens
gguuaccagggguggggaggag

SEQ ID NO: 14477 - RNA, 18 nt, Homo sapiens
guggggaggagacagaag

SEQ ID NO: 14478 - RNA, 23 nt, Homo sapiens
ucucccacuacguaccugcuggu

SEQ ID NO: 14479 - RNA, 18 nt, Homo sapiens
uggaugcccccuuggggg

SEQ ID NO: 14480 - RNA, 17 nt, Homo sapiens
uggggaggagagagggg

SEQ ID NO: 14481 - RNA, 22 nt, Homo sapiens
ugguggggcuguuccagccugg

SEQ ID NO: 14482 - RNA, 19 nt, Homo sapiens
uugaucauuucacaaugua

SEQ ID NO: 14483 - RNA, 16 nt, Homo sapiens
agccaaaggucuugca

SEQ ID NO: 14484 - RNA, 17 nt, Homo sapiens
gaggcugcugcugucgg

SEQ ID NO: 14485 - RNA, 21 nt, Homo sapiens
aggggcggcggggggggcggg

SEQ ID NO: 14486 - RNA, 24 nt, Homo sapiens
aggggcggcggggggggcgggggg

SEQ ID NO: 14487 - RNA, 19 nt, Homo sapiens
caguguuacacgugugugu

SEQ ID NO: 14488 - RNA, 21 nt, Homo sapiens
gcggcggggggggcggggggg

SEQ ID NO: 14489 - RNA, 22 nt, Homo sapiens
gcggcggggggggcgggggggg

SEQ ID NO: 14490 - RNA, 15 nt, Homo sapiens
ggcggcggggggggc

SEQ ID NO: 14491 - RNA, 18 nt, Homo sapiens
gggcggcggggggggcgg

SEQ ID NO: 14492 - RNA, 16 nt, Homo sapiens
ggggcggcgggggggg

SEQ ID NO: 14493 - RNA, 18 nt, Homo sapiens
ggggcggcggggggggcg

SEQ ID NO: 14494 - RNA, 16 nt, Homo sapiens
gggggggcgggggggg

SEQ ID NO: 14495 - RNA, 17 nt, Homo sapiens
ggggggggcgggggggg

SEQ ID NO: 14496 - RNA, 19 nt, Homo sapiens
uauuuaacaaaugauacca

SEQ ID NO: 14497 - RNA, 21 nt, Homo sapiens
ugaaugcugaccuuccuuauc

SEQ ID NO: 14498 - RNA, 21 nt, Homo sapiens
uggggaccggguggggggaaa

SEQ ID NO: 14499 - RNA, 20 nt, Homo sapiens
accagggguuucagacgugc

SEQ ID NO: 14500 - RNA, 25 nt, Homo sapiens
cccagagcgcgcagggacggucccg

SEQ ID NO: 14501 - RNA, 17 nt, Homo sapiens
ccccgccccggccuccc

SEQ ID NO: 14502 - RNA, 23 nt, Homo sapiens
ccucaggcagcuguucuaacccu

SEQ ID NO: 14503 - RNA, 17 nt, Homo sapiens
cugggggacgggggggu

SEQ ID NO: 14504 - RNA, 19 nt, Homo sapiens
gcagggcgugggcgaaggc

SEQ ID NO: 14505 - RNA, 23 nt, Homo sapiens
ggccggguggggcgaagcccggg

SEQ ID NO: 14506 - RNA, 24 nt, Homo sapiens
gggccggguggggcgaagcccggg

SEQ ID NO: 14507 - RNA, 19 nt, Homo sapiens
gggggcgggugaggggagc

SEQ ID NO: 14508 - RNA, 21 nt, Homo sapiens
gggggcgggugaggggagcgg

SEQ ID NO: 14509 - RNA, 19 nt, Homo sapiens
ucaggcagcuguucuaacc

SEQ ID NO: 14510 - RNA, 26 nt, Homo sapiens
ccgcggccgccgcugagcuacgugcc

SEQ ID NO: 14511 - RNA, 20 nt, Homo sapiens
gcgccgcggccgccgcugag

SEQ ID NO: 14512 - RNA, 23 nt, Homo sapiens
acaagucugaagcuggagaaaga

SEQ ID NO: 14513 - RNA, 14 nt, Homo sapiens
agaaagaugucugg

SEQ ID NO: 14514 - RNA, 21 nt, Homo sapiens
aggaggagccggcgccgcgcu

SEQ ID NO: 14515 - RNA, 21 nt, Homo sapiens
cccugugaagcccucagaugu

SEQ ID NO: 14516 - RNA, 24 nt, Homo sapiens
ccgcugauuucugcauucauucag

SEQ ID NO: 14517 - RNA, 17 nt, Homo sapiens
ccggcccgcaaggccac

SEQ ID NO: 14518 - RNA, 18 nt, Homo sapiens
ccucccugccccuuucua

SEQ ID NO: 14519 - RNA, 18 nt, Homo sapiens
cgccgcgcucaccuccgc

SEQ ID NO: 14520 - RNA, 17 nt, Homo sapiens
cugcuguaggguggcug

SEQ ID NO: 14521 - RNA, 21 nt, Homo sapiens
cuucaaaggagauuucggagg

SEQ ID NO: 14522 - RNA, 16 nt, Homo sapiens
gacaucuccuguggcu

SEQ ID NO: 14523 - RNA, 22 nt, Homo sapiens
gcaagauuucugguuagagcug

SEQ ID NO: 14524 - RNA, 19 nt, Homo sapiens
ggaaacaaacguggagaca

SEQ ID NO: 14525 - RNA, 17 nt, Homo sapiens
gggaaaacagcagggag

SEQ ID NO: 14526 - RNA, 22 nt, Homo sapiens
ggggaggaauccagacagguga

SEQ ID NO: 14527 - RNA, 18 nt, Homo sapiens
uaggguggcugugggugg

SEQ ID NO: 14528 - RNA, 18 nt, Homo sapiens
uccuacugaaaguuuuga

SEQ ID NO: 14529 - RNA, 20 nt, Homo sapiens
cacguggucugagugggucu

SEQ ID NO: 14530 - RNA, 20 nt, Homo sapiens
cccugcaccuccccuccucc

SEQ ID NO: 14531 - RNA, 18 nt, Homo sapiens
cccuuccagugugaaggc

SEQ ID NO: 14532 - RNA, 15 nt, Homo sapiens
ccgaccccgcucccu

SEQ ID NO: 14533 - RNA, 17 nt, Homo sapiens
ccuccccuccucccugc

SEQ ID NO: 14534 - RNA, 19 nt, Homo sapiens
ggcauccgggcccuggccc

SEQ ID NO: 14535 - RNA, 16 nt, Homo sapiens
ggguggggucccuggg

SEQ ID NO: 14536 - RNA, 22 nt, Homo sapiens
ucccucgguucuggagcagucc

SEQ ID NO: 14537 - RNA, 16 nt, Homo sapiens
uuccugugcaguguag

SEQ ID NO: 14538 - RNA, 19 nt, Homo sapiens
agcucaggcucuuucagcc

SEQ ID NO: 14539 - RNA, 19 nt, Homo sapiens
aggggggauaugcugguug

SEQ ID NO: 14540 - RNA, 22 nt, Homo sapiens
uaggcuauuugguggcccucag

SEQ ID NO: 14541 - RNA, 23 nt, Homo sapiens
ugcugguuggugaacuggccaca

SEQ ID NO: 14542 - RNA, 15 nt, Homo sapiens
agaguuaucccuugc

SEQ ID NO: 14543 - RNA, 20 nt, Homo sapiens
ugcaacucuggccuauauga

SEQ ID NO: 14544 - RNA, 22 nt, Homo sapiens
agagacuuaggugaagaauuau

SEQ ID NO: 14545 - RNA, 16 nt, Homo sapiens
cuacauuucuuuccaa

SEQ ID NO: 14546 - RNA, 27 nt, Homo sapiens
uauaauccuuacuucuaaccaaaaucu

SEQ ID NO: 14547 - RNA, 21 nt, Homo sapiens
uauguaaguauugaaauagua

SEQ ID NO: 14548 - RNA, 20 nt, Homo sapiens
ugaaaguggauacagccaca

SEQ ID NO: 14549 - RNA, 18 nt, Homo sapiens
uguccucuggguagggcc

SEQ ID NO: 14550 - RNA, 18 nt, Homo sapiens
cagugcaauucaaaagca

SEQ ID NO: 14551 - RNA, 20 nt, Homo sapiens
uauuaaaaacacccauaucu

SEQ ID NO: 14552 - RNA, 18 nt, Homo sapiens
aauauuugucuuauauga

SEQ ID NO: 14553 - RNA, 21 nt, Homo sapiens
cugugugaagaagggcacaua

SEQ ID NO: 14554 - RNA, 21 nt, Homo sapiens
uaaauuaugcucucauugaca

SEQ ID NO: 14555 - RNA, 16 nt, Homo sapiens
ucacaaucuaguagac

SEQ ID NO: 14556 - RNA, 16 nt, Homo sapiens
uucguuagugucugug

SEQ ID NO: 14557 - RNA, 17 nt, Homo sapiens
cagccacggccucuugc

SEQ ID NO: 14558 - RNA, 20 nt, Homo sapiens
cagcccccucucccuggggc

SEQ ID NO: 14559 - RNA, 19 nt, Homo sapiens
cccccucucccuggggcuc

SEQ ID NO: 14560 - RNA, 23 nt, Homo sapiens
ccugggggcacagggagcuggag

SEQ ID NO: 14561 - RNA, 27 nt, Homo sapiens
gggagcugggggcugcugcguggccac

SEQ ID NO: 14562 - RNA, 18 nt, Homo sapiens
gggcccaaggggaggugg

SEQ ID NO: 14563 - RNA, 18 nt, Homo sapiens
ggggccagacagucucca

SEQ ID NO: 14564 - RNA, 18 nt, Homo sapiens
ugccccuggguggaaggc

SEQ ID NO: 14565 - RNA, 15 nt, Homo sapiens
uugccggcuguacaa

SEQ ID NO: 14566 - RNA, 21 nt, Homo sapiens
uuugccggcuguacaauuuau

SEQ ID NO: 14567 - RNA, 26 nt, Homo sapiens
aagggccugguagaggaggggaucuu

SEQ ID NO: 14568 - RNA, 19 nt, Homo sapiens
acacgcaguccccuccuuc

SEQ ID NO: 14569 - RNA, 21 nt, Homo sapiens
accccgccugaugugagggac

SEQ ID NO: 14570 - RNA, 18 nt, Homo sapiens
agggaaggggguugggag

SEQ ID NO: 14571 - RNA, 21 nt, Homo sapiens
caaguccgauugggucugcug

SEQ ID NO: 14572 - RNA, 18 nt, Homo sapiens
ccaucccccaugcagacc

SEQ ID NO: 14573 - RNA, 17 nt, Homo sapiens
ccccugccaaccaccac

SEQ ID NO: 14574 - RNA, 16 nt, Homo sapiens
ccgcccgcagccuccc

SEQ ID NO: 14575 - RNA, 18 nt, Homo sapiens
cgccugccgcuucuguuc

SEQ ID NO: 14576 - RNA, 19 nt, Homo sapiens
cggagucuaguguguaggg

SEQ ID NO: 14577 - RNA, 16 nt, Homo sapiens
cggugccggcccccga

SEQ ID NO: 14578 - RNA, 24 nt, Homo sapiens
cugccgcuucuguuaccacaggcg

SEQ ID NO: 14579 - RNA, 15 nt, Homo sapiens
cuugcgaggccgcgg

SEQ ID NO: 14580 - RNA, 16 nt, Homo sapiens
gagcucaaaguggagc

SEQ ID NO: 14581 - RNA, 26 nt, Homo sapiens
gaggcggcaggcgccgggggcuggag

SEQ ID NO: 14582 - RNA, 20 nt, Homo sapiens
gagggagacccuucaaagcc

SEQ ID NO: 14583 - RNA, 19 nt, Homo sapiens
gccacguccgccgccugcc

SEQ ID NO: 14584 - RNA, 19 nt, Homo sapiens
gcgguugucacagccgcgg

SEQ ID NO: 14585 - RNA, 19 nt, Homo sapiens
ggagggcagcgagacgagg

SEQ ID NO: 14586 - RNA, 20 nt, Homo sapiens
gggaggggguaagaaaagga

SEQ ID NO: 14587 - RNA, 16 nt, Homo sapiens
ggggagggaagggggu

SEQ ID NO: 14588 - RNA, 17 nt, Homo sapiens
gguaagaaaaggaaaaa

SEQ ID NO: 14589 - RNA, 20 nt, Homo sapiens
uaagguugagggggaaggaa

SEQ ID NO: 14590 - RNA, 18 nt, Homo sapiens
uaaguggggggaaugggg

SEQ ID NO: 14591 - RNA, 20 nt, Homo sapiens
ucaggacgccgcccgcagcc

SEQ ID NO: 14592 - RNA, 18 nt, Homo sapiens
uccaaagacugcaggcug

SEQ ID NO: 14593 - RNA, 18 nt, Homo sapiens
ucccuucccuuuccauuc

SEQ ID NO: 14594 - RNA, 22 nt, Homo sapiens
ucgcugaucaauucaugccacc

SEQ ID NO: 14595 - RNA, 21 nt, Homo sapiens
ucuagaggaaaaaggcuuaag

SEQ ID NO: 14596 - RNA, 17 nt, Homo sapiens
ucuccaggauuuccauu

SEQ ID NO: 14597 - RNA, 22 nt, Homo sapiens
ucugagguugccaggaccauga

SEQ ID NO: 14598 - RNA, 17 nt, Homo sapiens
ugccacuaagcagguac

SEQ ID NO: 14599 - RNA, 18 nt, Homo sapiens
uggggagcgagaaaguuu

SEQ ID NO: 14600 - RNA, 22 nt, Homo sapiens
uggggagggaaggggguuggga

SEQ ID NO: 14601 - RNA, 19 nt, Homo sapiens
aagucugcuuuacuuuugc

SEQ ID NO: 14602 - RNA, 20 nt, Homo sapiens
uacuuuugcuagcucccugg

SEQ ID NO: 14603 - RNA, 18 nt, Homo sapiens
ugucaaauccucugaaaa

SEQ ID NO: 14604 - RNA, 22 nt, Homo sapiens
uuuugcuagcucccugguucag

SEQ ID NO: 14605 - RNA, 19 nt, Homo sapiens
gcuagaauauaucuacuga

SEQ ID NO: 14606 - RNA, 24 nt, Homo sapiens
aaugaagagaaaagguagaugaca

SEQ ID NO: 14607 - RNA, 17 nt, Homo sapiens
agcaggcauguugccca

SEQ ID NO: 14608 - RNA, 19 nt, Homo sapiens
aggucccuaguaggcugcc

SEQ ID NO: 14609 - RNA, 16 nt, Homo sapiens
cccgcagaaacagccc

SEQ ID NO: 14610 - RNA, 18 nt, Homo sapiens
cuggagagagaaauggaa

SEQ ID NO: 14611 - RNA, 19 nt, Homo sapiens
gaacuccugaccucgugau

SEQ ID NO: 14612 - RNA, 22 nt, Homo sapiens
gagaccauccuguguugcucuc

SEQ ID NO: 14613 - RNA, 24 nt, Homo sapiens
ggaugagauguccccaaggacaaa

SEQ ID NO: 14614 - RNA, 19 nt, Homo sapiens
uacagggcuuuccuccccc

SEQ ID NO: 14615 - RNA, 20 nt, Homo sapiens
uagcuuguuuguuugugucu

SEQ ID NO: 14616 - RNA, 20 nt, Homo sapiens
uucagaguguuccugaaagu

SEQ ID NO: 14617 - RNA, 14 nt, Homo sapiens
uuuugcuuccccag

SEQ ID NO: 14618 - RNA, 18 nt, Homo sapiens
cacaaacacccugacaca

SEQ ID NO: 14619 - RNA, 16 nt, Homo sapiens
gcugcugcugggggca

SEQ ID NO: 14620 - RNA, 18 nt, Homo sapiens
aaaacgcuuucuccaaaa

SEQ ID NO: 14621 - RNA, 19 nt, Homo sapiens
aaauccagaucaguggggc

SEQ ID NO: 14622 - RNA, 17 nt, Homo sapiens
acagaugugucauuuug

SEQ ID NO: 14623 - RNA, 19 nt, Homo sapiens
aggcgggagacgcggugcg

SEQ ID NO: 14624 - RNA, 21 nt, Homo sapiens
gcggggcugcggagaaggcgg

SEQ ID NO: 14625 - RNA, 23 nt, Homo sapiens
uauacaguugaaggcaaaggagg

SEQ ID NO: 14626 - RNA, 17 nt, Homo sapiens
ugcacagaugugucauu

SEQ ID NO: 14627 - RNA, 19 nt, Homo sapiens
ccugauggacaggagggcg

SEQ ID NO: 14628 - RNA, 20 nt, Homo sapiens
ggagcuccuuaaaauaugcc

SEQ ID NO: 14629 - RNA, 20 nt, Homo sapiens
acaggugugcgccaccaugc

SEQ ID NO: 14630 - RNA, 23 nt, Homo sapiens
caaaagcuugggaauuauauucu

SEQ ID NO: 14631 - RNA, 19 nt, Homo sapiens
gacuacaggugugcgccac

SEQ ID NO: 14632 - RNA, 20 nt, Homo sapiens
ucaugaccuuauuccuucug

SEQ ID NO: 14633 - RNA, 24 nt, Homo sapiens
uucaagaguguuuauacguagaaa

SEQ ID NO: 14634 - RNA, 19 nt, Homo sapiens
aaaggaggggaaaucugaa

SEQ ID NO: 14635 - RNA, 21 nt, Homo sapiens
aggggcggguggggauggggg

SEQ ID NO: 14636 - RNA, 18 nt, Homo sapiens
augguuccaggggcucgg

SEQ ID NO: 14637 - RNA, 21 nt, Homo sapiens
cagggguugggcugcggccug

SEQ ID NO: 14638 - RNA, 16 nt, Homo sapiens
ccugcggccuggggcu

SEQ ID NO: 14639 - RNA, 21 nt, Homo sapiens
cgcgggcggcgcgggcagcgg

SEQ ID NO: 14640 - RNA, 18 nt, Homo sapiens
cuuuuggggagggggcgg

SEQ ID NO: 14641 - RNA, 19 nt, Homo sapiens
gagggaggcggccaggggc

SEQ ID NO: 14642 - RNA, 20 nt, Homo sapiens
gccuccccgcagcccugccc

SEQ ID NO: 14643 - RNA, 24 nt, Homo sapiens
gcgggcagcggagcggcggcggcg

SEQ ID NO: 14644 - RNA, 16 nt, Homo sapiens
gcuccugccaccgucc

SEQ ID NO: 14645 - RNA, 20 nt, Homo sapiens
ggagccagacgcuguugggg

SEQ ID NO: 14646 - RNA, 18 nt, Homo sapiens
gggcaccuggccccuugc

SEQ ID NO: 14647 - RNA, 20 nt, Homo sapiens
ggggcaagggcgaagagggg

SEQ ID NO: 14648 - RNA, 18 nt, Homo sapiens
gggggcagcagggcaggg

SEQ ID NO: 14649 - RNA, 16 nt, Homo sapiens
gggggcaggcaguagc

SEQ ID NO: 14650 - RNA, 17 nt, Homo sapiens
gguugggcugcggccug

SEQ ID NO: 14651 - RNA, 18 nt, Homo sapiens
ugcaggggagggggcggc

SEQ ID NO: 14652 - RNA, 19 nt, Homo sapiens
aauacaugaaaaguuuuau

SEQ ID NO: 14653 - RNA, 18 nt, Homo sapiens
agagagaaaccaaaaaua

SEQ ID NO: 14654 - RNA, 21 nt, Homo sapiens
agaggcacugaucucagacau

SEQ ID NO: 14655 - RNA, 16 nt, Homo sapiens
agcagcccuccagucc

SEQ ID NO: 14656 - RNA, 20 nt, Homo sapiens
agcugaaauuacagccaggg

SEQ ID NO: 14657 - RNA, 18 nt, Homo sapiens
auuguaugaguuuuagau

SEQ ID NO: 14658 - RNA, 18 nt, Homo sapiens
cccgcccaacccaccuga

SEQ ID NO: 14659 - RNA, 15 nt, Homo sapiens
gaguuauugucccuu

SEQ ID NO: 14660 - RNA, 22 nt, Homo sapiens
ggggugauaggggagagaggug

SEQ ID NO: 14661 - RNA, 16 nt, Homo sapiens
guagguguuaacaugu

SEQ ID NO: 14662 - RNA, 20 nt, Homo sapiens
uccaagguaagguuuugccu

SEQ ID NO: 14663 - RNA, 22 nt, Homo sapiens
uccgugcaugagagguguccag

SEQ ID NO: 14664 - RNA, 18 nt, Homo sapiens
ugggaauaaaaaugcuga

SEQ ID NO: 14665 - RNA, 17 nt, Homo sapiens
uuacuucaugauucaau

SEQ ID NO: 14666 - RNA, 18 nt, Homo sapiens
cagaggcagccuuggggu

SEQ ID NO: 14667 - RNA, 20 nt, Homo sapiens
gugcuuuaauagucauuugu

SEQ ID NO: 14668 - RNA, 15 nt, Homo sapiens
agagccgggcccccc

SEQ ID NO: 14669 - RNA, 18 nt, Homo sapiens
gagggcccggggccuggc

SEQ ID NO: 14670 - RNA, 17 nt, Homo sapiens
gccgagcaggggagcac

SEQ ID NO: 14671 - RNA, 20 nt, Homo sapiens
ggcagaguucccgggagcac

SEQ ID NO: 14672 - RNA, 15 nt, Homo sapiens
ugcugggccuggccu

SEQ ID NO: 14673 - RNA, 17 nt, Homo sapiens
aagcgagccacagagcg

SEQ ID NO: 14674 - RNA, 21 nt, Homo sapiens
gcaaauuuaauagggggagaa

SEQ ID NO: 14675 - RNA, 25 nt, Homo sapiens
ggguuuuuuuuuucccccuuaaaau

SEQ ID NO: 14676 - RNA, 18 nt, Homo sapiens
guauauuuacauagcauu

SEQ ID NO: 14677 - RNA, 15 nt, Homo sapiens
guggcugugccaacc

SEQ ID NO: 14678 - RNA, 20 nt, Homo sapiens
guuuuuuuuuucccccuuaa

SEQ ID NO: 14679 - RNA, 19 nt, Homo sapiens
uaaagagaaauugcuagau

SEQ ID NO: 14680 - RNA, 18 nt, Homo sapiens
uauauauauuucuuucua

SEQ ID NO: 14681 - RNA, 21 nt, Homo sapiens
ucuuuguaugcaucucugaua

SEQ ID NO: 14682 - RNA, 26 nt, Homo sapiens
ugcuuuucuucuguauacagaccucu

SEQ ID NO: 14683 - RNA, 18 nt, Homo sapiens
cagcuguucagcagccac

SEQ ID NO: 14684 - RNA, 21 nt, Homo sapiens
aaaaagcuucuccaaugucau

SEQ ID NO: 14685 - RNA, 18 nt, Homo sapiens
ucugacucccaguacggu

SEQ ID NO: 14686 - RNA, 24 nt, Homo sapiens
ucauauuucccagcaucauaaaaa

SEQ ID NO: 14687 - RNA, 17 nt, Homo sapiens
acggggcuggacagagg

SEQ ID NO: 14688 - RNA, 19 nt, Homo sapiens
acggggcuggacagagugu

SEQ ID NO: 14689 - RNA, 21 nt, Homo sapiens
ucacagagcuguucuccugca

SEQ ID NO: 14690 - RNA, 18 nt, Homo sapiens
uggaaugguggcuggaug

SEQ ID NO: 14691 - RNA, 23 nt, Homo sapiens
ugugauguucagcaugugucagu

SEQ ID NO: 14692 - RNA, 18 nt, Homo sapiens
uuccuguagccuccgacc

SEQ ID NO: 14693 - RNA, 18 nt, Homo sapiens
aaucagggaaacaagaag

SEQ ID NO: 14694 - RNA, 18 nt, Homo sapiens
caggagacuggacauaca

SEQ ID NO: 14695 - RNA, 16 nt, Homo sapiens
cggcauccugcaccga

SEQ ID NO: 14696 - RNA, 18 nt, Homo sapiens
gcgggggaguggagaggc

SEQ ID NO: 14697 - RNA, 20 nt, Homo sapiens
uacgggacccaaggacugga

SEQ ID NO: 14698 - RNA, 18 nt, Homo sapiens
uguaacugugugcuacgg

SEQ ID NO: 14699 - RNA, 19 nt, Homo sapiens
aagcugacggagcucccug

SEQ ID NO: 14700 - RNA, 17 nt, Homo sapiens
acgugggcuugggagaa

SEQ ID NO: 14701 - RNA, 20 nt, Homo sapiens
caccccuggccacauccccc

SEQ ID NO: 14702 - RNA, 15 nt, Homo sapiens
ccccggcccggaccg

SEQ ID NO: 14703 - RNA, 17 nt, Homo sapiens
ccggccgcuccgggccc

SEQ ID NO: 14704 - RNA, 22 nt, Homo sapiens
ggugagcacaggagcaccccug

SEQ ID NO: 14705 - RNA, 19 nt, Homo sapiens
aaguuccagugcaaagugc

SEQ ID NO: 14706 - RNA, 16 nt, Homo sapiens
cagcgcgaucccuccc

SEQ ID NO: 14707 - RNA, 26 nt, Homo sapiens
cccgcccgcugcuauggcuguagaca

SEQ ID NO: 14708 - RNA, 19 nt, Homo sapiens
gcccgcucgcucccucugc

SEQ ID NO: 14709 - RNA, 19 nt, Homo sapiens
gcuccggaucucccuuccc

SEQ ID NO: 14710 - RNA, 20 nt, Homo sapiens
gcucgcucccucugccucuc

SEQ ID NO: 14711 - RNA, 24 nt, Homo sapiens
ggccggggcccggcgguggcggcc

SEQ ID NO: 14712 - RNA, 17 nt, Homo sapiens
uccuggcagcggcgggg

SEQ ID NO: 14713 - RNA, 20 nt, Homo sapiens
ugaucaugcauuugaaacaa

SEQ ID NO: 14714 - RNA, 17 nt, Homo sapiens
ugcccuucucgaggcag

SEQ ID NO: 14715 - RNA, 16 nt, Homo sapiens
gagcuggcucugcugg

SEQ ID NO: 14716 - RNA, 22 nt, Homo sapiens
gcacagacaccuaagaccaugg

SEQ ID NO: 14717 - RNA, 20 nt, Homo sapiens
gccagcauguaguccagcaa

SEQ ID NO: 14718 - RNA, 28 nt, Homo sapiens
gcucucccgcagccaagccuggucuccc

SEQ ID NO: 14719 - RNA, 16 nt, Homo sapiens
gucguggucacagcag

SEQ ID NO: 14720 - RNA, 19 nt, Homo sapiens
uccaggaauugagagguaa

SEQ ID NO: 14721 - RNA, 15 nt, Homo sapiens
ugagaguacaugucu

SEQ ID NO: 14722 - RNA, 21 nt, Homo sapiens
ugauguccagcugcugcagac

SEQ ID NO: 14723 - RNA, 17 nt, Homo sapiens
ugucguggucacagcag

SEQ ID NO: 14724 - RNA, 17 nt, Homo sapiens
ugugauguccagcugcg

SEQ ID NO: 14725 - RNA, 15 nt, Homo sapiens
ugcauaucuucuguc

SEQ ID NO: 14726 - RNA, 20 nt, Homo sapiens
ccagaaagauguaguauuuu

SEQ ID NO: 14727 - RNA, 20 nt, Homo sapiens
gcaauuccauuacuugcugc

SEQ ID NO: 14728 - RNA, 18 nt, Homo sapiens
uaaaaaaaaaaaggccac

SEQ ID NO: 14729 - RNA, 21 nt, Homo sapiens
ugcgcuuuuuuuuccuuaaaa

SEQ ID NO: 14730 - RNA, 17 nt, Homo sapiens
uucuagauaagagggca

SEQ ID NO: 14731 - RNA, 17 nt, Homo sapiens
agucuuguuuugacauc

SEQ ID NO: 14732 - RNA, 20 nt, Homo sapiens
guaugacuauuaggagggua

SEQ ID NO: 14733 - RNA, 17 nt, Homo sapiens
uagaagaauucaggguu

SEQ ID NO: 14734 - RNA, 22 nt, Homo sapiens
uguacauuugaacacacggcug

SEQ ID NO: 14735 - RNA, 19 nt, Homo sapiens
uugacaucuugggaaaagc

SEQ ID NO: 14736 - RNA, 26 nt, Homo sapiens
uuuggaucuaucuucuuccuuaacau

SEQ ID NO: 14737 - RNA, 21 nt, Homo sapiens
acuccacgaggguguuuucug

SEQ ID NO: 14738 - RNA, 20 nt, Homo sapiens
cuuuaugaggaauaggagaa

SEQ ID NO: 14739 - RNA, 22 nt, Homo sapiens
ucagugguugcaccauuaaggg

SEQ ID NO: 14740 - RNA, 21 nt, Homo sapiens
agagguacaccaggguuucca

SEQ ID NO: 14741 - RNA, 18 nt, Homo sapiens
ucaguucuugaaccugug

SEQ ID NO: 14742 - RNA, 19 nt, Homo sapiens
ugcagaaaauugguucauc

SEQ ID NO: 14743 - RNA, 21 nt, Homo sapiens
ccggagccaaccggaaacgga

SEQ ID NO: 14744 - RNA, 20 nt, Homo sapiens
guagagacuacaugagggac

SEQ ID NO: 14745 - RNA, 17 nt, Homo sapiens
uucccaguauaugugca

SEQ ID NO: 14746 - RNA, 19 nt, Homo sapiens
aacagauggugaauccaga

SEQ ID NO: 14747 - RNA, 16 nt, Homo sapiens
gccagagucgcgcugc

SEQ ID NO: 14748 - RNA, 23 nt, Homo sapiens
uacucuuccugcauaaauauuuu

SEQ ID NO: 14749 - RNA, 16 nt, Homo sapiens
cacagcacaaagacac

SEQ ID NO: 14750 - RNA, 17 nt, Homo sapiens
cacagcacaaagacacg

SEQ ID NO: 14751 - RNA, 15 nt, Homo sapiens
ccgcgcgccucagcc

SEQ ID NO: 14752 - RNA, 20 nt, Homo sapiens
ccuucccucccgcgcgccuc

SEQ ID NO: 14753 - RNA, 21 nt, Homo sapiens
gcccuugccuccuucccuccc

SEQ ID NO: 14754 - RNA, 18 nt, Homo sapiens
gcucggcucccgggcgcc

SEQ ID NO: 14755 - RNA, 23 nt, Homo sapiens
gcuguccucucguacucuguaca

SEQ ID NO: 14756 - RNA, 19 nt, Homo sapiens
ggcguuuuuguuuuugaag

SEQ ID NO: 14757 - RNA, 18 nt, Homo sapiens
uacucuguacaauuccuu

SEQ ID NO: 14758 - RNA, 21 nt, Homo sapiens
cucuuaauuuuuucuccucuu

SEQ ID NO: 14759 - RNA, 17 nt, Homo sapiens
uuccucgugucguggcc

SEQ ID NO: 14760 - RNA, 22 nt, Homo sapiens
uuugcacuuugcagcaguagua

SEQ ID NO: 14761 - RNA, 20 nt, Homo sapiens
caaaauuucuucuccccccu

SEQ ID NO: 14762 - RNA, 16 nt, Homo sapiens
cagccgccuguccggg

SEQ ID NO: 14763 - RNA, 25 nt, Homo sapiens
ccggcucugucuaguggcuccggcc

SEQ ID NO: 14764 - RNA, 17 nt, Homo sapiens
ggcucugucuaguggcu

SEQ ID NO: 14765 - RNA, 18 nt, Homo sapiens
uccggaguugggcuuggc

SEQ ID NO: 14766 - RNA, 14 nt, Homo sapiens
ccgccgccucaggg

SEQ ID NO: 14767 - RNA, 18 nt, Homo sapiens
caccagagggauaaaugc

SEQ ID NO: 14768 - RNA, 21 nt, Homo sapiens
uaagugguuucuguccuguag

SEQ ID NO: 14769 - RNA, 18 nt, Homo sapiens
uuugguugagaagguugu

SEQ ID NO: 14770 - RNA, 21 nt, Homo sapiens
ccauccagccccuuggacugc

SEQ ID NO: 14771 - RNA, 18 nt, Homo sapiens
ggagaguguagaaggggc

SEQ ID NO: 14772 - RNA, 21 nt, Homo sapiens
ugagguagggaggggcccagg

SEQ ID NO: 14773 - RNA, 21 nt, Homo sapiens
aagugaaggggccacacgggc

SEQ ID NO: 14774 - RNA, 20 nt, Homo sapiens
caaaaugaggggggugggcu

SEQ ID NO: 14775 - RNA, 18 nt, Homo sapiens
ccuccugugugugugugu

SEQ ID NO: 14776 - RNA, 18 nt, Homo sapiens
cugauggggcugcgcugc

SEQ ID NO: 14777 - RNA, 17 nt, Homo sapiens
gcacuuggccuccccgu

SEQ ID NO: 14778 - RNA, 18 nt, Homo sapiens
gccaggcgggcccccccc

SEQ ID NO: 14779 - RNA, 15 nt, Homo sapiens
gcccaccuagcagug

SEQ ID NO: 14780 - RNA, 14 nt, Homo sapiens
ggacaggaagugug

SEQ ID NO: 14781 - RNA, 17 nt, Homo sapiens
ggccaaaaggguuccau

SEQ ID NO: 14782 - RNA, 20 nt, Homo sapiens
ggcccccuucuggccaagcu

SEQ ID NO: 14783 - RNA, 23 nt, Homo sapiens
gggaaggggaggaugggggagca

SEQ ID NO: 14784 - RNA, 20 nt, Homo sapiens
gggaaggggugggggucugg

SEQ ID NO: 14785 - RNA, 20 nt, Homo sapiens
gggcugagggaggguugagg

SEQ ID NO: 14786 - RNA, 24 nt, Homo sapiens
gggcugggggaacccugggcuggg

SEQ ID NO: 14787 - RNA, 16 nt, Homo sapiens
ggggaggaugggggag

SEQ ID NO: 14788 - RNA, 15 nt, Homo sapiens
ggggggcaagagggg

SEQ ID NO: 14789 - RNA, 20 nt, Homo sapiens
gggggugcgggcuccacagg

SEQ ID NO: 14790 - RNA, 17 nt, Homo sapiens
gggguggggggcaagag

SEQ ID NO: 14791 - RNA, 16 nt, Homo sapiens
guaccaucccuggugu

SEQ ID NO: 14792 - RNA, 19 nt, Homo sapiens
uccuuggcccgccaaaccc

SEQ ID NO: 14793 - RNA, 18 nt, Homo sapiens
ugcccgccggagcuggcc

SEQ ID NO: 14794 - RNA, 21 nt, Homo sapiens
aggcugagcucauaaggccac

SEQ ID NO: 14795 - RNA, 16 nt, Homo sapiens
agucugucugaggguu

SEQ ID NO: 14796 - RNA, 18 nt, Homo sapiens
gagggaaaaguuguuguu

SEQ ID NO: 14797 - RNA, 23 nt, Homo sapiens
ggaggccggaggugagggacugu

SEQ ID NO: 14798 - RNA, 19 nt, Homo sapiens
ggagggagaaaccaaggag

SEQ ID NO: 14799 - RNA, 22 nt, Homo sapiens
uggggggcuaguauugggaaaa

SEQ ID NO: 14800 - RNA, 15 nt, Homo sapiens
uggugggacaucauc

SEQ ID NO: 14801 - RNA, 18 nt, Homo sapiens
uguuguuggggcucaggc

SEQ ID NO: 14802 - RNA, 15 nt, Homo sapiens
cccucccucucgccc

SEQ ID NO: 14803 - RNA, 19 nt, Homo sapiens
ucgccccugcaaguuuacu

SEQ ID NO: 14804 - RNA, 18 nt, Homo sapiens
aauacuuguacaaugaaa

SEQ ID NO: 14805 - RNA, 22 nt, Homo sapiens
acauguauguauacacauauau

SEQ ID NO: 14806 - RNA, 16 nt, Homo sapiens
agugcaaugugaaaca

SEQ ID NO: 14807 - RNA, 23 nt, Homo sapiens
caaguuuacaguuaauuacauuu

SEQ ID NO: 14808 - RNA, 22 nt, Homo sapiens
gaucaugaguuuucauaauuau

SEQ ID NO: 14809 - RNA, 18 nt, Homo sapiens
gcaaugugaaacagucua

SEQ ID NO: 14810 - RNA, 20 nt, Homo sapiens
gcuaauaugcuguuucugcu

SEQ ID NO: 14811 - RNA, 19 nt, Homo sapiens
ggcgcagcagcuacaggug

SEQ ID NO: 14812 - RNA, 17 nt, Homo sapiens
gugcucuguaggugugc

SEQ ID NO: 14813 - RNA, 22 nt, Homo sapiens
uacauguauguauacacauaua

SEQ ID NO: 14814 - RNA, 19 nt, Homo sapiens
ugcagccuaccuuguagcc

SEQ ID NO: 14815 - RNA, 20 nt, Homo sapiens
ugguggguggcgcagcagcu

SEQ ID NO: 14816 - RNA, 20 nt, Homo sapiens
aacaguaguuaauuuagugu

SEQ ID NO: 14817 - RNA, 22 nt, Homo sapiens
ccgcggccgccgcuccugggcc

SEQ ID NO: 14818 - RNA, 19 nt, Homo sapiens
gccgcagccgcgcgggucc

SEQ ID NO: 14819 - RNA, 21 nt, Homo sapiens
gccgccgcugggagacgaggc

SEQ ID NO: 14820 - RNA, 16 nt, Homo sapiens
gccggagcggccccgc

SEQ ID NO: 14821 - RNA, 20 nt, Homo sapiens
gcggcgggaggcgcugcucu

SEQ ID NO: 14822 - RNA, 16 nt, Homo sapiens
ugggagacgaggcggc

SEQ ID NO: 14823 - RNA, 25 nt, Homo sapiens
cggagauaaaagaacgcugcuccag

SEQ ID NO: 14824 - RNA, 26 nt, Homo sapiens
uuuuacuuuauuaaaauacugaguuu

SEQ ID NO: 14825 - RNA, 16 nt, Homo sapiens
cucaaagguaagaaac

SEQ ID NO: 14826 - RNA, 18 nt, Homo sapiens
cugcugcugcugcugcga

SEQ ID NO: 14827 - RNA, 20 nt, Homo sapiens
uggaaauuuugugcucaaag

SEQ ID NO: 14828 - RNA, 20 nt, Homo sapiens
aaagugaucuuugcagucuu

SEQ ID NO: 14829 - RNA, 21 nt, Homo sapiens
accggcucgggcuguggcucg

SEQ ID NO: 14830 - RNA, 23 nt, Homo sapiens
aggaagacgcuaucuaagaaaaa

SEQ ID NO: 14831 - RNA, 21 nt, Homo sapiens
caagugucaacacagugagga

SEQ ID NO: 14832 - RNA, 14 nt, Homo sapiens
caggacggccugcc

SEQ ID NO: 14833 - RNA, 19 nt, Homo sapiens
caguguccucagccauccc

SEQ ID NO: 14834 - RNA, 18 nt, Homo sapiens
ccuccugguccccaacau

SEQ ID NO: 14835 - RNA, 24 nt, Homo sapiens
cgccgcucugggcgcgcucuucgg

SEQ ID NO: 14836 - RNA, 17 nt, Homo sapiens
cggcuggggcucggcuc

SEQ ID NO: 14837 - RNA, 19 nt, Homo sapiens
cucggcuggggcucggcuc

SEQ ID NO: 14838 - RNA, 19 nt, Homo sapiens
gcaaagcaggaagcuccuc

SEQ ID NO: 14839 - RNA, 18 nt, Homo sapiens
gcccucucugggaagcag

SEQ ID NO: 14840 - RNA, 18 nt, Homo sapiens
ggccaggaggcugcaggg

SEQ ID NO: 14841 - RNA, 19 nt, Homo sapiens
ggggagggggagagggaaa

SEQ ID NO: 14842 - RNA, 17 nt, Homo sapiens
ucagggcagaggauggc

SEQ ID NO: 14843 - RNA, 18 nt, Homo sapiens
ugcgugugcgugugcagg

SEQ ID NO: 14844 - RNA, 16 nt, Homo sapiens
ugggaaggucgagggc

SEQ ID NO: 14845 - RNA, 20 nt, Homo sapiens
uggggcccggcuucccuggu

SEQ ID NO: 14846 - RNA, 19 nt, Homo sapiens
agaauagagccgauaacau

SEQ ID NO: 14847 - RNA, 22 nt, Homo sapiens
aggaaaaaggcacuucacugug

SEQ ID NO: 14848 - RNA, 22 nt, Homo sapiens
cagccgcacccagacccgcccc

SEQ ID NO: 14849 - RNA, 17 nt, Homo sapiens
ccggccccgcccgcuac

SEQ ID NO: 14850 - RNA, 15 nt, Homo sapiens
cucaaauagauauag

SEQ ID NO: 14851 - RNA, 18 nt, Homo sapiens
gugaagacuaggauagac

SEQ ID NO: 14852 - RNA, 19 nt, Homo sapiens
uagcuuuccuucaauggua

SEQ ID NO: 14853 - RNA, 20 nt, Homo sapiens
ucaguauucauuuuuguauu

SEQ ID NO: 14854 - RNA, 24 nt, Homo sapiens
uggcagagguguguugaggugugu

SEQ ID NO: 14855 - RNA, 18 nt, Homo sapiens
ccaggacccaccuccucc

SEQ ID NO: 14856 - RNA, 18 nt, Homo sapiens
ggccugaaccccuccccc

SEQ ID NO: 14857 - RNA, 18 nt, Homo sapiens
gggaacaggccugaaccc

SEQ ID NO: 14858 - RNA, 17 nt, Homo sapiens
cacuaugcuuaacaagu

SEQ ID NO: 14859 - RNA, 17 nt, Homo sapiens
ccuguaaagaugguuuu

SEQ ID NO: 14860 - RNA, 21 nt, Homo sapiens
gcacauggguguugcaagaga

SEQ ID NO: 14861 - RNA, 22 nt, Homo sapiens
ggagccuguaaagaugguuuuu

SEQ ID NO: 14862 - RNA, 19 nt, Homo sapiens
ggcuauugauaauuaugaa

SEQ ID NO: 14863 - RNA, 17 nt, Homo sapiens
ggucauuucaucagcau

SEQ ID NO: 14864 - RNA, 19 nt, Homo sapiens
guccuguucuuccccuucc

SEQ ID NO: 14865 - RNA, 19 nt, Homo sapiens
uagccucuugcuggagagg

SEQ ID NO: 14866 - RNA, 19 nt, Homo sapiens
uucacaauacacacacaga

SEQ ID NO: 14867 - RNA, 21 nt, Homo sapiens
ggaagggagaugugaggcagg

SEQ ID NO: 14868 - RNA, 19 nt, Homo sapiens
aaagaggagaugggggagg

SEQ ID NO: 14869 - RNA, 22 nt, Homo sapiens
aacugccuuuugccgcacacua

SEQ ID NO: 14870 - RNA, 21 nt, Homo sapiens
aagcacacggaaugcgcaccc

SEQ ID NO: 14871 - RNA, 15 nt, Homo sapiens
agacggggaaacuga

SEQ ID NO: 14872 - RNA, 25 nt, Homo sapiens
agaggagaugggggaggggugggga

SEQ ID NO: 14873 - RNA, 21 nt, Homo sapiens
agauggugggagugggggugg

SEQ ID NO: 14874 - RNA, 16 nt, Homo sapiens
agcccccucccaugug

SEQ ID NO: 14875 - RNA, 19 nt, Homo sapiens
aggacagcgcccagcccgg

SEQ ID NO: 14876 - RNA, 21 nt, Homo sapiens
agggguggggaggaguugggg

SEQ ID NO: 14877 - RNA, 20 nt, Homo sapiens
cacgugaggcccaaagccac

SEQ ID NO: 14878 - RNA, 17 nt, Homo sapiens
cccagagcccauuuccc

SEQ ID NO: 14879 - RNA, 18 nt, Homo sapiens
cccgggugggggcugcuc

SEQ ID NO: 14880 - RNA, 21 nt, Homo sapiens
ccggcucgggcugcgcggggc

SEQ ID NO: 14881 - RNA, 22 nt, Homo sapiens
gaggagaugggggagggguggg

SEQ ID NO: 14882 - RNA, 18 nt, Homo sapiens
gcaccccauccuggccac

SEQ ID NO: 14883 - RNA, 18 nt, Homo sapiens
ggagaugggggaggggug

SEQ ID NO: 14884 - RNA, 21 nt, Homo sapiens
ggaguuggggacaggcccggg

SEQ ID NO: 14885 - RNA, 19 nt, Homo sapiens
ggcaaaguuuggcaggaag

SEQ ID NO: 14886 - RNA, 15 nt, Homo sapiens
ggcuccgggcuccgc

SEQ ID NO: 14887 - RNA, 23 nt, Homo sapiens
gggagggguggggaggaguuggg

SEQ ID NO: 14888 - RNA, 17 nt, Homo sapiens
ggggaggaaggccccuc

SEQ ID NO: 14889 - RNA, 20 nt, Homo sapiens
ggggaggaguuggggacagg

SEQ ID NO: 14890 - RNA, 19 nt, Homo sapiens
ggggagggguggggaggag

SEQ ID NO: 14891 - RNA, 18 nt, Homo sapiens
ggguggggaggaguuggg

SEQ ID NO: 14892 - RNA, 20 nt, Homo sapiens
gguccugugguuggagaggg

SEQ ID NO: 14893 - RNA, 22 nt, Homo sapiens
uagaggcccuuuuccuaucugg

SEQ ID NO: 14894 - RNA, 22 nt, Homo sapiens
ucaugggagcucugugggggag

SEQ ID NO: 14895 - RNA, 21 nt, Homo sapiens
uccgcggcucuguccggcgcc

SEQ ID NO: 14896 - RNA, 18 nt, Homo sapiens
uccuggacacguuccggg

SEQ ID NO: 14897 - RNA, 20 nt, Homo sapiens
ugggagggacuccccacggc

SEQ ID NO: 14898 - RNA, 24 nt, Homo sapiens
uggauauaucagguauaucuuggu

SEQ ID NO: 14899 - RNA, 16 nt, Homo sapiens
aaagcauaaaauccuu

SEQ ID NO: 14900 - RNA, 17 nt, Homo sapiens
ccccggggugcguucgg

SEQ ID NO: 14901 - RNA, 22 nt, Homo sapiens
cgcgguccugcuucccacaccc

SEQ ID NO: 14902 - RNA, 18 nt, Homo sapiens
cucucgguuccugccgcc

SEQ ID NO: 14903 - RNA, 20 nt, Homo sapiens
cuucggauggaaccuugggg

SEQ ID NO: 14904 - RNA, 17 nt, Homo sapiens
gacgcgggaguguaggu

SEQ ID NO: 14905 - RNA, 16 nt, Homo sapiens
gcggcccgagaggcgg

SEQ ID NO: 14906 - RNA, 24 nt, Homo sapiens
gugauuauaaauaacaguuaucug

SEQ ID NO: 14907 - RNA, 16 nt, Homo sapiens
gugcguucggugcucc

SEQ ID NO: 14908 - RNA, 28 nt, Homo sapiens
ucccugaccaccccggggugcgcuucgc

SEQ ID NO: 14909 - RNA, 21 nt, Homo sapiens
uccuagggggcagcacggaug

SEQ ID NO: 14910 - RNA, 16 nt, Homo sapiens
uguucagcccaguuga

SEQ ID NO: 14911 - RNA, 21 nt, Homo sapiens
uuaaagcaaccaaaacuuugu

SEQ ID NO: 14912 - RNA, 20 nt, Homo sapiens
aggggcacucuugaguagcg

SEQ ID NO: 14913 - RNA, 20 nt, Homo sapiens
aguagcgugucugaagagug

SEQ ID NO: 14914 - RNA, 20 nt, Homo sapiens
cagcgccuggcucccgcccg

SEQ ID NO: 14915 - RNA, 18 nt, Homo sapiens
cgggcggcggcggcggcg

SEQ ID NO: 14916 - RNA, 16 nt, Homo sapiens
gcacucuugaguagcg

SEQ ID NO: 14917 - RNA, 15 nt, Homo sapiens
gccggagacgccggc

SEQ ID NO: 14918 - RNA, 17 nt, Homo sapiens
gccugagucgcagccgc

SEQ ID NO: 14919 - RNA, 22 nt, Homo sapiens
gcggcggcggcggcggcuacag

SEQ ID NO: 14920 - RNA, 22 nt, Homo sapiens
gcucccgcccgccggagacgcc

SEQ ID NO: 14921 - RNA, 20 nt, Homo sapiens
gcuuuuggcccauucugcca

SEQ ID NO: 14922 - RNA, 22 nt, Homo sapiens
ggcggcgggcggcggcggcggc

SEQ ID NO: 14923 - RNA, 22 nt, Homo sapiens
ucggccgcccccgccgcgcccg

SEQ ID NO: 14924 - RNA, 19 nt, Homo sapiens
uggcucccgcccgccggag

SEQ ID NO: 14925 - RNA, 20 nt, Homo sapiens
uuacaugguccccccaaauc

SEQ ID NO: 14926 - RNA, 17 nt, Homo sapiens
agggguguucucaucca

SEQ ID NO: 14927 - RNA, 19 nt, Homo sapiens
ccagaggggcaggcuuguc

SEQ ID NO: 14928 - RNA, 21 nt, Homo sapiens
cugcugcuuuugggacuuuuc

SEQ ID NO: 14929 - RNA, 19 nt, Homo sapiens
gcucagggggacccagagg

SEQ ID NO: 14930 - RNA, 17 nt, Homo sapiens
gcuugggggcaaguggc

SEQ ID NO: 14931 - RNA, 17 nt, Homo sapiens
ggcaggcuugucaauga

SEQ ID NO: 14932 - RNA, 24 nt, Homo sapiens
gggagaggaaaaccaccaggcuuc

SEQ ID NO: 14933 - RNA, 16 nt, Homo sapiens
ucgcugaugguuucgg

SEQ ID NO: 14934 - RNA, 23 nt, Homo sapiens
ugagagguuugcacugagcuugg

SEQ ID NO: 14935 - RNA, 18 nt, Homo sapiens
ugaggggagaagggugga

SEQ ID NO: 14936 - RNA, 19 nt, Homo sapiens
ugggacuuuucuagagcua

SEQ ID NO: 14937 - RNA, 17 nt, Homo sapiens
uuaaggccugucgagga

SEQ ID NO: 14938 - RNA, 26 nt, Homo sapiens
ccaaaaugugugugugugugugugua

SEQ ID NO: 14939 - RNA, 18 nt, Homo sapiens
gaaauagaagccuaaaaa

SEQ ID NO: 14940 - RNA, 20 nt, Homo sapiens
gaggagcauugugacacuuu

SEQ ID NO: 14941 - RNA, 17 nt, Homo sapiens
ggaauauucaacauuua

SEQ ID NO: 14942 - RNA, 23 nt, Homo sapiens
ggggaggagucaucaggaggagc

SEQ ID NO: 14943 - RNA, 15 nt, Homo sapiens
ugagcaaguucucca

SEQ ID NO: 14944 - RNA, 14 nt, Homo sapiens
ugugugugucuguc

SEQ ID NO: 14945 - RNA, 18 nt, Homo sapiens
ugugugugugugugugug

SEQ ID NO: 14946 - RNA, 21 nt, Homo sapiens
agaggaaagggaagggucaag

SEQ ID NO: 14947 - RNA, 18 nt, Homo sapiens
aucaucuauauugaaauc

SEQ ID NO: 14948 - RNA, 19 nt, Homo sapiens
caaaugaaacuuacguuuu

SEQ ID NO: 14949 - RNA, 18 nt, Homo sapiens
caggguguuuauugugag

SEQ ID NO: 14950 - RNA, 17 nt, Homo sapiens
ccccuuuuuuggucacu

SEQ ID NO: 14951 - RNA, 20 nt, Homo sapiens
cggcagccgcacaguccugg

SEQ ID NO: 14952 - RNA, 16 nt, Homo sapiens
gccauuggagaagcag

SEQ ID NO: 14953 - RNA, 21 nt, Homo sapiens
uacuggauaguuuucaaacag

SEQ ID NO: 14954 - RNA, 20 nt, Homo sapiens
ugaguaguagggagagaaua

SEQ ID NO: 14955 - RNA, 17 nt, Homo sapiens
ugcagagacagaugugu

SEQ ID NO: 14956 - RNA, 19 nt, Homo sapiens
ugugaggcucaauuuuugc

SEQ ID NO: 14957 - RNA, 22 nt, Homo sapiens
uuuauuuuuuagacugagggcc

SEQ ID NO: 14958 - RNA, 18 nt, Homo sapiens
aaaaaaagaaaaaaaaaa

SEQ ID NO: 14959 - RNA, 19 nt, Homo sapiens
aaaaaaagaaaaaaaaagg

SEQ ID NO: 14960 - RNA, 21 nt, Homo sapiens
aaaccaucauucucaguaaac

SEQ ID NO: 14961 - RNA, 19 nt, Homo sapiens
aggggcaucauggaguuuc

SEQ ID NO: 14962 - RNA, 17 nt, Homo sapiens
auggaggugcugugggg

SEQ ID NO: 14963 - RNA, 18 nt, Homo sapiens
ccucccuccuucaaaugu

SEQ ID NO: 14964 - RNA, 25 nt, Homo sapiens
cuuucuagggcucucaauaaucuuc

SEQ ID NO: 14965 - RNA, 21 nt, Homo sapiens
gacacuauaauugaaauuaga

SEQ ID NO: 14966 - RNA, 23 nt, Homo sapiens
gcgccccgccccagcgaagcccg

SEQ ID NO: 14967 - RNA, 18 nt, Homo sapiens
gcucccuggccuccaggc

SEQ ID NO: 14968 - RNA, 16 nt, Homo sapiens
guggggucgggggagg

SEQ ID NO: 14969 - RNA, 20 nt, Homo sapiens
gugguucuugacuuuuuugg

SEQ ID NO: 14970 - RNA, 19 nt, Homo sapiens
uagguucuuuguuaucccu

SEQ ID NO: 14971 - RNA, 24 nt, Homo sapiens
uaucacacucuggggacuguggug

SEQ ID NO: 14972 - RNA, 17 nt, Homo sapiens
ucgggggaggggggagg

SEQ ID NO: 14973 - RNA, 19 nt, Homo sapiens
ucgggggaggggggaggga

SEQ ID NO: 14974 - RNA, 17 nt, Homo sapiens
ugcacuguccccucccc

SEQ ID NO: 14975 - RNA, 16 nt, Homo sapiens
ugccuggccucaaucc

SEQ ID NO: 14976 - RNA, 20 nt, Homo sapiens
ugucauggaauugugcauac

SEQ ID NO: 14977 - RNA, 18 nt, Homo sapiens
uucaaauguuugccuuuc

SEQ ID NO: 14978 - RNA, 19 nt, Homo sapiens
uuggaaaccaucauucuca

SEQ ID NO: 14979 - RNA, 18 nt, Homo sapiens
gcucaaacccugcuguuu

SEQ ID NO: 14980 - RNA, 16 nt, Homo sapiens
gcugggccagcaccug

SEQ ID NO: 14981 - RNA, 23 nt, Homo sapiens
aagcaggaggcuggcggagcagg

SEQ ID NO: 14982 - RNA, 23 nt, Homo sapiens
ccuggccuugccugccuuugcag

SEQ ID NO: 14983 - RNA, 19 nt, Homo sapiens
ugagucacugggucccagg

SEQ ID NO: 14984 - RNA, 18 nt, Homo sapiens
accgccgcgcagcguccc

SEQ ID NO: 14985 - RNA, 19 nt, Homo sapiens
ccuggggugggacgcgucc

SEQ ID NO: 14986 - RNA, 19 nt, Homo sapiens
cgccgcccggagcgcccca

SEQ ID NO: 14987 - RNA, 17 nt, Homo sapiens
cgccgucgccgcccgga

SEQ ID NO: 14988 - RNA, 17 nt, Homo sapiens
ucacccccucccaucgc

SEQ ID NO: 14989 - RNA, 18 nt, Homo sapiens
uggcauuucucucgggcc

SEQ ID NO: 14990 - RNA, 15 nt, Homo sapiens
uggcugcuguuuccg

SEQ ID NO: 14991 - RNA, 17 nt, Homo sapiens
uucaguuuaugcgccug

SEQ ID NO: 14992 - RNA, 20 nt, Homo sapiens
uucucucgggccugucauuc

SEQ ID NO: 14993 - RNA, 22 nt, Homo sapiens
caggguccucuguggggaggcc

SEQ ID NO: 14994 - RNA, 20 nt, Homo sapiens
cuugcucaggcaggguccuc

SEQ ID NO: 14995 - RNA, 18 nt, Homo sapiens
ggggcccagugguggccu

SEQ ID NO: 14996 - RNA, 19 nt, Homo sapiens
uccccauuccuccaacccc

SEQ ID NO: 14997 - RNA, 19 nt, Homo sapiens
uggggaggccuggagccuu

SEQ ID NO: 14998 - RNA, 20 nt, Homo sapiens
aguggagacucaaucagauu

SEQ ID NO: 14999 - RNA, 16 nt, Homo sapiens
gcccgcucccaguccc

SEQ ID NO: 15000 - RNA, 16 nt, Homo sapiens
agcaguggcacaaucu

SEQ ID NO: 15001 - RNA, 20 nt, Homo sapiens
ugggacaguuugcugugccu

SEQ ID NO: 15002 - RNA, 22 nt, Homo sapiens
acugucaaccucuccuuuucug

SEQ ID NO: 15003 - RNA, 18 nt, Homo sapiens
aggaggcggcgagagggc

SEQ ID NO: 15004 - RNA, 19 nt, Homo sapiens
aggcaaaagagaaaguaaa

SEQ ID NO: 15005 - RNA, 18 nt, Homo sapiens
ccccaguugcuucauaca

SEQ ID NO: 15006 - RNA, 16 nt, Homo sapiens
cucaugguguuuacaa

SEQ ID NO: 15007 - RNA, 17 nt, Homo sapiens
cuuguccuggaacacaa

SEQ ID NO: 15008 - RNA, 21 nt, Homo sapiens
gagaauauagauuuuuuauuc

SEQ ID NO: 15009 - RNA, 18 nt, Homo sapiens
uacgauaauauaugcagg

SEQ ID NO: 15010 - RNA, 20 nt, Homo sapiens
uaguguuuuguuauauacca

SEQ ID NO: 15011 - RNA, 23 nt, Homo sapiens
uaucaucuaugcuuauaagacac

SEQ ID NO: 15012 - RNA, 16 nt, Homo sapiens
ugcacagcaguggggc

SEQ ID NO: 15013 - RNA, 15 nt, Homo sapiens
uucugcccaccccag

SEQ ID NO: 15014 - RNA, 20 nt, Homo sapiens
cuccagcauuuuucugggca

SEQ ID NO: 15015 - RNA, 24 nt, Homo sapiens
gccuccagaugggucuaugauauu

SEQ ID NO: 15016 - RNA, 17 nt, Homo sapiens
ggggccacgcccagccu

SEQ ID NO: 15017 - RNA, 18 nt, Homo sapiens
accagagugacauacuga

SEQ ID NO: 15018 - RNA, 21 nt, Homo sapiens
gccucugguugucuaggugag

SEQ ID NO: 15019 - RNA, 20 nt, Homo sapiens
ggcgacagaggcgacgcgga

SEQ ID NO: 15020 - RNA, 22 nt, Homo sapiens
uuaauaauuugaugaccccauc

SEQ ID NO: 15021 - RNA, 21 nt, Homo sapiens
aaagaauuacaaaauuaaaga

SEQ ID NO: 15022 - RNA, 23 nt, Homo sapiens
cggggccgcgggcgggcgggucg

SEQ ID NO: 15023 - RNA, 18 nt, Homo sapiens
gcccggagcacacacucc

SEQ ID NO: 15024 - RNA, 16 nt, Homo sapiens
ggcacggcugcccgca

SEQ ID NO: 15025 - RNA, 15 nt, Homo sapiens
ggccgcgggcgggcg

SEQ ID NO: 15026 - RNA, 22 nt, Homo sapiens
ggggggaggggagcggggagca

SEQ ID NO: 15027 - RNA, 16 nt, Homo sapiens
uugaaaacuacucaac

SEQ ID NO: 15028 - RNA, 16 nt, Homo sapiens
aggcaccugccuugcc

SEQ ID NO: 15029 - RNA, 21 nt, Homo sapiens
aggccagagaggccggcuggg

SEQ ID NO: 15030 - RNA, 23 nt, Homo sapiens
auuguccuaaugggaggggugca

SEQ ID NO: 15031 - RNA, 20 nt, Homo sapiens
cccagcugggguccaaaccc

SEQ ID NO: 15032 - RNA, 19 nt, Homo sapiens
ccgggcuggccacgagggc

SEQ ID NO: 15033 - RNA, 17 nt, Homo sapiens
ccucccagcuggggucc

SEQ ID NO: 15034 - RNA, 21 nt, Homo sapiens
gaggggggcaugacaggucag

SEQ ID NO: 15035 - RNA, 15 nt, Homo sapiens
gccggggcaagcugc

SEQ ID NO: 15036 - RNA, 18 nt, Homo sapiens
ggcuggggccggggccgg

SEQ ID NO: 15037 - RNA, 22 nt, Homo sapiens
ugacuggugggggcauggggcc

SEQ ID NO: 15038 - RNA, 21 nt, Homo sapiens
ugagaacguggguaguccagc

SEQ ID NO: 15039 - RNA, 21 nt, Homo sapiens
ugcaagagaggggaggguggu

SEQ ID NO: 15040 - RNA, 21 nt, Homo sapiens
uggcuaggguagaaaagaaaa

SEQ ID NO: 15041 - RNA, 16 nt, Homo sapiens
uggcugcgccagccug

SEQ ID NO: 15042 - RNA, 19 nt, Homo sapiens
ugggaggggugcaaaaggc

SEQ ID NO: 15043 - RNA, 22 nt, Homo sapiens
ugguggccaguggugguggagg

SEQ ID NO: 15044 - RNA, 18 nt, Homo sapiens
aaguaaagggccugcggg

SEQ ID NO: 15045 - RNA, 18 nt, Homo sapiens
cccccgggcccgcgcucc

SEQ ID NO: 15046 - RNA, 20 nt, Homo sapiens
ccgccgcgggcgggagccgg

SEQ ID NO: 15047 - RNA, 16 nt, Homo sapiens
cgacaggcucgcgcgg

SEQ ID NO: 15048 - RNA, 17 nt, Homo sapiens
cgcgcggcgcccgagcu

SEQ ID NO: 15049 - RNA, 17 nt, Homo sapiens
gcagaggccaaauguau

SEQ ID NO: 15050 - RNA, 20 nt, Homo sapiens
gccugcccucugugggcagc

SEQ ID NO: 15051 - RNA, 20 nt, Homo sapiens
gcugcgacuauaggcacacg

SEQ ID NO: 15052 - RNA, 17 nt, Homo sapiens
ggagaguuuuggggaaa

SEQ ID NO: 15053 - RNA, 24 nt, Homo sapiens
ggauggaugggagugccugcccuc

SEQ ID NO: 15054 - RNA, 17 nt, Homo sapiens
ggccgagagccguccgg

SEQ ID NO: 15055 - RNA, 19 nt, Homo sapiens
gucgagguggucguucagg

SEQ ID NO: 15056 - RNA, 19 nt, Homo sapiens
gugagacaaaggucaucuu

SEQ ID NO: 15057 - RNA, 17 nt, Homo sapiens
guguuguccaggcuaga

SEQ ID NO: 15058 - RNA, 22 nt, Homo sapiens
uaaaaugccuacacagguuugg

SEQ ID NO: 15059 - RNA, 19 nt, Homo sapiens
uaaauucuugugacacaca

SEQ ID NO: 15060 - RNA, 19 nt, Homo sapiens
uagcaagguugcaggguac

SEQ ID NO: 15061 - RNA, 17 nt, Homo sapiens
ugcacagcagcaguugg

SEQ ID NO: 15062 - RNA, 16 nt, Homo sapiens
ugcuuggccaucgggg

SEQ ID NO: 15063 - RNA, 17 nt, Homo sapiens
uggaccaaauggggucg

SEQ ID NO: 15064 - RNA, 15 nt, Homo sapiens
agcagccuccccaug

SEQ ID NO: 15065 - RNA, 18 nt, Homo sapiens
agcauggcugcggcugug

SEQ ID NO: 15066 - RNA, 15 nt, Homo sapiens
cauggcaauggugca

SEQ ID NO: 15067 - RNA, 18 nt, Homo sapiens
cgucaucgucuucugagc

SEQ ID NO: 15068 - RNA, 19 nt, Homo sapiens
cuuccuggaggcggaggug

SEQ ID NO: 15069 - RNA, 20 nt, Homo sapiens
ggguggcucugagcucugga

SEQ ID NO: 15070 - RNA, 18 nt, Homo sapiens
guggcucugagcucugga

SEQ ID NO: 15071 - RNA, 19 nt, Homo sapiens
uggagguguggaagggugg

SEQ ID NO: 15072 - RNA, 17 nt, Homo sapiens
cggcggguggcgcgucg

SEQ ID NO: 15073 - RNA, 17 nt, Homo sapiens
gcggguggcgcgucggu

SEQ ID NO: 15074 - RNA, 18 nt, Homo sapiens
uacaaugcaaagugccuu

SEQ ID NO: 15075 - RNA, 21 nt, Homo sapiens
ucgcucggucccgucgguccc

SEQ ID NO: 15076 - RNA, 16 nt, Homo sapiens
cuccugcaggaugagc

SEQ ID NO: 15077 - RNA, 19 nt, Homo sapiens
cuucccccacgacggccgc

SEQ ID NO: 15078 - RNA, 17 nt, Homo sapiens
aaaggcauuuauuagau

SEQ ID NO: 15079 - RNA, 18 nt, Homo sapiens
cagaagggcauggagggu

SEQ ID NO: 15080 - RNA, 19 nt, Homo sapiens
cugaguugcugucugacgg

SEQ ID NO: 15081 - RNA, 19 nt, Homo sapiens
ccccgugggugcgccuagc

SEQ ID NO: 15082 - RNA, 15 nt, Homo sapiens
gcggggcuccccuca

SEQ ID NO: 15083 - RNA, 26 nt, Homo sapiens
ggggcgggagggagcgugcuucuagc

SEQ ID NO: 15084 - RNA, 17 nt, Homo sapiens
gugcauuuaucucacag

SEQ ID NO: 15085 - RNA, 22 nt, Homo sapiens
uccgcgggggggcaagggggga

SEQ ID NO: 15086 - RNA, 16 nt, Homo sapiens
ucucucggcuccucgg

SEQ ID NO: 15087 - RNA, 19 nt, Homo sapiens
uggcacaaugaggcugggg

SEQ ID NO: 15088 - RNA, 20 nt, Homo sapiens
ugggggggcgggagggagcg

SEQ ID NO: 15089 - RNA, 18 nt, Homo sapiens
ccccgccccccccuucgc

SEQ ID NO: 15090 - RNA, 19 nt, Homo sapiens
ccgccccccccuucgcccc

SEQ ID NO: 15091 - RNA, 21 nt, Homo sapiens
cuccccgcuccuuuaucugcc

SEQ ID NO: 15092 - RNA, 18 nt, Homo sapiens
uuucucuccccgcuccuu

SEQ ID NO: 15093 - RNA, 17 nt, Homo sapiens
cgggcccgcgcccgccu

SEQ ID NO: 15094 - RNA, 19 nt, Homo sapiens
uguagauuugcacgauuuc

SEQ ID NO: 15095 - RNA, 15 nt, Homo sapiens
acagcagccggcggg

SEQ ID NO: 15096 - RNA, 16 nt, Homo sapiens
cagcauaggaauauug

SEQ ID NO: 15097 - RNA, 22 nt, Homo sapiens
gccgcugccuccucuuccuucc

SEQ ID NO: 15098 - RNA, 19 nt, Homo sapiens
uggaggagcuuguagggga

SEQ ID NO: 15099 - RNA, 21 nt, Homo sapiens
accaggcugacagcuggaggc

SEQ ID NO: 15100 - RNA, 17 nt, Homo sapiens
ucagugauaugagagag

SEQ ID NO: 15101 - RNA, 21 nt, Homo sapiens
agaaagacagaggagaaaaag

SEQ ID NO: 15102 - RNA, 18 nt, Homo sapiens
auguguauguuucugugu

SEQ ID NO: 15103 - RNA, 20 nt, Homo sapiens
cggggguggggaugcauggg

SEQ ID NO: 15104 - RNA, 18 nt, Homo sapiens
cuuuuccccacaucuggc

SEQ ID NO: 15105 - RNA, 24 nt, Homo sapiens
gccuugugagagcccccaccccug

SEQ ID NO: 15106 - RNA, 21 nt, Homo sapiens
ggggaagggaaagugggggag

SEQ ID NO: 15107 - RNA, 21 nt, Homo sapiens
ggguugugggaagaaggggga

SEQ ID NO: 15108 - RNA, 16 nt, Homo sapiens
gugggaagaaggggga

SEQ ID NO: 15109 - RNA, 18 nt, Homo sapiens
uagccccccggcccaugc

SEQ ID NO: 15110 - RNA, 25 nt, Homo sapiens
uauuuaacauauuuggcaauaacuc

SEQ ID NO: 15111 - RNA, 16 nt, Homo sapiens
ugucccaguccugccc

SEQ ID NO: 15112 - RNA, 18 nt, Homo sapiens
uuuguccucuggaagccu

SEQ ID NO: 15113 - RNA, 20 nt, Homo sapiens
gggagggagggggcaaaagc

SEQ ID NO: 15114 - RNA, 22 nt, Homo sapiens
cauuauauacaaacauuacauu

SEQ ID NO: 15115 - RNA, 16 nt, Homo sapiens
gaaauagcuuccaaca

SEQ ID NO: 15116 - RNA, 19 nt, Homo sapiens
uuuuuuuucuucaaacaca

SEQ ID NO: 15117 - RNA, 18 nt, Homo sapiens
agagucaagacccuuuug

SEQ ID NO: 15118 - RNA, 22 nt, Homo sapiens
caguucucaaagagcuuaguuu

SEQ ID NO: 15119 - RNA, 18 nt, Homo sapiens
gaauagagaaaaaaaaua

SEQ ID NO: 15120 - RNA, 23 nt, Homo sapiens
ggcggaguggcaacaacgccgcu

SEQ ID NO: 15121 - RNA, 23 nt, Homo sapiens
aagaggcuccauacaacuggaga

SEQ ID NO: 15122 - RNA, 22 nt, Homo sapiens
agcgagacauauuuuaguauua

SEQ ID NO: 15123 - RNA, 22 nt, Homo sapiens
aguggugacuuuugggauugac

SEQ ID NO: 15124 - RNA, 19 nt, Homo sapiens
augcaaugggaauugauga

SEQ ID NO: 15125 - RNA, 15 nt, Homo sapiens
caccuccuucaggcc

SEQ ID NO: 15126 - RNA, 18 nt, Homo sapiens
ccuucaggccucagguuc

SEQ ID NO: 15127 - RNA, 21 nt, Homo sapiens
gccaauaugggagaaaagaaa

SEQ ID NO: 15128 - RNA, 15 nt, Homo sapiens
gcuggaggggaagcc

SEQ ID NO: 15129 - RNA, 18 nt, Homo sapiens
ggagaggcugaagacaaa

SEQ ID NO: 15130 - RNA, 19 nt, Homo sapiens
uagaguaaaaaagauuguu

SEQ ID NO: 15131 - RNA, 26 nt, Homo sapiens
uauauagucuacauauguauauauau

SEQ ID NO: 15132 - RNA, 22 nt, Homo sapiens
uauauauauagcacuauauaua

SEQ ID NO: 15133 - RNA, 23 nt, Homo sapiens
uauauauauagcacuauauauau

SEQ ID NO: 15134 - RNA, 21 nt, Homo sapiens
uaucacccauuugaaugacag

SEQ ID NO: 15135 - RNA, 21 nt, Homo sapiens
uauguauauauacacauauau

SEQ ID NO: 15136 - RNA, 22 nt, Homo sapiens
uauguauauauacacauauaua

SEQ ID NO: 15137 - RNA, 19 nt, Homo sapiens
ugggaaaggcggaugugca

SEQ ID NO: 15138 - RNA, 24 nt, Homo sapiens
ugugcuuuccucacagaggucuuc

SEQ ID NO: 15139 - RNA, 18 nt, Homo sapiens
uucaaacgugccccuuuc

SEQ ID NO: 15140 - RNA, 22 nt, Homo sapiens
uuuaaaaaaucauauuauuaca

SEQ ID NO: 15141 - RNA, 18 nt, Homo sapiens
gcaagguauaaaagauua

SEQ ID NO: 15142 - RNA, 19 nt, Homo sapiens
gggcuggcguggggcgcag

SEQ ID NO: 15143 - RNA, 23 nt, Homo sapiens
ucccugucacuggacacuuuugu

SEQ ID NO: 15144 - RNA, 19 nt, Homo sapiens
aauguucaucuccacaggg

SEQ ID NO: 15145 - RNA, 17 nt, Homo sapiens
aggcuaccucuucaaag

SEQ ID NO: 15146 - RNA, 19 nt, Homo sapiens
caccccuguccucucugcc

SEQ ID NO: 15147 - RNA, 20 nt, Homo sapiens
cuggaugaggugucggugau

SEQ ID NO: 15148 - RNA, 18 nt, Homo sapiens
gaguuggacuggacaaca

SEQ ID NO: 15149 - RNA, 18 nt, Homo sapiens
gcuucagcccucuccacc

SEQ ID NO: 15150 - RNA, 25 nt, Homo sapiens
uacaaaacauuacauuauauacauu

SEQ ID NO: 15151 - RNA, 19 nt, Homo sapiens
uccagaaagagucaaaaaa

SEQ ID NO: 15152 - RNA, 17 nt, Homo sapiens
uccuguggggggcaggg

SEQ ID NO: 15153 - RNA, 21 nt, Homo sapiens
ucuaaugugagaauauuguuu

SEQ ID NO: 15154 - RNA, 20 nt, Homo sapiens
ugccaucaaggcaagucaac

SEQ ID NO: 15155 - RNA, 20 nt, Homo sapiens
ugccuuagucaucccagggu

SEQ ID NO: 15156 - RNA, 26 nt, Homo sapiens
ugcuuuucuucuaaauacagaccucu

SEQ ID NO: 15157 - RNA, 17 nt, Homo sapiens
uguagcaacuccugugg

SEQ ID NO: 15158 - RNA, 17 nt, Homo sapiens
aaggaggagacaaggag

SEQ ID NO: 15159 - RNA, 21 nt, Homo sapiens
auguaauaauaucacagucua

SEQ ID NO: 15160 - RNA, 17 nt, Homo sapiens
ccuguccccugcccugg

SEQ ID NO: 15161 - RNA, 16 nt, Homo sapiens
gcggcggucgccgccc

SEQ ID NO: 15162 - RNA, 18 nt, Homo sapiens
uggagaccucgggcuagc

SEQ ID NO: 15163 - RNA, 20 nt, Homo sapiens
ccgcgcagcucggccagccc

SEQ ID NO: 15164 - RNA, 21 nt, Homo sapiens
aagaggaaaaugcagggugga

SEQ ID NO: 15165 - RNA, 19 nt, Homo sapiens
aaggagucuuugugugaau

SEQ ID NO: 15166 - RNA, 18 nt, Homo sapiens
acggcagucgaugguucg

SEQ ID NO: 15167 - RNA, 21 nt, Homo sapiens
agggcugcacccucccuugga

SEQ ID NO: 15168 - RNA, 19 nt, Homo sapiens
aggggugggggaagcacca

SEQ ID NO: 15169 - RNA, 17 nt, Homo sapiens
aggugggaagggaggug

SEQ ID NO: 15170 - RNA, 19 nt, Homo sapiens
cagcgggggaggcugcggg

SEQ ID NO: 15171 - RNA, 18 nt, Homo sapiens
ccccuugguggagcagac

SEQ ID NO: 15172 - RNA, 16 nt, Homo sapiens
ccgcugcgcgcucggc

SEQ ID NO: 15173 - RNA, 16 nt, Homo sapiens
cgacagguggacgcgg

SEQ ID NO: 15174 - RNA, 17 nt, Homo sapiens
cggcgccgccgcccccg

SEQ ID NO: 15175 - RNA, 18 nt, Homo sapiens
cggcugcuccgcgcgcgc

SEQ ID NO: 15176 - RNA, 21 nt, Homo sapiens
cgggcccgggcggcgggcacg

SEQ ID NO: 15177 - RNA, 15 nt, Homo sapiens
gcacagaggcaccag

SEQ ID NO: 15178 - RNA, 22 nt, Homo sapiens
gcccgcugcgcgcucggcuggg

SEQ ID NO: 15179 - RNA, 26 nt, Homo sapiens
gccugcucgccgcucugggcguccuc

SEQ ID NO: 15180 - RNA, 18 nt, Homo sapiens
gcgcgcggcgugcccgcu

SEQ ID NO: 15181 - RNA, 21 nt, Homo sapiens
gcuccgcgcgcgcggcgugcc

SEQ ID NO: 15182 - RNA, 17 nt, Homo sapiens
gcugcuccgcgcgcgcg

SEQ ID NO: 15183 - RNA, 16 nt, Homo sapiens
ggaagggguggcagga

SEQ ID NO: 15184 - RNA, 17 nt, Homo sapiens
ggaggaccugggcgcag

SEQ ID NO: 15185 - RNA, 23 nt, Homo sapiens
ggaggcagcgggggaggcugcgg

SEQ ID NO: 15186 - RNA, 17 nt, Homo sapiens
ggaggggugcgggcaag

SEQ ID NO: 15187 - RNA, 21 nt, Homo sapiens
ggcggcgggcccgggcggcgg

SEQ ID NO: 15188 - RNA, 21 nt, Homo sapiens
ggcugcuccgcgcgcgcggcg

SEQ ID NO: 15189 - RNA, 24 nt, Homo sapiens
gggaggaagggguggcaggaggca

SEQ ID NO: 15190 - RNA, 20 nt, Homo sapiens
gggcaagaccggaggccgcu

SEQ ID NO: 15191 - RNA, 20 nt, Homo sapiens
ggggcuggggaggggggugg

SEQ ID NO: 15192 - RNA, 22 nt, Homo sapiens
gggggcaggggaggaccugggc

SEQ ID NO: 15193 - RNA, 19 nt, Homo sapiens
uaugaugagcaggucccuu

SEQ ID NO: 15194 - RNA, 22 nt, Homo sapiens
uccgucugcccgccugcucgcc

SEQ ID NO: 15195 - RNA, 23 nt, Homo sapiens
ucgcuggggggcaggggaggacc

SEQ ID NO: 15196 - RNA, 19 nt, Homo sapiens
ucugccagaaauugucaua

SEQ ID NO: 15197 - RNA, 20 nt, Homo sapiens
ugagcugcugggcaagaccg

SEQ ID NO: 15198 - RNA, 19 nt, Homo sapiens
ugccuggaggugccucccc

SEQ ID NO: 15199 - RNA, 17 nt, Homo sapiens
uggagcagacugaaggg

SEQ ID NO: 15200 - RNA, 18 nt, Homo sapiens
uuggagaccuucucccag

SEQ ID NO: 15201 - RNA, 18 nt, Homo sapiens
cauuuggauuuuccgaug

SEQ ID NO: 15202 - RNA, 19 nt, Homo sapiens
auauaucaaaaauauaucu

SEQ ID NO: 15203 - RNA, 15 nt, Homo sapiens
ccuagaaaauggaug

SEQ ID NO: 15204 - RNA, 20 nt, Homo sapiens
gacugcaggugcgcuggcug

SEQ ID NO: 15205 - RNA, 19 nt, Homo sapiens
ggccaauguagauuauuuc

SEQ ID NO: 15206 - RNA, 18 nt, Homo sapiens
uauaucaaaaauauaucu

SEQ ID NO: 15207 - RNA, 16 nt, Homo sapiens
uauaugccaguuuaaa

SEQ ID NO: 15208 - RNA, 21 nt, Homo sapiens
uggcuugugcgccccggccug

SEQ ID NO: 15209 - RNA, 18 nt, Homo sapiens
cagcguccuccuccccga

SEQ ID NO: 15210 - RNA, 18 nt, Homo sapiens
cgcgucggcgcgggcgcc

SEQ ID NO: 15211 - RNA, 18 nt, Homo sapiens
ucugcguuccccuuguga

SEQ ID NO: 15212 - RNA, 21 nt, Homo sapiens
ugauggcuggcagguggucug

SEQ ID NO: 15213 - RNA, 18 nt, Homo sapiens
uggcuggcagguggucug

SEQ ID NO: 15214 - RNA, 18 nt, Homo sapiens
uaauaggcuuaucugcua

SEQ ID NO: 15215 - RNA, 14 nt, Homo sapiens
cugcugucccucgg

SEQ ID NO: 15216 - RNA, 20 nt, Homo sapiens
acugagaguguucuaacuuc

SEQ ID NO: 15217 - RNA, 21 nt, Homo sapiens
caacuguaugguuuggggaag

SEQ ID NO: 15218 - RNA, 17 nt, Homo sapiens
cugcuguucucacugca

SEQ ID NO: 15219 - RNA, 17 nt, Homo sapiens
gaccgugggucagcagg

SEQ ID NO: 15220 - RNA, 18 nt, Homo sapiens
gcccucggggagagcagc

SEQ ID NO: 15221 - RNA, 23 nt, Homo sapiens
gcucgggcgccccuggcagcccc

SEQ ID NO: 15222 - RNA, 26 nt, Homo sapiens
ggcugcuguucucacuaccaacgugg

SEQ ID NO: 15223 - RNA, 18 nt, Homo sapiens
uacaugacaaaaaacuga

SEQ ID NO: 15224 - RNA, 20 nt, Homo sapiens
uggggcugcuguucucacug

SEQ ID NO: 15225 - RNA, 19 nt, Homo sapiens
cuagcagcaaaacaccuga

SEQ ID NO: 15226 - RNA, 22 nt, Homo sapiens
gagaggaggucccgcuuuaucu

SEQ ID NO: 15227 - RNA, 16 nt, Homo sapiens
ucucuaacauaaugac

SEQ ID NO: 15228 - RNA, 19 nt, Homo sapiens
cacuggaaguggggugccu

SEQ ID NO: 15229 - RNA, 17 nt, Homo sapiens
caccgacagcgccacgu

SEQ ID NO: 15230 - RNA, 19 nt, Homo sapiens
cagcccagggucacagcca

SEQ ID NO: 15231 - RNA, 18 nt, Homo sapiens
ccuugcgcgucgccgccg

SEQ ID NO: 15232 - RNA, 19 nt, Homo sapiens
cgucgccgccgcuggucag

SEQ ID NO: 15233 - RNA, 21 nt, Homo sapiens
cuccugcuggagggccuggca

SEQ ID NO: 15234 - RNA, 14 nt, Homo sapiens
gagcaggugugagg

SEQ ID NO: 15235 - RNA, 19 nt, Homo sapiens
gagcccuggcgcugcgcug

SEQ ID NO: 15236 - RNA, 18 nt, Homo sapiens
gaggggcgugggcauggc

SEQ ID NO: 15237 - RNA, 19 nt, Homo sapiens
ggagggccuggcaggcugg

SEQ ID NO: 15238 - RNA, 20 nt, Homo sapiens
gggcuggggaggggcguggg

SEQ ID NO: 15239 - RNA, 17 nt, Homo sapiens
ucaggacgccgauggcc

SEQ ID NO: 15240 - RNA, 18 nt, Homo sapiens
agcugguggggcagaugg

SEQ ID NO: 15241 - RNA, 16 nt, Homo sapiens
gcacucgccgauuagg

SEQ ID NO: 15242 - RNA, 17 nt, Homo sapiens
aguucauaugcuuucuu

SEQ ID NO: 15243 - RNA, 18 nt, Homo sapiens
ugguuaacauacaaauga

SEQ ID NO: 15244 - RNA, 22 nt, Homo sapiens
ugcugguccccaacuggccaca

SEQ ID NO: 15245 - RNA, 22 nt, Homo sapiens
aagugugaggggagaucacggg

SEQ ID NO: 15246 - RNA, 21 nt, Homo sapiens
ccagguccucccguagcuggg

SEQ ID NO: 15247 - RNA, 20 nt, Homo sapiens
cccgacggggagcggcccgg

SEQ ID NO: 15248 - RNA, 21 nt, Homo sapiens
ccuguccuucccugccccucg

SEQ ID NO: 15249 - RNA, 19 nt, Homo sapiens
cucccguagcugggcggcc

SEQ ID NO: 15250 - RNA, 17 nt, Homo sapiens
cucuuucucucacguug

SEQ ID NO: 15251 - RNA, 14 nt, Homo sapiens
cuugcggagucagg

SEQ ID NO: 15252 - RNA, 16 nt, Homo sapiens
gagccgggugcggggu

SEQ ID NO: 15253 - RNA, 21 nt, Homo sapiens
gccguggcggccccagcagga

SEQ ID NO: 15254 - RNA, 19 nt, Homo sapiens
ggggagcggcccggcgggg

SEQ ID NO: 15255 - RNA, 21 nt, Homo sapiens
aacugguuagugaaaaaguca

SEQ ID NO: 15256 - RNA, 24 nt, Homo sapiens
aacuugcaccaucauuucauugcc

SEQ ID NO: 15257 - RNA, 17 nt, Homo sapiens
aggggcggccggcugag

SEQ ID NO: 15258 - RNA, 20 nt, Homo sapiens
cggacuuggcuggcggaggg

SEQ ID NO: 15259 - RNA, 19 nt, Homo sapiens
ugacuuggauggguccggg

SEQ ID NO: 15260 - RNA, 18 nt, Homo sapiens
uggcggaggggcggccgg

SEQ ID NO: 15261 - RNA, 26 nt, Homo sapiens
uggggugagggcacggcggguggggg

SEQ ID NO: 15262 - RNA, 15 nt, Homo sapiens
cagccgcacaugccc

SEQ ID NO: 15263 - RNA, 22 nt, Homo sapiens
cggggcuguggcccagucagcc

SEQ ID NO: 15264 - RNA, 17 nt, Homo sapiens
gcaauuuuugguaggga

SEQ ID NO: 15265 - RNA, 20 nt, Homo sapiens
gcuggacccucucacaccug

SEQ ID NO: 15266 - RNA, 21 nt, Homo sapiens
uuucacagugauuucuggggu

SEQ ID NO: 15267 - RNA, 21 nt, Homo sapiens
accccaccucggacuccuccc

SEQ ID NO: 15268 - RNA, 28 nt, Homo sapiens
aucauccucccuccucagucucugcccc

SEQ ID NO: 15269 - RNA, 19 nt, Homo sapiens
cugagcgucuaggaagacc

SEQ ID NO: 15270 - RNA, 22 nt, Homo sapiens
gaaggaugggaggggucaggaa

SEQ ID NO: 15271 - RNA, 19 nt, Homo sapiens
gccgccgggagccgggcag

SEQ ID NO: 15272 - RNA, 20 nt, Homo sapiens
gggagaagggggugcugagc

SEQ ID NO: 15273 - RNA, 21 nt, Homo sapiens
agggaccagcugucaaaaggc

SEQ ID NO: 15274 - RNA, 15 nt, Homo sapiens
caccaggccccgcag

SEQ ID NO: 15275 - RNA, 16 nt, Homo sapiens
cgggugccaccggagc

SEQ ID NO: 15276 - RNA, 15 nt, Homo sapiens
gagccuccagguaau

SEQ ID NO: 15277 - RNA, 25 nt, Homo sapiens
gggaaggaugggacagaaaggggca

SEQ ID NO: 15278 - RNA, 18 nt, Homo sapiens
aguccagcuuggccuggc

SEQ ID NO: 15279 - RNA, 21 nt, Homo sapiens
gcaguccagcuuggccuggcu

SEQ ID NO: 15280 - RNA, 15 nt, Homo sapiens
gauuuauagguugcu

SEQ ID NO: 15281 - RNA, 21 nt, Homo sapiens
gcagcauauuaagguguugau

SEQ ID NO: 15282 - RNA, 20 nt, Homo sapiens
gcggcuuccugauccagcaa

SEQ ID NO: 15283 - RNA, 17 nt, Homo sapiens
ucucuuaccacaaugac

SEQ ID NO: 15284 - RNA, 22 nt, Homo sapiens
uuuuaauagaaaccacaucacu

SEQ ID NO: 15285 - RNA, 17 nt, Homo sapiens
auggcuagcuaacucuc

SEQ ID NO: 15286 - RNA, 19 nt, Homo sapiens
acagaaauggaguuuggga

SEQ ID NO: 15287 - RNA, 20 nt, Homo sapiens
acagugaaccucucucuucu

SEQ ID NO: 15288 - RNA, 19 nt, Homo sapiens
agcauauaggucauaauaa

SEQ ID NO: 15289 - RNA, 19 nt, Homo sapiens
agggguagaaaaugguauu

SEQ ID NO: 15290 - RNA, 21 nt, Homo sapiens
cggguccuuggcagaacccca

SEQ ID NO: 15291 - RNA, 17 nt, Homo sapiens
cuccucuucccccuccg

SEQ ID NO: 15292 - RNA, 20 nt, Homo sapiens
gauuuugcagugagucgaga

SEQ ID NO: 15293 - RNA, 17 nt, Homo sapiens
ggccaggagaauggagg

SEQ ID NO: 15294 - RNA, 16 nt, Homo sapiens
uacagcccaccccaca

SEQ ID NO: 15295 - RNA, 19 nt, Homo sapiens
ucacagcgcucuccuuugg

SEQ ID NO: 15296 - RNA, 19 nt, Homo sapiens
uggggagugauggaugggg

SEQ ID NO: 15297 - RNA, 16 nt, Homo sapiens
uuagaaaauacaauuc

SEQ ID NO: 15298 - RNA, 22 nt, Homo sapiens
uucuggaggguugugacauggu

SEQ ID NO: 15299 - RNA, 19 nt, Homo sapiens
uuucucaaaugucauuuau

SEQ ID NO: 15300 - RNA, 18 nt, Homo sapiens
acugaaaagacuaacucg

SEQ ID NO: 15301 - RNA, 22 nt, Homo sapiens
agacacuguuaacauaguuuuu

SEQ ID NO: 15302 - RNA, 19 nt, Homo sapiens
caauacagguuggacuaga

SEQ ID NO: 15303 - RNA, 20 nt, Homo sapiens
cgugcccucccuuuuccucc

SEQ ID NO: 15304 - RNA, 19 nt, Homo sapiens
gaccagcagaggaagguca

SEQ ID NO: 15305 - RNA, 19 nt, Homo sapiens
ggaggcagggaaaaaggaa

SEQ ID NO: 15306 - RNA, 18 nt, Homo sapiens
uagccgagaaggaagugc

SEQ ID NO: 15307 - RNA, 16 nt, Homo sapiens
uccaaagaauuuccag

SEQ ID NO: 15308 - RNA, 22 nt, Homo sapiens
ucccuguugauucuucuuugca

SEQ ID NO: 15309 - RNA, 19 nt, Homo sapiens
uuuaugagaagauguugga

SEQ ID NO: 15310 - RNA, 23 nt, Homo sapiens
aagcgggugagagaacauggaag

SEQ ID NO: 15311 - RNA, 19 nt, Homo sapiens
accaggaggggcagggaag

SEQ ID NO: 15312 - RNA, 18 nt, Homo sapiens
cacagcuggcucucccac

SEQ ID NO: 15313 - RNA, 18 nt, Homo sapiens
gaagcgggugagagaaca

SEQ ID NO: 15314 - RNA, 22 nt, Homo sapiens
gcauggccaguggccaaccaca

SEQ ID NO: 15315 - RNA, 21 nt, Homo sapiens
cauccaguccgcaggcccggc

SEQ ID NO: 15316 - RNA, 17 nt, Homo sapiens
cccccggccgcugggcc

SEQ ID NO: 15317 - RNA, 16 nt, Homo sapiens
ccgccuggcugcgacc

SEQ ID NO: 15318 - RNA, 17 nt, Homo sapiens
ccggauccagcgcggcg

SEQ ID NO: 15319 - RNA, 21 nt, Homo sapiens
ccggcucgacucuugcacggc

SEQ ID NO: 15320 - RNA, 31 nt, Homo sapiens
ccggggccccgcgugcguccuccgcgcccgc

SEQ ID NO: 15321 - RNA, 22 nt, Homo sapiens
ccugggcugggggcaccguccc

SEQ ID NO: 15322 - RNA, 18 nt, Homo sapiens
cgcuccaggggccggggc

SEQ ID NO: 15323 - RNA, 19 nt, Homo sapiens
cggcgcggugagcuggggc

SEQ ID NO: 15324 - RNA, 21 nt, Homo sapiens
gcccgcugucgcuccguggcc

SEQ ID NO: 15325 - RNA, 19 nt, Homo sapiens
gccgccuggcugcgaccug

SEQ ID NO: 15326 - RNA, 16 nt, Homo sapiens
gcugggcgcgcccgcc

SEQ ID NO: 15327 - RNA, 22 nt, Homo sapiens
gggccgcgccccuugcucugcc

SEQ ID NO: 15328 - RNA, 22 nt, Homo sapiens
gggggcgcgggauacgagguug

SEQ ID NO: 15329 - RNA, 22 nt, Homo sapiens
uccgcggagugggccuccgggg

SEQ ID NO: 15330 - RNA, 17 nt, Homo sapiens
agugggggaaaauggaa

SEQ ID NO: 15331 - RNA, 21 nt, Homo sapiens
ccaguccagcauuccuccuuc

SEQ ID NO: 15332 - RNA, 18 nt, Homo sapiens
gaggaggggcucuggggu

SEQ ID NO: 15333 - RNA, 16 nt, Homo sapiens
gcagccaggcucuggg

SEQ ID NO: 15334 - RNA, 18 nt, Homo sapiens
gggccacaugauggggca

SEQ ID NO: 15335 - RNA, 22 nt, Homo sapiens
gggcuggaggaggggcucuggg

SEQ ID NO: 15336 - RNA, 22 nt, Homo sapiens
ggggaagggggugggacagggg

SEQ ID NO: 15337 - RNA, 17 nt, Homo sapiens
ggggcuggaggaggggc

SEQ ID NO: 15338 - RNA, 18 nt, Homo sapiens
uccagcauuccuccuucu

SEQ ID NO: 15339 - RNA, 17 nt, Homo sapiens
uggaugggcugggggaa

SEQ ID NO: 15340 - RNA, 22 nt, Homo sapiens
aaaguaggcacuaaaauaaaaa

SEQ ID NO: 15341 - RNA, 18 nt, Homo sapiens
aaguacacgauauacaug

SEQ ID NO: 15342 - RNA, 26 nt, Homo sapiens
aauauuuuaaaucugguauauggaca

SEQ ID NO: 15343 - RNA, 25 nt, Homo sapiens
acugaugcuuuguguuuaggguuug

SEQ ID NO: 15344 - RNA, 19 nt, Homo sapiens
agcaccaugaagaguugua

SEQ ID NO: 15345 - RNA, 17 nt, Homo sapiens
caggagccaaagcuccu

SEQ ID NO: 15346 - RNA, 17 nt, Homo sapiens
ccccccauuuacauuau

SEQ ID NO: 15347 - RNA, 17 nt, Homo sapiens
ccucuuuccagcagcca

SEQ ID NO: 15348 - RNA, 21 nt, Homo sapiens
cuaagugcaaucugagugugc

SEQ ID NO: 15349 - RNA, 18 nt, Homo sapiens
cuuguaaaaaaauaaacc

SEQ ID NO: 15350 - RNA, 18 nt, Homo sapiens
cuuguaauauguguagua

SEQ ID NO: 15351 - RNA, 17 nt, Homo sapiens
cuuguuagaacauugug

SEQ ID NO: 15352 - RNA, 16 nt, Homo sapiens
gaguaggacuguuguu

SEQ ID NO: 15353 - RNA, 18 nt, Homo sapiens
guaugugugcaugugugu

SEQ ID NO: 15354 - RNA, 18 nt, Homo sapiens
guguguguguguguguau

SEQ ID NO: 15355 - RNA, 19 nt, Homo sapiens
uaacuggcccuacaaaaag

SEQ ID NO: 15356 - RNA, 20 nt, Homo sapiens
ucaccaauuuuuuuccuuuu

SEQ ID NO: 15357 - RNA, 20 nt, Homo sapiens
uccguguuuggugaccuaac

SEQ ID NO: 15358 - RNA, 20 nt, Homo sapiens
ucucaguucacuaauuugau

SEQ ID NO: 15359 - RNA, 20 nt, Homo sapiens
ugaagaguuguagcccaagu

SEQ ID NO: 15360 - RNA, 18 nt, Homo sapiens
uggaugugaauguuuaaa

SEQ ID NO: 15361 - RNA, 21 nt, Homo sapiens
ugugcaugugugugugugugu

SEQ ID NO: 15362 - RNA, 17 nt, Homo sapiens
ugugugcaugugugugu

SEQ ID NO: 15363 - RNA, 18 nt, Homo sapiens
uuauguagaucuauguga

SEQ ID NO: 15364 - RNA, 24 nt, Homo sapiens
uucuggccacuagagaaugaaaac

SEQ ID NO: 15365 - RNA, 21 nt, Homo sapiens
uuuucuuuucuauuuugacuc

SEQ ID NO: 15366 - RNA, 17 nt, Homo sapiens
ucuaaaaacauaagaca

SEQ ID NO: 15367 - RNA, 18 nt, Homo sapiens
uuaaauuugguacaaagc

SEQ ID NO: 15368 - RNA, 21 nt, Homo sapiens
aaauaugaauguggcugauua

SEQ ID NO: 15369 - RNA, 20 nt, Homo sapiens
ccucaggaaggaggcaguuu

SEQ ID NO: 15370 - RNA, 17 nt, Homo sapiens
cucuucugcuucacaca

SEQ ID NO: 15371 - RNA, 16 nt, Homo sapiens
uccgccacaaacuucc

SEQ ID NO: 15372 - RNA, 23 nt, Homo sapiens
ugauuauuuggcuaacaggauuu

SEQ ID NO: 15373 - RNA, 19 nt, Homo sapiens
uggccugaggucacacagc

SEQ ID NO: 15374 - RNA, 19 nt, Homo sapiens
ggggcggcggcggcacagg

SEQ ID NO: 15375 - RNA, 22 nt, Homo sapiens
gcugcagggcgaaggggccgcu

SEQ ID NO: 15376 - RNA, 20 nt, Homo sapiens
uacgagaaugcgucaggccu

SEQ ID NO: 15377 - RNA, 21 nt, Homo sapiens
cccuuuucagcuauuucucac

SEQ ID NO: 15378 - RNA, 18 nt, Homo sapiens
gagaagugguuugcacug

SEQ ID NO: 15379 - RNA, 19 nt, Homo sapiens
gaugagcucugggacucuc

SEQ ID NO: 15380 - RNA, 17 nt, Homo sapiens
gcagagcccccuucucc

SEQ ID NO: 15381 - RNA, 23 nt, Homo sapiens
ggaggggguucaagggcaggaag

SEQ ID NO: 15382 - RNA, 19 nt, Homo sapiens
gggcccugggacagggagg

SEQ ID NO: 15383 - RNA, 16 nt, Homo sapiens
gggcugggagggcccu

SEQ ID NO: 15384 - RNA, 19 nt, Homo sapiens
gggcugggagggcccuggg

SEQ ID NO: 15385 - RNA, 20 nt, Homo sapiens
ucaagggcaggaagaggaag

SEQ ID NO: 15386 - RNA, 18 nt, Homo sapiens
ugccugccuccccagauc

SEQ ID NO: 15387 - RNA, 21 nt, Homo sapiens
acagggaggcguuggcucagg

SEQ ID NO: 15388 - RNA, 17 nt, Homo sapiens
acccucaaaaccaccac

SEQ ID NO: 15389 - RNA, 20 nt, Homo sapiens
ggcccugaggcuggagaggg

SEQ ID NO: 15390 - RNA, 20 nt, Homo sapiens
ggggaggaggaaugcaggag

SEQ ID NO: 15391 - RNA, 19 nt, Homo sapiens
uuugucacagaaguggaca

SEQ ID NO: 15392 - RNA, 18 nt, Homo sapiens
ucccucacagacacagac

SEQ ID NO: 15393 - RNA, 18 nt, Homo sapiens
acauuucgaagacuaggg

SEQ ID NO: 15394 - RNA, 16 nt, Homo sapiens
aggcaguaaugaugca

SEQ ID NO: 15395 - RNA, 18 nt, Homo sapiens
aggguuggggaugaacug

SEQ ID NO: 15396 - RNA, 15 nt, Homo sapiens
cauuuugguucccca

SEQ ID NO: 15397 - RNA, 21 nt, Homo sapiens
ccacaaguuugguuaaagaga

SEQ ID NO: 15398 - RNA, 17 nt, Homo sapiens
ccggcccggggcgcggc

SEQ ID NO: 15399 - RNA, 23 nt, Homo sapiens
gaaauguggcugugagcaagcag

SEQ ID NO: 15400 - RNA, 20 nt, Homo sapiens
gggaccacuuugaaaguggc

SEQ ID NO: 15401 - RNA, 18 nt, Homo sapiens
guggccaucaaaaagagc

SEQ ID NO: 15402 - RNA, 18 nt, Homo sapiens
agucugaaguuuuaagug

SEQ ID NO: 15403 - RNA, 21 nt, Homo sapiens
auguguuaauuuacuguuuau

SEQ ID NO: 15404 - RNA, 15 nt, Homo sapiens
caacaguugcauuuu

SEQ ID NO: 15405 - RNA, 19 nt, Homo sapiens
guugaucauaugucuuaga

SEQ ID NO: 15406 - RNA, 18 nt, Homo sapiens
uaguaggcuauuagguag

SEQ ID NO: 15407 - RNA, 15 nt, Homo sapiens
ucaggaaguggucug

SEQ ID NO: 15408 - RNA, 22 nt, Homo sapiens
ucauauauuuuuaaaaaauacu

SEQ ID NO: 15409 - RNA, 19 nt, Homo sapiens
ucagaacuggugucuccua

SEQ ID NO: 15410 - RNA, 21 nt, Homo sapiens
uguuguugggguggggaggag

SEQ ID NO: 15411 - RNA, 17 nt, Homo sapiens
cuuaauguaucagauau

SEQ ID NO: 15412 - RNA, 18 nt, Homo sapiens
uaccaaacuaggaugugu

SEQ ID NO: 15413 - RNA, 19 nt, Homo sapiens
uguugcacaacaguauugc

SEQ ID NO: 15414 - RNA, 21 nt, Homo sapiens
uugggauguucuagccaaugu

SEQ ID NO: 15415 - RNA, 16 nt, Homo sapiens
aagcagcagcuguggc

SEQ ID NO: 15416 - RNA, 21 nt, Homo sapiens
aaaaagucuuguacaaaaaua

SEQ ID NO: 15417 - RNA, 18 nt, Homo sapiens
aaggacacugauugggaa

SEQ ID NO: 15418 - RNA, 24 nt, Homo sapiens
aguacuugguaauaaaaagaaaca

SEQ ID NO: 15419 - RNA, 19 nt, Homo sapiens
auagauuagaauuuuguag

SEQ ID NO: 15420 - RNA, 20 nt, Homo sapiens
ccuaccuugcccuugcuuug

SEQ ID NO: 15421 - RNA, 19 nt, Homo sapiens
ggagccccuucaagcuggc

SEQ ID NO: 15422 - RNA, 19 nt, Homo sapiens
guuccuaccuugcccuugc

SEQ ID NO: 15423 - RNA, 23 nt, Homo sapiens
uaaaauguuggcuggaguagagg

SEQ ID NO: 15424 - RNA, 18 nt, Homo sapiens
uggcagauaggauuagua

SEQ ID NO: 15425 - RNA, 21 nt, Homo sapiens
uguauucaguuuugucaaugg

SEQ ID NO: 15426 - RNA, 15 nt, Homo sapiens
agcaggcaaaggagg

SEQ ID NO: 15427 - RNA, 17 nt, Homo sapiens
ccuaggcucaggauccc

SEQ ID NO: 15428 - RNA, 22 nt, Homo sapiens
cgcgacaacaagcggcggaggc

SEQ ID NO: 15429 - RNA, 21 nt, Homo sapiens
gaccugggaggggguggugcu

SEQ ID NO: 15430 - RNA, 18 nt, Homo sapiens
gauccugggaauccucuu

SEQ ID NO: 15431 - RNA, 18 nt, Homo sapiens
gcccagugccccgggggc

SEQ ID NO: 15432 - RNA, 23 nt, Homo sapiens
gcggggcgcgacaacaagcggcg

SEQ ID NO: 15433 - RNA, 21 nt, Homo sapiens
gcgggggaagggcaagggagg

SEQ ID NO: 15434 - RNA, 16 nt, Homo sapiens
gggaagggcaagggag

SEQ ID NO: 15435 - RNA, 21 nt, Homo sapiens
ggggcgggggaagggcaaggg

SEQ ID NO: 15436 - RNA, 15 nt, Homo sapiens
ugucuggagggcucc

SEQ ID NO: 15437 - RNA, 17 nt, Homo sapiens
cccgccccaugggaugc

SEQ ID NO: 15438 - RNA, 16 nt, Homo sapiens
cccuggucccgccccc

SEQ ID NO: 15439 - RNA, 16 nt, Homo sapiens
cuggucccgcccccgc

SEQ ID NO: 15440 - RNA, 18 nt, Homo sapiens
gccacagccuacgccgcc

SEQ ID NO: 15441 - RNA, 16 nt, Homo sapiens
gggaaaacagacggag

SEQ ID NO: 15442 - RNA, 18 nt, Homo sapiens
aggcccacggcacggcgu

SEQ ID NO: 15443 - RNA, 18 nt, Homo sapiens
ccucgguccucacggugc

SEQ ID NO: 15444 - RNA, 16 nt, Homo sapiens
ccugucucugcucucc

SEQ ID NO: 15445 - RNA, 18 nt, Homo sapiens
gaacuuuggggcuucugc

SEQ ID NO: 15446 - RNA, 18 nt, Homo sapiens
gaagacguggagagagac

SEQ ID NO: 15447 - RNA, 21 nt, Homo sapiens
gccugcaccaccccgaugaag

SEQ ID NO: 15448 - RNA, 21 nt, Homo sapiens
ggcuuugggcuccagcuuggc

SEQ ID NO: 15449 - RNA, 20 nt, Homo sapiens
ggggcuucugcuucauuuuu

SEQ ID NO: 15450 - RNA, 16 nt, Homo sapiens
guggccuccacccggc

SEQ ID NO: 15451 - RNA, 19 nt, Homo sapiens
uccacugccuuggagcagg

SEQ ID NO: 15452 - RNA, 18 nt, Homo sapiens
cuguguaugugggagggg

SEQ ID NO: 15453 - RNA, 20 nt, Homo sapiens
gccagcccuggggcaagaac

SEQ ID NO: 15454 - RNA, 17 nt, Homo sapiens
ucuaucuaugacccacu

SEQ ID NO: 15455 - RNA, 21 nt, Homo sapiens
ucucagaaacgagaagagucu

SEQ ID NO: 15456 - RNA, 17 nt, Homo sapiens
agaccagguaggcaggc

SEQ ID NO: 15457 - RNA, 18 nt, Homo sapiens
gaugccuucugggaugag

SEQ ID NO: 15458 - RNA, 22 nt, Homo sapiens
aggaggaggaugaggaugaaga

SEQ ID NO: 15459 - RNA, 19 nt, Homo sapiens
cagccgcagccgcugcuga

SEQ ID NO: 15460 - RNA, 21 nt, Homo sapiens
ccuggaccuccaggggucugu

SEQ ID NO: 15461 - RNA, 21 nt, Homo sapiens
cucugcguccccaccacuggc

SEQ ID NO: 15462 - RNA, 21 nt, Homo sapiens
ggaggaggaggaggaugagga

SEQ ID NO: 15463 - RNA, 25 nt, Homo sapiens
ugaagaggaugaggaggagaggcca

SEQ ID NO: 15464 - RNA, 18 nt, Homo sapiens
ugccacagccgcagccgc

SEQ ID NO: 15465 - RNA, 17 nt, Homo sapiens
uggaggaggaggaggau

SEQ ID NO: 15466 - RNA, 21 nt, Homo sapiens
aggcgccccaagccgggggcc

SEQ ID NO: 15467 - RNA, 18 nt, Homo sapiens
ccagguuuucuuucccua

SEQ ID NO: 15468 - RNA, 18 nt, Homo sapiens
cccaagccgggggccugg

SEQ ID NO: 15469 - RNA, 19 nt, Homo sapiens
ccccugcccccacccuuug

SEQ ID NO: 15470 - RNA, 18 nt, Homo sapiens
cccuagcuccuccccucc

SEQ ID NO: 15471 - RNA, 16 nt, Homo sapiens
ccuccccucccccugu

SEQ ID NO: 15472 - RNA, 19 nt, Homo sapiens
ccuccccucccccuguccc

SEQ ID NO: 15473 - RNA, 22 nt, Homo sapiens
ccuuccuuagugaaugaagaac

SEQ ID NO: 15474 - RNA, 18 nt, Homo sapiens
uccccuccccuguucccc

SEQ ID NO: 15475 - RNA, 18 nt, Homo sapiens
uccuagaagggcaggcag

SEQ ID NO: 15476 - RNA, 21 nt, Homo sapiens
ucuaucuacugugucccaagc

SEQ ID NO: 15477 - RNA, 21 nt, Homo sapiens
ucuaucuacugugucccaggc

SEQ ID NO: 15478 - RNA, 21 nt, Homo sapiens
uggcacaaacuccagguuuuc

SEQ ID NO: 15479 - RNA, 21 nt, Homo sapiens
acaucuacauguauauauguu

SEQ ID NO: 15480 - RNA, 15 nt, Homo sapiens
agacuauauaccaaa

SEQ ID NO: 15481 - RNA, 21 nt, Homo sapiens
auuuauguguauguguacaug

SEQ ID NO: 15482 - RNA, 22 nt, Homo sapiens
caccugccuucucugaccaggu

SEQ ID NO: 15483 - RNA, 20 nt, Homo sapiens
gaucaagcacuucauuaaaa

SEQ ID NO: 15484 - RNA, 20 nt, Homo sapiens
uaaauauuaaauuucuaaau

SEQ ID NO: 15485 - RNA, 22 nt, Homo sapiens
uggccugcuauaauauaauaug

SEQ ID NO: 15486 - RNA, 23 nt, Homo sapiens
uguagaauuacuaaacugucaca

SEQ ID NO: 15487 - RNA, 16 nt, Homo sapiens
uguauguguacaugua

SEQ ID NO: 15488 - RNA, 18 nt, Homo sapiens
ugucacaguauuauuuuc

SEQ ID NO: 15489 - RNA, 24 nt, Homo sapiens
uguuacaagaaaaaacuucaaaaa

SEQ ID NO: 15490 - RNA, 18 nt, Homo sapiens
ucucagaauaaaauguga

SEQ ID NO: 15491 - RNA, 20 nt, Homo sapiens
caucgcaguuguccagucau

SEQ ID NO: 15492 - RNA, 18 nt, Homo sapiens
cgagggcuggacacuugu

SEQ ID NO: 15493 - RNA, 20 nt, Homo sapiens
gcagcagcccccacgggccc

SEQ ID NO: 15494 - RNA, 18 nt, Homo sapiens
gcugcaaggagugggcuu

SEQ ID NO: 15495 - RNA, 19 nt, Homo sapiens
gcuggacacuugugguuuc

SEQ ID NO: 15496 - RNA, 20 nt, Homo sapiens
gcuuggccugcaccagggcu

SEQ ID NO: 15497 - RNA, 23 nt, Homo sapiens
gggagaggacgacaccaaggagg

SEQ ID NO: 15498 - RNA, 18 nt, Homo sapiens
ugcaaggagugggcuugg

SEQ ID NO: 15499 - RNA, 20 nt, Homo sapiens
aaaugcuacugcacaauaga

SEQ ID NO: 15500 - RNA, 19 nt, Homo sapiens
aagggugucaaauggcugg

SEQ ID NO: 15501 - RNA, 18 nt, Homo sapiens
caggugaagguguuacca

SEQ ID NO: 15502 - RNA, 18 nt, Homo sapiens
cggguagcgagagcgcgc

SEQ ID NO: 15503 - RNA, 17 nt, Homo sapiens
gcggcggaggcugcggc

SEQ ID NO: 15504 - RNA, 18 nt, Homo sapiens
gggcuucucggcggcgga

SEQ ID NO: 15505 - RNA, 18 nt, Homo sapiens
uaaaaaaaagaaauagga

SEQ ID NO: 15506 - RNA, 19 nt, Homo sapiens
uaaguuaacagguuucuca

SEQ ID NO: 15507 - RNA, 17 nt, Homo sapiens
uagaaucacauccaaua

SEQ ID NO: 15508 - RNA, 15 nt, Homo sapiens
aucugaaaauggugu

SEQ ID NO: 15509 - RNA, 18 nt, Homo sapiens
cccguggcugggcaguuc

SEQ ID NO: 15510 - RNA, 22 nt, Homo sapiens
cccguggcugggcaguucuucc

SEQ ID NO: 15511 - RNA, 17 nt, Homo sapiens
gcgucgcgcgcgccagc

SEQ ID NO: 15512 - RNA, 20 nt, Homo sapiens
gcguaaguucgggccaaggc

SEQ ID NO: 15513 - RNA, 18 nt, Homo sapiens
aguuauaugguuuuacaa

SEQ ID NO: 15514 - RNA, 17 nt, Homo sapiens
augcaggaagaacccac

SEQ ID NO: 15515 - RNA, 23 nt, Homo sapiens
ccuugauuuuuauuuuaccuaca

SEQ ID NO: 15516 - RNA, 18 nt, Homo sapiens
uagaagggaggccuuggu

SEQ ID NO: 15517 - RNA, 18 nt, Homo sapiens
ugugcagucacaucgucu

SEQ ID NO: 15518 - RNA, 18 nt, Homo sapiens
cuaguaaaggccuuuucc

SEQ ID NO: 15519 - RNA, 18 nt, Homo sapiens
aagaccgaugaaaacuca

SEQ ID NO: 15520 - RNA, 14 nt, Homo sapiens
agcagaaagaaaac

SEQ ID NO: 15521 - RNA, 20 nt, Homo sapiens
cgcugaggcggacgcacguu

SEQ ID NO: 15522 - RNA, 21 nt, Homo sapiens
cugucaagguagacagagcaa

SEQ ID NO: 15523 - RNA, 19 nt, Homo sapiens
ggagaacaugaagaugaag

SEQ ID NO: 15524 - RNA, 21 nt, Homo sapiens
ggcaaaaagagagucuuccca

SEQ ID NO: 15525 - RNA, 21 nt, Homo sapiens
ucugggaagucaccauuguuu

SEQ ID NO: 15526 - RNA, 18 nt, Homo sapiens
ugacggaaacgaaaucug

SEQ ID NO: 15527 - RNA, 16 nt, Homo sapiens
uuguguuacuuuaugc

SEQ ID NO: 15528 - RNA, 28 nt, Homo sapiens
acuccgguuccggcucuccgcggggccg

SEQ ID NO: 15529 - RNA, 18 nt, Homo sapiens
caaguggggagagaggag

SEQ ID NO: 15530 - RNA, 15 nt, Homo sapiens
cacccucuuggggga

SEQ ID NO: 15531 - RNA, 18 nt, Homo sapiens
cagagucggggccgccgc

SEQ ID NO: 15532 - RNA, 25 nt, Homo sapiens
ccgccgcugcgacuccgguuccggc

SEQ ID NO: 15533 - RNA, 20 nt, Homo sapiens
ccgguuccggcucuccggcc

SEQ ID NO: 15534 - RNA, 18 nt, Homo sapiens
ggccagaaggguuggagg

SEQ ID NO: 15535 - RNA, 14 nt, Homo sapiens
ggccgccgcccccu

SEQ ID NO: 15536 - RNA, 24 nt, Homo sapiens
ggguuggagggggcaggggccggg

SEQ ID NO: 15537 - RNA, 21 nt, Homo sapiens
guuggagggggcaggggccgg

SEQ ID NO: 15538 - RNA, 20 nt, Homo sapiens
uccgcaccgcacaggggucu

SEQ ID NO: 15539 - RNA, 26 nt, Homo sapiens
uggugcgagggccagaaggguuggag

SEQ ID NO: 15540 - RNA, 22 nt, Homo sapiens
uuuuuuuuuuuuuucauuuuuc

SEQ ID NO: 15541 - RNA, 18 nt, Homo sapiens
cugggacagguauacaua

SEQ ID NO: 15542 - RNA, 21 nt, Homo sapiens
gcggcaacagcggcggcggcg

SEQ ID NO: 15543 - RNA, 23 nt, Homo sapiens
gcggcaacagcggcggcggcggc

SEQ ID NO: 15544 - RNA, 17 nt, Homo sapiens
guauauuguagagggua

SEQ ID NO: 15545 - RNA, 21 nt, Homo sapiens
uggggaugggaugggggaaaa

SEQ ID NO: 15546 - RNA, 22 nt, Homo sapiens
uuucucaagucuucucaaauga

SEQ ID NO: 15547 - RNA, 19 nt, Homo sapiens
cagaagaauagauggcuuu

SEQ ID NO: 15548 - RNA, 18 nt, Homo sapiens
ccucuuccacccccuccc

SEQ ID NO: 15549 - RNA, 21 nt, Homo sapiens
gagaaagaaggggagagagag

SEQ ID NO: 15550 - RNA, 18 nt, Homo sapiens
gagagagagaaaacgaau

SEQ ID NO: 15551 - RNA, 17 nt, Homo sapiens
ucccugccucgagggug

SEQ ID NO: 15552 - RNA, 16 nt, Homo sapiens
uggccggcacaggugc

SEQ ID NO: 15553 - RNA, 14 nt, Homo sapiens
ggaugaacaacuua

SEQ ID NO: 15554 - RNA, 18 nt, Homo sapiens
uaacuuguugcagaaagg

SEQ ID NO: 15555 - RNA, 19 nt, Homo sapiens
ucaguccaggaauaauguu

SEQ ID NO: 15556 - RNA, 16 nt, Homo sapiens
ugcagaaaggugaaau

SEQ ID NO: 15557 - RNA, 19 nt, Homo sapiens
aaaaugcagguauuuucaa

SEQ ID NO: 15558 - RNA, 14 nt, Homo sapiens
uacauugccuggug

SEQ ID NO: 15559 - RNA, 19 nt, Homo sapiens
augaaggaggcccugaggc

SEQ ID NO: 15560 - RNA, 21 nt, Homo sapiens
cagacagagaugaagaugaag

SEQ ID NO: 15561 - RNA, 19 nt, Homo sapiens
cccugucuuucuugcuucc

SEQ ID NO: 15562 - RNA, 17 nt, Homo sapiens
gagguggagggagggau

SEQ ID NO: 15563 - RNA, 17 nt, Homo sapiens
ggagguggagggaggga

SEQ ID NO: 15564 - RNA, 18 nt, Homo sapiens
acgaggucagucguccca

SEQ ID NO: 15565 - RNA, 24 nt, Homo sapiens
caaccauaucucugacaaaaagaa

SEQ ID NO: 15566 - RNA, 17 nt, Homo sapiens
cgcgcuccggccccucg

SEQ ID NO: 15567 - RNA, 19 nt, Homo sapiens
ucaaguuacuuauuaaaaa

SEQ ID NO: 15568 - RNA, 16 nt, Homo sapiens
uuuccagaauaccaga

SEQ ID NO: 15569 - RNA, 22 nt, Homo sapiens
aaagacuugggcuuggggcucc

SEQ ID NO: 15570 - RNA, 17 nt, Homo sapiens
aagacaggucuguuggg

SEQ ID NO: 15571 - RNA, 20 nt, Homo sapiens
aagugggagagggggcagga

SEQ ID NO: 15572 - RNA, 16 nt, Homo sapiens
accccagcgccucccu

SEQ ID NO: 15573 - RNA, 23 nt, Homo sapiens
accccaggccugagaacuccucc

SEQ ID NO: 15574 - RNA, 19 nt, Homo sapiens
aggaaggagggagggaggc

SEQ ID NO: 15575 - RNA, 22 nt, Homo sapiens
aggggccuagacccucgcagga

SEQ ID NO: 15576 - RNA, 22 nt, Homo sapiens
ccaggaugggggaggcggaagc

SEQ ID NO: 15577 - RNA, 24 nt, Homo sapiens
gagggcugaggggcuggggggcug

SEQ ID NO: 15578 - RNA, 17 nt, Homo sapiens
gcagaagugggcuggga

SEQ ID NO: 15579 - RNA, 18 nt, Homo sapiens
gcugcuuugucuggcuuu

SEQ ID NO: 15580 - RNA, 23 nt, Homo sapiens
ggagaggggcagcugcuuugucu

SEQ ID NO: 15581 - RNA, 17 nt, Homo sapiens
ggaggggugggaguaga

SEQ ID NO: 15582 - RNA, 25 nt, Homo sapiens
gggagagggggcaggagggugaagg

SEQ ID NO: 15583 - RNA, 19 nt, Homo sapiens
gggaugggggugugggugg

SEQ ID NO: 15584 - RNA, 20 nt, Homo sapiens
gggccugugguuggguggga

SEQ ID NO: 15585 - RNA, 25 nt, Homo sapiens
gggcugggagggcugaggggcuggg

SEQ ID NO: 15586 - RNA, 20 nt, Homo sapiens
ggggccugugguuggguggg

SEQ ID NO: 15587 - RNA, 21 nt, Homo sapiens
ggggcucccccucugucuuuu

SEQ ID NO: 15588 - RNA, 20 nt, Homo sapiens
ugcccuuagcaaguggggcc

SEQ ID NO: 15589 - RNA, 18 nt, Homo sapiens
ugggaugggggugugggu

SEQ ID NO: 15590 - RNA, 23 nt, Homo sapiens
ugggauggggguguggguggggg

SEQ ID NO: 15591 - RNA, 18 nt, Homo sapiens
uggggggcuguggggaaa

SEQ ID NO: 15592 - RNA, 17 nt, Homo sapiens
uuugcccuuagcaagug

SEQ ID NO: 15593 - RNA, 19 nt, Homo sapiens
aaaggaagaaauggaugua

SEQ ID NO: 15594 - RNA, 20 nt, Homo sapiens
auaucauuaguuuuuccugc

SEQ ID NO: 15595 - RNA, 18 nt, Homo sapiens
gaugcagagugcgcacac

SEQ ID NO: 15596 - RNA, 18 nt, Homo sapiens
uauuuaucuaaaccaaug

SEQ ID NO: 15597 - RNA, 20 nt, Homo sapiens
ugcugaaugagacacguuug

SEQ ID NO: 15598 - RNA, 19 nt, Homo sapiens
uuucugggucuagcuguac

SEQ ID NO: 15599 - RNA, 20 nt, Homo sapiens
aggaaggcauggggcggggg

SEQ ID NO: 15600 - RNA, 21 nt, Homo sapiens
cuccaaauaucugggcuuccu

SEQ ID NO: 15601 - RNA, 19 nt, Homo sapiens
gggcggggggugagggagc

SEQ ID NO: 15602 - RNA, 20 nt, Homo sapiens
gggcggggggugagggagca

SEQ ID NO: 15603 - RNA, 20 nt, Homo sapiens
uggggcggggggugagggag

SEQ ID NO: 15604 - RNA, 19 nt, Homo sapiens
cccccauaccuucccuagc

SEQ ID NO: 15605 - RNA, 19 nt, Homo sapiens
acagagucaguuaguugca

SEQ ID NO: 15606 - RNA, 16 nt, Homo sapiens
ccagaggaauaaaugc

SEQ ID NO: 15607 - RNA, 19 nt, Homo sapiens
cgggugcgaggcggcggcg

SEQ ID NO: 15608 - RNA, 16 nt, Homo sapiens
ggacauuugcuccauc

SEQ ID NO: 15609 - RNA, 17 nt, Homo sapiens
ggcgcgaggcugcgggu

SEQ ID NO: 15610 - RNA, 20 nt, Homo sapiens
ggcggcggcgggcgcgaggc

SEQ ID NO: 15611 - RNA, 22 nt, Homo sapiens
uaccugggaaagggcaggagaa

SEQ ID NO: 15612 - RNA, 18 nt, Homo sapiens
uacuggagucagcugaag

SEQ ID NO: 15613 - RNA, 20 nt, Homo sapiens
uccaaucuccuggaaucagu

SEQ ID NO: 15614 - RNA, 18 nt, Homo sapiens
ugcuagauaggaaagcag

SEQ ID NO: 15615 - RNA, 23 nt, Homo sapiens
uggcauuucucccuuuagcagca

SEQ ID NO: 15616 - RNA, 21 nt, Homo sapiens
ugugaaauuuuguuuaaaaaa

SEQ ID NO: 15617 - RNA, 17 nt, Homo sapiens
agggccccgcggcugcc

SEQ ID NO: 15618 - RNA, 21 nt, Homo sapiens
ccggcgccggcuggcccggcc

SEQ ID NO: 15619 - RNA, 21 nt, Homo sapiens
cuucauguagagagcucucuu

SEQ ID NO: 15620 - RNA, 18 nt, Homo sapiens
gcccggccgccggcuccc

SEQ ID NO: 15621 - RNA, 21 nt, Homo sapiens
ggcaugcugauaaggauccca

SEQ ID NO: 15622 - RNA, 18 nt, Homo sapiens
uauuggcugcugaucaau

SEQ ID NO: 15623 - RNA, 25 nt, Homo sapiens
ccacuaagauaauguuggcgcgccg

SEQ ID NO: 15624 - RNA, 21 nt, Homo sapiens
gagggcugggggcuggggagg

SEQ ID NO: 15625 - RNA, 18 nt, Homo sapiens
gggagggcugggggcugg

SEQ ID NO: 15626 - RNA, 19 nt, Homo sapiens
ggggagggcugggggcugg

SEQ ID NO: 15627 - RNA, 21 nt, Homo sapiens
gcuguagaggcuguauggagu

SEQ ID NO: 15628 - RNA, 18 nt, Homo sapiens
ggcuguagaggcuguaug

SEQ ID NO: 15629 - RNA, 20 nt, Homo sapiens
gggacguuggggacaccuag

SEQ ID NO: 15630 - RNA, 18 nt, Homo sapiens
ugggacagggggugguga

SEQ ID NO: 15631 - RNA, 19 nt, Homo sapiens
ccgggggugcggggggcgc

SEQ ID NO: 15632 - RNA, 22 nt, Homo sapiens
cgcuggaggccgggggugcggg

SEQ ID NO: 15633 - RNA, 24 nt, Homo sapiens
gcgcuugccggagaaccgcggccg

SEQ ID NO: 15634 - RNA, 19 nt, Homo sapiens
ggcgcuucgggcgccgugg

SEQ ID NO: 15635 - RNA, 22 nt, Homo sapiens
ucgccucgccggagcagccgga

SEQ ID NO: 15636 - RNA, 25 nt, Homo sapiens
aagagcacuaggucuugcacagcua

SEQ ID NO: 15637 - RNA, 22 nt, Homo sapiens
aggaggaggagggcgaggagaa

SEQ ID NO: 15638 - RNA, 22 nt, Homo sapiens
ccucauucauuuuuuucccaca

SEQ ID NO: 15639 - RNA, 16 nt, Homo sapiens
cgggaggggagggcga

SEQ ID NO: 15640 - RNA, 19 nt, Homo sapiens
cgggaggggagggcgagga

SEQ ID NO: 15641 - RNA, 19 nt, Homo sapiens
cuguugauuugucuuggca

SEQ ID NO: 15642 - RNA, 17 nt, Homo sapiens
gaggaggaggagagaag

SEQ ID NO: 15643 - RNA, 17 nt, Homo sapiens
gaggaggaggaggaggg

SEQ ID NO: 15644 - RNA, 21 nt, Homo sapiens
ggaggaggaggagggcgagga

SEQ ID NO: 15645 - RNA, 18 nt, Homo sapiens
gggggcuggcggcgcggc

SEQ ID NO: 15646 - RNA, 21 nt, Homo sapiens
uauggcaguuuacauuucuaa

SEQ ID NO: 15647 - RNA, 15 nt, Homo sapiens
uggaccagccccgcc

SEQ ID NO: 15648 - RNA, 15 nt, Homo sapiens
cagggacugcgccgc

SEQ ID NO: 15649 - RNA, 16 nt, Homo sapiens
cgagugaagcugccac

SEQ ID NO: 15650 - RNA, 23 nt, Homo sapiens
cgggccggcgggcgggcggaggg

SEQ ID NO: 15651 - RNA, 20 nt, Homo sapiens
gcagucuuuauauaacccau

SEQ ID NO: 15652 - RNA, 21 nt, Homo sapiens
gccgggccgccgccgccuccg

SEQ ID NO: 15653 - RNA, 23 nt, Homo sapiens
ucaggagagggaggaaccacugc

SEQ ID NO: 15654 - RNA, 21 nt, Homo sapiens
uccggagacggaagcacuugc

SEQ ID NO: 15655 - RNA, 15 nt, Homo sapiens
ucugagcacguccag

SEQ ID NO: 15656 - RNA, 23 nt, Homo sapiens
ugcccuagguaguagccuucccu

SEQ ID NO: 15657 - RNA, 18 nt, Homo sapiens
uguagaaggaaaaagaau

SEQ ID NO: 15658 - RNA, 19 nt, Homo sapiens
aaggauguugggucccaug

SEQ ID NO: 15659 - RNA, 18 nt, Homo sapiens
cucggauccuucacgugu

SEQ ID NO: 15660 - RNA, 15 nt, Homo sapiens
gaaggauguuggguc

SEQ ID NO: 15661 - RNA, 23 nt, Homo sapiens
gcucuguggggccuggagcggcc

SEQ ID NO: 15662 - RNA, 18 nt, Homo sapiens
ggggccaggagacuggga

SEQ ID NO: 15663 - RNA, 18 nt, Homo sapiens
gguccaguucaaacccgc

SEQ ID NO: 15664 - RNA, 15 nt, Homo sapiens
gugagggugaacgca

SEQ ID NO: 15665 - RNA, 18 nt, Homo sapiens
uaaggcguguggugugag

SEQ ID NO: 15666 - RNA, 18 nt, Homo sapiens
uagggagugcugaggggg

SEQ ID NO: 15667 - RNA, 21 nt, Homo sapiens
ucugggggucuccugcucugu

SEQ ID NO: 15668 - RNA, 21 nt, Homo sapiens
ucuuugggaguguugggggaa

SEQ ID NO: 15669 - RNA, 21 nt, Homo sapiens
ugcuuggugacuaggagaaag

SEQ ID NO: 15670 - RNA, 17 nt, Homo sapiens
ugggaguguugggggaa

SEQ ID NO: 15671 - RNA, 18 nt, Homo sapiens
ugggggaagagaaggagc

SEQ ID NO: 15672 - RNA, 22 nt, Homo sapiens
ugggugacacacaguuugcaug

SEQ ID NO: 15673 - RNA, 19 nt, Homo sapiens
uggugugagggugaacgca

SEQ ID NO: 15674 - RNA, 18 nt, Homo sapiens
ugucaaguuuucuaccau

SEQ ID NO: 15675 - RNA, 19 nt, Homo sapiens
uuuuacccacagaccccag

SEQ ID NO: 15676 - RNA, 19 nt, Homo sapiens
aaaagagaaaaaagaaggc

SEQ ID NO: 15677 - RNA, 18 nt, Homo sapiens
aaauagauaugaauugau

SEQ ID NO: 15678 - RNA, 23 nt, Homo sapiens
cuaugcuugucgugccugugguu

SEQ ID NO: 15679 - RNA, 18 nt, Homo sapiens
uagaacaaagagaugagg

SEQ ID NO: 15680 - RNA, 16 nt, Homo sapiens
aaacaggguggcuaug

SEQ ID NO: 15681 - RNA, 16 nt, Homo sapiens
aagaaaauacugccaa

SEQ ID NO: 15682 - RNA, 16 nt, Homo sapiens
agaacacucucacgcc

SEQ ID NO: 15683 - RNA, 19 nt, Homo sapiens
agacaaggguuucaucaug

SEQ ID NO: 15684 - RNA, 20 nt, Homo sapiens
agagggaguggggcugaacu

SEQ ID NO: 15685 - RNA, 22 nt, Homo sapiens
agcuggucucaaacuccuggcc

SEQ ID NO: 15686 - RNA, 22 nt, Homo sapiens
cacccucuucagaugucuacag

SEQ ID NO: 15687 - RNA, 19 nt, Homo sapiens
cagaaggagacagaugaag

SEQ ID NO: 15688 - RNA, 23 nt, Homo sapiens
cagugauuuccauugcgcaacaa

SEQ ID NO: 15689 - RNA, 18 nt, Homo sapiens
caugaaucugcggaucuu

SEQ ID NO: 15690 - RNA, 18 nt, Homo sapiens
cccgccgcuuccuccagc

SEQ ID NO: 15691 - RNA, 23 nt, Homo sapiens
cccgccgcuuccuccagcucggu

SEQ ID NO: 15692 - RNA, 22 nt, Homo sapiens
ccggauaucuuauucccccaaa

SEQ ID NO: 15693 - RNA, 27 nt, Homo sapiens
ccuacauuuuuaaaaauguauggcuuu

SEQ ID NO: 15694 - RNA, 18 nt, Homo sapiens
ccuuaaaguggacguucu

SEQ ID NO: 15695 - RNA, 21 nt, Homo sapiens
cgcggggcgugcaccgagugc

SEQ ID NO: 15696 - RNA, 17 nt, Homo sapiens
cggagcgcucgggaagc

SEQ ID NO: 15697 - RNA, 17 nt, Homo sapiens
gauuacaggugugagcc

SEQ ID NO: 15698 - RNA, 16 nt, Homo sapiens
gccgaggggacccaac

SEQ ID NO: 15699 - RNA, 18 nt, Homo sapiens
gcggcgcggcagccgcgg

SEQ ID NO: 15700 - RNA, 21 nt, Homo sapiens
gcugggggcaaggcagauggu

SEQ ID NO: 15701 - RNA, 20 nt, Homo sapiens
gcuucagcuuccccaaaucc

SEQ ID NO: 15702 - RNA, 20 nt, Homo sapiens
gcuucucacugcacacauuu

SEQ ID NO: 15703 - RNA, 21 nt, Homo sapiens
ggcuuggugaaaauacagccc

SEQ ID NO: 15704 - RNA, 19 nt, Homo sapiens
gugcaucugccauaaugac

SEQ ID NO: 15705 - RNA, 19 nt, Homo sapiens
uacaacuggagaaaucaaa

SEQ ID NO: 15706 - RNA, 22 nt, Homo sapiens
uacaguguggaauucugguugc

SEQ ID NO: 15707 - RNA, 18 nt, Homo sapiens
uagagaccauguagguca

SEQ ID NO: 15708 - RNA, 18 nt, Homo sapiens
uccggcagcagucacagg

SEQ ID NO: 15709 - RNA, 19 nt, Homo sapiens
uccuguuucuuccagaugu

SEQ ID NO: 15710 - RNA, 21 nt, Homo sapiens
ucuacauuuugcacagugauu

SEQ ID NO: 15711 - RNA, 18 nt, Homo sapiens
ucuuaaaaguuauuugug

SEQ ID NO: 15712 - RNA, 17 nt, Homo sapiens
uggaaauguccucaggc

SEQ ID NO: 15713 - RNA, 16 nt, Homo sapiens
ugggcauggagaggga

SEQ ID NO: 15714 - RNA, 23 nt, Homo sapiens
ugugacuuuauuuccuuccuggc

SEQ ID NO: 15715 - RNA, 19 nt, Homo sapiens
uugguugacugcagccucc

SEQ ID NO: 15716 - RNA, 24 nt, Homo sapiens
agcagguggaacucugugggcagc

SEQ ID NO: 15717 - RNA, 19 nt, Homo sapiens
cucacucgguguuucuugg

SEQ ID NO: 15718 - RNA, 20 nt, Homo sapiens
ggagaucugguggcuccugg

SEQ ID NO: 15719 - RNA, 17 nt, Homo sapiens
ugcagugggcccuggag

SEQ ID NO: 15720 - RNA, 19 nt, Homo sapiens
aggcagaaagaaaacaacc

SEQ ID NO: 15721 - RNA, 19 nt, Homo sapiens
gagagaaacgugaugagga

SEQ ID NO: 15722 - RNA, 19 nt, Homo sapiens
gccuuuugggguacuuugg

SEQ ID NO: 15723 - RNA, 16 nt, Homo sapiens
uaauuuggccuuuugg

SEQ ID NO: 15724 - RNA, 20 nt, Homo sapiens
ugucauggguuuuccucagc

SEQ ID NO: 15725 - RNA, 17 nt, Homo sapiens
accaccccccacccccc

SEQ ID NO: 15726 - RNA, 17 nt, Homo sapiens
ccugcuccugccuuaca

SEQ ID NO: 15727 - RNA, 24 nt, Homo sapiens
uaccugaugugggauguagaaagc

SEQ ID NO: 15728 - RNA, 18 nt, Homo sapiens
aaacaccaaauagucaag

SEQ ID NO: 15729 - RNA, 19 nt, Homo sapiens
aaggaaaauucaaaaucca

SEQ ID NO: 15730 - RNA, 18 nt, Homo sapiens
accaaauaaccaccacca

SEQ ID NO: 15731 - RNA, 16 nt, Homo sapiens
gaccaauguauuuggu

SEQ ID NO: 15732 - RNA, 20 nt, Homo sapiens
gcggaggagguggcggaggc

SEQ ID NO: 15733 - RNA, 18 nt, Homo sapiens
uaaaacuagcucuauaca

SEQ ID NO: 15734 - RNA, 21 nt, Homo sapiens
uucagguaagugacaguuaug

SEQ ID NO: 15735 - RNA, 19 nt, Homo sapiens
gcgggggaacggggagagc

SEQ ID NO: 15736 - RNA, 16 nt, Homo sapiens
uggauaguaauagggc

SEQ ID NO: 15737 - RNA, 25 nt, Homo sapiens
gccaaaacacaaaguuuuagaaaaa

SEQ ID NO: 15738 - RNA, 18 nt, Homo sapiens
ucaaaagaggagaauaaa

SEQ ID NO: 15739 - RNA, 20 nt, Homo sapiens
ugcagaaaauaaauacaauc

SEQ ID NO: 15740 - RNA, 19 nt, Homo sapiens
uucaaaagaggagaauaaa

SEQ ID NO: 15741 - RNA, 18 nt, Homo sapiens
uucuugguuuuccaauuu

SEQ ID NO: 15742 - RNA, 19 nt, Homo sapiens
accacgucuaggaccuacc

SEQ ID NO: 15743 - RNA, 28 nt, Homo sapiens
accccagcccagcugaagacggcucucc

SEQ ID NO: 15744 - RNA, 19 nt, Homo sapiens
acuugaauguggaucugag

SEQ ID NO: 15745 - RNA, 19 nt, Homo sapiens
agacaaacagcacagcaca

SEQ ID NO: 15746 - RNA, 17 nt, Homo sapiens
aggcugugcccaaagcc

SEQ ID NO: 15747 - RNA, 18 nt, Homo sapiens
cagagucugaaggccccc

SEQ ID NO: 15748 - RNA, 21 nt, Homo sapiens
cagccucagcaugggcugcac

SEQ ID NO: 15749 - RNA, 19 nt, Homo sapiens
cccaaggggaggagcugca

SEQ ID NO: 15750 - RNA, 21 nt, Homo sapiens
cccugccagccgcccaccacc

SEQ ID NO: 15751 - RNA, 18 nt, Homo sapiens
gcacggggugggcaggac

SEQ ID NO: 15752 - RNA, 20 nt, Homo sapiens
gccuuggcuuccaagcuggg

SEQ ID NO: 15753 - RNA, 19 nt, Homo sapiens
gggcugcacggggugggca

SEQ ID NO: 15754 - RNA, 19 nt, Homo sapiens
guggacaggcucccugucg

SEQ ID NO: 15755 - RNA, 19 nt, Homo sapiens
ugaggaggggagggcagga

SEQ ID NO: 15756 - RNA, 19 nt, Homo sapiens
uaaguguaugguauaugcu

SEQ ID NO: 15757 - RNA, 18 nt, Homo sapiens
agucaccagcaccgucug

SEQ ID NO: 15758 - RNA, 21 nt, Homo sapiens
ccccagccucccgcagagucc

SEQ ID NO: 15759 - RNA, 24 nt, Homo sapiens
gagucagggcucgggggcgcucag

SEQ ID NO: 15760 - RNA, 17 nt, Homo sapiens
gcccgccccuccccugc

SEQ ID NO: 15761 - RNA, 21 nt, Homo sapiens
uccauggugggugaggggcca

SEQ ID NO: 15762 - RNA, 17 nt, Homo sapiens
ugggcuccgccagcucc

SEQ ID NO: 15763 - RNA, 18 nt, Homo sapiens
ugggguggugucgaaggc

SEQ ID NO: 15764 - RNA, 14 nt, Homo sapiens
caucgugcucccaa

SEQ ID NO: 15765 - RNA, 16 nt, Homo sapiens
cgugcucccaauucca

SEQ ID NO: 15766 - RNA, 25 nt, Homo sapiens
ggcggcggcggcgguggcggcggac

SEQ ID NO: 15767 - RNA, 19 nt, Homo sapiens
uggcucccguggggcuucu

SEQ ID NO: 15768 - RNA, 18 nt, Homo sapiens
aggcacgucauuguuccc

SEQ ID NO: 15769 - RNA, 19 nt, Homo sapiens
aggggcccuggaauacagg

SEQ ID NO: 15770 - RNA, 18 nt, Homo sapiens
cacacagcggggaguggc

SEQ ID NO: 15771 - RNA, 21 nt, Homo sapiens
gcacuuggcuugcccaaaguc

SEQ ID NO: 15772 - RNA, 24 nt, Homo sapiens
ggggauaggugggggaaugaggug

SEQ ID NO: 15773 - RNA, 18 nt, Homo sapiens
uaggugggggaaugaggu

SEQ ID NO: 15774 - RNA, 25 nt, Homo sapiens
uccccagcaaggcuagggguggcag

SEQ ID NO: 15775 - RNA, 17 nt, Homo sapiens
ugaacagugcagacaag

SEQ ID NO: 15776 - RNA, 23 nt, Homo sapiens
aacauuaucacaaaaaggggcuc

SEQ ID NO: 15777 - RNA, 17 nt, Homo sapiens
aguggaagagauagaug

SEQ ID NO: 15778 - RNA, 18 nt, Homo sapiens
cagagggggacugauggu

SEQ ID NO: 15779 - RNA, 16 nt, Homo sapiens
cccagggugagggagc

SEQ ID NO: 15780 - RNA, 17 nt, Homo sapiens
ccccaccugccucaucg

SEQ ID NO: 15781 - RNA, 22 nt, Homo sapiens
ccucaggggcaccguguccagg

SEQ ID NO: 15782 - RNA, 20 nt, Homo sapiens
ccuuggggaggaaggagggg

SEQ ID NO: 15783 - RNA, 18 nt, Homo sapiens
cgcgguagcaccucaggg

SEQ ID NO: 15784 - RNA, 21 nt, Homo sapiens
cggacaccgcguccggcgcgg

SEQ ID NO: 15785 - RNA, 19 nt, Homo sapiens
gacuacaggcgugcgccac

SEQ ID NO: 15786 - RNA, 19 nt, Homo sapiens
gaggcccucguggguggcc

SEQ ID NO: 15787 - RNA, 16 nt, Homo sapiens
ggcuagacacaacaau

SEQ ID NO: 15788 - RNA, 19 nt, Homo sapiens
gggccagggagugggccgg

SEQ ID NO: 15789 - RNA, 19 nt, Homo sapiens
gggcuggggugggccuggg

SEQ ID NO: 15790 - RNA, 17 nt, Homo sapiens
ggggaggaaggagggga

SEQ ID NO: 15791 - RNA, 23 nt, Homo sapiens
ucgauggccgagucggccuccuc

SEQ ID NO: 15792 - RNA, 18 nt, Homo sapiens
uggccaggauggucucga

SEQ ID NO: 15793 - RNA, 16 nt, Homo sapiens
ugggguggggcuggcg

SEQ ID NO: 15794 - RNA, 21 nt, Homo sapiens
uucacauauuucuuuuucuac

SEQ ID NO: 15795 - RNA, 21 nt, Homo sapiens
uucccggggggaggaccaggu

SEQ ID NO: 15796 - RNA, 16 nt, Homo sapiens
agaggcaggcaugagc

SEQ ID NO: 15797 - RNA, 18 nt, Homo sapiens
agcuguuguuaugguguc

SEQ ID NO: 15798 - RNA, 19 nt, Homo sapiens
caaugugcauuuaaaggag

SEQ ID NO: 15799 - RNA, 21 nt, Homo sapiens
gaaauggugagagccauccac

SEQ ID NO: 15800 - RNA, 22 nt, Homo sapiens
ucucugcugcuuguguguucuc

SEQ ID NO: 15801 - RNA, 20 nt, Homo sapiens
auuuaguccaauaacaugga

SEQ ID NO: 15802 - RNA, 20 nt, Homo sapiens
gaagaaaaagcaauuuugga

SEQ ID NO: 15803 - RNA, 20 nt, Homo sapiens
gcuguccuuccuccuucccc

SEQ ID NO: 15804 - RNA, 17 nt, Homo sapiens
ugaaguuaucaggaacu

SEQ ID NO: 15805 - RNA, 22 nt, Homo sapiens
ucucugcugucuguguguucuc

SEQ ID NO: 15806 - RNA, 20 nt, Homo sapiens
cauguuuuauucugcuagaa

SEQ ID NO: 15807 - RNA, 21 nt, Homo sapiens
gaaauggugagagccauccac

SEQ ID NO: 15808 - RNA, 16 nt, Homo sapiens
uguaaaaguuugaggu

SEQ ID NO: 15809 - RNA, 22 nt, Homo sapiens
uguaguacauguuuuauucugc

SEQ ID NO: 15810 - RNA, 19 nt, Homo sapiens
uugagguuccaugggagaa

SEQ ID NO: 15811 - RNA, 20 nt, Homo sapiens
auuuaguccaauaacauuga

SEQ ID NO: 15812 - RNA, 22 nt, Homo sapiens
ucucugcugccuguguguucuc

SEQ ID NO: 15813 - RNA, 23 nt, Homo sapiens
gaaaacauuauccuuuuguuauu

SEQ ID NO: 15814 - RNA, 17 nt, Homo sapiens
ugaaguuaucaggaacu

SEQ ID NO: 15815 - RNA, 19 nt, Homo sapiens
aaauauuuuucacuacaug

SEQ ID NO: 15816 - RNA, 21 nt, Homo sapiens
aauggagggcggagcaggaag

SEQ ID NO: 15817 - RNA, 19 nt, Homo sapiens
gaaaggaagccaagcaugg

SEQ ID NO: 15818 - RNA, 20 nt, Homo sapiens
gagacggagucucacucugu

SEQ ID NO: 15819 - RNA, 17 nt, Homo sapiens
gagguugcagugagcca

SEQ ID NO: 15820 - RNA, 17 nt, Homo sapiens
gcccgccucggccuccc

SEQ ID NO: 15821 - RNA, 18 nt, Homo sapiens
ggagggcggagcaggaag

SEQ ID NO: 15822 - RNA, 23 nt, Homo sapiens
uaagaaauuaguagcugaaguuu

SEQ ID NO: 15823 - RNA, 19 nt, Homo sapiens
ugcaguggcaugaucucgg

SEQ ID NO: 15824 - RNA, 18 nt, Homo sapiens
ccacaugagugucuuacu

SEQ ID NO: 15825 - RNA, 17 nt, Homo sapiens
uuuauugaguugaguuu

SEQ ID NO: 15826 - RNA, 24 nt, Homo sapiens
aguguaugcugacaucuaggaggg

SEQ ID NO: 15827 - RNA, 22 nt, Homo sapiens
cagguuuuggcccuagagaguu

SEQ ID NO: 15828 - RNA, 21 nt, Homo sapiens
ccugggacaaaagaagaaaga

SEQ ID NO: 15829 - RNA, 22 nt, Homo sapiens
ggagguaaggucagguggcuua

SEQ ID NO: 15830 - RNA, 24 nt, Homo sapiens
ucauguauagggcucuuuauauuu

SEQ ID NO: 15831 - RNA, 16 nt, Homo sapiens
cacgcuuuauugggaa

SEQ ID NO: 15832 - RNA, 18 nt, Homo sapiens
uaggauuccaauuuaaag

SEQ ID NO: 15833 - RNA, 23 nt, Homo sapiens
cuuuaacuuuauuuuuacaauaa

SEQ ID NO: 15834 - RNA, 17 nt, Homo sapiens
cagcugcaguucagagc

SEQ ID NO: 15835 - RNA, 21 nt, Homo sapiens
cagagagcucuuguuggguca

SEQ ID NO: 15836 - RNA, 19 nt, Homo sapiens
cauuccacuuagcaauuuu

SEQ ID NO: 15837 - RNA, 19 nt, Homo sapiens
gcagcaguagcggucaccg

SEQ ID NO: 15838 - RNA, 18 nt, Homo sapiens
guggcuucucuucauuuu

SEQ ID NO: 15839 - RNA, 18 nt, Homo sapiens
ucucauacaaucugaagg

SEQ ID NO: 15840 - RNA, 24 nt, Homo sapiens
ugggucagcuuucuaauaagcaug

SEQ ID NO: 15841 - RNA, 20 nt, Homo sapiens
aaaauaaaagggaggaagaa

SEQ ID NO: 15842 - RNA, 19 nt, Homo sapiens
acacagggcuugccuggca

SEQ ID NO: 15843 - RNA, 17 nt, Homo sapiens
cagcaugucuguggcua

SEQ ID NO: 15844 - RNA, 19 nt, Homo sapiens
cucacgccugugaucccag

SEQ ID NO: 15845 - RNA, 20 nt, Homo sapiens
gcuugcugcccucugguggg

SEQ ID NO: 15846 - RNA, 21 nt, Homo sapiens
uaaaagagacaaaaaauaaaa

SEQ ID NO: 15847 - RNA, 16 nt, Homo sapiens
uagcgaagugaaagga

SEQ ID NO: 15848 - RNA, 19 nt, Homo sapiens
uccuguuacuguuccccag

SEQ ID NO: 15849 - RNA, 18 nt, Homo sapiens
ugggagggucauaagaaa

SEQ ID NO: 15850 - RNA, 17 nt, Homo sapiens
acacagagcagacccgc

SEQ ID NO: 15851 - RNA, 21 nt, Homo sapiens
ggggcccggccgugggggccu

SEQ ID NO: 15852 - RNA, 14 nt, Homo sapiens
ggggugucgcagcc

SEQ ID NO: 15853 - RNA, 20 nt, Homo sapiens
ucgaaguccagguacagacu

SEQ ID NO: 15854 - RNA, 16 nt, Homo sapiens
cucccuugaagugaaa

SEQ ID NO: 15855 - RNA, 17 nt, Homo sapiens
ugagagcaccccgcuga

SEQ ID NO: 15856 - RNA, 20 nt, Homo sapiens
ugggugacgguggagaaaga

SEQ ID NO: 15857 - RNA, 21 nt, Homo sapiens
cagggaucuugcccaucaugc

SEQ ID NO: 15858 - RNA, 18 nt, Homo sapiens
cccaggccauccugagcg

SEQ ID NO: 15859 - RNA, 16 nt, Homo sapiens
cggagcgcaccggagc

SEQ ID NO: 15860 - RNA, 16 nt, Homo sapiens
cgggcgccgcagcagc

SEQ ID NO: 15861 - RNA, 19 nt, Homo sapiens
gcaccggagcgcgggcgcc

SEQ ID NO: 15862 - RNA, 19 nt, Homo sapiens
ucaucugccaggcacuuag

SEQ ID NO: 15863 - RNA, 20 nt, Homo sapiens
uggggaggacucacuugcug

SEQ ID NO: 15864 - RNA, 19 nt, Homo sapiens
caaaaaaggaaaaaaaaag

SEQ ID NO: 15865 - RNA, 22 nt, Homo sapiens
cagggccuuggaaguuuugguu

SEQ ID NO: 15866 - RNA, 15 nt, Homo sapiens
cgcggcggaggcggc

SEQ ID NO: 15867 - RNA, 21 nt, Homo sapiens
gaggcgcgcggcggaggcggc

SEQ ID NO: 15868 - RNA, 21 nt, Homo sapiens
gcgcggcggaggcggcugcgg

SEQ ID NO: 15869 - RNA, 18 nt, Homo sapiens
gcggaggaggcgcgcggc

SEQ ID NO: 15870 - RNA, 21 nt, Homo sapiens
gcugcggcgagcaaggaggcg

SEQ ID NO: 15871 - RNA, 19 nt, Homo sapiens
ggcgcgcggcggaggcggc

SEQ ID NO: 15872 - RNA, 23 nt, Homo sapiens
ggcggcggaggaggcgcgcggcg

SEQ ID NO: 15873 - RNA, 17 nt, Homo sapiens
gggugguggagagcgcg

SEQ ID NO: 15874 - RNA, 17 nt, Homo sapiens
ggugauccgaugcaggg

SEQ ID NO: 15875 - RNA, 19 nt, Homo sapiens
uacacaaaaaaguuacugg

SEQ ID NO: 15876 - RNA, 20 nt, Homo sapiens
uauaaaauguaaauaaaaaa

SEQ ID NO: 15877 - RNA, 16 nt, Homo sapiens
ucuuuuuuccuccccu

SEQ ID NO: 15878 - RNA, 22 nt, Homo sapiens
aagaggcggcagaggcgcgcgg

SEQ ID NO: 15879 - RNA, 19 nt, Homo sapiens
acacggcagcggcggccgc

SEQ ID NO: 15880 - RNA, 18 nt, Homo sapiens
agggagaaagagagcaaa

SEQ ID NO: 15881 - RNA, 16 nt, Homo sapiens
agggaggggagggggg

SEQ ID NO: 15882 - RNA, 20 nt, Homo sapiens
cggaaccuggcgcgguggcg

SEQ ID NO: 15883 - RNA, 19 nt, Homo sapiens
gacaugacgcugggggaug

SEQ ID NO: 15884 - RNA, 18 nt, Homo sapiens
gaggggaggggggcagcu

SEQ ID NO: 15885 - RNA, 19 nt, Homo sapiens
gaggguggccgcggccgga

SEQ ID NO: 15886 - RNA, 20 nt, Homo sapiens
gccgcggccggaaccuggcg

SEQ ID NO: 15887 - RNA, 21 nt, Homo sapiens
gcgcgcgggguggggcggggg

SEQ ID NO: 15888 - RNA, 23 nt, Homo sapiens
gcggcggcgacacggcagcggcg

SEQ ID NO: 15889 - RNA, 16 nt, Homo sapiens
ggaggcggggucccgg

SEQ ID NO: 15890 - RNA, 18 nt, Homo sapiens
ggagggcgcagugucugg

SEQ ID NO: 15891 - RNA, 20 nt, Homo sapiens
ggagggcgcagugucuggag

SEQ ID NO: 15892 - RNA, 20 nt, Homo sapiens
gggagaaagaagaggguggc

SEQ ID NO: 15893 - RNA, 17 nt, Homo sapiens
gggaggggaggggggca

SEQ ID NO: 15894 - RNA, 19 nt, Homo sapiens
gggaggggaggggggcagc

SEQ ID NO: 15895 - RNA, 25 nt, Homo sapiens
gggaggggaggggggcagcuguggg

SEQ ID NO: 15896 - RNA, 17 nt, Homo sapiens
gggguggggcgggggug

SEQ ID NO: 15897 - RNA, 21 nt, Homo sapiens
ggugccggggccggggccggg

SEQ ID NO: 15898 - RNA, 19 nt, Homo sapiens
gguggagggcgcagugucu

SEQ ID NO: 15899 - RNA, 27 nt, Homo sapiens
cacggucugcucaagaagaguguugac

SEQ ID NO: 15900 - RNA, 20 nt, Homo sapiens
ccuaaaggaccgucacccag

SEQ ID NO: 15901 - RNA, 23 nt, Homo sapiens
cucaagaagaguguugacuugga

SEQ ID NO: 15902 - RNA, 21 nt, Homo sapiens
ggggggcuguuggcgugccgc

SEQ ID NO: 15903 - RNA, 15 nt, Homo sapiens
gguggggggcggggg

SEQ ID NO: 15904 - RNA, 16 nt, Homo sapiens
uacagccuggcaccua

SEQ ID NO: 15905 - RNA, 23 nt, Homo sapiens
uagugcacuauggaugccuuugg

SEQ ID NO: 15906 - RNA, 23 nt, Homo sapiens
ucugccgcucuaggccgcgucgc

SEQ ID NO: 15907 - RNA, 18 nt, Homo sapiens
ugacuuggaauggcggag

SEQ ID NO: 15908 - RNA, 18 nt, Homo sapiens
agcuggcgcgagcagagc

SEQ ID NO: 15909 - RNA, 20 nt, Homo sapiens
auuuuagacagccauuuaca

SEQ ID NO: 15910 - RNA, 17 nt, Homo sapiens
caauguuggucagguga

SEQ ID NO: 15911 - RNA, 18 nt, Homo sapiens
ccgcgccccgcccccacg

SEQ ID NO: 15912 - RNA, 20 nt, Homo sapiens
cgucagcgcgcagacucggc

SEQ ID NO: 15913 - RNA, 17 nt, Homo sapiens
gcaauauauaguagaaa

SEQ ID NO: 15914 - RNA, 17 nt, Homo sapiens
gcagagccugcgccggc

SEQ ID NO: 15915 - RNA, 19 nt, Homo sapiens
gcggcgcaugcgcgcugcg

SEQ ID NO: 15916 - RNA, 17 nt, Homo sapiens
uuuucaaauugagcucu

SEQ ID NO: 15917 - RNA, 18 nt, Homo sapiens
uccggagaggaagggggc

SEQ ID NO: 15918 - RNA, 20 nt, Homo sapiens
ugccgggccgccucaccacc

SEQ ID NO: 15919 - RNA, 18 nt, Homo sapiens
gcuggcccgagggaggcc

SEQ ID NO: 15920 - RNA, 19 nt, Homo sapiens
ggcuccgcgacggacccgc

SEQ ID NO: 15921 - RNA, 21 nt, Homo sapiens
gaauacuauaaaucuggcuuu

SEQ ID NO: 15922 - RNA, 16 nt, Homo sapiens
ucccgcguccccccgg

SEQ ID NO: 15923 - RNA, 19 nt, Homo sapiens
ccggcccgcggcuccgagc

SEQ ID NO: 15924 - RNA, 17 nt, Homo sapiens
caaguuuuuaaaaacaa

SEQ ID NO: 15925 - RNA, 20 nt, Homo sapiens
uaaaauuuuaaacauucucc

SEQ ID NO: 15926 - RNA, 20 nt, Homo sapiens
uaaauuauacauaguaucaa

SEQ ID NO: 15927 - RNA, 19 nt, Homo sapiens
uacagguugaauuaguuuu

SEQ ID NO: 15928 - RNA, 18 nt, Homo sapiens
cggagccgaagcuggagc

SEQ ID NO: 15929 - RNA, 15 nt, Homo sapiens
ggaggagaggggagc

SEQ ID NO: 15930 - RNA, 20 nt, Homo sapiens
aaggggaggggagaggcagg

SEQ ID NO: 15931 - RNA, 17 nt, Homo sapiens
aggggaaggggagggga

SEQ ID NO: 15932 - RNA, 21 nt, Homo sapiens
aggggaggggagaggcagggg

SEQ ID NO: 15933 - RNA, 21 nt, Homo sapiens
cggaggaaacggaggaaaaca

SEQ ID NO: 15934 - RNA, 23 nt, Homo sapiens
cggcccgaguccccuuggaaucc

SEQ ID NO: 15935 - RNA, 18 nt, Homo sapiens
cuguuguauaagauuaua

SEQ ID NO: 15936 - RNA, 18 nt, Homo sapiens
gccggcgggcggcggcgg

SEQ ID NO: 15937 - RNA, 16 nt, Homo sapiens
gcgcucggcggcccga

SEQ ID NO: 15938 - RNA, 21 nt, Homo sapiens
gggaaggggaggggagaggca

SEQ ID NO: 15939 - RNA, 18 nt, Homo sapiens
ggggagaggcagggggag

SEQ ID NO: 15940 - RNA, 21 nt, Homo sapiens
ggggagaggcagggggagcgg

SEQ ID NO: 15941 - RNA, 19 nt, Homo sapiens
uaaaaaaaaguagcaugua

SEQ ID NO: 15942 - RNA, 17 nt, Homo sapiens
uaagugcccuuucagga

SEQ ID NO: 15943 - RNA, 15 nt, Homo sapiens
uagaaugcaaccacu

SEQ ID NO: 15944 - RNA, 18 nt, Homo sapiens
uccaugcuccugaaaguu

SEQ ID NO: 15945 - RNA, 18 nt, Homo sapiens
uugcuguuguauaagauu

SEQ ID NO: 15946 - RNA, 22 nt, Homo sapiens
cagcacccaggagucugggagc

SEQ ID NO: 15947 - RNA, 16 nt, Homo sapiens
caggauccuuccugcc

SEQ ID NO: 15948 - RNA, 15 nt, Homo sapiens
ccagcccccuccucc

SEQ ID NO: 15949 - RNA, 30 nt, Homo sapiens
uccaggaaucugggcucaaguggguguccg

SEQ ID NO: 15950 - RNA, 21 nt, Homo sapiens
ccgcugccuccuccgcgcguc

SEQ ID NO: 15951 - RNA, 19 nt, Homo sapiens
cgcgcccuggaacgugccc

SEQ ID NO: 15952 - RNA, 19 nt, Homo sapiens
cggagacauggcagcggcg

SEQ ID NO: 15953 - RNA, 20 nt, Homo sapiens
cgggccccgccgugcgcccg

SEQ ID NO: 15954 - RNA, 18 nt, Homo sapiens
cugccgucuccuucgccu

SEQ ID NO: 15955 - RNA, 19 nt, Homo sapiens
gcccgccccgggcuucccc

SEQ ID NO: 15956 - RNA, 15 nt, Homo sapiens
gcggcggcggcggcc

SEQ ID NO: 15957 - RNA, 17 nt, Homo sapiens
gcggcugccgcgggggg

SEQ ID NO: 15958 - RNA, 19 nt, Homo sapiens
gcuacuguuuaaauauucc

SEQ ID NO: 15959 - RNA, 18 nt, Homo sapiens
ggcagcggcggcggcggc

SEQ ID NO: 15960 - RNA, 18 nt, Homo sapiens
ggcggcggcggccgcggc

SEQ ID NO: 15961 - RNA, 22 nt, Homo sapiens
gggcaggggaagcggggccggg

SEQ ID NO: 15962 - RNA, 21 nt, Homo sapiens
ucggggcaugugccuucgcug

SEQ ID NO: 15963 - RNA, 18 nt, Homo sapiens
aagaaaauaagccaguua

SEQ ID NO: 15964 - RNA, 20 nt, Homo sapiens
acaguuugcucaaauuugac

SEQ ID NO: 15965 - RNA, 20 nt, Homo sapiens
ggacagccgcccgcccgccc

SEQ ID NO: 15966 - RNA, 24 nt, Homo sapiens
uauauauauuuauauauuuauaua

SEQ ID NO: 15967 - RNA, 24 nt, Homo sapiens
uauauauuuauauauuuauauaga

SEQ ID NO: 15968 - RNA, 19 nt, Homo sapiens
uucaucagcuuucauuuua

SEQ ID NO: 15969 - RNA, 19 nt, Homo sapiens
acuguggcugugugugugu

SEQ ID NO: 15970 - RNA, 16 nt, Homo sapiens
aggcagcagcauuacu

SEQ ID NO: 15971 - RNA, 18 nt, Homo sapiens
cuguguguguguuucugu

SEQ ID NO: 15972 - RNA, 20 nt, Homo sapiens
gauuuggcaacuguggcugu

SEQ ID NO: 15973 - RNA, 23 nt, Homo sapiens
uaucuguuaguccuggaaagcua

SEQ ID NO: 15974 - RNA, 15 nt, Homo sapiens
uccuggaaagcuaca

SEQ ID NO: 15975 - RNA, 18 nt, Homo sapiens
ucuuuguucauuacacau

SEQ ID NO: 15976 - RNA, 21 nt, Homo sapiens
ugguaugaaagggauuguuug

SEQ ID NO: 15977 - RNA, 18 nt, Homo sapiens
agaggcaggcccggggcu

SEQ ID NO: 15978 - RNA, 17 nt, Homo sapiens
aggcaggagaaggcucu

SEQ ID NO: 15979 - RNA, 15 nt, Homo sapiens
gaggaggcugggcgu

SEQ ID NO: 15980 - RNA, 19 nt, Homo sapiens
gcccggggcugagaagcag

SEQ ID NO: 15981 - RNA, 21 nt, Homo sapiens
ggcaggcgugccccuucuggc

SEQ ID NO: 15982 - RNA, 21 nt, Homo sapiens
ggcugguggggcagugaggag

SEQ ID NO: 15983 - RNA, 23 nt, Homo sapiens
ugcccugggcucugggaugcccc

SEQ ID NO: 15984 - RNA, 22 nt, Homo sapiens
aaguuacugucaggugauggga

SEQ ID NO: 15985 - RNA, 14 nt, Homo sapiens
gaacaauguuuggu

SEQ ID NO: 15986 - RNA, 16 nt, Homo sapiens
ggagagggagggggag

SEQ ID NO: 15987 - RNA, 19 nt, Homo sapiens
ugccuaauuuuaggaagag

SEQ ID NO: 15988 - RNA, 17 nt, Homo sapiens
uguauagaucgaaguga

SEQ ID NO: 15989 - RNA, 19 nt, Homo sapiens
aacauuauccucaaaagcu

SEQ ID NO: 15990 - RNA, 18 nt, Homo sapiens
ccuuguaguauaaauaug

SEQ ID NO: 15991 - RNA, 20 nt, Homo sapiens
uggagagacgcaaaguucuu

SEQ ID NO: 15992 - RNA, 23 nt, Homo sapiens
uggcauguguuuuaagugugagu

SEQ ID NO: 15993 - RNA, 22 nt, Homo sapiens
cucggccaccgucaccacagag

SEQ ID NO: 15994 - RNA, 21 nt, Homo sapiens
ggaggcggcacagaccuggag

SEQ ID NO: 15995 - RNA, 22 nt, Homo sapiens
gggcaucguccacugcgcauuc

SEQ ID NO: 15996 - RNA, 23 nt, Homo sapiens
ucgaacuccugaccucaggugau

SEQ ID NO: 15997 - RNA, 22 nt, Homo sapiens
uguuacuuugauaccauuuuua

SEQ ID NO: 15998 - RNA, 16 nt, Homo sapiens
cacugaaaggcugggc

SEQ ID NO: 15999 - RNA, 21 nt, Homo sapiens
cccgcgggccacucugugggg

SEQ ID NO: 16000 - RNA, 19 nt, Homo sapiens
ccggcuccggcuccgggcc

SEQ ID NO: 16001 - RNA, 21 nt, Homo sapiens
gccuguggggcuccggcuccg

SEQ ID NO: 16002 - RNA, 18 nt, Homo sapiens
ggcuccggcuccggcucc

SEQ ID NO: 16003 - RNA, 20 nt, Homo sapiens
gggcccgggaggggacuggg

SEQ ID NO: 16004 - RNA, 16 nt, Homo sapiens
uggucaggucgggggc

SEQ ID NO: 16005 - RNA, 21 nt, Homo sapiens
accuguauuuuuuccaucucu

SEQ ID NO: 16006 - RNA, 22 nt, Homo sapiens
cagagaggaaaacguguugugu

SEQ ID NO: 16007 - RNA, 18 nt, Homo sapiens
ccaggagaacuauagaaa

SEQ ID NO: 16008 - RNA, 23 nt, Homo sapiens
ccccagcccaggcuguuucuccc

SEQ ID NO: 16009 - RNA, 23 nt, Homo sapiens
ccuccuccucucuauccuugucc

SEQ ID NO: 16010 - RNA, 18 nt, Homo sapiens
gaccuguagccccagccc

SEQ ID NO: 16011 - RNA, 25 nt, Homo sapiens
uagcagaagugagaaucuguaaaag

SEQ ID NO: 16012 - RNA, 22 nt, Homo sapiens
uaucacacagcauuguaggaag

SEQ ID NO: 16013 - RNA, 17 nt, Homo sapiens
uccaccacaaguccugg

SEQ ID NO: 16014 - RNA, 18 nt, Homo sapiens
uuauuuugagaaaggaaa

SEQ ID NO: 16015 - RNA, 20 nt, Homo sapiens
uucagaucugggcucuucca

SEQ ID NO: 16016 - RNA, 15 nt, Homo sapiens
acugcagacugagag

SEQ ID NO: 16017 - RNA, 21 nt, Homo sapiens
cacaggaaaaugaaacugaag

SEQ ID NO: 16018 - RNA, 17 nt, Homo sapiens
cagagauaaaacagugc

SEQ ID NO: 16019 - RNA, 18 nt, Homo sapiens
ccaacuaccacagggcac

SEQ ID NO: 16020 - RNA, 22 nt, Homo sapiens
ccuccuuguaagcaagacugca

SEQ ID NO: 16021 - RNA, 18 nt, Homo sapiens
ucacugaagcagguauag

SEQ ID NO: 16022 - RNA, 20 nt, Homo sapiens
uuuauaggauaucugaguuu

SEQ ID NO: 16023 - RNA, 19 nt, Homo sapiens
aaagagggggagucacaga

SEQ ID NO: 16024 - RNA, 23 nt, Homo sapiens
acggaggaagugacuagaaaaca

SEQ ID NO: 16025 - RNA, 21 nt, Homo sapiens
cguggggacguacaugggcug

SEQ ID NO: 16026 - RNA, 17 nt, Homo sapiens
gccggaccacgggcgcc

SEQ ID NO: 16027 - RNA, 17 nt, Homo sapiens
gccugggaaguaaagaa

SEQ ID NO: 16028 - RNA, 22 nt, Homo sapiens
gggaggaauaaggauaaaaaga

SEQ ID NO: 16029 - RNA, 17 nt, Homo sapiens
gggaggauggagagugg

SEQ ID NO: 16030 - RNA, 18 nt, Homo sapiens
ggggaggauggagagugg

SEQ ID NO: 16031 - RNA, 14 nt, Homo sapiens
uccauggccccuuu

SEQ ID NO: 16032 - RNA, 19 nt, Homo sapiens
ugagggcuuacucagacag

SEQ ID NO: 16033 - RNA, 22 nt, Homo sapiens
ugaugaagaagagauacaaaag

SEQ ID NO: 16034 - RNA, 20 nt, Homo sapiens
uggaaggguaggaggagcac

SEQ ID NO: 16035 - RNA, 21 nt, Homo sapiens
uggagugguuuggacugucac

SEQ ID NO: 16036 - RNA, 19 nt, Homo sapiens
auauuccuccagcucagug

SEQ ID NO: 16037 - RNA, 18 nt, Homo sapiens
cacgggggacacagcauc

SEQ ID NO: 16038 - RNA, 18 nt, Homo sapiens
uaaccaaaguaucuuccc

SEQ ID NO: 16039 - RNA, 20 nt, Homo sapiens
ucucaaaaaagggggaagaa

SEQ ID NO: 16040 - RNA, 23 nt, Homo sapiens
ugaaacuugcaucuccugcugca

SEQ ID NO: 16041 - RNA, 17 nt, Homo sapiens
acgcgaacgccgggaug

SEQ ID NO: 16042 - RNA, 20 nt, Homo sapiens
aggaaaagagauggaggagg

SEQ ID NO: 16043 - RNA, 20 nt, Homo sapiens
cacagugguggucagggugg

SEQ ID NO: 16044 - RNA, 27 nt, Homo sapiens
cacagugguggucagggugguggcccc

SEQ ID NO: 16045 - RNA, 18 nt, Homo sapiens
cagggcuggccacgaccc

SEQ ID NO: 16046 - RNA, 19 nt, Homo sapiens
cauuggauggcuacaaagg

SEQ ID NO: 16047 - RNA, 21 nt, Homo sapiens
ccugacccccauggccccucc

SEQ ID NO: 16048 - RNA, 15 nt, Homo sapiens
cucucuugggcaaug

SEQ ID NO: 16049 - RNA, 22 nt, Homo sapiens
gagggcagggggcagggggcug

SEQ ID NO: 16050 - RNA, 19 nt, Homo sapiens
gugcagcugcucuggcgcg

SEQ ID NO: 16051 - RNA, 20 nt, Homo sapiens
uggggaaaaaaggaggugca

SEQ ID NO: 16052 - RNA, 18 nt, Homo sapiens
ugugcaaaguucuggggg

SEQ ID NO: 16053 - RNA, 15 nt, Homo sapiens
uuccagacgaggcug

SEQ ID NO: 16054 - RNA, 16 nt, Homo sapiens
cuagagacauuguaga

SEQ ID NO: 16055 - RNA, 19 nt, Homo sapiens
gcggcgggcugcgcggcgg

SEQ ID NO: 16056 - RNA, 20 nt, Homo sapiens
ggcggcgggcugcgcggcgg

SEQ ID NO: 16057 - RNA, 20 nt, Homo sapiens
gggcggcgggcugcgcggcg

SEQ ID NO: 16058 - RNA, 19 nt, Homo sapiens
aggaacuggggggcacguu

SEQ ID NO: 16059 - RNA, 20 nt, Homo sapiens
aggcgggggggggguucagg

SEQ ID NO: 16060 - RNA, 19 nt, Homo sapiens
caggaccccggugcguuga

SEQ ID NO: 16061 - RNA, 21 nt, Homo sapiens
gaggggcagggcuuggggcgg

SEQ ID NO: 16062 - RNA, 18 nt, Homo sapiens
gcagcagcggcucaggcc

SEQ ID NO: 16063 - RNA, 17 nt, Homo sapiens
gcaggccuggccaccuc

SEQ ID NO: 16064 - RNA, 18 nt, Homo sapiens
gcggcggcggcagcagcg

SEQ ID NO: 16065 - RNA, 16 nt, Homo sapiens
gcgggggggggggggg

SEQ ID NO: 16066 - RNA, 19 nt, Homo sapiens
gcgggggggggguucagga

SEQ ID NO: 16067 - RNA, 21 nt, Homo sapiens
gcgggggggggguucaggagg

SEQ ID NO: 16068 - RNA, 19 nt, Homo sapiens
gcucaggccccugcagucc

SEQ ID NO: 16069 - RNA, 21 nt, Homo sapiens
gcuuggggcgggcaggggagc

SEQ ID NO: 16070 - RNA, 17 nt, Homo sapiens
ggaagaggggaaaggga

SEQ ID NO: 16071 - RNA, 14 nt, Homo sapiens
ggcggggggggggg

SEQ ID NO: 16072 - RNA, 19 nt, Homo sapiens
gggaagaggggaaagggag

SEQ ID NO: 16073 - RNA, 15 nt, Homo sapiens
gggcggggggggggg

SEQ ID NO: 16074 - RNA, 20 nt, Homo sapiens
ggggggggggggggucccag

SEQ ID NO: 16075 - RNA, 20 nt, Homo sapiens
gggggggggggggucccagg

SEQ ID NO: 16076 - RNA, 19 nt, Homo sapiens
ggggggggggggucccagg

SEQ ID NO: 16077 - RNA, 23 nt, Homo sapiens
uggcugguaggggccgggucagg

SEQ ID NO: 16078 - RNA, 18 nt, Homo sapiens
aggaaacaagcacguugu

SEQ ID NO: 16079 - RNA, 26 nt, Homo sapiens
agggggccggggcggggcgcugcggg

SEQ ID NO: 16080 - RNA, 19 nt, Homo sapiens
cgcggagggggccggggcg

SEQ ID NO: 16081 - RNA, 20 nt, Homo sapiens
gagaaccccaggggcaggca

SEQ ID NO: 16082 - RNA, 18 nt, Homo sapiens
gccggggcggggcgcugc

SEQ ID NO: 16083 - RNA, 23 nt, Homo sapiens
gggccggggcggggcgcugcggg

SEQ ID NO: 16084 - RNA, 20 nt, Homo sapiens
gugugcgugucaaauuuugg

SEQ ID NO: 16085 - RNA, 19 nt, Homo sapiens
ucaggaaggugggccuugc

SEQ ID NO: 16086 - RNA, 20 nt, Homo sapiens
acccggcaccuccugcuugg

SEQ ID NO: 16087 - RNA, 20 nt, Homo sapiens
aggaacacuagggaggagga

SEQ ID NO: 16088 - RNA, 20 nt, Homo sapiens
aggggaaacaccauuagggg

SEQ ID NO: 16089 - RNA, 18 nt, Homo sapiens
ccguagggguuguguguc

SEQ ID NO: 16090 - RNA, 18 nt, Homo sapiens
ccuccaccuccgcccagu

SEQ ID NO: 16091 - RNA, 21 nt, Homo sapiens
cggggaggaacacuagggagg

SEQ ID NO: 16092 - RNA, 20 nt, Homo sapiens
cuccauacuuguuugcugcu

SEQ ID NO: 16093 - RNA, 18 nt, Homo sapiens
uaccuaggaacacccucc

SEQ ID NO: 16094 - RNA, 18 nt, Homo sapiens
aagcugaggguggcggag

SEQ ID NO: 16095 - RNA, 24 nt, Homo sapiens
aauauugaguuuuauuuccauucu

SEQ ID NO: 16096 - RNA, 15 nt, Homo sapiens
agccggaaccgcaga

SEQ ID NO: 16097 - RNA, 16 nt, Homo sapiens
agcggaagggcgggca

SEQ ID NO: 16098 - RNA, 20 nt, Homo sapiens
agcggaagggcgggcaccga

SEQ ID NO: 16099 - RNA, 18 nt, Homo sapiens
cagccgccgccgccuccc

SEQ ID NO: 16100 - RNA, 16 nt, Homo sapiens
cagcugccgccgcccc

SEQ ID NO: 16101 - RNA, 19 nt, Homo sapiens
caucugaagauugaaaguu

SEQ ID NO: 16102 - RNA, 17 nt, Homo sapiens
ccgccgccucccggcag

SEQ ID NO: 16103 - RNA, 16 nt, Homo sapiens
cucaagaauaauuuug

SEQ ID NO: 16104 - RNA, 17 nt, Homo sapiens
gaagagaagcugagggu

SEQ ID NO: 16105 - RNA, 18 nt, Homo sapiens
gagcggaagggcgggcac

SEQ ID NO: 16106 - RNA, 22 nt, Homo sapiens
gggaaggagggcggugucggca

SEQ ID NO: 16107 - RNA, 17 nt, Homo sapiens
gggaagggaaggagggc

SEQ ID NO: 16108 - RNA, 15 nt, Homo sapiens
ucggcaggagccagg

SEQ ID NO: 16109 - RNA, 20 nt, Homo sapiens
ugggaagggaaggagggcgg

SEQ ID NO: 16110 - RNA, 18 nt, Homo sapiens
uguugagauuuccaucau

SEQ ID NO: 16111 - RNA, 19 nt, Homo sapiens
agccgggggaggggugggg

SEQ ID NO: 16112 - RNA, 22 nt, Homo sapiens
cccuuccucucucuuccuuuuu

SEQ ID NO: 16113 - RNA, 15 nt, Homo sapiens
ccucauucucuuuac

SEQ ID NO: 16114 - RNA, 18 nt, Homo sapiens
cugcucacucccucugcc

SEQ ID NO: 16115 - RNA, 21 nt, Homo sapiens
ggagccgggggaggggugggg

SEQ ID NO: 16116 - RNA, 16 nt, Homo sapiens
ggggagggguggggag

SEQ ID NO: 16117 - RNA, 19 nt, Homo sapiens
ggggagggguggggagcgc

SEQ ID NO: 16118 - RNA, 17 nt, Homo sapiens
gggggagccgggggagg

SEQ ID NO: 16119 - RNA, 23 nt, Homo sapiens
gggggagccgggggagggguggg

SEQ ID NO: 16120 - RNA, 18 nt, Homo sapiens
ucccuuccucucucuucc

SEQ ID NO: 16121 - RNA, 20 nt, Homo sapiens
agagauuccaguugaaccaa

SEQ ID NO: 16122 - RNA, 16 nt, Homo sapiens
cagugucccaaaacug

SEQ ID NO: 16123 - RNA, 14 nt, Homo sapiens
ccaccuugcacugc

SEQ ID NO: 16124 - RNA, 20 nt, Homo sapiens
ccuccugaauaguagaggug

SEQ ID NO: 16125 - RNA, 17 nt, Homo sapiens
cugaguuuugaaaaugc

SEQ ID NO: 16126 - RNA, 18 nt, Homo sapiens
guauaauguggcaaaggc

SEQ ID NO: 16127 - RNA, 21 nt, Homo sapiens
uaguacauaagcaucuuuugu

SEQ ID NO: 16128 - RNA, 23 nt, Homo sapiens
ucuagagcaagaaaaagcgggag

SEQ ID NO: 16129 - RNA, 20 nt, Homo sapiens
uguuguuuguuugagacagg

SEQ ID NO: 16130 - RNA, 23 nt, Homo sapiens
uuuguuguuacuguuguuguuug

SEQ ID NO: 16131 - RNA, 19 nt, Homo sapiens
uaggugggagcgcuggggu

SEQ ID NO: 16132 - RNA, 20 nt, Homo sapiens
aaggggaaaagacagggaga

SEQ ID NO: 16133 - RNA, 20 nt, Homo sapiens
agggaaggggaaaagacagg

SEQ ID NO: 16134 - RNA, 18 nt, Homo sapiens
cacuaaguuucuggaucu

SEQ ID NO: 16135 - RNA, 17 nt, Homo sapiens
ccgccgcgcagcucggc

SEQ ID NO: 16136 - RNA, 18 nt, Homo sapiens
cuccccucccaccccaag

SEQ ID NO: 16137 - RNA, 25 nt, Homo sapiens
cugcauuucuccauuggccccaaaa

SEQ ID NO: 16138 - RNA, 18 nt, Homo sapiens
gaaggcgguggggguggg

SEQ ID NO: 16139 - RNA, 17 nt, Homo sapiens
ggcgguggggguggggg

SEQ ID NO: 16140 - RNA, 18 nt, Homo sapiens
gggggugggggcuuguca

SEQ ID NO: 16141 - RNA, 17 nt, Homo sapiens
ucuguggccuggcgggg

SEQ ID NO: 16142 - RNA, 19 nt, Homo sapiens
uguugccaugaaacagaga

SEQ ID NO: 16143 - RNA, 22 nt, Homo sapiens
aggggagaagaaagaaauucca

SEQ ID NO: 16144 - RNA, 21 nt, Homo sapiens
agucggggagagugggaagca

SEQ ID NO: 16145 - RNA, 19 nt, Homo sapiens
cccgccgccuccgccgucc

SEQ ID NO: 16146 - RNA, 20 nt, Homo sapiens
ccgccguccgcacccggccc

SEQ ID NO: 16147 - RNA, 17 nt, Homo sapiens
ggucuucugaggcugug

SEQ ID NO: 16148 - RNA, 21 nt, Homo sapiens
ugacacacagaugacccacug

SEQ ID NO: 16149 - RNA, 19 nt, Homo sapiens
uuugggagggaagaagggg

SEQ ID NO: 16150 - RNA, 20 nt, Homo sapiens
aguauauuauauauuuuagc

SEQ ID NO: 16151 - RNA, 20 nt, Homo sapiens
uaaaguauaaugguucaacu

SEQ ID NO: 16152 - RNA, 18 nt, Homo sapiens
uccuucacccacguggaa

SEQ ID NO: 16153 - RNA, 22 nt, Homo sapiens
ucuaaauucuucacauaauaua

SEQ ID NO: 16154 - RNA, 18 nt, Homo sapiens
ucuuugcucuucucgcgu

SEQ ID NO: 16155 - RNA, 17 nt, Homo sapiens
ugcugcaaugaguuuca

SEQ ID NO: 16156 - RNA, 17 nt, Homo sapiens
uuuucacaucuguuaua

SEQ ID NO: 16157 - RNA, 16 nt, Homo sapiens
agagggaugcucaggg

SEQ ID NO: 16158 - RNA, 18 nt, Homo sapiens
aggggugauggaggccca

SEQ ID NO: 16159 - RNA, 19 nt, Homo sapiens
aggucuagugccugaggga

SEQ ID NO: 16160 - RNA, 19 nt, Homo sapiens
aucccaggucuggacggcu

SEQ ID NO: 16161 - RNA, 20 nt, Homo sapiens
cacagccggcucccugcccc

SEQ ID NO: 16162 - RNA, 24 nt, Homo sapiens
cacaggggcuuccaaaauggguau

SEQ ID NO: 16163 - RNA, 24 nt, Homo sapiens
cagaggggguggcgacacaacgug

SEQ ID NO: 16164 - RNA, 25 nt, Homo sapiens
ccagagggaugcucgacacaacgug

SEQ ID NO: 16165 - RNA, 16 nt, Homo sapiens
ccugcagagacagccc

SEQ ID NO: 16166 - RNA, 18 nt, Homo sapiens
ccugggccgggggcgucc

SEQ ID NO: 16167 - RNA, 20 nt, Homo sapiens
cucggcacucuggugcccgc

SEQ ID NO: 16168 - RNA, 24 nt, Homo sapiens
gggaggguggggaggcagggggca

SEQ ID NO: 16169 - RNA, 19 nt, Homo sapiens
gugcuucuguggccucauc

SEQ ID NO: 16170 - RNA, 19 nt, Homo sapiens
uccccuugugcuucugugg

SEQ ID NO: 16171 - RNA, 23 nt, Homo sapiens
acaacucuugauaugaaauuaga

SEQ ID NO: 16172 - RNA, 19 nt, Homo sapiens
guauuuucaaaauuguauu

SEQ ID NO: 16173 - RNA, 17 nt, Homo sapiens
guccuucauccuucugu

SEQ ID NO: 16174 - RNA, 18 nt, Homo sapiens
ccccgacuucuuucuccc

SEQ ID NO: 16175 - RNA, 22 nt, Homo sapiens
ccgccuuggccucccaaagucc

SEQ ID NO: 16176 - RNA, 21 nt, Homo sapiens
cgcgggcugcgcgccacggcc

SEQ ID NO: 16177 - RNA, 20 nt, Homo sapiens
gccuuggccucccaaagucc

SEQ ID NO: 16178 - RNA, 20 nt, Homo sapiens
uauuuauauauauauauaua

SEQ ID NO: 16179 - RNA, 21 nt, Homo sapiens
uauuuauauauauauauauau

SEQ ID NO: 16180 - RNA, 22 nt, Homo sapiens
ucgaacuccugacuccggugau

SEQ ID NO: 16181 - RNA, 19 nt, Homo sapiens
cggguggugggcggcccgg

SEQ ID NO: 16182 - RNA, 19 nt, Homo sapiens
gaacacaggucacuuuauu

SEQ ID NO: 16183 - RNA, 23 nt, Homo sapiens
aggagugcccuuggugugugucc

SEQ ID NO: 16184 - RNA, 24 nt, Homo sapiens
cauacacauauauauguguauaua

SEQ ID NO: 16185 - RNA, 22 nt, Homo sapiens
cauauauauauacauauauaua

SEQ ID NO: 16186 - RNA, 18 nt, Homo sapiens
cugucugcccuggggcuc

SEQ ID NO: 16187 - RNA, 25 nt, Homo sapiens
uaagaaaaagagcaaaguaugaaga

SEQ ID NO: 16188 - RNA, 19 nt, Homo sapiens
uauacauacacauauauau

SEQ ID NO: 16189 - RNA, 21 nt, Homo sapiens
uauauacauacacauauauau

SEQ ID NO: 16190 - RNA, 20 nt, Homo sapiens
uauauacauauauauacaua

SEQ ID NO: 16191 - RNA, 20 nt, Homo sapiens
uauauauacauacacauaua

SEQ ID NO: 16192 - RNA, 23 nt, Homo sapiens
uauauauacauacacauauauau

SEQ ID NO: 16193 - RNA, 18 nt, Homo sapiens
uauauauacauauauaua

SEQ ID NO: 16194 - RNA, 18 nt, Homo sapiens
uauauauauacauauaua

SEQ ID NO: 16195 - RNA, 19 nt, Homo sapiens
uauauauauacauauauau

SEQ ID NO: 16196 - RNA, 17 nt, Homo sapiens
ucagcaggccccuuugc

SEQ ID NO: 16197 - RNA, 22 nt, Homo sapiens
accccgcuccguuuggcuuccc

SEQ ID NO: 16198 - RNA, 27 nt, Homo sapiens
agaaagaauugcaauuuaccaagguuu

SEQ ID NO: 16199 - RNA, 22 nt, Homo sapiens
caccagcgccagcagcagcccc

SEQ ID NO: 16200 - RNA, 19 nt, Homo sapiens
caccgcgcgccaucguccc

SEQ ID NO: 16201 - RNA, 22 nt, Homo sapiens
ccguuuggcuucccaaggaucc

SEQ ID NO: 16202 - RNA, 23 nt, Homo sapiens
gcuccgagucgggccgcaccacg

SEQ ID NO: 16203 - RNA, 22 nt, Homo sapiens
ggcccgcagaacccgcggcgcc

SEQ ID NO: 16204 - RNA, 18 nt, Homo sapiens
ggcuaaccccaggcggcc

SEQ ID NO: 16205 - RNA, 18 nt, Homo sapiens
gggggggcaggucugcgg

SEQ ID NO: 16206 - RNA, 14 nt, Homo sapiens
guauccuagccacu

SEQ ID NO: 16207 - RNA, 21 nt, Homo sapiens
ucuaaucagugaucauugagg

SEQ ID NO: 16208 - RNA, 21 nt, Homo sapiens
ucuguacagguugugucugcc

SEQ ID NO: 16209 - RNA, 16 nt, Homo sapiens
uucaaggauauuuagg

SEQ ID NO: 16210 - RNA, 18 nt, Homo sapiens
aggcuggcgggggcccgg

SEQ ID NO: 16211 - RNA, 20 nt, Homo sapiens
aggcuggcgggggcccgggc

SEQ ID NO: 16212 - RNA, 16 nt, Homo sapiens
cauuguccugucaguu

SEQ ID NO: 16213 - RNA, 19 nt, Homo sapiens
gagggacgcgaggagggag

SEQ ID NO: 16214 - RNA, 25 nt, Homo sapiens
ggaggcuggcgggggcccgggcggc

SEQ ID NO: 16215 - RNA, 23 nt, Homo sapiens
uaauauuuuguugcucaauacgu

SEQ ID NO: 16216 - RNA, 18 nt, Homo sapiens
uacauaugcaaaaauaua

SEQ ID NO: 16217 - RNA, 23 nt, Homo sapiens
ugucauauggcacaauauuaaua

SEQ ID NO: 16218 - RNA, 20 nt, Homo sapiens
agggaggggugggaccgggc

SEQ ID NO: 16219 - RNA, 18 nt, Homo sapiens
augugugugugugugugu

SEQ ID NO: 16220 - RNA, 19 nt, Homo sapiens
ggaggaggggcccaggagc

SEQ ID NO: 16221 - RNA, 16 nt, Homo sapiens
gggcagcggcugggga

SEQ ID NO: 16222 - RNA, 20 nt, Homo sapiens
gugguccccuggccgcaggc

SEQ ID NO: 16223 - RNA, 18 nt, Homo sapiens
gugugugugcaugugugu

SEQ ID NO: 16224 - RNA, 21 nt, Homo sapiens
ugugcgcgcgcgugcccccgg

SEQ ID NO: 16225 - RNA, 23 nt, Homo sapiens
ugugcgcgcgcgugugcccccgg

SEQ ID NO: 16226 - RNA, 25 nt, Homo sapiens
ugugcgcgcgcgugugugcccccgg

SEQ ID NO: 16227 - RNA, 17 nt, Homo sapiens
ugugugcaugugugugu

SEQ ID NO: 16228 - RNA, 21 nt, Homo sapiens
ugugugugcaugugugugugu

SEQ ID NO: 16229 - RNA, 22 nt, Homo sapiens
aaccgggggccccacggucucc

SEQ ID NO: 16230 - RNA, 16 nt, Homo sapiens
cagaggcugagggaga

SEQ ID NO: 16231 - RNA, 22 nt, Homo sapiens
ccacggucuccggccgcgcccg

SEQ ID NO: 16232 - RNA, 24 nt, Homo sapiens
uccggccgcgcccgcgcuggccgc

SEQ ID NO: 16233 - RNA, 18 nt, Homo sapiens
agucagagauugaaacaa

SEQ ID NO: 16234 - RNA, 19 nt, Homo sapiens
aguuaccaacaaauguaua

SEQ ID NO: 16235 - RNA, 20 nt, Homo sapiens
aucuccaaauuuagcuguuu

SEQ ID NO: 16236 - RNA, 21 nt, Homo sapiens
gagcuuuugucacuuuauugu

SEQ ID NO: 16237 - RNA, 20 nt, Homo sapiens
uauccaauaagguaauuaaa

SEQ ID NO: 16238 - RNA, 16 nt, Homo sapiens
uggaaagggcaaggga

SEQ ID NO: 16239 - RNA, 18 nt, Homo sapiens
uuugucagacgugauaau

SEQ ID NO: 16240 - RNA, 20 nt, Homo sapiens
gcuggcucagggaagccaaa

SEQ ID NO: 16241 - RNA, 18 nt, Homo sapiens
acccuugccccgcccucc

SEQ ID NO: 16242 - RNA, 17 nt, Homo sapiens
cacuuguuccugccgcg

SEQ ID NO: 16243 - RNA, 21 nt, Homo sapiens
ccucccccuccucuucagggu

SEQ ID NO: 16244 - RNA, 22 nt, Homo sapiens
ucagcugacacagccgcgcccg

SEQ ID NO: 16245 - RNA, 17 nt, Homo sapiens
agaaaaagaaauaaaag

SEQ ID NO: 16246 - RNA, 17 nt, Homo sapiens
aggggaagcuggaggcc

SEQ ID NO: 16247 - RNA, 17 nt, Homo sapiens
agggucuuccucccucc

SEQ ID NO: 16248 - RNA, 18 nt, Homo sapiens
caccacacccucaguccc

SEQ ID NO: 16249 - RNA, 19 nt, Homo sapiens
cccucaggccgccgcgggg

SEQ ID NO: 16250 - RNA, 18 nt, Homo sapiens
cggaccgagagguaacag

SEQ ID NO: 16251 - RNA, 16 nt, Homo sapiens
gagcccgccgccgcgc

SEQ ID NO: 16252 - RNA, 18 nt, Homo sapiens
gagguguucggaucaggg

SEQ ID NO: 16253 - RNA, 22 nt, Homo sapiens
gcccucggagaacacaggcagc

SEQ ID NO: 16254 - RNA, 17 nt, Homo sapiens
gccgccgagccccuccg

SEQ ID NO: 16255 - RNA, 19 nt, Homo sapiens
gcgcgaccucggcgcgucc

SEQ ID NO: 16256 - RNA, 16 nt, Homo sapiens
ggccagcagggggcgc

SEQ ID NO: 16257 - RNA, 16 nt, Homo sapiens
uaccccccagaagcag

SEQ ID NO: 16258 - RNA, 14 nt, Homo sapiens
uccggccgcggcac

SEQ ID NO: 16259 - RNA, 24 nt, Homo sapiens
uccguuuauuuuuauuuuuuauua

SEQ ID NO: 16260 - RNA, 21 nt, Homo sapiens
ucucgccuccuggccacaggg

SEQ ID NO: 16261 - RNA, 22 nt, Homo sapiens
ugggaauaaauaagagucccug

SEQ ID NO: 16262 - RNA, 19 nt, Homo sapiens
uggguuugucaaggcugcu

SEQ ID NO: 16263 - RNA, 21 nt, Homo sapiens
cagcagcggcggcggcucccu

SEQ ID NO: 16264 - RNA, 20 nt, Homo sapiens
cgggcggggcgguguaggcg

SEQ ID NO: 16265 - RNA, 21 nt, Homo sapiens
ggcagcagcagcggcggcggc

SEQ ID NO: 16266 - RNA, 24 nt, Homo sapiens
gggcggggcgguguaggcgcugcu

SEQ ID NO: 16267 - RNA, 20 nt, Homo sapiens
gguacuacuguuugcacagu

SEQ ID NO: 16268 - RNA, 15 nt, Homo sapiens
gucccaggcugcagc

SEQ ID NO: 16269 - RNA, 25 nt, Homo sapiens
ugagagaaaucuuccucagauauau

SEQ ID NO: 16270 - RNA, 20 nt, Homo sapiens
ugccaugaugaugaugucac

SEQ ID NO: 16271 - RNA, 16 nt, Homo sapiens
uucgccgccgccgcca

SEQ ID NO: 16272 - RNA, 17 nt, Homo sapiens
cacaacagguuaguaag

SEQ ID NO: 16273 - RNA, 18 nt, Homo sapiens
gcuggcuggcgggugggc

SEQ ID NO: 16274 - RNA, 20 nt, Homo sapiens
ggaaaaaacaaggcuuucuc

SEQ ID NO: 16275 - RNA, 19 nt, Homo sapiens
gggaaaaaacaaggcuuuc

SEQ ID NO: 16276 - RNA, 16 nt, Homo sapiens
guugagacuccagaag

SEQ ID NO: 16277 - RNA, 18 nt, Homo sapiens
ccgagaaauggaaacuca

SEQ ID NO: 16278 - RNA, 22 nt, Homo sapiens
ccuccaccuccuccuccugggu

SEQ ID NO: 16279 - RNA, 18 nt, Homo sapiens
ccuggccagccacuggag

SEQ ID NO: 16280 - RNA, 19 nt, Homo sapiens
cgccugccacagccucccg

SEQ ID NO: 16281 - RNA, 18 nt, Homo sapiens
cgcgccuccucuucccuc

SEQ ID NO: 16282 - RNA, 23 nt, Homo sapiens
ucacugcaaccuccaccuccucc

SEQ ID NO: 16283 - RNA, 19 nt, Homo sapiens
acucuaaagucucuaaguu

SEQ ID NO: 16284 - RNA, 19 nt, Homo sapiens
accgccgccggcucguucc

SEQ ID NO: 16285 - RNA, 19 nt, Homo sapiens
cagucgccucaguucccgc

SEQ ID NO: 16286 - RNA, 20 nt, Homo sapiens
ccgccggcucguuccucagg

SEQ ID NO: 16287 - RNA, 22 nt, Homo sapiens
uaagauugugauucuggaugaa

SEQ ID NO: 16288 - RNA, 20 nt, Homo sapiens
agaaggggaagcaguggggu

SEQ ID NO: 16289 - RNA, 18 nt, Homo sapiens
aggagaagcguggucucc

SEQ ID NO: 16290 - RNA, 20 nt, Homo sapiens
ccaccugcgccggcccgggg

SEQ ID NO: 16291 - RNA, 17 nt, Homo sapiens
gcggguggggcggggag

SEQ ID NO: 16292 - RNA, 18 nt, Homo sapiens
ggcggguggggcgggggg

SEQ ID NO: 16293 - RNA, 22 nt, Homo sapiens
gggcuggggagaagacgcuggg

SEQ ID NO: 16294 - RNA, 18 nt, Homo sapiens
ggggcggguggggcgggg

SEQ ID NO: 16295 - RNA, 20 nt, Homo sapiens
ggggcggguggggcgggggg

SEQ ID NO: 16296 - RNA, 22 nt, Homo sapiens
ggguggggcggggggacccugg

SEQ ID NO: 16297 - RNA, 21 nt, Homo sapiens
gucagaguuugcagcugcggc

SEQ ID NO: 16298 - RNA, 15 nt, Homo sapiens
gugggguugcugggg

SEQ ID NO: 16299 - RNA, 20 nt, Homo sapiens
ucagaguuugcagcugcggc

SEQ ID NO: 16300 - RNA, 15 nt, Homo sapiens
ugggaggggggcggc

SEQ ID NO: 16301 - RNA, 16 nt, Homo sapiens
uggugggaggacgggg

SEQ ID NO: 16302 - RNA, 20 nt, Homo sapiens
uugagcuugggggcaaggga

SEQ ID NO: 16303 - RNA, 19 nt, Homo sapiens
caaaaaauuacagauauug

SEQ ID NO: 16304 - RNA, 18 nt, Homo sapiens
uaagugggagcuaaauaa

SEQ ID NO: 16305 - RNA, 24 nt, Homo sapiens
uacauauauauaacguuuauauau

SEQ ID NO: 16306 - RNA, 20 nt, Homo sapiens
uuaaaaauagagcuaccauu

SEQ ID NO: 16307 - RNA, 20 nt, Homo sapiens
ccuccuucugcggucucucu

SEQ ID NO: 16308 - RNA, 22 nt, Homo sapiens
uaaaugaauuauuuauuuauuu

SEQ ID NO: 16309 - RNA, 18 nt, Homo sapiens
uacaaacuauauaauaau

SEQ ID NO: 16310 - RNA, 21 nt, Homo sapiens
ugacuuugauucuuacagucu

SEQ ID NO: 16311 - RNA, 17 nt, Homo sapiens
ugaggggcuuucuaaua

SEQ ID NO: 16312 - RNA, 21 nt, Homo sapiens
aacaguacugaugaucugugg

SEQ ID NO: 16313 - RNA, 17 nt, Homo sapiens
accagcuucuccuaguc

SEQ ID NO: 16314 - RNA, 21 nt, Homo sapiens
aguuuucaacaccauagcacu

SEQ ID NO: 16315 - RNA, 16 nt, Homo sapiens
gcuuuuggaccaacag

SEQ ID NO: 16316 - RNA, 17 nt, Homo sapiens
agccuccuuucagggcu

SEQ ID NO: 16317 - RNA, 20 nt, Homo sapiens
aggaguguuacgagguacaa

SEQ ID NO: 16318 - RNA, 16 nt, Homo sapiens
aggauccuuuucugcc

SEQ ID NO: 16319 - RNA, 22 nt, Homo sapiens
ccaagagacagcacagaacuca

SEQ ID NO: 16320 - RNA, 18 nt, Homo sapiens
ccccaccaacccucauca

SEQ ID NO: 16321 - RNA, 20 nt, Homo sapiens
cuuugcagaaccugccuccc

SEQ ID NO: 16322 - RNA, 20 nt, Homo sapiens
gccaccugcagggggccacc

SEQ ID NO: 16323 - RNA, 17 nt, Homo sapiens
ggagggccaaaggggaa

SEQ ID NO: 16324 - RNA, 22 nt, Homo sapiens
ggcaucucuuuuugccuguucu

SEQ ID NO: 16325 - RNA, 18 nt, Homo sapiens
uagaacacuuccuucucc

SEQ ID NO: 16326 - RNA, 23 nt, Homo sapiens
ucaagugagccuccuuucagggc

SEQ ID NO: 16327 - RNA, 18 nt, Homo sapiens
uccacacuuuguucuccu

SEQ ID NO: 16328 - RNA, 23 nt, Homo sapiens
ucgaagcagccucuccccccagc

SEQ ID NO: 16329 - RNA, 19 nt, Homo sapiens
uggaaagggcucacaggcc

SEQ ID NO: 16330 - RNA, 23 nt, Homo sapiens
ugucacaauaaauaaauauuuaa

SEQ ID NO: 16331 - RNA, 20 nt, Homo sapiens
uuuuuuuuucauauuugacu

SEQ ID NO: 16332 - RNA, 16 nt, Homo sapiens
aggugguguggguuag

SEQ ID NO: 16333 - RNA, 20 nt, Homo sapiens
cuggcugggcuggggguacu

SEQ ID NO: 16334 - RNA, 18 nt, Homo sapiens
gaggguucuucaccuucu

SEQ ID NO: 16335 - RNA, 20 nt, Homo sapiens
ggggguacugggggacaaag

SEQ ID NO: 16336 - RNA, 20 nt, Homo sapiens
uccaacaccucguauagaug

SEQ ID NO: 16337 - RNA, 19 nt, Homo sapiens
ugggcuggggguacugggg

SEQ ID NO: 16338 - RNA, 17 nt, Homo sapiens
uggguuagagggaaagg

SEQ ID NO: 16339 - RNA, 18 nt, Homo sapiens
agggcuguggagcuucca

SEQ ID NO: 16340 - RNA, 14 nt, Homo sapiens
aggucuuccucccc

SEQ ID NO: 16341 - RNA, 21 nt, Homo sapiens
gacuuuguuuuuccucugcug

SEQ ID NO: 16342 - RNA, 17 nt, Homo sapiens
uaaccaguggacacgcu

SEQ ID NO: 16343 - RNA, 18 nt, Homo sapiens
ugaaucagauuuacaguu

SEQ ID NO: 16344 - RNA, 19 nt, Homo sapiens
uugcuggaguggccacaga

SEQ ID NO: 16345 - RNA, 20 nt, Homo sapiens
guagugacaucauuauaagu

SEQ ID NO: 16346 - RNA, 22 nt, Homo sapiens
uauuacaaggaaaacauaaaaa

SEQ ID NO: 16347 - RNA, 21 nt, Homo sapiens
ucucaauucuuccauuaacuu

SEQ ID NO: 16348 - RNA, 20 nt, Homo sapiens
uuuaaggaguaaguguaagg

SEQ ID NO: 16349 - RNA, 18 nt, Homo sapiens
acugcagaucaaugauaa

SEQ ID NO: 16350 - RNA, 21 nt, Homo sapiens
aggaaacaggggagugcccug

SEQ ID NO: 16351 - RNA, 18 nt, Homo sapiens
ccccugagagaaccugag

SEQ ID NO: 16352 - RNA, 19 nt, Homo sapiens
cguuagccacccccaggcc

SEQ ID NO: 16353 - RNA, 19 nt, Homo sapiens
gagggcccuggguccagcg

SEQ ID NO: 16354 - RNA, 18 nt, Homo sapiens
gccguuuguuuggcguga

SEQ ID NO: 16355 - RNA, 17 nt, Homo sapiens
gcugaaaaguagguaac

SEQ ID NO: 16356 - RNA, 22 nt, Homo sapiens
ggacaaaagguggugugcccgg

SEQ ID NO: 16357 - RNA, 19 nt, Homo sapiens
ucacauagaggagggacac

SEQ ID NO: 16358 - RNA, 24 nt, Homo sapiens
uccucgagcugggugaaccggguc

SEQ ID NO: 16359 - RNA, 17 nt, Homo sapiens
ucugggcaucgugacac

SEQ ID NO: 16360 - RNA, 18 nt, Homo sapiens
gcgggccaggcaggcugc

SEQ ID NO: 16361 - RNA, 21 nt, Homo sapiens
ggggagggguggguggggugg

SEQ ID NO: 16362 - RNA, 20 nt, Homo sapiens
ucgcccucggccccucgccc

SEQ ID NO: 16363 - RNA, 19 nt, Homo sapiens
ugacaggaggcaucuugag

SEQ ID NO: 16364 - RNA, 22 nt, Homo sapiens
aguuauagaccaccaugacauu

SEQ ID NO: 16365 - RNA, 20 nt, Homo sapiens
ugaaugagaguguuuaucuc

SEQ ID NO: 16366 - RNA, 18 nt, Homo sapiens
agcggggauggggggggg

SEQ ID NO: 16367 - RNA, 16 nt, Homo sapiens
aggcagagggagugac

SEQ ID NO: 16368 - RNA, 15 nt, Homo sapiens
ggauggggggggggg

SEQ ID NO: 16369 - RNA, 17 nt, Homo sapiens
gggauggggggggggug

SEQ ID NO: 16370 - RNA, 16 nt, Homo sapiens
ggggaugggggggggg

SEQ ID NO: 16371 - RNA, 19 nt, Homo sapiens
ggggauggggggggggugg

SEQ ID NO: 16372 - RNA, 22 nt, Homo sapiens
ucuagaaagagagagccuucga

SEQ ID NO: 16373 - RNA, 18 nt, Homo sapiens
ucugcaguuagggucagu

SEQ ID NO: 16374 - RNA, 21 nt, Homo sapiens
uuuugauuaauaucagaccca

SEQ ID NO: 16375 - RNA, 14 nt, Homo sapiens
aacuagguccagcu

SEQ ID NO: 16376 - RNA, 19 nt, Homo sapiens
aucccacccuggauugcau

SEQ ID NO: 16377 - RNA, 17 nt, Homo sapiens
ccugguagcauccuucc

SEQ ID NO: 16378 - RNA, 16 nt, Homo sapiens
uggcaccacaaacgcc

SEQ ID NO: 16379 - RNA, 23 nt, Homo sapiens
acugaaacugugcgccccgcggg

SEQ ID NO: 16380 - RNA, 18 nt, Homo sapiens
gcuguucacugcugucuc

SEQ ID NO: 16381 - RNA, 20 nt, Homo sapiens
ggaaugauacgugguguggc

SEQ ID NO: 16382 - RNA, 19 nt, Homo sapiens
gguugugauacccgccccc

SEQ ID NO: 16383 - RNA, 26 nt, Homo sapiens
uaaguaagaagaaugugguaaauuag

SEQ ID NO: 16384 - RNA, 19 nt, Homo sapiens
ucuugccaguucugcgugg

SEQ ID NO: 16385 - RNA, 20 nt, Homo sapiens
ugcugugggugcugcguacc

SEQ ID NO: 16386 - RNA, 19 nt, Homo sapiens
ugucuauggggcagauuuc

SEQ ID NO: 16387 - RNA, 18 nt, Homo sapiens
uucccucuugccaguucu

SEQ ID NO: 16388 - RNA, 14 nt, Homo sapiens
uuggauaggggcgg

SEQ ID NO: 16389 - RNA, 15 nt, Homo sapiens
accacacaguauguu

SEQ ID NO: 16390 - RNA, 20 nt, Homo sapiens
accacuaaucacugaaugcc

SEQ ID NO: 16391 - RNA, 22 nt, Homo sapiens
cuagucuccuggaagacauggu

SEQ ID NO: 16392 - RNA, 19 nt, Homo sapiens
uagcuuaccaaucuuaagg

SEQ ID NO: 16393 - RNA, 19 nt, Homo sapiens
gauuacaggcaugugccac

SEQ ID NO: 16394 - RNA, 22 nt, Homo sapiens
ucagaauuuccaucuuucuucu

SEQ ID NO: 16395 - RNA, 18 nt, Homo sapiens
ucuugacuccuuuucuug

SEQ ID NO: 16396 - RNA, 19 nt, Homo sapiens
cgagucuccuggggacgug

SEQ ID NO: 16397 - RNA, 21 nt, Homo sapiens
cggcggcggcggcgcucggac

SEQ ID NO: 16398 - RNA, 19 nt, Homo sapiens
gcggcggcggcggcggcgc

SEQ ID NO: 16399 - RNA, 15 nt, Homo sapiens
gcuuuugucugugcu

SEQ ID NO: 16400 - RNA, 19 nt, Homo sapiens
ggggggggugagggggagg

SEQ ID NO: 16401 - RNA, 19 nt, Homo sapiens
ucacacggaguagaaaaug

SEQ ID NO: 16402 - RNA, 19 nt, Homo sapiens
ugaccgcaguugccauccc

SEQ ID NO: 16403 - RNA, 19 nt, Homo sapiens
uacauuuauaaccaaaaau

SEQ ID NO: 16404 - RNA, 21 nt, Homo sapiens
uauauacauacaauauauaga

SEQ ID NO: 16405 - RNA, 19 nt, Homo sapiens
ucgaacacacaguugauaa

SEQ ID NO: 16406 - RNA, 21 nt, Homo sapiens
ucuuuuuugugauaagaaaau

SEQ ID NO: 16407 - RNA, 17 nt, Homo sapiens
acgguggaucgggcagg

SEQ ID NO: 16408 - RNA, 17 nt, Homo sapiens
agcaggcguucagugag

SEQ ID NO: 16409 - RNA, 21 nt, Homo sapiens
agcgggcggcgggcgcggcgg

SEQ ID NO: 16410 - RNA, 16 nt, Homo sapiens
aggcagcgggcggcgg

SEQ ID NO: 16411 - RNA, 19 nt, Homo sapiens
aggcagcgggcggcgggcg

SEQ ID NO: 16412 - RNA, 18 nt, Homo sapiens
aggcuggggaggggccgg

SEQ ID NO: 16413 - RNA, 18 nt, Homo sapiens
agggguggagggcggcgg

SEQ ID NO: 16414 - RNA, 17 nt, Homo sapiens
caccagcuugcgccccc

SEQ ID NO: 16415 - RNA, 18 nt, Homo sapiens
cagcuccagggcuggggc

SEQ ID NO: 16416 - RNA, 22 nt, Homo sapiens
ccagccgggccaaggcggggac

SEQ ID NO: 16417 - RNA, 23 nt, Homo sapiens
ccagggcuggggcccgaagaccc

SEQ ID NO: 16418 - RNA, 22 nt, Homo sapiens
cccucucauccccgaggcggcu

SEQ ID NO: 16419 - RNA, 17 nt, Homo sapiens
ccgcaucauuccuagac

SEQ ID NO: 16420 - RNA, 17 nt, Homo sapiens
ccgccaggggcagcugg

SEQ ID NO: 16421 - RNA, 21 nt, Homo sapiens
ccugagccccucucucuccag

SEQ ID NO: 16422 - RNA, 18 nt, Homo sapiens
cgcuggugugcggcucuc

SEQ ID NO: 16423 - RNA, 18 nt, Homo sapiens
cugcagcuccagggcugg

SEQ ID NO: 16424 - RNA, 15 nt, Homo sapiens
cuuuggaaaaagggg

SEQ ID NO: 16425 - RNA, 21 nt, Homo sapiens
cuuuugcacucccaccgcugg

SEQ ID NO: 16426 - RNA, 21 nt, Homo sapiens
gccggcggcugacacaggccc

SEQ ID NO: 16427 - RNA, 20 nt, Homo sapiens
gccugggaggggcccagcug

SEQ ID NO: 16428 - RNA, 22 nt, Homo sapiens
gcuggggcccgaagacccugua

SEQ ID NO: 16429 - RNA, 20 nt, Homo sapiens
ggaggccccaagccccgccc

SEQ ID NO: 16430 - RNA, 19 nt, Homo sapiens
ggagggcggcggggaggag

SEQ ID NO: 16431 - RNA, 20 nt, Homo sapiens
ggaggggccggggcacucug

SEQ ID NO: 16432 - RNA, 18 nt, Homo sapiens
ggcggcgggcgcggcggc

SEQ ID NO: 16433 - RNA, 18 nt, Homo sapiens
ggcuguccuucccagagg

SEQ ID NO: 16434 - RNA, 22 nt, Homo sapiens
uacagcacauacauguuuacac

SEQ ID NO: 16435 - RNA, 20 nt, Homo sapiens
uccaucaaacccuggcaccu

SEQ ID NO: 16436 - RNA, 22 nt, Homo sapiens
uccgggcacggaugggugggcg

SEQ ID NO: 16437 - RNA, 19 nt, Homo sapiens
ugggaggggcccagcuggc

SEQ ID NO: 16438 - RNA, 17 nt, Homo sapiens
uucuccucucacacuuc

SEQ ID NO: 16439 - RNA, 20 nt, Homo sapiens
auuucuuuaguguagguccu

SEQ ID NO: 16440 - RNA, 21 nt, Homo sapiens
gccgcccggcgcgcccgccca

SEQ ID NO: 16441 - RNA, 18 nt, Homo sapiens
gggagggccccagcuggc

SEQ ID NO: 16442 - RNA, 19 nt, Homo sapiens
agggagaggagggcagggg

SEQ ID NO: 16443 - RNA, 24 nt, Homo sapiens
cuucugccuuuauuucccugaucu

SEQ ID NO: 16444 - RNA, 16 nt, Homo sapiens
gggagggagaggaggg

SEQ ID NO: 16445 - RNA, 20 nt, Homo sapiens
ucugaaaucugauggaacaa

SEQ ID NO: 16446 - RNA, 20 nt, Homo sapiens
uggaaacuuuauuuccuccc

SEQ ID NO: 16447 - RNA, 18 nt, Homo sapiens
ugggagggagaggagggc

SEQ ID NO: 16448 - RNA, 23 nt, Homo sapiens
uugagguauugaugacuuuauua

SEQ ID NO: 16449 - RNA, 20 nt, Homo sapiens
aacaggccccggggcccugg

SEQ ID NO: 16450 - RNA, 16 nt, Homo sapiens
cacgagacaggacaca

SEQ ID NO: 16451 - RNA, 21 nt, Homo sapiens
ucacauuguauugagcuacaa

SEQ ID NO: 16452 - RNA, 23 nt, Homo sapiens
aaggggcggggcggggugggggg

SEQ ID NO: 16453 - RNA, 22 nt, Homo sapiens
aggggcggggcggggugggggg

SEQ ID NO: 16454 - RNA, 19 nt, Homo sapiens
caaauagcaguucaaaaug

SEQ ID NO: 16455 - RNA, 18 nt, Homo sapiens
gcggggcggggugggggg

SEQ ID NO: 16456 - RNA, 18 nt, Homo sapiens
gcgggguggggggcaagg

SEQ ID NO: 16457 - RNA, 19 nt, Homo sapiens
gcgggguggggggcaagga

SEQ ID NO: 16458 - RNA, 22 nt, Homo sapiens
ggaaggggcggggcgggguggg

SEQ ID NO: 16459 - RNA, 22 nt, Homo sapiens
ggggcggggcgggguggggggc

SEQ ID NO: 16460 - RNA, 21 nt, Homo sapiens
ggggcgggguggggggcaagg

SEQ ID NO: 16461 - RNA, 23 nt, Homo sapiens
ggggcgggguggggggcaaggag

SEQ ID NO: 16462 - RNA, 23 nt, Homo sapiens
uaagcuuucuuagaacucuaaag

SEQ ID NO: 16463 - RNA, 24 nt, Homo sapiens
ccgccggccgcuggggcgcucccg

SEQ ID NO: 16464 - RNA, 18 nt, Homo sapiens
cgcgcgccucgggccggc

SEQ ID NO: 16465 - RNA, 17 nt, Homo sapiens
cggcgcgcacgugacgc

SEQ ID NO: 16466 - RNA, 17 nt, Homo sapiens
cggcgcgcgccucgggc

SEQ ID NO: 16467 - RNA, 18 nt, Homo sapiens
cggcgcgcgccucgggcc

SEQ ID NO: 16468 - RNA, 22 nt, Homo sapiens
cgggccggcuccgcgccgcucg

SEQ ID NO: 16469 - RNA, 19 nt, Homo sapiens
gcccgcccgcccgccggcc

SEQ ID NO: 16470 - RNA, 16 nt, Homo sapiens
gcucccggcccuuccc

SEQ ID NO: 16471 - RNA, 18 nt, Homo sapiens
gcucccggcccuucccuc

SEQ ID NO: 16472 - RNA, 19 nt, Homo sapiens
gcucgcccgcccgcccgcc

SEQ ID NO: 16473 - RNA, 19 nt, Homo sapiens
ugcgcacggccccuccccc

SEQ ID NO: 16474 - RNA, 19 nt, Homo sapiens
ugucccaggugccgacccc

SEQ ID NO: 16475 - RNA, 20 nt, Homo sapiens
aauuauggaauagcccccaa

SEQ ID NO: 16476 - RNA, 20 nt, Homo sapiens
gcggaggugcggauagggac

SEQ ID NO: 16477 - RNA, 23 nt, Homo sapiens
gggagggacacgugaggagcggg

SEQ ID NO: 16478 - RNA, 18 nt, Homo sapiens
ucuuguuacuucuuuugc

SEQ ID NO: 16479 - RNA, 23 nt, Homo sapiens
ugaggagcgggcggcgcgcuggg

SEQ ID NO: 16480 - RNA, 19 nt, Homo sapiens
uggccccggggccgggagg

SEQ ID NO: 16481 - RNA, 18 nt, Homo sapiens
ccuggccauguuggcauu

SEQ ID NO: 16482 - RNA, 22 nt, Homo sapiens
gauuauuaucucuacuuuucuu

SEQ ID NO: 16483 - RNA, 15 nt, Homo sapiens
uggcauucacauggu

SEQ ID NO: 16484 - RNA, 19 nt, Homo sapiens
caaaagcuuuuuuguuuac

SEQ ID NO: 16485 - RNA, 22 nt, Homo sapiens
cacccagagcauaggaaaaaca

SEQ ID NO: 16486 - RNA, 22 nt, Homo sapiens
ugggaagaaaauacuguuucug

SEQ ID NO: 16487 - RNA, 19 nt, Homo sapiens
agggucccgggcuccggcc

SEQ ID NO: 16488 - RNA, 16 nt, Homo sapiens
ccugccccacagugcc

SEQ ID NO: 16489 - RNA, 16 nt, Homo sapiens
uucccugucccuuucu

SEQ ID NO: 16490 - RNA, 20 nt, Homo sapiens
uaugaugcauggucuuuuuu

SEQ ID NO: 16491 - RNA, 17 nt, Homo sapiens
uuuaugagaagagugag

SEQ ID NO: 16492 - RNA, 22 nt, Homo sapiens
ggcuggagacggacagggugcc

SEQ ID NO: 16493 - RNA, 22 nt, Homo sapiens
uagcuuucaccucugauagaca

SEQ ID NO: 16494 - RNA, 18 nt, Homo sapiens
uuuuacuugaauaaaguu

SEQ ID NO: 16495 - RNA, 19 nt, Homo sapiens
aaaaaaaaaaaaaaaaaag

SEQ ID NO: 16496 - RNA, 17 nt, Homo sapiens
aauggugcgaugccagg

SEQ ID NO: 16497 - RNA, 17 nt, Homo sapiens
aggccccugccgcccuc

SEQ ID NO: 16498 - RNA, 19 nt, Homo sapiens
aguggcagggcggaggggg

SEQ ID NO: 16499 - RNA, 25 nt, Homo sapiens
augugcaaaaacaagucgauaucua

SEQ ID NO: 16500 - RNA, 19 nt, Homo sapiens
cacucagcggccacccccc

SEQ ID NO: 16501 - RNA, 28 nt, Homo sapiens
ccacaugaggccauuuagcuaaaaagua

SEQ ID NO: 16502 - RNA, 18 nt, Homo sapiens
ccaccagacagauagucc

SEQ ID NO: 16503 - RNA, 17 nt, Homo sapiens
cgggccggcuucgcggg

SEQ ID NO: 16504 - RNA, 15 nt, Homo sapiens
gcccaggguggggcc

SEQ ID NO: 16505 - RNA, 17 nt, Homo sapiens
gcccggaccggcggcgg

SEQ ID NO: 16506 - RNA, 21 nt, Homo sapiens
gcggcggccccacggcagccu

SEQ ID NO: 16507 - RNA, 20 nt, Homo sapiens
ggcggagggggcgcauggcu

SEQ ID NO: 16508 - RNA, 22 nt, Homo sapiens
gggcaggagcgaccagaggggc

SEQ ID NO: 16509 - RNA, 24 nt, Homo sapiens
ggggcuggaaugcuggggaggugg

SEQ ID NO: 16510 - RNA, 19 nt, Homo sapiens
gggucgcggcugcgggccg

SEQ ID NO: 16511 - RNA, 20 nt, Homo sapiens
gguuccgcugcucgaugcuc

SEQ ID NO: 16512 - RNA, 21 nt, Homo sapiens
ucucacacgggcuucuccaac

SEQ ID NO: 16513 - RNA, 16 nt, Homo sapiens
uggcuuccagauuugg

SEQ ID NO: 16514 - RNA, 24 nt, Homo sapiens
ugugcaaaaacaagucgauaucua

SEQ ID NO: 16515 - RNA, 19 nt, Homo sapiens
aaggugcaggugguucuag

SEQ ID NO: 16516 - RNA, 21 nt, Homo sapiens
agaaaggguagaaccauccac

SEQ ID NO: 16517 - RNA, 18 nt, Homo sapiens
aggggaagggcacugggg

SEQ ID NO: 16518 - RNA, 21 nt, Homo sapiens
caaagguaaucagagcuggag

SEQ ID NO: 16519 - RNA, 17 nt, Homo sapiens
caggccccagcuggggc

SEQ ID NO: 16520 - RNA, 17 nt, Homo sapiens
ccagcacagcugaggcu

SEQ ID NO: 16521 - RNA, 24 nt, Homo sapiens
ccccagcuggggccucaucagccc

SEQ ID NO: 16522 - RNA, 17 nt, Homo sapiens
cccuggcuucccucccc

SEQ ID NO: 16523 - RNA, 16 nt, Homo sapiens
cccuggguugcagugg

SEQ ID NO: 16524 - RNA, 15 nt, Homo sapiens
ggccccagcuggggc

SEQ ID NO: 16525 - RNA, 20 nt, Homo sapiens
gggaagggaggcccuaucua

SEQ ID NO: 16526 - RNA, 21 nt, Homo sapiens
ggguugcaguggugacgggag

SEQ ID NO: 16527 - RNA, 20 nt, Homo sapiens
uaaaaaaaaaaaaaaaaaaa

SEQ ID NO: 16528 - RNA, 22 nt, Homo sapiens
uauuggauagcacagcccuaga

SEQ ID NO: 16529 - RNA, 23 nt, Homo sapiens
ucaaaaaaaaucaguaacagaca

SEQ ID NO: 16530 - RNA, 21 nt, Homo sapiens
ucaucagcccucccccauucc

SEQ ID NO: 16531 - RNA, 18 nt, Homo sapiens
ucuagaaccaaggaagaa

SEQ ID NO: 16532 - RNA, 18 nt, Homo sapiens
uauuauauaacauuuuau

SEQ ID NO: 16533 - RNA, 23 nt, Homo sapiens
aagaggcucggcaggugcggugg

SEQ ID NO: 16534 - RNA, 16 nt, Homo sapiens
acguuucuuucagauu

SEQ ID NO: 16535 - RNA, 18 nt, Homo sapiens
caagcaagccggugucug

SEQ ID NO: 16536 - RNA, 17 nt, Homo sapiens
cccccuggcgguggggc

SEQ ID NO: 16537 - RNA, 21 nt, Homo sapiens
cccggccugcgcuugcccccu

SEQ ID NO: 16538 - RNA, 18 nt, Homo sapiens
ccgcggaagggcccccaa

SEQ ID NO: 16539 - RNA, 18 nt, Homo sapiens
ccuggcugggggcucccc

SEQ ID NO: 16540 - RNA, 20 nt, Homo sapiens
ccuuagggacguuuuggggc

SEQ ID NO: 16541 - RNA, 20 nt, Homo sapiens
cgggcgccgccgcguccugc

SEQ ID NO: 16542 - RNA, 19 nt, Homo sapiens
gacuugggccccugguccu

SEQ ID NO: 16543 - RNA, 19 nt, Homo sapiens
gccucggucaccgggcgcc

SEQ ID NO: 16544 - RNA, 19 nt, Homo sapiens
ucuguggguuugaugaggg

SEQ ID NO: 16545 - RNA, 19 nt, Homo sapiens
ugcgaggccucggucaccg

SEQ ID NO: 16546 - RNA, 18 nt, Homo sapiens
uucagauauucgagucau

SEQ ID NO: 16547 - RNA, 19 nt, Homo sapiens
aacaggugagucaaagcac

SEQ ID NO: 16548 - RNA, 18 nt, Homo sapiens
caggaaggggugguaggu

SEQ ID NO: 16549 - RNA, 25 nt, Homo sapiens
ccuucuagcuugauucuuggccuuc

SEQ ID NO: 16550 - RNA, 22 nt, Homo sapiens
cuccuggcuucuguggcuugug

SEQ ID NO: 16551 - RNA, 19 nt, Homo sapiens
ugagucagaugcuccaguc

SEQ ID NO: 16552 - RNA, 17 nt, Homo sapiens
ugggacaggaaggggug

SEQ ID NO: 16553 - RNA, 20 nt, Homo sapiens
uggucuucuugugagucaga

SEQ ID NO: 16554 - RNA, 15 nt, Homo sapiens
uucugcccaacccag

SEQ ID NO: 16555 - RNA, 15 nt, Homo sapiens
cuugauauuggucca

SEQ ID NO: 16556 - RNA, 20 nt, Homo sapiens
gaaguuugaaggcgcuucag

SEQ ID NO: 16557 - RNA, 17 nt, Homo sapiens
uggaaguuugaaggcgc

SEQ ID NO: 16558 - RNA, 17 nt, Homo sapiens
uggaaguuugaaggggc

SEQ ID NO: 16559 - RNA, 22 nt, Homo sapiens
caagagaaaguagacagauaca

SEQ ID NO: 16560 - RNA, 18 nt, Homo sapiens
cacaagagggaaaaaaaa

SEQ ID NO: 16561 - RNA, 20 nt, Homo sapiens
gccagcaacugucccgugua

SEQ ID NO: 16562 - RNA, 20 nt, Homo sapiens
uauuguaacaaagcaacuug

SEQ ID NO: 16563 - RNA, 16 nt, Homo sapiens
ugagagaaaagcauca

SEQ ID NO: 16564 - RNA, 18 nt, Homo sapiens
uuuucuuuuuucccacag

SEQ ID NO: 16565 - RNA, 20 nt, Homo sapiens
aaaacuacugccuucucagc

SEQ ID NO: 16566 - RNA, 22 nt, Homo sapiens
accccacccgaggcucccuccc

SEQ ID NO: 16567 - RNA, 16 nt, Homo sapiens
aggcgcggggcggcgg

SEQ ID NO: 16568 - RNA, 20 nt, Homo sapiens
caguggcggcccucggccug

SEQ ID NO: 16569 - RNA, 16 nt, Homo sapiens
ccccccgcucccaccc

SEQ ID NO: 16570 - RNA, 20 nt, Homo sapiens
cccugcaggcugccuagggu

SEQ ID NO: 16571 - RNA, 16 nt, Homo sapiens
cggggcggcgggcgcg

SEQ ID NO: 16572 - RNA, 24 nt, Homo sapiens
cugacacaaaggcaggcacaggcu

SEQ ID NO: 16573 - RNA, 17 nt, Homo sapiens
cugccgcagagagaggg

SEQ ID NO: 16574 - RNA, 16 nt, Homo sapiens
gcgcggggcggcgggc

SEQ ID NO: 16575 - RNA, 22 nt, Homo sapiens
gcguugcccggcuccgcggccg

SEQ ID NO: 16576 - RNA, 16 nt, Homo sapiens
ucucucggagaccaau

SEQ ID NO: 16577 - RNA, 22 nt, Homo sapiens
ugcgggggaacaggcaggcugu

SEQ ID NO: 16578 - RNA, 17 nt, Homo sapiens
uggcggcccucggccug

SEQ ID NO: 16579 - RNA, 18 nt, Homo sapiens
uguguugcuguuggaaau

SEQ ID NO: 16580 - RNA, 19 nt, Homo sapiens
uguuuccauuuaaagcaga

SEQ ID NO: 16581 - RNA, 23 nt, Homo sapiens
uuccuguacauuggacaagaagg

SEQ ID NO: 16582 - RNA, 20 nt, Homo sapiens
auguuuauucaguauuguca

SEQ ID NO: 16583 - RNA, 19 nt, Homo sapiens
cccagccucauccuguaag

SEQ ID NO: 16584 - RNA, 18 nt, Homo sapiens
cggggccgcgggguccgg

SEQ ID NO: 16585 - RNA, 20 nt, Homo sapiens
cggggccgcgggguccggcc

SEQ ID NO: 16586 - RNA, 22 nt, Homo sapiens
gcacugcagugaguuguuaggg

SEQ ID NO: 16587 - RNA, 21 nt, Homo sapiens
ugcagugaguuguuagggcaa

SEQ ID NO: 16588 - RNA, 18 nt, Homo sapiens
uggguauaaaauacuuga

SEQ ID NO: 16589 - RNA, 23 nt, Homo sapiens
cagccgccgccgccgccgccgcg

SEQ ID NO: 16590 - RNA, 19 nt, Homo sapiens
caggggcgguggggagaac

SEQ ID NO: 16591 - RNA, 22 nt, Homo sapiens
ccgccgccgcggaggucgccca

SEQ ID NO: 16592 - RNA, 20 nt, Homo sapiens
ccggcgugcgcccccggccc

SEQ ID NO: 16593 - RNA, 15 nt, Homo sapiens
cggcgugcgcccccg

SEQ ID NO: 16594 - RNA, 19 nt, Homo sapiens
gaugacgcguacaggggcg

SEQ ID NO: 16595 - RNA, 28 nt, Homo sapiens
gggaaggcaggggguguggcuggaggca

SEQ ID NO: 16596 - RNA, 22 nt, Homo sapiens
gggguguggcuggaggcacuga

SEQ ID NO: 16597 - RNA, 19 nt, Homo sapiens
ggguguggcuggaggcacu

SEQ ID NO: 16598 - RNA, 16 nt, Homo sapiens
ugcccugagccccucc

SEQ ID NO: 16599 - RNA, 18 nt, Homo sapiens
uggcagggcaaggaggag

SEQ ID NO: 16600 - RNA, 18 nt, Homo sapiens
aggagcuccaagcaaacu

SEQ ID NO: 16601 - RNA, 23 nt, Homo sapiens
ucuggccaaacuccugggccaag

SEQ ID NO: 16602 - RNA, 18 nt, Homo sapiens
cuacauacagcugcuuug

SEQ ID NO: 16603 - RNA, 18 nt, Homo sapiens
uucacauuuuaaaaaccc

SEQ ID NO: 16604 - RNA, 21 nt, Homo sapiens
aaggggaaaauccaucuugac

SEQ ID NO: 16605 - RNA, 21 nt, Homo sapiens
agcggcugcagggccgcggcg

SEQ ID NO: 16606 - RNA, 22 nt, Homo sapiens
agcggcugcagggccgcggcgg

SEQ ID NO: 16607 - RNA, 20 nt, Homo sapiens
aguggaggagggcagagaua

SEQ ID NO: 16608 - RNA, 21 nt, Homo sapiens
cagcugccuucccugugcccg

SEQ ID NO: 16609 - RNA, 17 nt, Homo sapiens
cagggccgcggcggccc

SEQ ID NO: 16610 - RNA, 19 nt, Homo sapiens
cgccaugagcggcugcagg

SEQ ID NO: 16611 - RNA, 24 nt, Homo sapiens
cucuuccccucucucaggcagucc

SEQ ID NO: 16612 - RNA, 18 nt, Homo sapiens
cuugcgcaccgcggugcc

SEQ ID NO: 16613 - RNA, 15 nt, Homo sapiens
gccgcagcuggcagg

SEQ ID NO: 16614 - RNA, 20 nt, Homo sapiens
gcgcaccgcggugccgcccg

SEQ ID NO: 16615 - RNA, 20 nt, Homo sapiens
gcgccgugggcucgucugcc

SEQ ID NO: 16616 - RNA, 21 nt, Homo sapiens
gcgcuugcgcaccgcggugcc

SEQ ID NO: 16617 - RNA, 22 nt, Homo sapiens
gcgcuugcgcaccgcggugccg

SEQ ID NO: 16618 - RNA, 18 nt, Homo sapiens
gcugcagggccgcggcgg

SEQ ID NO: 16619 - RNA, 15 nt, Homo sapiens
gcugggaccacggcg

SEQ ID NO: 16620 - RNA, 15 nt, Homo sapiens
gggaccacggcgccg

SEQ ID NO: 16621 - RNA, 21 nt, Homo sapiens
ugggaggaggggaaacauguc

SEQ ID NO: 16622 - RNA, 23 nt, Homo sapiens
acaaaacuguugcuagcagcauu

SEQ ID NO: 16623 - RNA, 19 nt, Homo sapiens
agagguggccuuggacacc

SEQ ID NO: 16624 - RNA, 20 nt, Homo sapiens
cacaggaagagaagaagcau

SEQ ID NO: 16625 - RNA, 19 nt, Homo sapiens
cagggccccugugacugcc

SEQ ID NO: 16626 - RNA, 23 nt, Homo sapiens
cagugggcccaagugcugaccuc

SEQ ID NO: 16627 - RNA, 20 nt, Homo sapiens
ccccagaacugagcccaccu

SEQ ID NO: 16628 - RNA, 25 nt, Homo sapiens
ccuccagagcccuaacccuagcccu

SEQ ID NO: 16629 - RNA, 18 nt, Homo sapiens
ccugaacucaucuugaag

SEQ ID NO: 16630 - RNA, 23 nt, Homo sapiens
cucgucuagagacaagcacggcc

SEQ ID NO: 16631 - RNA, 22 nt, Homo sapiens
cuucggguuaaccacaagccuc

SEQ ID NO: 16632 - RNA, 16 nt, Homo sapiens
gagguacccaguaacc

SEQ ID NO: 16633 - RNA, 20 nt, Homo sapiens
gcauugcacuccagccuggg

SEQ ID NO: 16634 - RNA, 17 nt, Homo sapiens
gcgugguggcgggcgcc

SEQ ID NO: 16635 - RNA, 21 nt, Homo sapiens
ggauuggggcugggccugagc

SEQ ID NO: 16636 - RNA, 17 nt, Homo sapiens
ggcaacugagcuggagc

SEQ ID NO: 16637 - RNA, 19 nt, Homo sapiens
ggguggcagggagccuggc

SEQ ID NO: 16638 - RNA, 15 nt, Homo sapiens
uaaggggauggauug

SEQ ID NO: 16639 - RNA, 18 nt, Homo sapiens
ucaagcacccagcucggc

SEQ ID NO: 16640 - RNA, 18 nt, Homo sapiens
ucaagcaucuucacaggg

SEQ ID NO: 16641 - RNA, 22 nt, Homo sapiens
ucuguauguuguuuuauucugc

SEQ ID NO: 16642 - RNA, 22 nt, Homo sapiens
ugaggcccucggccuagaacag

SEQ ID NO: 16643 - RNA, 23 nt, Homo sapiens
ugccuguaaucccagcacuuugg

SEQ ID NO: 16644 - RNA, 21 nt, Homo sapiens
uggaaggugugccagggagag

SEQ ID NO: 16645 - RNA, 19 nt, Homo sapiens
uucaaggcugggcgccgug

SEQ ID NO: 16646 - RNA, 19 nt, Homo sapiens
uuccuggugugacccuggu

SEQ ID NO: 16647 - RNA, 17 nt, Homo sapiens
uugggaggccaaggugg

SEQ ID NO: 16648 - RNA, 16 nt, Homo sapiens
uuuucccaagccccag

SEQ ID NO: 16649 - RNA, 17 nt, Homo sapiens
aaacaaaugcaugccug

SEQ ID NO: 16650 - RNA, 21 nt, Homo sapiens
aaccagaugaucuccuggcau

SEQ ID NO: 16651 - RNA, 23 nt, Homo sapiens
aagcauauuaugugagguugggg

SEQ ID NO: 16652 - RNA, 19 nt, Homo sapiens
acagcauguguggccgugg

SEQ ID NO: 16653 - RNA, 20 nt, Homo sapiens
auggacugccuucauuuucu

SEQ ID NO: 16654 - RNA, 20 nt, Homo sapiens
cccuguugagggcuauggga

SEQ ID NO: 16655 - RNA, 18 nt, Homo sapiens
cuaugggauuucagcgac

SEQ ID NO: 16656 - RNA, 19 nt, Homo sapiens
gaaaguuucuaacuacagg

SEQ ID NO: 16657 - RNA, 20 nt, Homo sapiens
gcacauucaagcacagaaca

SEQ ID NO: 16658 - RNA, 18 nt, Homo sapiens
gccugucuuugccauccc

SEQ ID NO: 16659 - RNA, 18 nt, Homo sapiens
gcuuuguuucaugaaaca

SEQ ID NO: 16660 - RNA, 16 nt, Homo sapiens
gggccugucuuugcca

SEQ ID NO: 16661 - RNA, 18 nt, Homo sapiens
uaauaaaguauuucuuaa

SEQ ID NO: 16662 - RNA, 24 nt, Homo sapiens
uguuucaugaaacaggaaauuguu

SEQ ID NO: 16663 - RNA, 18 nt, Homo sapiens
aaggagugcgugugugag

SEQ ID NO: 16664 - RNA, 19 nt, Homo sapiens
aggcagaucccagcuggcc

SEQ ID NO: 16665 - RNA, 22 nt, Homo sapiens
aggggcggggcggggacacggg

SEQ ID NO: 16666 - RNA, 19 nt, Homo sapiens
cagggcccugcaggagacc

SEQ ID NO: 16667 - RNA, 16 nt, Homo sapiens
gagcagagccuggggu

SEQ ID NO: 16668 - RNA, 19 nt, Homo sapiens
gaggcgggggugcauuggc

SEQ ID NO: 16669 - RNA, 23 nt, Homo sapiens
gaggggcggggcggggacacggg

SEQ ID NO: 16670 - RNA, 18 nt, Homo sapiens
gcgcggcuguggucccgu

SEQ ID NO: 16671 - RNA, 18 nt, Homo sapiens
gcugugugcucaucucug

SEQ ID NO: 16672 - RNA, 18 nt, Homo sapiens
ggacggaggggcggggcg

SEQ ID NO: 16673 - RNA, 16 nt, Homo sapiens
gggcggggacacgggu

SEQ ID NO: 16674 - RNA, 20 nt, Homo sapiens
ggggcggggcggggacacgg

SEQ ID NO: 16675 - RNA, 18 nt, Homo sapiens
guggguguggguggcugg

SEQ ID NO: 16676 - RNA, 20 nt, Homo sapiens
ucgggucaggacggaggugg

SEQ ID NO: 16677 - RNA, 18 nt, Homo sapiens
uggggugggugugggugg

SEQ ID NO: 16678 - RNA, 19 nt, Homo sapiens
uggguggcuggugguggca

SEQ ID NO: 16679 - RNA, 20 nt, Homo sapiens
uggguguggguggcuggugg

SEQ ID NO: 16680 - RNA, 17 nt, Homo sapiens
cagcaguucugugacua

SEQ ID NO: 16681 - RNA, 15 nt, Homo sapiens
gagaaaugcaaagag

SEQ ID NO: 16682 - RNA, 18 nt, Homo sapiens
gaguuuauacauuaagca

SEQ ID NO: 16683 - RNA, 19 nt, Homo sapiens
gguaaaaguggaaaggaaa

SEQ ID NO: 16684 - RNA, 18 nt, Homo sapiens
cuuuauggugcagcuuga

SEQ ID NO: 16685 - RNA, 18 nt, Homo sapiens
uuugucagaaacggauag

SEQ ID NO: 16686 - RNA, 24 nt, Homo sapiens
aguggcugggggcugguugguggg

SEQ ID NO: 16687 - RNA, 20 nt, Homo sapiens
cgccggagcccgcgcgcccg

SEQ ID NO: 16688 - RNA, 16 nt, Homo sapiens
cggcgcccgccggagc

SEQ ID NO: 16689 - RNA, 17 nt, Homo sapiens
gcccgucccggcggccc

SEQ ID NO: 16690 - RNA, 23 nt, Homo sapiens
ggccguacgccccucgccgugga

SEQ ID NO: 16691 - RNA, 18 nt, Homo sapiens
ugccgcccuucugucuuu

SEQ ID NO: 16692 - RNA, 21 nt, Homo sapiens
acagaugguauguggggauug

SEQ ID NO: 16693 - RNA, 19 nt, Homo sapiens
accccuuggggugaggggc

SEQ ID NO: 16694 - RNA, 21 nt, Homo sapiens
aggaacugcagguuuugcguu

SEQ ID NO: 16695 - RNA, 15 nt, Homo sapiens
aggugaaagaggggc

SEQ ID NO: 16696 - RNA, 20 nt, Homo sapiens
cacaggaaaggcccagguga

SEQ ID NO: 16697 - RNA, 18 nt, Homo sapiens
ccaccccgggccuaggcu

SEQ ID NO: 16698 - RNA, 18 nt, Homo sapiens
cucaagaauaagcaaugg

SEQ ID NO: 16699 - RNA, 16 nt, Homo sapiens
gagcuguaaaagggcu

SEQ ID NO: 16700 - RNA, 23 nt, Homo sapiens
gauaugaaacccagaguccaugc

SEQ ID NO: 16701 - RNA, 19 nt, Homo sapiens
gccuggccgggaguggggc

SEQ ID NO: 16702 - RNA, 25 nt, Homo sapiens
ggccaggaggcacugagcaagggag

SEQ ID NO: 16703 - RNA, 21 nt, Homo sapiens
gggagagggacaaguggcuuc

SEQ ID NO: 16704 - RNA, 19 nt, Homo sapiens
ggggaaggggcaucagguu

SEQ ID NO: 16705 - RNA, 24 nt, Homo sapiens
guacauaggcaugcaacaugggag

SEQ ID NO: 16706 - RNA, 16 nt, Homo sapiens
uacaagaggcccaaau

SEQ ID NO: 16707 - RNA, 19 nt, Homo sapiens
uacaagaggcccaaauuca

SEQ ID NO: 16708 - RNA, 23 nt, Homo sapiens
ucccagaaagggaggcagggcag

SEQ ID NO: 16709 - RNA, 21 nt, Homo sapiens
ucugccucaggucucugguau

SEQ ID NO: 16710 - RNA, 19 nt, Homo sapiens
cccgcaacggccgccccgg

SEQ ID NO: 16711 - RNA, 22 nt, Homo sapiens
ccgccccggcuccccccuggcc

SEQ ID NO: 16712 - RNA, 19 nt, Homo sapiens
gguacaaaaaaaggaaaaa

SEQ ID NO: 16713 - RNA, 22 nt, Homo sapiens
gguuggcagacagaugggugcc

SEQ ID NO: 16714 - RNA, 24 nt, Homo sapiens
uaaaauauuucuaaugaacugauu

SEQ ID NO: 16715 - RNA, 18 nt, Homo sapiens
uauuuuacaaugcuuccu

SEQ ID NO: 16716 - RNA, 19 nt, Homo sapiens
aggccaggcagagcuggag

SEQ ID NO: 16717 - RNA, 16 nt, Homo sapiens
agguauugaaaaggaa

SEQ ID NO: 16718 - RNA, 20 nt, Homo sapiens
auauuuacugguuuaucauc

SEQ ID NO: 16719 - RNA, 16 nt, Homo sapiens
auguguguggcaggag

SEQ ID NO: 16720 - RNA, 20 nt, Homo sapiens
cagaugucugccucucucac

SEQ ID NO: 16721 - RNA, 17 nt, Homo sapiens
cugccucucucacugaa

SEQ ID NO: 16722 - RNA, 22 nt, Homo sapiens
gccugcuucuggcuaauccccc

SEQ ID NO: 16723 - RNA, 24 nt, Homo sapiens
ugacaggacagggucaggccaggc

SEQ ID NO: 16724 - RNA, 16 nt, Homo sapiens
acacccugucccugua

SEQ ID NO: 16725 - RNA, 18 nt, Homo sapiens
cacucuuguauaagagug

SEQ ID NO: 16726 - RNA, 19 nt, Homo sapiens
ccgcggagcugaggucugu

SEQ ID NO: 16727 - RNA, 20 nt, Homo sapiens
ccggccccgccucugggacg

SEQ ID NO: 16728 - RNA, 20 nt, Homo sapiens
ggcuuuucuuaaagguuuca

SEQ ID NO: 16729 - RNA, 17 nt, Homo sapiens
uugggaggccgaggcgg

SEQ ID NO: 16730 - RNA, 18 nt, Homo sapiens
aggcggcacgugugcccg

SEQ ID NO: 16731 - RNA, 25 nt, Homo sapiens
ccagaggggguuucgacacaacgug

SEQ ID NO: 16732 - RNA, 22 nt, Homo sapiens
cccccggccgcucccgcucccg

SEQ ID NO: 16733 - RNA, 19 nt, Homo sapiens
ccgcccagccgcgcccccc

SEQ ID NO: 16734 - RNA, 18 nt, Homo sapiens
gggaagguuguggacaaa

SEQ ID NO: 16735 - RNA, 25 nt, Homo sapiens
uccagcuguaguugggggacgcggc

SEQ ID NO: 16736 - RNA, 20 nt, Homo sapiens
ucgacggcggcguggcgggc

SEQ ID NO: 16737 - RNA, 24 nt, Homo sapiens
uugcauuuucguuuuuuugugauu

SEQ ID NO: 16738 - RNA, 19 nt, Homo sapiens
aauggcuuagcugguuuaa

SEQ ID NO: 16739 - RNA, 16 nt, Homo sapiens
aggggaccugggaacc

SEQ ID NO: 16740 - RNA, 21 nt, Homo sapiens
caacacacauguguguauaga

SEQ ID NO: 16741 - RNA, 23 nt, Homo sapiens
caaugugauuguuucccuugaaa

SEQ ID NO: 16742 - RNA, 20 nt, Homo sapiens
cacgguuccuggucccuuuu

SEQ ID NO: 16743 - RNA, 20 nt, Homo sapiens
cauucccucuccuuuuuucu

SEQ ID NO: 16744 - RNA, 22 nt, Homo sapiens
ccccuggucuaccgacucugug

SEQ ID NO: 16745 - RNA, 21 nt, Homo sapiens
cgccccgggggucucgcggcc

SEQ ID NO: 16746 - RNA, 17 nt, Homo sapiens
cucuggggugguggugg

SEQ ID NO: 16747 - RNA, 22 nt, Homo sapiens
cugucccuuacauaaaaaagaa

SEQ ID NO: 16748 - RNA, 19 nt, Homo sapiens
gcagggccaggccaggaca

SEQ ID NO: 16749 - RNA, 14 nt, Homo sapiens
gcagugcccugugu

SEQ ID NO: 16750 - RNA, 17 nt, Homo sapiens
ggcugggucaacucugu

SEQ ID NO: 16751 - RNA, 18 nt, Homo sapiens
ggcuuagcugguuuaaag

SEQ ID NO: 16752 - RNA, 22 nt, Homo sapiens
gggaaaacaagggagugaagga

SEQ ID NO: 16753 - RNA, 19 nt, Homo sapiens
gucucgcggccuggcgcag

SEQ ID NO: 16754 - RNA, 22 nt, Homo sapiens
uaaugcacauagagaacaaagc

SEQ ID NO: 16755 - RNA, 19 nt, Homo sapiens
uacauaugugugugugugu

SEQ ID NO: 16756 - RNA, 21 nt, Homo sapiens
uacauauguguguguguguug

SEQ ID NO: 16757 - RNA, 23 nt, Homo sapiens
uccccucuauccaaacacaaacu

SEQ ID NO: 16758 - RNA, 15 nt, Homo sapiens
uggcaagggcagugc

SEQ ID NO: 16759 - RNA, 23 nt, Homo sapiens
ugggaggguaaaaguuggcaagg

SEQ ID NO: 16760 - RNA, 24 nt, Homo sapiens
ugguuuucucuggggugguggugg

SEQ ID NO: 16761 - RNA, 23 nt, Homo sapiens
uguacuggcaagaaagggcucua

SEQ ID NO: 16762 - RNA, 18 nt, Homo sapiens
uguguguguguguugugu

SEQ ID NO: 16763 - RNA, 18 nt, Homo sapiens
uguguguguguuguguau

SEQ ID NO: 16764 - RNA, 19 nt, Homo sapiens
uuaaacaccugagucccag

SEQ ID NO: 16765 - RNA, 20 nt, Homo sapiens
uucugcucaggcucaugucc

SEQ ID NO: 16766 - RNA, 15 nt, Homo sapiens
uuucgaagauuaaca

SEQ ID NO: 16767 - RNA, 18 nt, Homo sapiens
gacagguauuucuggaaa

SEQ ID NO: 16768 - RNA, 26 nt, Homo sapiens
ggccaccgaguuaguuggcugacugc

SEQ ID NO: 16769 - RNA, 17 nt, Homo sapiens
ugccgcucaccuccuuu

SEQ ID NO: 16770 - RNA, 22 nt, Homo sapiens
uuucuggaaaaggaucugguaa

SEQ ID NO: 16771 - RNA, 18 nt, Homo sapiens
caccccggggcgcgcccc

SEQ ID NO: 16772 - RNA, 19 nt, Homo sapiens
cccgacgacugccccgugc

SEQ ID NO: 16773 - RNA, 20 nt, Homo sapiens
cgugccccgggggucucggg

SEQ ID NO: 16774 - RNA, 18 nt, Homo sapiens
ggagggaggggcauggga

SEQ ID NO: 16775 - RNA, 19 nt, Homo sapiens
gggcaugggagggggaacc

SEQ ID NO: 16776 - RNA, 18 nt, Homo sapiens
uuacugcaggggcagugg

SEQ ID NO: 16777 - RNA, 15 nt, Homo sapiens
ggcaacugcagcggg

SEQ ID NO: 16778 - RNA, 21 nt, Homo sapiens
ucaugggaagugacugccaau

SEQ ID NO: 16779 - RNA, 19 nt, Homo sapiens
ugcagugggccccaggcag

SEQ ID NO: 16780 - RNA, 24 nt, Homo sapiens
accccagcuccugccgggagagcc

SEQ ID NO: 16781 - RNA, 16 nt, Homo sapiens
ccacgugccaccugcc

SEQ ID NO: 16782 - RNA, 19 nt, Homo sapiens
cccaccacuccccuagucc

SEQ ID NO: 16783 - RNA, 15 nt, Homo sapiens
cccaggcugagagug

SEQ ID NO: 16784 - RNA, 15 nt, Homo sapiens
cccaucugcaugccu

SEQ ID NO: 16785 - RNA, 19 nt, Homo sapiens
cucuuuuggguccccaggu

SEQ ID NO: 16786 - RNA, 24 nt, Homo sapiens
cuguggccuccugugccucugcca

SEQ ID NO: 16787 - RNA, 19 nt, Homo sapiens
gacugagcuuggaagugac

SEQ ID NO: 16788 - RNA, 21 nt, Homo sapiens
gaggauacgacucaaaagcug

SEQ ID NO: 16789 - RNA, 24 nt, Homo sapiens
gagggcuuggcaggagucucccag

SEQ ID NO: 16790 - RNA, 16 nt, Homo sapiens
gauguugcuuggggaa

SEQ ID NO: 16791 - RNA, 20 nt, Homo sapiens
gcagaguagauagcuuugga

SEQ ID NO: 16792 - RNA, 19 nt, Homo sapiens
gcccuugggagggggacac

SEQ ID NO: 16793 - RNA, 18 nt, Homo sapiens
ucaaaacaaaacacacac

SEQ ID NO: 16794 - RNA, 19 nt, Homo sapiens
uggggaguggggagaugag

SEQ ID NO: 16795 - RNA, 17 nt, Homo sapiens
aagcaggauggcaaaug

SEQ ID NO: 16796 - RNA, 17 nt, Homo sapiens
cagcucgccaccauccc

SEQ ID NO: 16797 - RNA, 19 nt, Homo sapiens
cuguacagcucgccaccau

SEQ ID NO: 16798 - RNA, 19 nt, Homo sapiens
gccaugagagacucggagg

SEQ ID NO: 16799 - RNA, 14 nt, Homo sapiens
gcccaucugcccag

SEQ ID NO: 16800 - RNA, 22 nt, Homo sapiens
ggaaauccaggccuuggcagau

SEQ ID NO: 16801 - RNA, 18 nt, Homo sapiens
ggaggcaugccgaguguu

SEQ ID NO: 16802 - RNA, 22 nt, Homo sapiens
uccagcugggggugccuguggc

SEQ ID NO: 16803 - RNA, 18 nt, Homo sapiens
ugcaagaacagugcggaa

SEQ ID NO: 16804 - RNA, 21 nt, Homo sapiens
ugcugagugaccucagccuag

SEQ ID NO: 16805 - RNA, 19 nt, Homo sapiens
acgggaagccucaccaccu

SEQ ID NO: 16806 - RNA, 21 nt, Homo sapiens
aggugguuucuguugcacugg

SEQ ID NO: 16807 - RNA, 14 nt, Homo sapiens
gccggcggcggcgg

SEQ ID NO: 16808 - RNA, 20 nt, Homo sapiens
gguagacacccugucugugu

SEQ ID NO: 16809 - RNA, 18 nt, Homo sapiens
uaaguuggggauagguga

SEQ ID NO: 16810 - RNA, 23 nt, Homo sapiens
uggaaugggauuuggguauuuga

SEQ ID NO: 16811 - RNA, 23 nt, Homo sapiens
aaaugucuacuauuugcauugag

SEQ ID NO: 16812 - RNA, 21 nt, Homo sapiens
aagauguugccaaaguuuuau

SEQ ID NO: 16813 - RNA, 16 nt, Homo sapiens
gcgcggaucgcagcgc

SEQ ID NO: 16814 - RNA, 18 nt, Homo sapiens
gugcgugacgugguggcg

SEQ ID NO: 16815 - RNA, 21 nt, Homo sapiens
uaagugaaaggggucacaaaa

SEQ ID NO: 16816 - RNA, 18 nt, Homo sapiens
uaugcgcggaucgcagcg

SEQ ID NO: 16817 - RNA, 21 nt, Homo sapiens
ucgcucgcugccucguuugcu

SEQ ID NO: 16818 - RNA, 23 nt, Homo sapiens
ucgcucgcugccucguuugcuug

SEQ ID NO: 16819 - RNA, 17 nt, Homo sapiens
aagaggggagggagucu

SEQ ID NO: 16820 - RNA, 18 nt, Homo sapiens
cuguguaugugugugugu

SEQ ID NO: 16821 - RNA, 20 nt, Homo sapiens
ggaggaaagaagauucccag

SEQ ID NO: 16822 - RNA, 20 nt, Homo sapiens
ggcagcuguuagcaagacag

SEQ ID NO: 16823 - RNA, 18 nt, Homo sapiens
ucaaggagcaccuucugc

SEQ ID NO: 16824 - RNA, 18 nt, Homo sapiens
ucacuuggagcccauguu

SEQ ID NO: 16825 - RNA, 18 nt, Homo sapiens
ccgcccgcccgcuugccc

SEQ ID NO: 16826 - RNA, 18 nt, Homo sapiens
ccgcccgcuugcccgccc

SEQ ID NO: 16827 - RNA, 24 nt, Homo sapiens
cgcuggcgucccgcagugcagagg

SEQ ID NO: 16828 - RNA, 16 nt, Homo sapiens
cgggacccgcggcugc

SEQ ID NO: 16829 - RNA, 20 nt, Homo sapiens
cugcgcuccccuccccucgc

SEQ ID NO: 16830 - RNA, 18 nt, Homo sapiens
cugugccucaggugggcc

SEQ ID NO: 16831 - RNA, 18 nt, Homo sapiens
cuguugccgcccgcccgc

SEQ ID NO: 16832 - RNA, 19 nt, Homo sapiens
gcccgcccgcuugcccgcc

SEQ ID NO: 16833 - RNA, 21 nt, Homo sapiens
gcccgcccgcuugcccgcccg

SEQ ID NO: 16834 - RNA, 20 nt, Homo sapiens
gcccgcccguuagccccgcc

SEQ ID NO: 16835 - RNA, 20 nt, Homo sapiens
gccgcugcgcuccccucccc

SEQ ID NO: 16836 - RNA, 15 nt, Homo sapiens
ggcgcgccgaggggc

SEQ ID NO: 16837 - RNA, 16 nt, Homo sapiens
uggacaagagagaaag

SEQ ID NO: 16838 - RNA, 18 nt, Homo sapiens
uggaggaggaguggggau

SEQ ID NO: 16839 - RNA, 16 nt, Homo sapiens
uggccgagggacaugc

SEQ ID NO: 16840 - RNA, 19 nt, Homo sapiens
uggcuucgcuggccucggu

SEQ ID NO: 16841 - RNA, 18 nt, Homo sapiens
aaaaaaaaaaaaagcauc

SEQ ID NO: 16842 - RNA, 18 nt, Homo sapiens
acagugcagggacagcau

SEQ ID NO: 16843 - RNA, 18 nt, Homo sapiens
agcacguccgcggugacc

SEQ ID NO: 16844 - RNA, 23 nt, Homo sapiens
aggcagcccccccaaggcugccg

SEQ ID NO: 16845 - RNA, 16 nt, Homo sapiens
cagggcccugcaaacc

SEQ ID NO: 16846 - RNA, 23 nt, Homo sapiens
cccucgaggcaggggucgugggg

SEQ ID NO: 16847 - RNA, 19 nt, Homo sapiens
gagggucccggcucccacc

SEQ ID NO: 16848 - RNA, 18 nt, Homo sapiens
gaugacaaugugucugcc

SEQ ID NO: 16849 - RNA, 16 nt, Homo sapiens
ggcgcgcucacagggc

SEQ ID NO: 16850 - RNA, 22 nt, Homo sapiens
ucccucuggaugcauucuggau

SEQ ID NO: 16851 - RNA, 18 nt, Homo sapiens
uggagaugugccaggggc

SEQ ID NO: 16852 - RNA, 15 nt, Homo sapiens
uggcacaaguguggg

SEQ ID NO: 16853 - RNA, 19 nt, Homo sapiens
uugcaccuacaaagcuucu

SEQ ID NO: 16854 - RNA, 19 nt, Homo sapiens
aggcgucuaggaauuucug

SEQ ID NO: 16855 - RNA, 18 nt, Homo sapiens
gggguaggcaaguaugag

SEQ ID NO: 16856 - RNA, 18 nt, Homo sapiens
agaggcuagggcugguaa

SEQ ID NO: 16857 - RNA, 23 nt, Homo sapiens
aggggaguggggaaagggguggg

SEQ ID NO: 16858 - RNA, 16 nt, Homo sapiens
gagcgcggccuggggu

SEQ ID NO: 16859 - RNA, 15 nt, Homo sapiens
gcgcggggcacccgc

SEQ ID NO: 16860 - RNA, 16 nt, Homo sapiens
gcgcggggcacccgcc

SEQ ID NO: 16861 - RNA, 18 nt, Homo sapiens
gcgcggggcacccgccgc

SEQ ID NO: 16862 - RNA, 20 nt, Homo sapiens
gggaguggggaaaggggugg

SEQ ID NO: 16863 - RNA, 25 nt, Homo sapiens
gugcccauccaggagcaagucagac

SEQ ID NO: 16864 - RNA, 20 nt, Homo sapiens
uucaauggagcauuuauuau

SEQ ID NO: 16865 - RNA, 19 nt, Homo sapiens
ccagcuucauuuccuucau

SEQ ID NO: 16866 - RNA, 21 nt, Homo sapiens
cggggagcgcgggcggccugg

SEQ ID NO: 16867 - RNA, 21 nt, Homo sapiens
gaaucaccagggggucccaca

SEQ ID NO: 16868 - RNA, 21 nt, Homo sapiens
gccuggggagcgggcggcgga

SEQ ID NO: 16869 - RNA, 23 nt, Homo sapiens
gcgcgcggggagcgcgggcggcc

SEQ ID NO: 16870 - RNA, 20 nt, Homo sapiens
gcgcggggagcgcgggcggc

SEQ ID NO: 16871 - RNA, 26 nt, Homo sapiens
gcggggcgcuccgggcggcggcggcg

SEQ ID NO: 16872 - RNA, 18 nt, Homo sapiens
ggcggagcggggcgcucc

SEQ ID NO: 16873 - RNA, 18 nt, Homo sapiens
ggggagcgggcggcggag

SEQ ID NO: 16874 - RNA, 17 nt, Homo sapiens
ucgcugggagugcccag

SEQ ID NO: 16875 - RNA, 15 nt, Homo sapiens
agacagaucaggggc

SEQ ID NO: 16876 - RNA, 19 nt, Homo sapiens
agucaaucccaggaccaug

SEQ ID NO: 16877 - RNA, 19 nt, Homo sapiens
ccaacuccuucucccuccc

SEQ ID NO: 16878 - RNA, 15 nt, Homo sapiens
gcccuugggagcagc

SEQ ID NO: 16879 - RNA, 20 nt, Homo sapiens
acuuuauuugucauuuggcu

SEQ ID NO: 16880 - RNA, 20 nt, Homo sapiens
cugugggugugugugugugu

SEQ ID NO: 16881 - RNA, 18 nt, Homo sapiens
gauaacgguccggcggga

SEQ ID NO: 16882 - RNA, 21 nt, Homo sapiens
gccuuuggacuuuauuuguca

SEQ ID NO: 16883 - RNA, 20 nt, Homo sapiens
uacauucuccuguguuuugu

SEQ ID NO: 16884 - RNA, 24 nt, Homo sapiens
uagcuauagacaacaucucaguuu

SEQ ID NO: 16885 - RNA, 18 nt, Homo sapiens
uauaaaaauaaacacaaa

SEQ ID NO: 16886 - RNA, 23 nt, Homo sapiens
ucugugggugugugugugugugu

SEQ ID NO: 16887 - RNA, 17 nt, Homo sapiens
uggcgggcgcccggcgc

SEQ ID NO: 16888 - RNA, 21 nt, Homo sapiens
ugugugugcauaugugugugu

SEQ ID NO: 16889 - RNA, 17 nt, Homo sapiens
uucaaagcuaaucuuuc

SEQ ID NO: 16890 - RNA, 19 nt, Homo sapiens
uucuuuucaguugaaauga

SEQ ID NO: 16891 - RNA, 21 nt, Homo sapiens
uuggacuuuauuugucauuug

SEQ ID NO: 16892 - RNA, 17 nt, Homo sapiens
accaugaauacacugga

SEQ ID NO: 16893 - RNA, 21 nt, Homo sapiens
guagaaaugagacaggggagg

SEQ ID NO: 16894 - RNA, 23 nt, Homo sapiens
uauaugacaaaugaacucacugg

SEQ ID NO: 16895 - RNA, 21 nt, Homo sapiens
ugccugaugaaaaauaaaaua

SEQ ID NO: 16896 - RNA, 19 nt, Homo sapiens
uggaaaaauguauaugcag

SEQ ID NO: 16897 - RNA, 23 nt, Homo sapiens
aaacuuacuuaugaguguguuuu

SEQ ID NO: 16898 - RNA, 21 nt, Homo sapiens
auaaucccuaauuuuuucaug

SEQ ID NO: 16899 - RNA, 17 nt, Homo sapiens
auuacccuagacuccua

SEQ ID NO: 16900 - RNA, 22 nt, Homo sapiens
caguguggaggcccucagaggc

SEQ ID NO: 16901 - RNA, 24 nt, Homo sapiens
gagaggggugguaagaggaguggg

SEQ ID NO: 16902 - RNA, 22 nt, Homo sapiens
gcccaccccggcccucgcggug

SEQ ID NO: 16903 - RNA, 21 nt, Homo sapiens
gccgcuucccggccccgccca

SEQ ID NO: 16904 - RNA, 14 nt, Homo sapiens
uccacucccaagag

SEQ ID NO: 16905 - RNA, 21 nt, Homo sapiens
uccagaacaaaaacaaaagga

SEQ ID NO: 16906 - RNA, 17 nt, Homo sapiens
ugccaaacucccucccc

SEQ ID NO: 16907 - RNA, 19 nt, Homo sapiens
uuaaagagggagaaaaaaa

SEQ ID NO: 16908 - RNA, 19 nt, Homo sapiens
uucagguauuuuguagaau

SEQ ID NO: 16909 - RNA, 19 nt, Homo sapiens
agagggugacagcagacac

SEQ ID NO: 16910 - RNA, 22 nt, Homo sapiens
agcgggggcagcgggaacccgc

SEQ ID NO: 16911 - RNA, 15 nt, Homo sapiens
cagcagccuuugguu

SEQ ID NO: 16912 - RNA, 18 nt, Homo sapiens
cccgucccgcggugccgc

SEQ ID NO: 16913 - RNA, 17 nt, Homo sapiens
ccuccucuuccuagccc

SEQ ID NO: 16914 - RNA, 23 nt, Homo sapiens
ccugcccgggagauuccggaucc

SEQ ID NO: 16915 - RNA, 19 nt, Homo sapiens
ccuuugguucggaaauguc

SEQ ID NO: 16916 - RNA, 19 nt, Homo sapiens
cgggaacccgcccgcgccu

SEQ ID NO: 16917 - RNA, 19 nt, Homo sapiens
gcaucccaggagaugaugg

SEQ ID NO: 16918 - RNA, 23 nt, Homo sapiens
gcaucccaggagaugauggcggc

SEQ ID NO: 16919 - RNA, 18 nt, Homo sapiens
ggaacccgcccgcgccuc

SEQ ID NO: 16920 - RNA, 19 nt, Homo sapiens
ggcugggaagaaagauccc

SEQ ID NO: 16921 - RNA, 19 nt, Homo sapiens
uaaaacuaaagcuggagag

SEQ ID NO: 16922 - RNA, 20 nt, Homo sapiens
uguaggaauggcaaagaacu

SEQ ID NO: 16923 - RNA, 17 nt, Homo sapiens
uugaggaaagaaaagaa

SEQ ID NO: 16924 - RNA, 17 nt, Homo sapiens
uuuccaaaccugccaga

SEQ ID NO: 16925 - RNA, 18 nt, Homo sapiens
cccgggaccccggcccgg

SEQ ID NO: 16926 - RNA, 21 nt, Homo sapiens
cggagcgcggccgcccgcucc

SEQ ID NO: 16927 - RNA, 25 nt, Homo sapiens
cuguuguuuugugugugugugugua

SEQ ID NO: 16928 - RNA, 20 nt, Homo sapiens
agccacugucggggaucggg

SEQ ID NO: 16929 - RNA, 19 nt, Homo sapiens
ccuggcccuguccaugccc

SEQ ID NO: 16930 - RNA, 20 nt, Homo sapiens
ggcagacgcgggggccgcua

SEQ ID NO: 16931 - RNA, 22 nt, Homo sapiens
ggggggcggggcagggacaggg

SEQ ID NO: 16932 - RNA, 17 nt, Homo sapiens
ggggguugccucagagc

SEQ ID NO: 16933 - RNA, 21 nt, Homo sapiens
gcagcagcacagguggacagg

SEQ ID NO: 16934 - RNA, 22 nt, Homo sapiens
agggcucccggagggggcgacg

SEQ ID NO: 16935 - RNA, 21 nt, Homo sapiens
agguggguggcgggucccugc

SEQ ID NO: 16936 - RNA, 23 nt, Homo sapiens
cagaucacucgcuacuacagcca

SEQ ID NO: 16937 - RNA, 21 nt, Homo sapiens
cagcaggggggccccggcggc

SEQ ID NO: 16938 - RNA, 22 nt, Homo sapiens
caguuugaaaggcaagggggcu

SEQ ID NO: 16939 - RNA, 21 nt, Homo sapiens
cucaccccagggcucccggag

SEQ ID NO: 16940 - RNA, 19 nt, Homo sapiens
gcccuggagcccaccuggc

SEQ ID NO: 16941 - RNA, 19 nt, Homo sapiens
gccgcagccgcugacccga

SEQ ID NO: 16942 - RNA, 19 nt, Homo sapiens
gcggaggggagagugggga

SEQ ID NO: 16943 - RNA, 22 nt, Homo sapiens
gcucccagcccccaaccguccc

SEQ ID NO: 16944 - RNA, 17 nt, Homo sapiens
ggcugggaggagguggc

SEQ ID NO: 16945 - RNA, 22 nt, Homo sapiens
gggcugggaggagguggcuggg

SEQ ID NO: 16946 - RNA, 19 nt, Homo sapiens
gggucccugcggcggcgcc

SEQ ID NO: 16947 - RNA, 21 nt, Homo sapiens
ggguuagcagggaggguuggc

SEQ ID NO: 16948 - RNA, 18 nt, Homo sapiens
uacccgcccgccaccacc

SEQ ID NO: 16949 - RNA, 23 nt, Homo sapiens
ugccagacucgccccguggcaga

SEQ ID NO: 16950 - RNA, 18 nt, Homo sapiens
ugcuccuuuguucggcug

SEQ ID NO: 16951 - RNA, 23 nt, Homo sapiens
acaaaauuaucagcagcagucuu

SEQ ID NO: 16952 - RNA, 21 nt, Homo sapiens
agccagcccaggaacgcaggc

SEQ ID NO: 16953 - RNA, 20 nt, Homo sapiens
cagaggggggccucgggggu

SEQ ID NO: 16954 - RNA, 20 nt, Homo sapiens
ccugcuugcuggccugcccg

SEQ ID NO: 16955 - RNA, 16 nt, Homo sapiens
cucccgacgucugucc

SEQ ID NO: 16956 - RNA, 18 nt, Homo sapiens
gccuaggaggaaccugaa

SEQ ID NO: 16957 - RNA, 18 nt, Homo sapiens
ggucccuggccgccgccg

SEQ ID NO: 16958 - RNA, 18 nt, Homo sapiens
gguggguggggaggggug

SEQ ID NO: 16959 - RNA, 17 nt, Homo sapiens
ucauugucauugucguu

SEQ ID NO: 16960 - RNA, 17 nt, Homo sapiens
ucucuccugaaaagaga

SEQ ID NO: 16961 - RNA, 16 nt, Homo sapiens
uggaaggauggugggu

SEQ ID NO: 16962 - RNA, 19 nt, Homo sapiens
ugggagaacuaggaguguu

SEQ ID NO: 16963 - RNA, 19 nt, Homo sapiens
uggguggggaggggugggg

SEQ ID NO: 16964 - RNA, 17 nt, Homo sapiens
cuacuugcugaacuuug

SEQ ID NO: 16965 - RNA, 20 nt, Homo sapiens
gagaagaggaaagauuuucu

SEQ ID NO: 16966 - RNA, 21 nt, Homo sapiens
gggaggggguccuucacuugg

SEQ ID NO: 16967 - RNA, 20 nt, Homo sapiens
gguccacaaguagcaguuuc

SEQ ID NO: 16968 - RNA, 17 nt, Homo sapiens
uaacucagcccucauuc

SEQ ID NO: 16969 - RNA, 23 nt, Homo sapiens
ugaguggcagauuuucaugaaaa

SEQ ID NO: 16970 - RNA, 21 nt, Homo sapiens
cgccgcucccggggcuccagg

SEQ ID NO: 16971 - RNA, 18 nt, Homo sapiens
cgggaccgcgcgcgccgc

SEQ ID NO: 16972 - RNA, 22 nt, Homo sapiens
ggccgggaccgcgcgcgccgcu

SEQ ID NO: 16973 - RNA, 21 nt, Homo sapiens
aagggggagacuccuucaagu

SEQ ID NO: 16974 - RNA, 19 nt, Homo sapiens
agaguggguccccggcccg

SEQ ID NO: 16975 - RNA, 22 nt, Homo sapiens
agggggggaggggugcgcuggg

SEQ ID NO: 16976 - RNA, 19 nt, Homo sapiens
caacaucuccuccuccggc

SEQ ID NO: 16977 - RNA, 23 nt, Homo sapiens
ccacgcgcgcucacacccucgcg

SEQ ID NO: 16978 - RNA, 20 nt, Homo sapiens
cccucaacaucuccuccucc

SEQ ID NO: 16979 - RNA, 18 nt, Homo sapiens
ccgccgccgccagcuccc

SEQ ID NO: 16980 - RNA, 20 nt, Homo sapiens
ccgccgcgcuccuugauccg

SEQ ID NO: 16981 - RNA, 24 nt, Homo sapiens
cgucuguccuuuucguuucuuuuu

SEQ ID NO: 16982 - RNA, 15 nt, Homo sapiens
cguuggaagggggag

SEQ ID NO: 16983 - RNA, 16 nt, Homo sapiens
cuccgcgucccuccgg

SEQ ID NO: 16984 - RNA, 17 nt, Homo sapiens
cucucccucucucucgc

SEQ ID NO: 16985 - RNA, 20 nt, Homo sapiens
gcaggaagggggagacuccu

SEQ ID NO: 16986 - RNA, 20 nt, Homo sapiens
gccucggcucggcgggcgcc

SEQ ID NO: 16987 - RNA, 19 nt, Homo sapiens
gcgcuggguucuccccucc

SEQ ID NO: 16988 - RNA, 23 nt, Homo sapiens
gcucucucaccgcgcugcaguuu

SEQ ID NO: 16989 - RNA, 19 nt, Homo sapiens
ggaagggggagggggucuc

SEQ ID NO: 16990 - RNA, 17 nt, Homo sapiens
ggguccaaaacgccgcc

SEQ ID NO: 16991 - RNA, 17 nt, Homo sapiens
gucuguccuuuucguuu

SEQ ID NO: 16992 - RNA, 17 nt, Homo sapiens
ucgcagaggaguuauag

SEQ ID NO: 16993 - RNA, 20 nt, Homo sapiens
ucucucagucccggcguucc

SEQ ID NO: 16994 - RNA, 16 nt, Homo sapiens
ucugccaucggccaaa

SEQ ID NO: 16995 - RNA, 18 nt, Homo sapiens
uuuucuuucuuuuuuccc

SEQ ID NO: 16996 - RNA, 21 nt, Homo sapiens
uuuuuuuuuccgaaaccacuc

SEQ ID NO: 16997 - RNA, 23 nt, Homo sapiens
aaaacuacucauuucacuuuaac

SEQ ID NO: 16998 - RNA, 23 nt, Homo sapiens
aacaucucugcccaaaagaguug

SEQ ID NO: 16999 - RNA, 22 nt, Homo sapiens
aagcgggaggggaggcgggaag

SEQ ID NO: 17000 - RNA, 25 nt, Homo sapiens
aauuucuuugcgucacgacaucuua

SEQ ID NO: 17001 - RNA, 24 nt, Homo sapiens
aggucaaacacugcggcggcguuc

SEQ ID NO: 17002 - RNA, 19 nt, Homo sapiens
agucggggggccgggggag

SEQ ID NO: 17003 - RNA, 20 nt, Homo sapiens
agugguuuguuucucuguag

SEQ ID NO: 17004 - RNA, 22 nt, Homo sapiens
auguaucaaaaauguuucaaua

SEQ ID NO: 17005 - RNA, 18 nt, Homo sapiens
caccagcacggagcacgu

SEQ ID NO: 17006 - RNA, 14 nt, Homo sapiens
cacccgccaccccc

SEQ ID NO: 17007 - RNA, 15 nt, Homo sapiens
cagccuaacccccua

SEQ ID NO: 17008 - RNA, 17 nt, Homo sapiens
ccaccuucguugcggcg

SEQ ID NO: 17009 - RNA, 19 nt, Homo sapiens
cccccugcuccccacgccc

SEQ ID NO: 17010 - RNA, 19 nt, Homo sapiens
cccgccgcgccccgcgccc

SEQ ID NO: 17011 - RNA, 20 nt, Homo sapiens
cccggggcgcgcgugcccgg

SEQ ID NO: 17012 - RNA, 18 nt, Homo sapiens
ccgggugcccucugccac

SEQ ID NO: 17013 - RNA, 17 nt, Homo sapiens
ccuaccuccccuccccc

SEQ ID NO: 17014 - RNA, 22 nt, Homo sapiens
ccuugcgcgucccggacuaccg

SEQ ID NO: 17015 - RNA, 18 nt, Homo sapiens
cgccagcgggaugggucg

SEQ ID NO: 17016 - RNA, 20 nt, Homo sapiens
cgccgccgccggagccccca

SEQ ID NO: 17017 - RNA, 21 nt, Homo sapiens
cggcagccgccugcuccccgg

SEQ ID NO: 17018 - RNA, 19 nt, Homo sapiens
cgggagcccggggcgcgcg

SEQ ID NO: 17019 - RNA, 17 nt, Homo sapiens
cugggucucgugcggag

SEQ ID NO: 17020 - RNA, 19 nt, Homo sapiens
gaggggaggcgggaagggc

SEQ ID NO: 17021 - RNA, 21 nt, Homo sapiens
gcaucuucuucucuccccucc

SEQ ID NO: 17022 - RNA, 19 nt, Homo sapiens
gccgggggagggguggugg

SEQ ID NO: 17023 - RNA, 20 nt, Homo sapiens
gcggguccuaccuccccucc

SEQ ID NO: 17024 - RNA, 19 nt, Homo sapiens
gcuuucuuccucucacccc

SEQ ID NO: 17025 - RNA, 22 nt, Homo sapiens
ggacacaggccggucaggaaaa

SEQ ID NO: 17026 - RNA, 15 nt, Homo sapiens
ggcgcgcccaggagc

SEQ ID NO: 17027 - RNA, 19 nt, Homo sapiens
ggggccgggggaggggugg

SEQ ID NO: 17028 - RNA, 16 nt, Homo sapiens
ggggcgcgcgugcccg

SEQ ID NO: 17029 - RNA, 16 nt, Homo sapiens
ggggggccgggggagg

SEQ ID NO: 17030 - RNA, 20 nt, Homo sapiens
ggguggggagaagaggcagg

SEQ ID NO: 17031 - RNA, 18 nt, Homo sapiens
gguucggcccucccaggc

SEQ ID NO: 17032 - RNA, 16 nt, Homo sapiens
guagucauucauaaca

SEQ ID NO: 17033 - RNA, 22 nt, Homo sapiens
gucaggaaaaaugguggggagc

SEQ ID NO: 17034 - RNA, 18 nt, Homo sapiens
gucguggugauuuugcag

SEQ ID NO: 17035 - RNA, 24 nt, Homo sapiens
uaaaaauaagacuuacuuaagaga

SEQ ID NO: 17036 - RNA, 16 nt, Homo sapiens
uaagauauucugucaa

SEQ ID NO: 17037 - RNA, 20 nt, Homo sapiens
uagaguaacaguugugcugc

SEQ ID NO: 17038 - RNA, 21 nt, Homo sapiens
ucaguucacaguuuuuuuuuu

SEQ ID NO: 17039 - RNA, 23 nt, Homo sapiens
uccccacuggcuaggcugccgug

SEQ ID NO: 17040 - RNA, 18 nt, Homo sapiens
ucugcagcaaaagcuugc

SEQ ID NO: 17041 - RNA, 22 nt, Homo sapiens
ugaguucuaacagguuuuaaau

SEQ ID NO: 17042 - RNA, 21 nt, Homo sapiens
ugcuuuauuuuuucauuuuca

SEQ ID NO: 17043 - RNA, 19 nt, Homo sapiens
uguaucaaaaauguuucaa

SEQ ID NO: 17044 - RNA, 21 nt, Homo sapiens
uuacauggagacgguuacuuu

SEQ ID NO: 17045 - RNA, 19 nt, Homo sapiens
uucaccaauugcucauugg

SEQ ID NO: 17046 - RNA, 21 nt, Homo sapiens
auagagguggguggggguggg

SEQ ID NO: 17047 - RNA, 15 nt, Homo sapiens
auggaggaaauacuu

SEQ ID NO: 17048 - RNA, 15 nt, Homo sapiens
ccaguacaucaguuu

SEQ ID NO: 17049 - RNA, 16 nt, Homo sapiens
gggggcgaggcgggag

SEQ ID NO: 17050 - RNA, 17 nt, Homo sapiens
gggggugggggcgaggg

SEQ ID NO: 17051 - RNA, 18 nt, Homo sapiens
ggugggggcgaggcggga

SEQ ID NO: 17052 - RNA, 17 nt, Homo sapiens
uaacaggacaaacccuc

SEQ ID NO: 17053 - RNA, 21 nt, Homo sapiens
auggaggaauaaagugacuuu

SEQ ID NO: 17054 - RNA, 18 nt, Homo sapiens
caggcaaagguuaguggc

SEQ ID NO: 17055 - RNA, 20 nt, Homo sapiens
gaaggugaaaaaacuaccau

SEQ ID NO: 17056 - RNA, 20 nt, Homo sapiens
ugauggaggaauaaagugac

SEQ ID NO: 17057 - RNA, 20 nt, Homo sapiens
uuugugcugugcacuaacaa

SEQ ID NO: 17058 - RNA, 21 nt, Homo sapiens
ccgcugcggucgccaaggccc

SEQ ID NO: 17059 - RNA, 17 nt, Homo sapiens
gggccuccuucagccgc

SEQ ID NO: 17060 - RNA, 17 nt, Homo sapiens
cacuuugguuuacccaa

SEQ ID NO: 17061 - RNA, 26 nt, Homo sapiens
aagcugcaauguguguuggccaucgg

SEQ ID NO: 17062 - RNA, 18 nt, Homo sapiens
acauuuuaaacauugggg

SEQ ID NO: 17063 - RNA, 24 nt, Homo sapiens
acccugaaaugaaaugaacacaaa

SEQ ID NO: 17064 - RNA, 18 nt, Homo sapiens
agcagcuuuuucaugaaa

SEQ ID NO: 17065 - RNA, 18 nt, Homo sapiens
aggcaggcaggcggcagg

SEQ ID NO: 17066 - RNA, 22 nt, Homo sapiens
cccaccacugagccucuagucc

SEQ ID NO: 17067 - RNA, 20 nt, Homo sapiens
ggggaaacacgaaggggagg

SEQ ID NO: 17068 - RNA, 24 nt, Homo sapiens
uaauguauucacuuaaaucuaugu

SEQ ID NO: 17069 - RNA, 18 nt, Homo sapiens
ucauuuuuagcaccguua

SEQ ID NO: 17070 - RNA, 19 nt, Homo sapiens
ugugucuguuacuucccuu

SEQ ID NO: 17071 - RNA, 21 nt, Homo sapiens
aaaguaucucaacaauucuca

SEQ ID NO: 17072 - RNA, 18 nt, Homo sapiens
ugaugagugagcuggaug

SEQ ID NO: 17073 - RNA, 18 nt, Homo sapiens
aguggggggaggggcggg

SEQ ID NO: 17074 - RNA, 19 nt, Homo sapiens
ccgagucggucagaucccc

SEQ ID NO: 17075 - RNA, 18 nt, Homo sapiens
cggagcccggcccgccac

SEQ ID NO: 17076 - RNA, 15 nt, Homo sapiens
gacggucguggggcg

SEQ ID NO: 17077 - RNA, 19 nt, Homo sapiens
ggaguggggggaggggcgg

SEQ ID NO: 17078 - RNA, 20 nt, Homo sapiens
ggaguggggggaggggcggg

SEQ ID NO: 17079 - RNA, 20 nt, Homo sapiens
gggccggcgggggcugcggg

SEQ ID NO: 17080 - RNA, 19 nt, Homo sapiens
ggggaggggcgggugacgg

SEQ ID NO: 17081 - RNA, 22 nt, Homo sapiens
ggggaggggcgggugacggagc

SEQ ID NO: 17082 - RNA, 18 nt, Homo sapiens
gggggccuggaguggggg

SEQ ID NO: 17083 - RNA, 22 nt, Homo sapiens
gggggccuggaguggggggagg

SEQ ID NO: 17084 - RNA, 21 nt, Homo sapiens
ugagaauaacuuuacuuguuu

SEQ ID NO: 17085 - RNA, 16 nt, Homo sapiens
uggacggucguggggc

SEQ ID NO: 17086 - RNA, 19 nt, Homo sapiens
caagagcugggaccggcuc

SEQ ID NO: 17087 - RNA, 16 nt, Homo sapiens
ggguggaaacauggga

SEQ ID NO: 17088 - RNA, 22 nt, Homo sapiens
gugcauugcacuccagccuggg

SEQ ID NO: 17089 - RNA, 18 nt, Homo sapiens
uaaggacgcagcacuggg

SEQ ID NO: 17090 - RNA, 18 nt, Homo sapiens
ugccggguggaaacaugg

SEQ ID NO: 17091 - RNA, 18 nt, Homo sapiens
uggugagagggaaggugc

SEQ ID NO: 17092 - RNA, 19 nt, Homo sapiens
aggcaggacugccccuaug

SEQ ID NO: 17093 - RNA, 17 nt, Homo sapiens
cagcaggcaugaaugcu

SEQ ID NO: 17094 - RNA, 16 nt, Homo sapiens
ggagccacagggcucu

SEQ ID NO: 17095 - RNA, 18 nt, Homo sapiens
ucccaccccuuaaguucu

SEQ ID NO: 17096 - RNA, 20 nt, Homo sapiens
cuugcuugguccuagaaucc

SEQ ID NO: 17097 - RNA, 15 nt, Homo sapiens
gagagagagagagag

SEQ ID NO: 17098 - RNA, 21 nt, Homo sapiens
uagaaacuuugacaccccuca

SEQ ID NO: 17099 - RNA, 21 nt, Homo sapiens
ccgcggccuccgcuccacacc

SEQ ID NO: 17100 - RNA, 22 nt, Homo sapiens
ccuaagucuuauuccaagcuaa

SEQ ID NO: 17101 - RNA, 20 nt, Homo sapiens
cggggggugaggggcguggg

SEQ ID NO: 17102 - RNA, 18 nt, Homo sapiens
gacaugaugauugugacu

SEQ ID NO: 17103 - RNA, 18 nt, Homo sapiens
gggacccaaugaaucagg

SEQ ID NO: 17104 - RNA, 16 nt, Homo sapiens
agaggagcacggagag

SEQ ID NO: 17105 - RNA, 21 nt, Homo sapiens
agauuaucugcucgagugggu

SEQ ID NO: 17106 - RNA, 18 nt, Homo sapiens
uaccaagaggagcacgga

SEQ ID NO: 17107 - RNA, 18 nt, Homo sapiens
uccaaaucuugguccaag

SEQ ID NO: 17108 - RNA, 22 nt, Homo sapiens
uccaacccuucuuugguggcac

SEQ ID NO: 17109 - RNA, 24 nt, Homo sapiens
ugguacuaugcuauauauauccuc

SEQ ID NO: 17110 - RNA, 23 nt, Homo sapiens
uauacauauuaccgaaggcaaag

SEQ ID NO: 17111 - RNA, 18 nt, Homo sapiens
ugguguaacagacuagau

SEQ ID NO: 17112 - RNA, 19 nt, Homo sapiens
ccgcagcacaacgggacca

SEQ ID NO: 17113 - RNA, 19 nt, Homo sapiens
cgggcggcgcggggcgcgg

SEQ ID NO: 17114 - RNA, 20 nt, Homo sapiens
cgggcgggcgggcggcgcgg

SEQ ID NO: 17115 - RNA, 14 nt, Homo sapiens
aagcaggaaaugua

SEQ ID NO: 17116 - RNA, 23 nt, Homo sapiens
gcucuucacagagaugucuacag

SEQ ID NO: 17117 - RNA, 21 nt, Homo sapiens
gcauauacgcgagaugcaaac

SEQ ID NO: 17118 - RNA, 17 nt, Homo sapiens
ccagagaaaagaaaaca

SEQ ID NO: 17119 - RNA, 23 nt, Homo sapiens
aagugacuucccugcuaaagcuc

SEQ ID NO: 17120 - RNA, 24 nt, Homo sapiens
aagggcuaagagagaagagauugc

SEQ ID NO: 17121 - RNA, 20 nt, Homo sapiens
cugcacaagggaaaccaagu

SEQ ID NO: 17122 - RNA, 25 nt, Homo sapiens
gagggccccggcgcgagaggugggc

SEQ ID NO: 17123 - RNA, 20 nt, Homo sapiens
gcggggagggggaugggggg

SEQ ID NO: 17124 - RNA, 19 nt, Homo sapiens
gcggggggggcgcggggag

SEQ ID NO: 17125 - RNA, 21 nt, Homo sapiens
gcuggggggacgcgggggggg

SEQ ID NO: 17126 - RNA, 21 nt, Homo sapiens
ggacgcggggggggcgcgggg

SEQ ID NO: 17127 - RNA, 23 nt, Homo sapiens
ggcgcggggagggggaugggggg

SEQ ID NO: 17128 - RNA, 18 nt, Homo sapiens
ggggcgcggggaggggga

SEQ ID NO: 17129 - RNA, 18 nt, Homo sapiens
ggggggacgcgggggggg

SEQ ID NO: 17130 - RNA, 24 nt, Homo sapiens
ggggggcgcggggagggggauggg

SEQ ID NO: 17131 - RNA, 20 nt, Homo sapiens
uaaaucauuuucacagacca

SEQ ID NO: 17132 - RNA, 20 nt, Homo sapiens
agagaggaagccuggagagc

SEQ ID NO: 17133 - RNA, 19 nt, Homo sapiens
ccuagaacagcaggaagga

SEQ ID NO: 17134 - RNA, 19 nt, Homo sapiens
cuugauucuugucucacug

SEQ ID NO: 17135 - RNA, 18 nt, Homo sapiens
gaugccaugucaacauag

SEQ ID NO: 17136 - RNA, 16 nt, Homo sapiens
ggagugggauccuggg

SEQ ID NO: 17137 - RNA, 21 nt, Homo sapiens
gucuuuaggcaggucaggucu

SEQ ID NO: 17138 - RNA, 16 nt, Homo sapiens
uagaugaugcuaauug

SEQ ID NO: 17139 - RNA, 16 nt, Homo sapiens
ucccugcaacguaggc

SEQ ID NO: 17140 - RNA, 20 nt, Homo sapiens
uccuacugcugcugccaagc

SEQ ID NO: 17141 - RNA, 21 nt, Homo sapiens
ugaaaauggagacuuuuugug

SEQ ID NO: 17142 - RNA, 19 nt, Homo sapiens
aacacugguuucuuaaagu

SEQ ID NO: 17143 - RNA, 21 nt, Homo sapiens
agucagaagcgccccucacag

SEQ ID NO: 17144 - RNA, 15 nt, Homo sapiens
cauuucuccucccac

SEQ ID NO: 17145 - RNA, 18 nt, Homo sapiens
cuccucccacuugaggcu

SEQ ID NO: 17146 - RNA, 22 nt, Homo sapiens
gaggagugccacgggaguguga

SEQ ID NO: 17147 - RNA, 21 nt, Homo sapiens
aagcaguggcugccccagccc

SEQ ID NO: 17148 - RNA, 22 nt, Homo sapiens
cagcaggcccugggggugaggc

SEQ ID NO: 17149 - RNA, 18 nt, Homo sapiens
caggagaagcuuagugag

SEQ ID NO: 17150 - RNA, 18 nt, Homo sapiens
cagggucccuugagcugc

SEQ ID NO: 17151 - RNA, 19 nt, Homo sapiens
cauagucucauacacguau

SEQ ID NO: 17152 - RNA, 18 nt, Homo sapiens
ccccagcccgcuguuucc

SEQ ID NO: 17153 - RNA, 17 nt, Homo sapiens
gauggggcaacagaaaa

SEQ ID NO: 17154 - RNA, 19 nt, Homo sapiens
gccucggcaaccccucugc

SEQ ID NO: 17155 - RNA, 15 nt, Homo sapiens
gcuggcacggcagca

SEQ ID NO: 17156 - RNA, 22 nt, Homo sapiens
gggcacuuccaggccccauagg

SEQ ID NO: 17157 - RNA, 19 nt, Homo sapiens
ggggauggagugagagugu

SEQ ID NO: 17158 - RNA, 20 nt, Homo sapiens
ugccccagcccgcuguuucc

SEQ ID NO: 17159 - RNA, 20 nt, Homo sapiens
ugccuugagagggagaaugg

SEQ ID NO: 17160 - RNA, 19 nt, Homo sapiens
uguccagagcaggucugug

SEQ ID NO: 17161 - RNA, 20 nt, Homo sapiens
ugugucuguauguuccugcc

SEQ ID NO: 17162 - RNA, 17 nt, Homo sapiens
uuagugagguccuguuc

SEQ ID NO: 17163 - RNA, 20 nt, Homo sapiens
uucagauuguguacaguaga

SEQ ID NO: 17164 - RNA, 19 nt, Homo sapiens
augaaagaugagaauaugg

SEQ ID NO: 17165 - RNA, 17 nt, Homo sapiens
ugugauaugguaugaaa

SEQ ID NO: 17166 - RNA, 18 nt, Homo sapiens
uguuuuucauuugcauug

SEQ ID NO: 17167 - RNA, 24 nt, Homo sapiens
aaagagagaaauuugcuaggaaua

SEQ ID NO: 17168 - RNA, 19 nt, Homo sapiens
aagagaagucuauuaaggc

SEQ ID NO: 17169 - RNA, 18 nt, Homo sapiens
aauugcucuugguccuug

SEQ ID NO: 17170 - RNA, 21 nt, Homo sapiens
agcagcacguuacugguuuua

SEQ ID NO: 17171 - RNA, 18 nt, Homo sapiens
caacaugugagaacugcu

SEQ ID NO: 17172 - RNA, 17 nt, Homo sapiens
ccuaccccuccucccuc

SEQ ID NO: 17173 - RNA, 18 nt, Homo sapiens
ccuccucccucucuuccu

SEQ ID NO: 17174 - RNA, 23 nt, Homo sapiens
ccugccccccuuuccucuuuccc

SEQ ID NO: 17175 - RNA, 19 nt, Homo sapiens
cguggggagaaaagggggg

SEQ ID NO: 17176 - RNA, 20 nt, Homo sapiens
cguuacugguuuuaaaggcu

SEQ ID NO: 17177 - RNA, 18 nt, Homo sapiens
cuuuggaaguuuaagggg

SEQ ID NO: 17178 - RNA, 18 nt, Homo sapiens
ggagggaggggaagaguc

SEQ ID NO: 17179 - RNA, 19 nt, Homo sapiens
gggguggucucaggggagc

SEQ ID NO: 17180 - RNA, 17 nt, Homo sapiens
guuccuggaauuuccag

SEQ ID NO: 17181 - RNA, 18 nt, Homo sapiens
uacaaaacuaaaucuaua

SEQ ID NO: 17182 - RNA, 23 nt, Homo sapiens
uaguaggccuuaucacacuguaa

SEQ ID NO: 17183 - RNA, 20 nt, Homo sapiens
ucaugcaauuuucuuuaagg

SEQ ID NO: 17184 - RNA, 19 nt, Homo sapiens
uccauaaguuuggggaccu

SEQ ID NO: 17185 - RNA, 21 nt, Homo sapiens
ucuaacuuagaauauggucua

SEQ ID NO: 17186 - RNA, 18 nt, Homo sapiens
uguagauauauguauugu

SEQ ID NO: 17187 - RNA, 17 nt, Homo sapiens
ugugaauaaccucuccc

SEQ ID NO: 17188 - RNA, 18 nt, Homo sapiens
uuuuuugaaaccaauaaa

SEQ ID NO: 17189 - RNA, 21 nt, Homo sapiens
agcggcggguagggcagcggg

SEQ ID NO: 17190 - RNA, 19 nt, Homo sapiens
agggggcagugggggcggc

SEQ ID NO: 17191 - RNA, 20 nt, Homo sapiens
gggaugcggcggcagcggcg

SEQ ID NO: 17192 - RNA, 18 nt, Homo sapiens
gggggcagugggggcggc

SEQ ID NO: 17193 - RNA, 20 nt, Homo sapiens
uccuuaagguuauuaacaau

SEQ ID NO: 17194 - RNA, 21 nt, Homo sapiens
ugcuggggcccggcccgcgac

SEQ ID NO: 17195 - RNA, 21 nt, Homo sapiens
ugggggcggcuguugaggcag

SEQ ID NO: 17196 - RNA, 23 nt, Homo sapiens
ugggaacuuucacauauuuguuc

SEQ ID NO: 17197 - RNA, 21 nt, Homo sapiens
acaaaugagguggcagagcag

SEQ ID NO: 17198 - RNA, 19 nt, Homo sapiens
cugcugggcugcugggcug

SEQ ID NO: 17199 - RNA, 20 nt, Homo sapiens
gcugcugggcugcugggcug

SEQ ID NO: 17200 - RNA, 17 nt, Homo sapiens
gugggcugcugggcugc

SEQ ID NO: 17201 - RNA, 20 nt, Homo sapiens
agagaugauauauguuugug

SEQ ID NO: 17202 - RNA, 16 nt, Homo sapiens
ccgccgccuccucagg

SEQ ID NO: 17203 - RNA, 21 nt, Homo sapiens
ccucgucccgcgacgccugcg

SEQ ID NO: 17204 - RNA, 19 nt, Homo sapiens
cgagaggguacagggucug

SEQ ID NO: 17205 - RNA, 18 nt, Homo sapiens
cucuuacaaacacgauga

SEQ ID NO: 17206 - RNA, 14 nt, Homo sapiens
cugacugaagaugc

SEQ ID NO: 17207 - RNA, 22 nt, Homo sapiens
cuucaguguguccagcaguuuc

SEQ ID NO: 17208 - RNA, 20 nt, Homo sapiens
uauccugauugucaccuccc

SEQ ID NO: 17209 - RNA, 19 nt, Homo sapiens
ucccucgggaucacagcac

SEQ ID NO: 17210 - RNA, 19 nt, Homo sapiens
ucugacgacuaaucucagu

SEQ ID NO: 17211 - RNA, 19 nt, Homo sapiens
ugagagcaggcacugaggg

SEQ ID NO: 17212 - RNA, 15 nt, Homo sapiens
ugccuggggacagaa

SEQ ID NO: 17213 - RNA, 18 nt, Homo sapiens
uuugguccgagggagggg

SEQ ID NO: 17214 - RNA, 23 nt, Homo sapiens
ucacuguauccacaaccuccugg

SEQ ID NO: 17215 - RNA, 20 nt, Homo sapiens
ugucauaacucacuguaucc

SEQ ID NO: 17216 - RNA, 15 nt, Homo sapiens
ccagggagggaaaaa

SEQ ID NO: 17217 - RNA, 23 nt, Homo sapiens
ccccaguuuccgaaucuguucuc

SEQ ID NO: 17218 - RNA, 22 nt, Homo sapiens
ccuccccaguuuccgaaucugu

SEQ ID NO: 17219 - RNA, 19 nt, Homo sapiens
uuccgcugcugcugggaaa

SEQ ID NO: 17220 - RNA, 22 nt, Homo sapiens
aagugcuaucuacggacuaucu

SEQ ID NO: 17221 - RNA, 21 nt, Homo sapiens
aggguugagggguguacaaga

SEQ ID NO: 17222 - RNA, 15 nt, Homo sapiens
cugaagguggguggg

SEQ ID NO: 17223 - RNA, 14 nt, Homo sapiens
gagcaggugggggc

SEQ ID NO: 17224 - RNA, 18 nt, Homo sapiens
ggcagguggaggcaggcg

SEQ ID NO: 17225 - RNA, 18 nt, Homo sapiens
gguuuguaagugcaaccc

SEQ ID NO: 17226 - RNA, 20 nt, Homo sapiens
uagcagggcauacagucuca

SEQ ID NO: 17227 - RNA, 18 nt, Homo sapiens
ucuuucacuaguacaaag

SEQ ID NO: 17228 - RNA, 15 nt, Homo sapiens
ugacgugggaaucca

SEQ ID NO: 17229 - RNA, 18 nt, Homo sapiens
ccucguuuccuucucccu

SEQ ID NO: 17230 - RNA, 16 nt, Homo sapiens
ccugaaaagaaagccc

SEQ ID NO: 17231 - RNA, 18 nt, Homo sapiens
cugucccauuaaauucca

SEQ ID NO: 17232 - RNA, 18 nt, Homo sapiens
gcccgcugccacgcuggc

SEQ ID NO: 17233 - RNA, 18 nt, Homo sapiens
uccaaaauauuuuaauag

SEQ ID NO: 17234 - RNA, 18 nt, Homo sapiens
aggcauccuugggcauuu

SEQ ID NO: 17235 - RNA, 18 nt, Homo sapiens
ccgcggcucuuccuccuc

SEQ ID NO: 17236 - RNA, 18 nt, Homo sapiens
gaaagggauuuggaaaca

SEQ ID NO: 17237 - RNA, 20 nt, Homo sapiens
gccgggguggccucagccgc

SEQ ID NO: 17238 - RNA, 21 nt, Homo sapiens
gccucagccgccgggcccgcg

SEQ ID NO: 17239 - RNA, 17 nt, Homo sapiens
gcgcagcgcggggccac

SEQ ID NO: 17240 - RNA, 18 nt, Homo sapiens
ugaguccugggacaggcu

SEQ ID NO: 17241 - RNA, 18 nt, Homo sapiens
uccccuccccgcuuuccu

SEQ ID NO: 17242 - RNA, 18 nt, Homo sapiens
gguggaagguggggggag

SEQ ID NO: 17243 - RNA, 23 nt, Homo sapiens
ucaugcugggaguuguaguauca

SEQ ID NO: 17244 - RNA, 19 nt, Homo sapiens
cccgccguccccgaagccc

SEQ ID NO: 17245 - RNA, 18 nt, Homo sapiens
gcgcgccucccuccccuc

SEQ ID NO: 17246 - RNA, 17 nt, Homo sapiens
gcucuuggccgccgccc

SEQ ID NO: 17247 - RNA, 16 nt, Homo sapiens
ggccgccgcccuuccg

SEQ ID NO: 17248 - RNA, 17 nt, Homo sapiens
uaaccugagacugccac

SEQ ID NO: 17249 - RNA, 18 nt, Homo sapiens
uaccuaguaggucaaucc

SEQ ID NO: 17250 - RNA, 18 nt, Homo sapiens
ucaucuguaagccaccug

SEQ ID NO: 17251 - RNA, 18 nt, Homo sapiens
aaaaacuaaaaccugaaa

SEQ ID NO: 17252 - RNA, 16 nt, Homo sapiens
ggcugcaggcggccug

SEQ ID NO: 17253 - RNA, 19 nt, Homo sapiens
aauagucuaaaaaaucagu

SEQ ID NO: 17254 - RNA, 24 nt, Homo sapiens
agcggggugggaggggaagggaag

SEQ ID NO: 17255 - RNA, 18 nt, Homo sapiens
aggggaggggagggcagg

SEQ ID NO: 17256 - RNA, 20 nt, Homo sapiens
aggggaggggagggcagggg

SEQ ID NO: 17257 - RNA, 16 nt, Homo sapiens
aguggaggggaaggga

SEQ ID NO: 17258 - RNA, 20 nt, Homo sapiens
auggcuuguuuggcaggaag

SEQ ID NO: 17259 - RNA, 18 nt, Homo sapiens
caugugccaaaaguuaug

SEQ ID NO: 17260 - RNA, 18 nt, Homo sapiens
cuaugucaugugccaaaa

SEQ ID NO: 17261 - RNA, 15 nt, Homo sapiens
cuguaaagucggccc

SEQ ID NO: 17262 - RNA, 20 nt, Homo sapiens
ggaggggagggcagggggca

SEQ ID NO: 17263 - RNA, 24 nt, Homo sapiens
gggaagggaggggaggggagggca

SEQ ID NO: 17264 - RNA, 17 nt, Homo sapiens
ggugcaacgaugaauug

SEQ ID NO: 17265 - RNA, 18 nt, Homo sapiens
ucuaugucaugugccaaa

SEQ ID NO: 17266 - RNA, 21 nt, Homo sapiens
ugaguuaagauuuaauugucc

SEQ ID NO: 17267 - RNA, 19 nt, Homo sapiens
ugggaggggaagggaagga

SEQ ID NO: 17268 - RNA, 18 nt, Homo sapiens
aggggagaauuuugugac

SEQ ID NO: 17269 - RNA, 15 nt, Homo sapiens
cagcugccacuuacc

SEQ ID NO: 17270 - RNA, 17 nt, Homo sapiens
caguuggcauucagaac

SEQ ID NO: 17271 - RNA, 22 nt, Homo sapiens
gccguguccggcucuggcuccg

SEQ ID NO: 17272 - RNA, 16 nt, Homo sapiens
ggcgauccguggcggg

SEQ ID NO: 17273 - RNA, 20 nt, Homo sapiens
ucacugcaucuguuuugaag

SEQ ID NO: 17274 - RNA, 18 nt, Homo sapiens
ugcaaugaaacaguaaaa

SEQ ID NO: 17275 - RNA, 17 nt, Homo sapiens
aagaggaugcacacccg

SEQ ID NO: 17276 - RNA, 22 nt, Homo sapiens
acccgggucuuugcuuuccccc

SEQ ID NO: 17277 - RNA, 21 nt, Homo sapiens
accgugccgucuucacaaaaa

SEQ ID NO: 17278 - RNA, 16 nt, Homo sapiens
agcgguuuacaaucua

SEQ ID NO: 17279 - RNA, 21 nt, Homo sapiens
cagcagccuaagaacgcccuc

SEQ ID NO: 17280 - RNA, 19 nt, Homo sapiens
ccccaggucuuaggaaaga

SEQ ID NO: 17281 - RNA, 17 nt, Homo sapiens
ccggaaaggggcggaag

SEQ ID NO: 17282 - RNA, 15 nt, Homo sapiens
ccugacccuccggcc

SEQ ID NO: 17283 - RNA, 14 nt, Homo sapiens
cuagaagugaggcg

SEQ ID NO: 17284 - RNA, 19 nt, Homo sapiens
cucagggcugcagacaugg

SEQ ID NO: 17285 - RNA, 19 nt, Homo sapiens
gacucaggcugcgaaaccc

SEQ ID NO: 17286 - RNA, 17 nt, Homo sapiens
gauggaucaacauaggc

SEQ ID NO: 17287 - RNA, 22 nt, Homo sapiens
gggugcaauggcugacaccugu

SEQ ID NO: 17288 - RNA, 19 nt, Homo sapiens
uaccuuuauguucuuuccc

SEQ ID NO: 17289 - RNA, 18 nt, Homo sapiens
uacgcgguugccuccuca

SEQ ID NO: 17290 - RNA, 19 nt, Homo sapiens
ucgcaaacagcuuuccgcc

SEQ ID NO: 17291 - RNA, 19 nt, Homo sapiens
ucuuugcuuucccccuuuu

SEQ ID NO: 17292 - RNA, 19 nt, Homo sapiens
uggaaaagaauaaagguug

SEQ ID NO: 17293 - RNA, 21 nt, Homo sapiens
uggauggaucaacauaggccu

SEQ ID NO: 17294 - RNA, 15 nt, Homo sapiens
uguacagaugcuauu

SEQ ID NO: 17295 - RNA, 14 nt, Homo sapiens
uugccaguuuuuca

SEQ ID NO: 17296 - RNA, 22 nt, Homo sapiens
aaagaaaaaaaaaaaaggcauu

SEQ ID NO: 17297 - RNA, 22 nt, Homo sapiens
augagcauugagaggaggucug

SEQ ID NO: 17298 - RNA, 20 nt, Homo sapiens
ccuggaggugggcgggaggc

SEQ ID NO: 17299 - RNA, 20 nt, Homo sapiens
cgggcgcgguggcucacgcg

SEQ ID NO: 17300 - RNA, 16 nt, Homo sapiens
gaacccaggaggcgga

SEQ ID NO: 17301 - RNA, 16 nt, Homo sapiens
gagcagaugauagggu

SEQ ID NO: 17302 - RNA, 23 nt, Homo sapiens
gagguugcaguaagccaagauca

SEQ ID NO: 17303 - RNA, 24 nt, Homo sapiens
gcacaagagggacgcgcggcgguc

SEQ ID NO: 17304 - RNA, 18 nt, Homo sapiens
gcaguggcuccagcgcgg

SEQ ID NO: 17305 - RNA, 21 nt, Homo sapiens
gcgugaacccgagaggcggag

SEQ ID NO: 17306 - RNA, 19 nt, Homo sapiens
ggagaucccugagcugcgc

SEQ ID NO: 17307 - RNA, 18 nt, Homo sapiens
ggcugaagaacuaggcag

SEQ ID NO: 17308 - RNA, 20 nt, Homo sapiens
gugagauuuuauaacaaaau

SEQ ID NO: 17309 - RNA, 20 nt, Homo sapiens
ugugagauuuuauaacaaaa

SEQ ID NO: 17310 - RNA, 17 nt, Homo sapiens
uugggaggccgaggcgg

SEQ ID NO: 17311 - RNA, 17 nt, Homo sapiens
uugggaggcugaggugg

SEQ ID NO: 17312 - RNA, 21 nt, Homo sapiens
uacaguguuacagugucaggc

SEQ ID NO: 17313 - RNA, 23 nt, Homo sapiens
ucaaugccaacuuuuaaaagguc

SEQ ID NO: 17314 - RNA, 23 nt, Homo sapiens
aggcagggaggcggggcuguggc

SEQ ID NO: 17315 - RNA, 16 nt, Homo sapiens
caccugcagacugcag

SEQ ID NO: 17316 - RNA, 18 nt, Homo sapiens
uggcgcggccuccucgcc

SEQ ID NO: 17317 - RNA, 19 nt, Homo sapiens
aaggagaaguguuuaugug

SEQ ID NO: 17318 - RNA, 18 nt, Homo sapiens
gcuccugcgcccgcuccc

SEQ ID NO: 17319 - RNA, 20 nt, Homo sapiens
cagaggcuucuggcuggcaa

SEQ ID NO: 17320 - RNA, 22 nt, Homo sapiens
cugucaucggaaggaacggggc

SEQ ID NO: 17321 - RNA, 17 nt, Homo sapiens
cugugaauggggagggg

SEQ ID NO: 17322 - RNA, 17 nt, Homo sapiens
gggacccggggcagccu

SEQ ID NO: 17323 - RNA, 21 nt, Homo sapiens
gggccugugggggcccugggg

SEQ ID NO: 17324 - RNA, 20 nt, Homo sapiens
guggcagugggggauggggg

SEQ ID NO: 17325 - RNA, 22 nt, Homo sapiens
ugaauggggaggggugcacacu

SEQ ID NO: 17326 - RNA, 18 nt, Homo sapiens
uggggaggggugcacacu

SEQ ID NO: 17327 - RNA, 20 nt, Homo sapiens
aaggaccagaauguuuaugc

SEQ ID NO: 17328 - RNA, 23 nt, Homo sapiens
agguccagguccagguccagguc

SEQ ID NO: 17329 - RNA, 15 nt, Homo sapiens
auaagcccaguuguu

SEQ ID NO: 17330 - RNA, 18 nt, Homo sapiens
gaauauugggaaucuccu

SEQ ID NO: 17331 - RNA, 21 nt, Homo sapiens
gagagcuuguguguuugggga

SEQ ID NO: 17332 - RNA, 22 nt, Homo sapiens
uauuuugucaugugcucaacag

SEQ ID NO: 17333 - RNA, 16 nt, Homo sapiens
uccacuccacccgagu

SEQ ID NO: 17334 - RNA, 15 nt, Homo sapiens
ucuaaaucucaaagc

SEQ ID NO: 17335 - RNA, 18 nt, Homo sapiens
ucuuuuguuguugcuggg

SEQ ID NO: 17336 - RNA, 21 nt, Homo sapiens
ugaaugacaugcgugauguug

SEQ ID NO: 17337 - RNA, 19 nt, Homo sapiens
ugguaggcagaggcccgag

SEQ ID NO: 17338 - RNA, 25 nt, Homo sapiens
aaaaaugagagcaagagaaaugcua

SEQ ID NO: 17339 - RNA, 22 nt, Homo sapiens
aggagaggucaccuucuaucua

SEQ ID NO: 17340 - RNA, 25 nt, Homo sapiens
cgguucacuuugccccgcacgagcu

SEQ ID NO: 17341 - RNA, 18 nt, Homo sapiens
gcagaagcgacacacugc

SEQ ID NO: 17342 - RNA, 14 nt, Homo sapiens
ggaaagcuucuggc

SEQ ID NO: 17343 - RNA, 20 nt, Homo sapiens
uacugauaacucuggaacug

SEQ ID NO: 17344 - RNA, 16 nt, Homo sapiens
uaucacacuaccugcc

SEQ ID NO: 17345 - RNA, 19 nt, Homo sapiens
uauuauuagaaauaaagca

SEQ ID NO: 17346 - RNA, 17 nt, Homo sapiens
ugggacaggggcagaug

SEQ ID NO: 17347 - RNA, 17 nt, Homo sapiens
ugggagggggaggcggc

SEQ ID NO: 17348 - RNA, 22 nt, Homo sapiens
uuuaugaaggaaagcuucuggg

SEQ ID NO: 17349 - RNA, 17 nt, Homo sapiens
ggaguuggggucugguu

SEQ ID NO: 17350 - RNA, 16 nt, Homo sapiens
uaaaguguucucgcgg

SEQ ID NO: 17351 - RNA, 20 nt, Homo sapiens
ugggacagagagaggagcau

SEQ ID NO: 17352 - RNA, 22 nt, Homo sapiens
cccagcuuuaauaucuaccaga

SEQ ID NO: 17353 - RNA, 18 nt, Homo sapiens
ccccagagaccugggccc

SEQ ID NO: 17354 - RNA, 18 nt, Homo sapiens
cuacuuguugacaacugc

SEQ ID NO: 17355 - RNA, 18 nt, Homo sapiens
gacugauccuauaugcug

SEQ ID NO: 17356 - RNA, 22 nt, Homo sapiens
gaggccgcugaugcggcggcuc

SEQ ID NO: 17357 - RNA, 20 nt, Homo sapiens
gcauauagcucagggaaccc

SEQ ID NO: 17358 - RNA, 17 nt, Homo sapiens
ggauauaucaacauuua

SEQ ID NO: 17359 - RNA, 18 nt, Homo sapiens
ucaguuagcaaacugagg

SEQ ID NO: 17360 - RNA, 25 nt, Homo sapiens
uuaauugcuccuaaucccugaugca

SEQ ID NO: 17361 - RNA, 18 nt, Homo sapiens
cuuugggaaaaaaagggg

SEQ ID NO: 17362 - RNA, 22 nt, Homo sapiens
gaaaaaagaaguaguuuuuugg

SEQ ID NO: 17363 - RNA, 22 nt, Homo sapiens
gagguugcagugaaccaagauc

SEQ ID NO: 17364 - RNA, 17 nt, Homo sapiens
ucacuugguuuacaacu

SEQ ID NO: 17365 - RNA, 20 nt, Homo sapiens
ucauugcaguccagccuggg

SEQ ID NO: 17366 - RNA, 18 nt, Homo sapiens
uggaaacuugcccuucca

SEQ ID NO: 17367 - RNA, 19 nt, Homo sapiens
uggcaauuuaagaagaaaa

SEQ ID NO: 17368 - RNA, 19 nt, Homo sapiens
acagcuggauuuuaaaaau

SEQ ID NO: 17369 - RNA, 24 nt, Homo sapiens
agguagaugaauccucaauccugg

SEQ ID NO: 17370 - RNA, 18 nt, Homo sapiens
ccccaccucucugagguc

SEQ ID NO: 17371 - RNA, 20 nt, Homo sapiens
cgcgggggcgcuccggccgg

SEQ ID NO: 17372 - RNA, 22 nt, Homo sapiens
cgcugagcccuccucuccucuc

SEQ ID NO: 17373 - RNA, 23 nt, Homo sapiens
cuccggccgggccgcuccgccgg

SEQ ID NO: 17374 - RNA, 21 nt, Homo sapiens
cucgcgggggcgcuccggccg

SEQ ID NO: 17375 - RNA, 18 nt, Homo sapiens
gcucacugacucccuugg

SEQ ID NO: 17376 - RNA, 20 nt, Homo sapiens
gcuccggccgggccgcuccg

SEQ ID NO: 17377 - RNA, 16 nt, Homo sapiens
gggggucguggggagg

SEQ ID NO: 17378 - RNA, 21 nt, Homo sapiens
uaagggaacagugcccaccaa

SEQ ID NO: 17379 - RNA, 18 nt, Homo sapiens
uccggccgggccgcuccg

SEQ ID NO: 17380 - RNA, 18 nt, Homo sapiens
ucguggggagggggcugg

SEQ ID NO: 17381 - RNA, 18 nt, Homo sapiens
acuuucuuccauuaugag

SEQ ID NO: 17382 - RNA, 18 nt, Homo sapiens
aggcaaaaaggaaggccc

SEQ ID NO: 17383 - RNA, 18 nt, Homo sapiens
aggcauauuugauguuca

SEQ ID NO: 17384 - RNA, 19 nt, Homo sapiens
ccugaaaaacguccgggag

SEQ ID NO: 17385 - RNA, 18 nt, Homo sapiens
ccugccacugaagauccc

SEQ ID NO: 17386 - RNA, 18 nt, Homo sapiens
cuucucuucaggcauauu

SEQ ID NO: 17387 - RNA, 15 nt, Homo sapiens
uagacugaccaggau

SEQ ID NO: 17388 - RNA, 21 nt, Homo sapiens
uagguauuuauuuauccaaga

SEQ ID NO: 17389 - RNA, 18 nt, Homo sapiens
uccuaugugagguggggg

SEQ ID NO: 17390 - RNA, 19 nt, Homo sapiens
uccugagaggcuguacaac

SEQ ID NO: 17391 - RNA, 23 nt, Homo sapiens
ucguggcgcucacgugaccgaga

SEQ ID NO: 17392 - RNA, 16 nt, Homo sapiens
ugauacaguuucuuuc

SEQ ID NO: 17393 - RNA, 24 nt, Homo sapiens
cacagcaccuccccccaauuugac

SEQ ID NO: 17394 - RNA, 19 nt, Homo sapiens
cucucggccuggcuguggg

SEQ ID NO: 17395 - RNA, 21 nt, Homo sapiens
gaggcgggugcagagucggag

SEQ ID NO: 17396 - RNA, 17 nt, Homo sapiens
gaggggcggggcgggag

SEQ ID NO: 17397 - RNA, 17 nt, Homo sapiens
gcggggcgggaggagag

SEQ ID NO: 17398 - RNA, 19 nt, Homo sapiens
ggugaggcgugggaggggc

SEQ ID NO: 17399 - RNA, 21 nt, Homo sapiens
ggugaggcgugggaggggcgg

SEQ ID NO: 17400 - RNA, 22 nt, Homo sapiens
ggugaggcgugggaggggcggg

SEQ ID NO: 17401 - RNA, 22 nt, Homo sapiens
ggugggcgcgcggggggcuggu

SEQ ID NO: 17402 - RNA, 18 nt, Homo sapiens
auuguugaucuguugauc

SEQ ID NO: 17403 - RNA, 21 nt, Homo sapiens
cagcauccucuuaauucuuaa

SEQ ID NO: 17404 - RNA, 20 nt, Homo sapiens
gcccccguuugaacacgggg

SEQ ID NO: 17405 - RNA, 19 nt, Homo sapiens
ggccaggagggguucccag

SEQ ID NO: 17406 - RNA, 20 nt, Homo sapiens
uaacacugaaaaaaaaggua

SEQ ID NO: 17407 - RNA, 22 nt, Homo sapiens
uucccagucugugcgguggaga

SEQ ID NO: 17408 - RNA, 22 nt, Homo sapiens
agaggugggggcuggggggugg

SEQ ID NO: 17409 - RNA, 17 nt, Homo sapiens
aggugggggcugggggg

SEQ ID NO: 17410 - RNA, 18 nt, Homo sapiens
ccccagaaugccccagcc

SEQ ID NO: 17411 - RNA, 17 nt, Homo sapiens
gaggagggcuggggggg

SEQ ID NO: 17412 - RNA, 18 nt, Homo sapiens
gggaagggggaggggggc

SEQ ID NO: 17413 - RNA, 25 nt, Homo sapiens
gggaggcgggcaugggaggggcggg

SEQ ID NO: 17414 - RNA, 19 nt, Homo sapiens
gggaggggcgggagggagg

SEQ ID NO: 17415 - RNA, 18 nt, Homo sapiens
uaugugugugugugugug

SEQ ID NO: 17416 - RNA, 20 nt, Homo sapiens
ugaguggcuucguucaaagg

SEQ ID NO: 17417 - RNA, 17 nt, Homo sapiens
uggcuucguucaaaggu

SEQ ID NO: 17418 - RNA, 18 nt, Homo sapiens
ugggagaguggcgaauuc

SEQ ID NO: 17419 - RNA, 20 nt, Homo sapiens
ugggaggggcgggagggagg

SEQ ID NO: 17420 - RNA, 21 nt, Homo sapiens
uguguaugugugugugugugu

SEQ ID NO: 17421 - RNA, 18 nt, Homo sapiens
ugugugugugugugugug

SEQ ID NO: 17422 - RNA, 20 nt, Homo sapiens
ugugugugugugugugugua

SEQ ID NO: 17423 - RNA, 17 nt, Homo sapiens
uguguguguguuugcag

SEQ ID NO: 17424 - RNA, 23 nt, Homo sapiens
agccuguuagcacguacuggcua

SEQ ID NO: 17425 - RNA, 22 nt, Homo sapiens
aguucuagaagcccgcacucac

SEQ ID NO: 17426 - RNA, 20 nt, Homo sapiens
caacccuaacuguagaaaag

SEQ ID NO: 17427 - RNA, 16 nt, Homo sapiens
caacuaaaacuaaaag

SEQ ID NO: 17428 - RNA, 18 nt, Homo sapiens
caccggagcggccgcucc

SEQ ID NO: 17429 - RNA, 19 nt, Homo sapiens
cagguuaucuacccuguau

SEQ ID NO: 17430 - RNA, 20 nt, Homo sapiens
cgcggccccgcuccaucccg

SEQ ID NO: 17431 - RNA, 21 nt, Homo sapiens
gggccgcgaccgcuuucccgc

SEQ ID NO: 17432 - RNA, 20 nt, Homo sapiens
uaaaucuagguaagugacac

SEQ ID NO: 17433 - RNA, 17 nt, Homo sapiens
uaaguagaggaccugga

SEQ ID NO: 17434 - RNA, 20 nt, Homo sapiens
uaugaugguucacucacgga

SEQ ID NO: 17435 - RNA, 21 nt, Homo sapiens
ucauauuguguuauacgauga

SEQ ID NO: 17436 - RNA, 16 nt, Homo sapiens
ugaagaugucauugca

SEQ ID NO: 17437 - RNA, 18 nt, Homo sapiens
uggaggcuuaugggggaa

SEQ ID NO: 17438 - RNA, 18 nt, Homo sapiens
agauguugggcugguuga

SEQ ID NO: 17439 - RNA, 20 nt, Homo sapiens
agggcaggggucuccugagc

SEQ ID NO: 17440 - RNA, 22 nt, Homo sapiens
auggauuugcuaaguuuucucc

SEQ ID NO: 17441 - RNA, 16 nt, Homo sapiens
cacgggucauagaauu

SEQ ID NO: 17442 - RNA, 16 nt, Homo sapiens
ccccaagcagacggag

SEQ ID NO: 17443 - RNA, 19 nt, Homo sapiens
ggcuugcauugaugcagcc

SEQ ID NO: 17444 - RNA, 24 nt, Homo sapiens
uaaaugacuggucccccuuucaug

SEQ ID NO: 17445 - RNA, 16 nt, Homo sapiens
ucaggggaacaauugc

SEQ ID NO: 17446 - RNA, 19 nt, Homo sapiens
ucugugacugggcagguug

SEQ ID NO: 17447 - RNA, 16 nt, Homo sapiens
ucuguggcacacccag

SEQ ID NO: 17448 - RNA, 18 nt, Homo sapiens
ugcccucgaaaaccuggc

SEQ ID NO: 17449 - RNA, 22 nt, Homo sapiens
ugcuggaccuaggaacuagaac

SEQ ID NO: 17450 - RNA, 24 nt, Homo sapiens
uucauugucuccugagccauugga

SEQ ID NO: 17451 - RNA, 14 nt, Homo sapiens
uuccagaucagggu

SEQ ID NO: 17452 - RNA, 17 nt, Homo sapiens
uuggucucuaagcagga

SEQ ID NO: 17453 - RNA, 21 nt, Homo sapiens
aguuguuuuuaaaagucagaa

SEQ ID NO: 17454 - RNA, 15 nt, Homo sapiens
gaugcgaaacuuuug

SEQ ID NO: 17455 - RNA, 21 nt, Homo sapiens
accaucccuuuccucuauccc

SEQ ID NO: 17456 - RNA, 17 nt, Homo sapiens
aggagggacccagaggg

SEQ ID NO: 17457 - RNA, 15 nt, Homo sapiens
caccaaaugaacaca

SEQ ID NO: 17458 - RNA, 17 nt, Homo sapiens
cacuuucuuuaccaccg

SEQ ID NO: 17459 - RNA, 18 nt, Homo sapiens
cccucugucugcgucaca

SEQ ID NO: 17460 - RNA, 16 nt, Homo sapiens
cuccccucucucuguc

SEQ ID NO: 17461 - RNA, 23 nt, Homo sapiens
uccagucuggcccugacccagcc

SEQ ID NO: 17462 - RNA, 16 nt, Homo sapiens
ugcccuuccuucuccc

SEQ ID NO: 17463 - RNA, 22 nt, Homo sapiens
uguagcgcugggauuguugucc

SEQ ID NO: 17464 - RNA, 20 nt, Homo sapiens
gagacaaugguggcccugau

SEQ ID NO: 17465 - RNA, 21 nt, Homo sapiens
guggauggaauaccaaagaaa

SEQ ID NO: 17466 - RNA, 23 nt, Homo sapiens
aaagugacuucucaauguaaacu

SEQ ID NO: 17467 - RNA, 16 nt, Homo sapiens
aagaccaagacccucc

SEQ ID NO: 17468 - RNA, 20 nt, Homo sapiens
accaaguaauucaacacaaa

SEQ ID NO: 17469 - RNA, 22 nt, Homo sapiens
auagauauauauauauauauau

SEQ ID NO: 17470 - RNA, 24 nt, Homo sapiens
auauauauauauauauaaaacaua

SEQ ID NO: 17471 - RNA, 19 nt, Homo sapiens
auauauauauauauauaua

SEQ ID NO: 17472 - RNA, 19 nt, Homo sapiens
caaaagcaagugcaaugug

SEQ ID NO: 17473 - RNA, 19 nt, Homo sapiens
cugcuugguucuggaguuc

SEQ ID NO: 17474 - RNA, 18 nt, Homo sapiens
guggagguggacauuuga

SEQ ID NO: 17475 - RNA, 17 nt, Homo sapiens
uaacccagaagugagaa

SEQ ID NO: 17476 - RNA, 19 nt, Homo sapiens
uaguauacaaguauaauuu

SEQ ID NO: 17477 - RNA, 22 nt, Homo sapiens
uauagauauauauauauauaua

SEQ ID NO: 17478 - RNA, 24 nt, Homo sapiens
uauagauauauauauauauauaua

SEQ ID NO: 17479 - RNA, 22 nt, Homo sapiens
uauauagauauauauauauaua

SEQ ID NO: 17480 - RNA, 24 nt, Homo sapiens
uauauagauauauauauauauaua

SEQ ID NO: 17481 - RNA, 18 nt, Homo sapiens
uauauauauauauauaua

SEQ ID NO: 17482 - RNA, 21 nt, Homo sapiens
ucaguauuuuuaggaacuaca

SEQ ID NO: 17483 - RNA, 18 nt, Homo sapiens
uccaaaccuuugcaugua

SEQ ID NO: 17484 - RNA, 19 nt, Homo sapiens
ucgcauggauggggacauc

SEQ ID NO: 17485 - RNA, 21 nt, Homo sapiens
ugaaaaaaaaaaaaaagcacu

SEQ ID NO: 17486 - RNA, 23 nt, Homo sapiens
ugagacuuuugauauaaaaagag

SEQ ID NO: 17487 - RNA, 17 nt, Homo sapiens
cagcauuuuaaaaacug

SEQ ID NO: 17488 - RNA, 18 nt, Homo sapiens
cagccauugguccugccc

SEQ ID NO: 17489 - RNA, 14 nt, Homo sapiens
ccaaauuauggaug

SEQ ID NO: 17490 - RNA, 24 nt, Homo sapiens
gagggcagcacccaucuugggaca

SEQ ID NO: 17491 - RNA, 20 nt, Homo sapiens
gcauuugcaucuugcuacag

SEQ ID NO: 17492 - RNA, 22 nt, Homo sapiens
guggggugaauacaacggguga

SEQ ID NO: 17493 - RNA, 19 nt, Homo sapiens
uaaccaacuggagaccgac

SEQ ID NO: 17494 - RNA, 18 nt, Homo sapiens
ugcccuuuccaaucucag

SEQ ID NO: 17495 - RNA, 26 nt, Homo sapiens
aggcaaggcgggggucuagcggcgcg

SEQ ID NO: 17496 - RNA, 18 nt, Homo sapiens
aucccaggcgcccgcucc

SEQ ID NO: 17497 - RNA, 18 nt, Homo sapiens
ccccucuccgcuccuuug

SEQ ID NO: 17498 - RNA, 22 nt, Homo sapiens
ccccucuccgcuccuuuguucc

SEQ ID NO: 17499 - RNA, 18 nt, Homo sapiens
ccuccccucuccgcuccu

SEQ ID NO: 17500 - RNA, 15 nt, Homo sapiens
ccugcuccugcucgg

SEQ ID NO: 17501 - RNA, 17 nt, Homo sapiens
ggaggggccaggagcgg

SEQ ID NO: 17502 - RNA, 16 nt, Homo sapiens
uaacaggaagcuguuu

SEQ ID NO: 17503 - RNA, 18 nt, Homo sapiens
uggcagccggccgggggc

SEQ ID NO: 17504 - RNA, 15 nt, Homo sapiens
gacccagccccaacc

SEQ ID NO: 17505 - RNA, 18 nt, Homo sapiens
gugagcucucccugcucc

SEQ ID NO: 17506 - RNA, 20 nt, Homo sapiens
uggugagcucucccugcucc

SEQ ID NO: 17507 - RNA, 21 nt, Homo sapiens
uuucccaggccggacagcaug

SEQ ID NO: 17508 - RNA, 21 nt, Homo sapiens
aaggugcaauaccagcauugg

SEQ ID NO: 17509 - RNA, 17 nt, Homo sapiens
agguacuacaguagcuu

SEQ ID NO: 17510 - RNA, 16 nt, Homo sapiens
auggcuuucuuugcaa

SEQ ID NO: 17511 - RNA, 18 nt, Homo sapiens
cgcggcggccgggagcgg

SEQ ID NO: 17512 - RNA, 17 nt, Homo sapiens
uaaauuuccaggcagaa

SEQ ID NO: 17513 - RNA, 19 nt, Homo sapiens
uagcauaucuacacaaucu

SEQ ID NO: 17514 - RNA, 18 nt, Homo sapiens
ugcuuuggccucugcucc

SEQ ID NO: 17515 - RNA, 23 nt, Homo sapiens
agagacuggggugggcacacugg

SEQ ID NO: 17516 - RNA, 16 nt, Homo sapiens
aggggggcgggcggug

SEQ ID NO: 17517 - RNA, 19 nt, Homo sapiens
caagggagucuggccaugu

SEQ ID NO: 17518 - RNA, 16 nt, Homo sapiens
cagagaaagggggaag

SEQ ID NO: 17519 - RNA, 20 nt, Homo sapiens
ggcacuccuucuccuucccc

SEQ ID NO: 17520 - RNA, 15 nt, Homo sapiens
ggccgguggggcccg

SEQ ID NO: 17521 - RNA, 17 nt, Homo sapiens
ggcgcgccggaccgggc

SEQ ID NO: 17522 - RNA, 20 nt, Homo sapiens
ggggcccgggccgcccgccu

SEQ ID NO: 17523 - RNA, 18 nt, Homo sapiens
gggggcgggcggugggag

SEQ ID NO: 17524 - RNA, 16 nt, Homo sapiens
ugggagggcugggggc

SEQ ID NO: 17525 - RNA, 22 nt, Homo sapiens
acggucguccgggaucuccgcg

SEQ ID NO: 17526 - RNA, 19 nt, Homo sapiens
gcagaguuagggcaggaag

SEQ ID NO: 17527 - RNA, 16 nt, Homo sapiens
ggauucugaucaauuc

SEQ ID NO: 17528 - RNA, 20 nt, Homo sapiens
agcaagaggucaggugguaa

SEQ ID NO: 17529 - RNA, 18 nt, Homo sapiens
caaaggaaaacacauauu

SEQ ID NO: 17530 - RNA, 21 nt, Homo sapiens
gagccugugaggucuggggga

SEQ ID NO: 17531 - RNA, 15 nt, Homo sapiens
gccaaagcucugcag

SEQ ID NO: 17532 - RNA, 15 nt, Homo sapiens
accuccuccuccucu

SEQ ID NO: 17533 - RNA, 22 nt, Homo sapiens
aggugaggguggggaggaccug

SEQ ID NO: 17534 - RNA, 18 nt, Homo sapiens
aguggccgcgcagagaca

SEQ ID NO: 17535 - RNA, 16 nt, Homo sapiens
cagcagcacccguggc

SEQ ID NO: 17536 - RNA, 20 nt, Homo sapiens
cccgggucuucuccacgggg

SEQ ID NO: 17537 - RNA, 21 nt, Homo sapiens
cccuccccugcacauggacuc

SEQ ID NO: 17538 - RNA, 22 nt, Homo sapiens
cgaggacgggcugggggugucc

SEQ ID NO: 17539 - RNA, 20 nt, Homo sapiens
cgcagcccggccacgucggc

SEQ ID NO: 17540 - RNA, 17 nt, Homo sapiens
cgcccggucgcccgccc

SEQ ID NO: 17541 - RNA, 20 nt, Homo sapiens
cggcgucuccucggaagccg

SEQ ID NO: 17542 - RNA, 20 nt, Homo sapiens
gaggguggggaggaccuggg

SEQ ID NO: 17543 - RNA, 18 nt, Homo sapiens
gcccgccccgcccggguc

SEQ ID NO: 17544 - RNA, 20 nt, Homo sapiens
gcccgcccgcuccucacgcc

SEQ ID NO: 17545 - RNA, 20 nt, Homo sapiens
gcgcagagacaggcggggcc

SEQ ID NO: 17546 - RNA, 19 nt, Homo sapiens
uccgcggcgcuggcccgcc

SEQ ID NO: 17547 - RNA, 16 nt, Homo sapiens
uuguagacaaaagauu

SEQ ID NO: 17548 - RNA, 18 nt, Homo sapiens
aggcggcaguggcaggaa

SEQ ID NO: 17549 - RNA, 19 nt, Homo sapiens
cagaggggaagaagcaggc

SEQ ID NO: 17550 - RNA, 16 nt, Homo sapiens
cagugaaagccgcaga

SEQ ID NO: 17551 - RNA, 16 nt, Homo sapiens
ccucaccccaaggaga

SEQ ID NO: 17552 - RNA, 19 nt, Homo sapiens
cgacuuccuccuggagugg

SEQ ID NO: 17553 - RNA, 20 nt, Homo sapiens
gagaggagggagcaugcggc

SEQ ID NO: 17554 - RNA, 19 nt, Homo sapiens
ggccagcuccagccugggc

SEQ ID NO: 17555 - RNA, 17 nt, Homo sapiens
gggccaaggcucaaagg

SEQ ID NO: 17556 - RNA, 20 nt, Homo sapiens
aggcagggcugggaggcggc

SEQ ID NO: 17557 - RNA, 19 nt, Homo sapiens
agucauuguuggaacuucc

SEQ ID NO: 17558 - RNA, 18 nt, Homo sapiens
cacaaugagccccacagg

SEQ ID NO: 17559 - RNA, 16 nt, Homo sapiens
gcuagccuuuccuuuu

SEQ ID NO: 17560 - RNA, 23 nt, Homo sapiens
uagaauauaaucauuuacaaaua

SEQ ID NO: 17561 - RNA, 21 nt, Homo sapiens
uaguccaaauccagacauuuc

SEQ ID NO: 17562 - RNA, 18 nt, Homo sapiens
aggaaaaagugaacaccc

SEQ ID NO: 17563 - RNA, 24 nt, Homo sapiens
gaaugacaucgagugacaaaguga

SEQ ID NO: 17564 - RNA, 22 nt, Homo sapiens
uacuuaguaggcaauaacuuug

SEQ ID NO: 17565 - RNA, 18 nt, Homo sapiens
ucaaacaucacuuguucu

SEQ ID NO: 17566 - RNA, 17 nt, Homo sapiens
ucucuagagaugcuaga

SEQ ID NO: 17567 - RNA, 17 nt, Homo sapiens
uuagcuuauaggcaaga

SEQ ID NO: 17568 - RNA, 20 nt, Homo sapiens
uucuggucucacgcaggaga

SEQ ID NO: 17569 - RNA, 20 nt, Homo sapiens
gugccaggaacaugaacauc

SEQ ID NO: 17570 - RNA, 22 nt, Homo sapiens
aagcucuucucuuuuugacaug

SEQ ID NO: 17571 - RNA, 22 nt, Homo sapiens
acggugugugugugugugugua

SEQ ID NO: 17572 - RNA, 19 nt, Homo sapiens
aggaagacugaggaagaag

SEQ ID NO: 17573 - RNA, 23 nt, Homo sapiens
auuaccccgugacuuugugccug

SEQ ID NO: 17574 - RNA, 20 nt, Homo sapiens
cagggcggcaggucauagcu

SEQ ID NO: 17575 - RNA, 21 nt, Homo sapiens
ccugaaggguuuguuaguuga

SEQ ID NO: 17576 - RNA, 22 nt, Homo sapiens
cgcgcgcugcgcugcucccugg

SEQ ID NO: 17577 - RNA, 18 nt, Homo sapiens
cuccagccgcccuccagc

SEQ ID NO: 17578 - RNA, 20 nt, Homo sapiens
gacuugcugcaccacgaguu

SEQ ID NO: 17579 - RNA, 21 nt, Homo sapiens
gucagucgcgcgcugcgcugc

SEQ ID NO: 17580 - RNA, 19 nt, Homo sapiens
ucuccuugaaguuccuucu

SEQ ID NO: 17581 - RNA, 19 nt, Homo sapiens
ugcugggaaaucuuccgag

SEQ ID NO: 17582 - RNA, 19 nt, Homo sapiens
ugugccugucgcugcgggc

SEQ ID NO: 17583 - RNA, 18 nt, Homo sapiens
ugugugugugugugugug

SEQ ID NO: 17584 - RNA, 19 nt, Homo sapiens
ugugugugugugugugugu

SEQ ID NO: 17585 - RNA, 21 nt, Homo sapiens
caaccauuccagcagauuuuc

SEQ ID NO: 17586 - RNA, 21 nt, Homo sapiens
uaaggaaaauacaacaauucc

SEQ ID NO: 17587 - RNA, 19 nt, Homo sapiens
ucaguaaguaguguugucg

SEQ ID NO: 17588 - RNA, 14 nt, Homo sapiens
ggggcccgggggcc

SEQ ID NO: 17589 - RNA, 14 nt, Homo sapiens
caaguucaauucca

SEQ ID NO: 17590 - RNA, 18 nt, Homo sapiens
ccugaaagacaaauggcc

SEQ ID NO: 17591 - RNA, 19 nt, Homo sapiens
cgcaagcacagugcugggc

SEQ ID NO: 17592 - RNA, 14 nt, Homo sapiens
cggcgccgcccgcc

SEQ ID NO: 17593 - RNA, 20 nt, Homo sapiens
gagcuaaaagacaacacaga

SEQ ID NO: 17594 - RNA, 18 nt, Homo sapiens
gagggaggccagggcucu

SEQ ID NO: 17595 - RNA, 18 nt, Homo sapiens
gccgcagcugccgcccgc

SEQ ID NO: 17596 - RNA, 19 nt, Homo sapiens
gcgccgcagcugccgcccg

SEQ ID NO: 17597 - RNA, 21 nt, Homo sapiens
gcuuuuuagauacacauugca

SEQ ID NO: 17598 - RNA, 16 nt, Homo sapiens
uacaucaguuagucug

SEQ ID NO: 17599 - RNA, 23 nt, Homo sapiens
ccuggccccgccuccaguuaccc

SEQ ID NO: 17600 - RNA, 22 nt, Homo sapiens
gcagagcacaggucaucaauag

SEQ ID NO: 17601 - RNA, 20 nt, Homo sapiens
uacuaaauaccauagccaug

SEQ ID NO: 17602 - RNA, 16 nt, Homo sapiens
ucaaaaguauuuggcc

SEQ ID NO: 17603 - RNA, 20 nt, Homo sapiens
uggaagaacuugucuguguc

SEQ ID NO: 17604 - RNA, 18 nt, Homo sapiens
uuacccuguacugcccac

SEQ ID NO: 17605 - RNA, 19 nt, Homo sapiens
uucaugcugccagcauuuu

SEQ ID NO: 17606 - RNA, 21 nt, Homo sapiens
gcuugcuccuggccggggacc

SEQ ID NO: 17607 - RNA, 16 nt, Homo sapiens
cgcccgcgcucccggc

SEQ ID NO: 17608 - RNA, 24 nt, Homo sapiens
gagguccaggccaagucacugguc

SEQ ID NO: 17609 - RNA, 20 nt, Homo sapiens
gggccccgggcucugcaucc

SEQ ID NO: 17610 - RNA, 17 nt, Homo sapiens
ggugccuuugcgcccgc

SEQ ID NO: 17611 - RNA, 18 nt, Homo sapiens
ucuuccggugggggcccc

SEQ ID NO: 17612 - RNA, 24 nt, Homo sapiens
aacgcagugagcagccacggccca

SEQ ID NO: 17613 - RNA, 23 nt, Homo sapiens
ggcugcugcugccugcagcgggu

SEQ ID NO: 17614 - RNA, 19 nt, Homo sapiens
ggugaccgggacuccucug

SEQ ID NO: 17615 - RNA, 18 nt, Homo sapiens
ugcuggugaccgggacuc

SEQ ID NO: 17616 - RNA, 16 nt, Homo sapiens
caggacucagcuggag

SEQ ID NO: 17617 - RNA, 19 nt, Homo sapiens
cuggaguuggaggcugggc

SEQ ID NO: 17618 - RNA, 21 nt, Homo sapiens
ggagggagucgggggauuugg

SEQ ID NO: 17619 - RNA, 16 nt, Homo sapiens
gggaaccuaggcugcg

SEQ ID NO: 17620 - RNA, 19 nt, Homo sapiens
acagaaaauauugguuggc

SEQ ID NO: 17621 - RNA, 21 nt, Homo sapiens
auggagacugagggucaggcu

SEQ ID NO: 17622 - RNA, 18 nt, Homo sapiens
ccuuggugggaaaggagg

SEQ ID NO: 17623 - RNA, 22 nt, Homo sapiens
accacggcggcgacgcugccug

SEQ ID NO: 17624 - RNA, 15 nt, Homo sapiens
agggacgagcgcggc

SEQ ID NO: 17625 - RNA, 18 nt, Homo sapiens
cggcaggcgaggcggcgg

SEQ ID NO: 17626 - RNA, 22 nt, Homo sapiens
gaggaaagaugugggaaaugga

SEQ ID NO: 17627 - RNA, 21 nt, Homo sapiens
uaacaggugcgcuggguuuuu

SEQ ID NO: 17628 - RNA, 19 nt, Homo sapiens
ucaaaacaaaucauacagc

SEQ ID NO: 17629 - RNA, 20 nt, Homo sapiens
ucaggaaauauuuucccauc

SEQ ID NO: 17630 - RNA, 24 nt, Homo sapiens
agagaagcagguuuuguacacugg

SEQ ID NO: 17631 - RNA, 18 nt, Homo sapiens
agcuccugagaaaaagac

SEQ ID NO: 17632 - RNA, 20 nt, Homo sapiens
caacacccgcacaaccugcc

SEQ ID NO: 17633 - RNA, 22 nt, Homo sapiens
caaccugccuucucaccacacc

SEQ ID NO: 17634 - RNA, 15 nt, Homo sapiens
cuaaagacaggguuu

SEQ ID NO: 17635 - RNA, 22 nt, Homo sapiens
gagauaaaaaauugcguaacag

SEQ ID NO: 17636 - RNA, 16 nt, Homo sapiens
gcgggagcugccacgg

SEQ ID NO: 17637 - RNA, 17 nt, Homo sapiens
gcucauccgcccuggcu

SEQ ID NO: 17638 - RNA, 16 nt, Homo sapiens
gcuggcugcuccgcug

SEQ ID NO: 17639 - RNA, 20 nt, Homo sapiens
gcuggguugcgugugcucug

SEQ ID NO: 17640 - RNA, 23 nt, Homo sapiens
uauuuuaugcuuagaacucuuca

SEQ ID NO: 17641 - RNA, 20 nt, Homo sapiens
ugcgagagaggcugcugggg

SEQ ID NO: 17642 - RNA, 16 nt, Homo sapiens
uggcagagccgggcac

SEQ ID NO: 17643 - RNA, 14 nt, Homo sapiens
gcgaggaggacgga

SEQ ID NO: 17644 - RNA, 20 nt, Homo sapiens
gcgaggaggacggagcggga

SEQ ID NO: 17645 - RNA, 22 nt, Homo sapiens
aggaucaauuaauuaccaucua

SEQ ID NO: 17646 - RNA, 19 nt, Homo sapiens
cuugagaagauguuugucc

SEQ ID NO: 17647 - RNA, 19 nt, Homo sapiens
gacuacaggcaggcgucac

SEQ ID NO: 17648 - RNA, 18 nt, Homo sapiens
guccugcaugguggagag

SEQ ID NO: 17649 - RNA, 22 nt, Homo sapiens
uccugcugagugggucauuacu

SEQ ID NO: 17650 - RNA, 23 nt, Homo sapiens
ucgaacuccugaccucaagugau

SEQ ID NO: 17651 - RNA, 20 nt, Homo sapiens
aggcauuaagaaaacaccau

SEQ ID NO: 17652 - RNA, 20 nt, Homo sapiens
caaugugaggcauuaagaaa

SEQ ID NO: 17653 - RNA, 19 nt, Homo sapiens
gcacuuacacauguauuca

SEQ ID NO: 17654 - RNA, 26 nt, Homo sapiens
ugaagauuuauugaagcaguuaugcu

SEQ ID NO: 17655 - RNA, 21 nt, Homo sapiens
gcgcgcccgcccgccggagac

SEQ ID NO: 17656 - RNA, 19 nt, Homo sapiens
ugggaacccgagcucagag

SEQ ID NO: 17657 - RNA, 18 nt, Homo sapiens
acccagugggcucucccc

SEQ ID NO: 17658 - RNA, 21 nt, Homo sapiens
gggcaggggagggcuggaggg

SEQ ID NO: 17659 - RNA, 17 nt, Homo sapiens
uaggaagcagugguguu

SEQ ID NO: 17660 - RNA, 17 nt, Homo sapiens
uguuccuucuacccagu

SEQ ID NO: 17661 - RNA, 15 nt, Homo sapiens
agcggcgcucggggg

SEQ ID NO: 17662 - RNA, 14 nt, Homo sapiens
uggcgacugaaggg

SEQ ID NO: 17663 - RNA, 18 nt, Homo sapiens
ugucuuaaguccuggugu

SEQ ID NO: 17664 - RNA, 15 nt, Homo sapiens
agcaggaugaaauau

SEQ ID NO: 17665 - RNA, 19 nt, Homo sapiens
gcugcgcgccccucucacc

SEQ ID NO: 17666 - RNA, 16 nt, Homo sapiens
gggccggcgcguugcg

SEQ ID NO: 17667 - RNA, 21 nt, Homo sapiens
uuagcauguuucaggaaauac

SEQ ID NO: 17668 - RNA, 24 nt, Homo sapiens
cagcgggcgagagacgagacgccg

SEQ ID NO: 17669 - RNA, 22 nt, Homo sapiens
cggcgggcggcccccggcgcgg

SEQ ID NO: 17670 - RNA, 18 nt, Homo sapiens
cgggagccgggggccgcg

SEQ ID NO: 17671 - RNA, 15 nt, Homo sapiens
cucgcggggcagcgg

SEQ ID NO: 17672 - RNA, 26 nt, Homo sapiens
ggcgggagccgggggccgcgggcucg

SEQ ID NO: 17673 - RNA, 16 nt, Homo sapiens
gggcagggcgcgggga

SEQ ID NO: 17674 - RNA, 19 nt, Homo sapiens
gggcucgcggggcagcggg

SEQ ID NO: 17675 - RNA, 18 nt, Homo sapiens
ucugggauuaacagauaa

SEQ ID NO: 17676 - RNA, 18 nt, Homo sapiens
ugcacauaccaaaauacc

SEQ ID NO: 17677 - RNA, 21 nt, Homo sapiens
gggagaaggggauuagggggc

SEQ ID NO: 17678 - RNA, 24 nt, Homo sapiens
caauuucuuugucauccauuuucu

SEQ ID NO: 17679 - RNA, 21 nt, Homo sapiens
cacagauucucaauuucuuug

SEQ ID NO: 17680 - RNA, 21 nt, Homo sapiens
cucugucuucacauaugacua

SEQ ID NO: 17681 - RNA, 20 nt, Homo sapiens
ccacugcugccucggcucga

SEQ ID NO: 17682 - RNA, 16 nt, Homo sapiens
ccgccggcgccccggc

SEQ ID NO: 17683 - RNA, 21 nt, Homo sapiens
ugacagccccaaguugguggc

SEQ ID NO: 17684 - RNA, 18 nt, Homo sapiens
ugguggcggcgcaugcgc

SEQ ID NO: 17685 - RNA, 21 nt, Homo sapiens
agggcccaggaacagccugag

SEQ ID NO: 17686 - RNA, 23 nt, Homo sapiens
aggggugccagggcacauuggca

SEQ ID NO: 17687 - RNA, 16 nt, Homo sapiens
caaccaggccugcugc

SEQ ID NO: 17688 - RNA, 21 nt, Homo sapiens
cacagacauaggccugagggg

SEQ ID NO: 17689 - RNA, 19 nt, Homo sapiens
caggaagaugaggcugaug

SEQ ID NO: 17690 - RNA, 20 nt, Homo sapiens
ccuggccacaugcuuccuca

SEQ ID NO: 17691 - RNA, 18 nt, Homo sapiens
cgacaugguuucgcaacu

SEQ ID NO: 17692 - RNA, 14 nt, Homo sapiens
gcaccaccacgcag

SEQ ID NO: 17693 - RNA, 17 nt, Homo sapiens
gcgugagaugugucccu

SEQ ID NO: 17694 - RNA, 17 nt, Homo sapiens
uagagagcuuuggguca

SEQ ID NO: 17695 - RNA, 18 nt, Homo sapiens
ucccuuggcuggggcccc

SEQ ID NO: 17696 - RNA, 23 nt, Homo sapiens
ucggccagugcucaguggccagg

SEQ ID NO: 17697 - RNA, 19 nt, Homo sapiens
ucuagagacacauggggug

SEQ ID NO: 17698 - RNA, 23 nt, Homo sapiens
ugaggggcacuggguccaccaaa

SEQ ID NO: 17699 - RNA, 16 nt, Homo sapiens
uguccagggaagggug

SEQ ID NO: 17700 - RNA, 20 nt, Homo sapiens
aacgucugcugcucggcauc

SEQ ID NO: 17701 - RNA, 19 nt, Homo sapiens
aggacaauaguacccacgc

SEQ ID NO: 17702 - RNA, 17 nt, Homo sapiens
ggagaaagcuuagauag

SEQ ID NO: 17703 - RNA, 19 nt, Homo sapiens
gaugaggguguccugcccg

SEQ ID NO: 17704 - RNA, 19 nt, Homo sapiens
ucacugagccacagccgga

SEQ ID NO: 17705 - RNA, 16 nt, Homo sapiens
cggacgccgcgcuggc

SEQ ID NO: 17706 - RNA, 20 nt, Homo sapiens
uggaaagaugcuuggggcug

SEQ ID NO: 17707 - RNA, 26 nt, Homo sapiens
cugggcugugugugugcgcaugcgcg

SEQ ID NO: 17708 - RNA, 20 nt, Homo sapiens
uaggacagccagaaucgggg

SEQ ID NO: 17709 - RNA, 20 nt, Homo sapiens
ucacccugaucauaaaagag

SEQ ID NO: 17710 - RNA, 19 nt, Homo sapiens
ugcugggcugugugugugu

SEQ ID NO: 17711 - RNA, 19 nt, Homo sapiens
acuugcugcugcaaacuga

SEQ ID NO: 17712 - RNA, 19 nt, Homo sapiens
agaaaaauacuuggaaccu

SEQ ID NO: 17713 - RNA, 16 nt, Homo sapiens
aggguaagucugccaa

SEQ ID NO: 17714 - RNA, 26 nt, Homo sapiens
gaaguuauguacaaaacacacucauu

SEQ ID NO: 17715 - RNA, 22 nt, Homo sapiens
gugcuaaaguuucagacuaagg

SEQ ID NO: 17716 - RNA, 21 nt, Homo sapiens
ucaacggauguuccucuucuc

SEQ ID NO: 17717 - RNA, 24 nt, Homo sapiens
uccagggggaaaaagucuuagucg

SEQ ID NO: 17718 - RNA, 18 nt, Homo sapiens
uccgaaagauucucgucc

SEQ ID NO: 17719 - RNA, 21 nt, Homo sapiens
ugggguggggaaggagaaugg

SEQ ID NO: 17720 - RNA, 24 nt, Homo sapiens
ugggguggggaaggagaauggugg

SEQ ID NO: 17721 - RNA, 18 nt, Homo sapiens
uguuugcugaaugaagaa

SEQ ID NO: 17722 - RNA, 17 nt, Homo sapiens
uuaguugccauagcuuc

SEQ ID NO: 17723 - RNA, 19 nt, Homo sapiens
uucaacacacugguggaug

SEQ ID NO: 17724 - RNA, 18 nt, Homo sapiens
uucaauggggggcaaggg

SEQ ID NO: 17725 - RNA, 15 nt, Homo sapiens
caucuccguccuacc

SEQ ID NO: 17726 - RNA, 15 nt, Homo sapiens
gcccgccccagcucc

SEQ ID NO: 17727 - RNA, 21 nt, Homo sapiens
gccuggcccucgucccccauc

SEQ ID NO: 17728 - RNA, 18 nt, Homo sapiens
gcgcggggaggagggggg

SEQ ID NO: 17729 - RNA, 19 nt, Homo sapiens
gggaggaggggggcacagc

SEQ ID NO: 17730 - RNA, 20 nt, Homo sapiens
ggggaggaggggggcacagc

SEQ ID NO: 17731 - RNA, 22 nt, Homo sapiens
ggggaggaggggggcacagcgg

SEQ ID NO: 17732 - RNA, 19 nt, Homo sapiens
uggggcgcggggaggaggg

SEQ ID NO: 17733 - RNA, 17 nt, Homo sapiens
uuuauuggggauguggg

SEQ ID NO: 17734 - RNA, 18 nt, Homo sapiens
aggggaaggggaggccac

SEQ ID NO: 17735 - RNA, 19 nt, Homo sapiens
cccgccaccgaggaagccc

SEQ ID NO: 17736 - RNA, 22 nt, Homo sapiens
gcagggaggggaaggggaggcc

SEQ ID NO: 17737 - RNA, 16 nt, Homo sapiens
cagccgccacccgcgc

SEQ ID NO: 17738 - RNA, 22 nt, Homo sapiens
cccgcgccacccgcccuccggc

SEQ ID NO: 17739 - RNA, 17 nt, Homo sapiens
ccuccggccgccgcccg

SEQ ID NO: 17740 - RNA, 18 nt, Homo sapiens
cgcucggccgccgccgcc

SEQ ID NO: 17741 - RNA, 18 nt, Homo sapiens
gcaggccugggacugccu

SEQ ID NO: 17742 - RNA, 17 nt, Homo sapiens
gucccucagcgcgcccg

SEQ ID NO: 17743 - RNA, 18 nt, Homo sapiens
ucgcccaccccuuugccc

SEQ ID NO: 17744 - RNA, 19 nt, Homo sapiens
ugccagugucuccuccccc

SEQ ID NO: 17745 - RNA, 16 nt, Homo sapiens
uuaggucagucugcug

SEQ ID NO: 17746 - RNA, 21 nt, Homo sapiens
aaacacacacacaaucuucug

SEQ ID NO: 17747 - RNA, 24 nt, Homo sapiens
aguuaaggggacauuucaacuaaa

SEQ ID NO: 17748 - RNA, 19 nt, Homo sapiens
cccuuaagcauucucuaaa

SEQ ID NO: 17749 - RNA, 18 nt, Homo sapiens
ccucucauuuaacagaaa

SEQ ID NO: 17750 - RNA, 25 nt, Homo sapiens
guucaugcuggugccugguuuuaga

SEQ ID NO: 17751 - RNA, 20 nt, Homo sapiens
uagugcuauuugacaucaga

SEQ ID NO: 17752 - RNA, 18 nt, Homo sapiens
ucaaagacaaacacacac

SEQ ID NO: 17753 - RNA, 18 nt, Homo sapiens
ucccuguauacaagaaaa

SEQ ID NO: 17754 - RNA, 18 nt, Homo sapiens
uccuucacuccuugcucc

SEQ ID NO: 17755 - RNA, 23 nt, Homo sapiens
ucuguggcaaagaauguguuuuc

SEQ ID NO: 17756 - RNA, 23 nt, Homo sapiens
ugacuuaaaauaggggaccugcc

SEQ ID NO: 17757 - RNA, 14 nt, Homo sapiens
ugagacuauauaug

SEQ ID NO: 17758 - RNA, 20 nt, Homo sapiens
ugauuuggaucgggauugga

SEQ ID NO: 17759 - RNA, 19 nt, Homo sapiens
ugugagaaauauagauaaa

SEQ ID NO: 17760 - RNA, 24 nt, Homo sapiens
uucuaguuucaauuaucaauguga

SEQ ID NO: 17761 - RNA, 20 nt, Homo sapiens
agaucaggaaaucaaggacc

SEQ ID NO: 17762 - RNA, 15 nt, Homo sapiens
ccgcccagcagaccc

SEQ ID NO: 17763 - RNA, 19 nt, Homo sapiens
cggcagcucgagauugccc

SEQ ID NO: 17764 - RNA, 21 nt, Homo sapiens
uggaagaguaguggggggaaa

SEQ ID NO: 17765 - RNA, 19 nt, Homo sapiens
ccuggauuuccgaaacaau

SEQ ID NO: 17766 - RNA, 19 nt, Homo sapiens
gcuuuugucuccucuucug

SEQ ID NO: 17767 - RNA, 19 nt, Homo sapiens
ggagcuugaugucacauuu

SEQ ID NO: 17768 - RNA, 19 nt, Homo sapiens
ucuuaaauuuuuaaaacuu

SEQ ID NO: 17769 - RNA, 19 nt, Homo sapiens
acuuguuuugggaauauau

SEQ ID NO: 17770 - RNA, 19 nt, Homo sapiens
cguccccgccggcaggccg

SEQ ID NO: 17771 - RNA, 19 nt, Homo sapiens
gcucgcggcuuugucuggu

SEQ ID NO: 17772 - RNA, 19 nt, Homo sapiens
uagcaggaaugaaaaagaa

SEQ ID NO: 17773 - RNA, 21 nt, Homo sapiens
ucugcugccuaaaugccaggc

SEQ ID NO: 17774 - RNA, 19 nt, Homo sapiens
uucaagaacugcuggcagg

SEQ ID NO: 17775 - RNA, 16 nt, Homo sapiens
uucccauuucuuuaca

SEQ ID NO: 17776 - RNA, 22 nt, Homo sapiens
uucaggaauggcuggauccagg

SEQ ID NO: 17777 - RNA, 23 nt, Homo sapiens
uucauguuuauuuuaggagagua

SEQ ID NO: 17778 - RNA, 21 nt, Homo sapiens
uuugugcuucauguuuauuuu

SEQ ID NO: 17779 - RNA, 14 nt, Homo sapiens
ccagggccacgggg

SEQ ID NO: 17780 - RNA, 19 nt, Homo sapiens
ccagggccacggggccugg

SEQ ID NO: 17781 - RNA, 18 nt, Homo sapiens
gaugaugagggaacacca

SEQ ID NO: 17782 - RNA, 16 nt, Homo sapiens
ugaugagggaacacca

SEQ ID NO: 17783 - RNA, 18 nt, Homo sapiens
aaacagcacaacaguuau

SEQ ID NO: 17784 - RNA, 21 nt, Homo sapiens
aggaggccgaagaggcuggag

SEQ ID NO: 17785 - RNA, 14 nt, Homo sapiens
ggaccagccaggau

SEQ ID NO: 17786 - RNA, 20 nt, Homo sapiens
ggagaaggggaggcggaagc

SEQ ID NO: 17787 - RNA, 21 nt, Homo sapiens
guacauuuuuuuuuacauggg

SEQ ID NO: 17788 - RNA, 18 nt, Homo sapiens
aaaaaaauacaaacagga

SEQ ID NO: 17789 - RNA, 17 nt, Homo sapiens
cacugaaguuauguauu

SEQ ID NO: 17790 - RNA, 18 nt, Homo sapiens
ccgccgccuccggauccc

SEQ ID NO: 17791 - RNA, 22 nt, Homo sapiens
ccgccuccggaucccuccgccc

SEQ ID NO: 17792 - RNA, 21 nt, Homo sapiens
ccuggccucaagugauccucc

SEQ ID NO: 17793 - RNA, 16 nt, Homo sapiens
gcgggguggagaaaga

SEQ ID NO: 17794 - RNA, 20 nt, Homo sapiens
gggaggagggggcgggacgc

SEQ ID NO: 17795 - RNA, 18 nt, Homo sapiens
ucacagcucacugcagcc

SEQ ID NO: 17796 - RNA, 17 nt, Homo sapiens
ucagcaggcccuggcau

SEQ ID NO: 17797 - RNA, 16 nt, Homo sapiens
ucccuccgcccuccgc

SEQ ID NO: 17798 - RNA, 21 nt, Homo sapiens
ugcgaauuauauagugcggaa

SEQ ID NO: 17799 - RNA, 20 nt, Homo sapiens
uuaaagacaggguauugcuc

SEQ ID NO: 17800 - RNA, 21 nt, Homo sapiens
uuuaaguuacaccaagauuuc

SEQ ID NO: 17801 - RNA, 17 nt, Homo sapiens
acauggcuggcuccgag

SEQ ID NO: 17802 - RNA, 19 nt, Homo sapiens
auauauaauauauauauau

SEQ ID NO: 17803 - RNA, 22 nt, Homo sapiens
augcuaugcaccucagguugag

SEQ ID NO: 17804 - RNA, 16 nt, Homo sapiens
cagcaggccucuuccu

SEQ ID NO: 17805 - RNA, 15 nt, Homo sapiens
guggcugcagggccu

SEQ ID NO: 17806 - RNA, 17 nt, Homo sapiens
uauaauauauauauauc

SEQ ID NO: 17807 - RNA, 18 nt, Homo sapiens
uauauaauauauauauau

SEQ ID NO: 17808 - RNA, 16 nt, Homo sapiens
uccuccccaaguuuuu

SEQ ID NO: 17809 - RNA, 14 nt, Homo sapiens
uggcugcagggccu

SEQ ID NO: 17810 - RNA, 19 nt, Homo sapiens
acuugaggacucaccaugc

SEQ ID NO: 17811 - RNA, 21 nt, Homo sapiens
caaccacgguuucaaggcugu

SEQ ID NO: 17812 - RNA, 17 nt, Homo sapiens
caccaggcuucugaagc

SEQ ID NO: 17813 - RNA, 18 nt, Homo sapiens
cacguggcaggcccagcu

SEQ ID NO: 17814 - RNA, 19 nt, Homo sapiens
cagaaaucggggguggggu

SEQ ID NO: 17815 - RNA, 18 nt, Homo sapiens
caggauguccuuccccac

SEQ ID NO: 17816 - RNA, 14 nt, Homo sapiens
cuccucuaagugag

SEQ ID NO: 17817 - RNA, 19 nt, Homo sapiens
gggcaccaggcuucugaag

SEQ ID NO: 17818 - RNA, 23 nt, Homo sapiens
gggugacagggccagccgggcac

SEQ ID NO: 17819 - RNA, 22 nt, Homo sapiens
uggcgcagaaccgagaugcugc

SEQ ID NO: 17820 - RNA, 23 nt, Homo sapiens
ugggguugggaucaaagaagcca

SEQ ID NO: 17821 - RNA, 20 nt, Homo sapiens
accucaggagccuuucuggc

SEQ ID NO: 17822 - RNA, 19 nt, Homo sapiens
acggaggaaguggagagca

SEQ ID NO: 17823 - RNA, 18 nt, Homo sapiens
agugcggggacaauccca

SEQ ID NO: 17824 - RNA, 18 nt, Homo sapiens
ccacagaguccugcuuug

SEQ ID NO: 17825 - RNA, 19 nt, Homo sapiens
cggggccaccacagaccug

SEQ ID NO: 17826 - RNA, 17 nt, Homo sapiens
cuuuuugguuuuggagc

SEQ ID NO: 17827 - RNA, 15 nt, Homo sapiens
gccucugcugacggg

SEQ ID NO: 17828 - RNA, 21 nt, Homo sapiens
ggacuggaggagggguguggc

SEQ ID NO: 17829 - RNA, 21 nt, Homo sapiens
ggaggagggggucagcagggg

SEQ ID NO: 17830 - RNA, 19 nt, Homo sapiens
gggcacaagggagucucca

SEQ ID NO: 17831 - RNA, 20 nt, Homo sapiens
uaaaacaaagagagcagaac

SEQ ID NO: 17832 - RNA, 17 nt, Homo sapiens
ucggggccaccacagac

SEQ ID NO: 17833 - RNA, 17 nt, Homo sapiens
ugccacaagcgaacgcc

SEQ ID NO: 17834 - RNA, 15 nt, Homo sapiens
uggaggcgagcccgg

SEQ ID NO: 17835 - RNA, 22 nt, Homo sapiens
uucugcuaaugaagacagaugu

SEQ ID NO: 17836 - RNA, 17 nt, Homo sapiens
uuggauagcugacagaa

SEQ ID NO: 17837 - RNA, 23 nt, Homo sapiens
ugaaagcccuguuuaaaacuucu

SEQ ID NO: 17838 - RNA, 19 nt, Homo sapiens
aauguccugaaaaagguga

SEQ ID NO: 17839 - RNA, 20 nt, Homo sapiens
cacguaauuuuuaaaaagga

SEQ ID NO: 17840 - RNA, 15 nt, Homo sapiens
ccugaaaaugcaaug

SEQ ID NO: 17841 - RNA, 23 nt, Homo sapiens
acgggucuucaguacuuuuauua

SEQ ID NO: 17842 - RNA, 18 nt, Homo sapiens
ucgcagccccaaaccggg

SEQ ID NO: 17843 - RNA, 17 nt, Homo sapiens
agaugagaauguagaaa

SEQ ID NO: 17844 - RNA, 19 nt, Homo sapiens
aggugguagguaaaggagc

SEQ ID NO: 17845 - RNA, 18 nt, Homo sapiens
ggcccgauccccuugguu

SEQ ID NO: 17846 - RNA, 21 nt, Homo sapiens
gggaaggugguagguaaagga

SEQ ID NO: 17847 - RNA, 14 nt, Homo sapiens
gucugucggcuggc

SEQ ID NO: 17848 - RNA, 18 nt, Homo sapiens
uccccuugguuuuccaua

SEQ ID NO: 17849 - RNA, 17 nt, Homo sapiens
accagauuucacgggga

SEQ ID NO: 17850 - RNA, 19 nt, Homo sapiens
agucauaauaauuucccga

SEQ ID NO: 17851 - RNA, 20 nt, Homo sapiens
aguuuuuucucuuguuccuu

SEQ ID NO: 17852 - RNA, 22 nt, Homo sapiens
cauggggguggggcuccugugg

SEQ ID NO: 17853 - RNA, 19 nt, Homo sapiens
gcccaggaauccaccucuu

SEQ ID NO: 17854 - RNA, 19 nt, Homo sapiens
ggggggggguggggaagag

SEQ ID NO: 17855 - RNA, 20 nt, Homo sapiens
uaggcaugccuaauggguuu

SEQ ID NO: 17856 - RNA, 20 nt, Homo sapiens
ucuacuucuguuucuugaau

SEQ ID NO: 17857 - RNA, 18 nt, Homo sapiens
ucucccacuccauugugg

SEQ ID NO: 17858 - RNA, 21 nt, Homo sapiens
ugcccagcuucucacuugcau

SEQ ID NO: 17859 - RNA, 17 nt, Homo sapiens
ugugugauggugcagcu

SEQ ID NO: 17860 - RNA, 21 nt, Homo sapiens
uugcaugucauagcaccccug

SEQ ID NO: 17861 - RNA, 21 nt, Homo sapiens
uuuauugagucauaauaauuu

SEQ ID NO: 17862 - RNA, 19 nt, Homo sapiens
cagcggcagaggcuggagc

SEQ ID NO: 17863 - RNA, 22 nt, Homo sapiens
agauaccaaaacauacauguga

SEQ ID NO: 17864 - RNA, 26 nt, Homo sapiens
agggggguggggacggaaggggcggg

SEQ ID NO: 17865 - RNA, 19 nt, Homo sapiens
ccgcccgcgcgcucucgcc

SEQ ID NO: 17866 - RNA, 18 nt, Homo sapiens
ccgcggccccgcgcuccg

SEQ ID NO: 17867 - RNA, 21 nt, Homo sapiens
ccgcugcggccgccaacacgg

SEQ ID NO: 17868 - RNA, 17 nt, Homo sapiens
cgcccccgcccgcgcgc

SEQ ID NO: 17869 - RNA, 24 nt, Homo sapiens
cgcgggaggcgagaggaagguggg

SEQ ID NO: 17870 - RNA, 16 nt, Homo sapiens
cggccccgcgcuccgg

SEQ ID NO: 17871 - RNA, 16 nt, Homo sapiens
cggcgcgcucgcgggc

SEQ ID NO: 17872 - RNA, 15 nt, Homo sapiens
cggggcgaccgcggc

SEQ ID NO: 17873 - RNA, 26 nt, Homo sapiens
gaggaaagggcggaggggggugggga

SEQ ID NO: 17874 - RNA, 28 nt, Homo sapiens
ggagggggguggggacggaaggggcggg

SEQ ID NO: 17875 - RNA, 20 nt, Homo sapiens
ggcggcugcgggugcugcgg

SEQ ID NO: 17876 - RNA, 20 nt, Homo sapiens
gggagaggaaagggcggagg

SEQ ID NO: 17877 - RNA, 24 nt, Homo sapiens
gggggguggggacggaaggggcgg

SEQ ID NO: 17878 - RNA, 19 nt, Homo sapiens
gggguggggacggaagggg

SEQ ID NO: 17879 - RNA, 23 nt, Homo sapiens
guggggagaggaaagggcggagg

SEQ ID NO: 17880 - RNA, 17 nt, Homo sapiens
ucggggcgaccgcggcc

SEQ ID NO: 17881 - RNA, 15 nt, Homo sapiens
agcaauuucauggau

SEQ ID NO: 17882 - RNA, 23 nt, Homo sapiens
cuuuauauuugucucccucuucu

SEQ ID NO: 17883 - RNA, 22 nt, Homo sapiens
gccuguagucccagcuacuugg

SEQ ID NO: 17884 - RNA, 20 nt, Homo sapiens
gcgugaaccugggaagcaga

SEQ ID NO: 17885 - RNA, 17 nt, Homo sapiens
ggaagcagagcuugcag

SEQ ID NO: 17886 - RNA, 22 nt, Homo sapiens
uccugaaggaugagaccuggga

SEQ ID NO: 17887 - RNA, 17 nt, Homo sapiens
uguaaaauauuuaaguu

SEQ ID NO: 17888 - RNA, 17 nt, Homo sapiens
gcacagggcuuuccgcu

SEQ ID NO: 17889 - RNA, 21 nt, Homo sapiens
cuuucuagguaaacggucuuc

SEQ ID NO: 17890 - RNA, 23 nt, Homo sapiens
gcccgccgugcaguccaucuccc

SEQ ID NO: 17891 - RNA, 19 nt, Homo sapiens
gcguacugaggucuggcgg

SEQ ID NO: 17892 - RNA, 24 nt, Homo sapiens
uguuucucaccagccgcgcugcgu

SEQ ID NO: 17893 - RNA, 18 nt, Homo sapiens
cacacacacccccaaagg

SEQ ID NO: 17894 - RNA, 19 nt, Homo sapiens
cagaaacaagagguggggu

SEQ ID NO: 17895 - RNA, 27 nt, Homo sapiens
cggaugggcagggaggauaccguuucc

SEQ ID NO: 17896 - RNA, 14 nt, Homo sapiens
gaggggcauguguc

SEQ ID NO: 17897 - RNA, 18 nt, Homo sapiens
gcgggacguuggcagagg

SEQ ID NO: 17898 - RNA, 17 nt, Homo sapiens
ggacccagaaacaagag

SEQ ID NO: 17899 - RNA, 22 nt, Homo sapiens
ggccggcgugggcggcggcggc

SEQ ID NO: 17900 - RNA, 16 nt, Homo sapiens
ggcggcggcggcugcg

SEQ ID NO: 17901 - RNA, 28 nt, Homo sapiens
ggcggcggcggcugcguggugguggcgg

SEQ ID NO: 17902 - RNA, 19 nt, Homo sapiens
ggcggcggcugcguggugg

SEQ ID NO: 17903 - RNA, 16 nt, Homo sapiens
ggcgugggcggcggcg

SEQ ID NO: 17904 - RNA, 20 nt, Homo sapiens
gggcggcggcggcugcgugg

SEQ ID NO: 17905 - RNA, 17 nt, Homo sapiens
ugucucaguaccuccag

SEQ ID NO: 17906 - RNA, 15 nt, Homo sapiens
uccaacccgaaugag

SEQ ID NO: 17907 - RNA, 19 nt, Homo sapiens
ugagauucugcuucuuggg

SEQ ID NO: 17908 - RNA, 15 nt, Homo sapiens
cagagcuucugcccc

SEQ ID NO: 17909 - RNA, 18 nt, Homo sapiens
uuuauaaaccauggugag

SEQ ID NO: 17910 - RNA, 15 nt, Homo sapiens
aaauucccuccuucc

SEQ ID NO: 17911 - RNA, 18 nt, Homo sapiens
aaggggagucccuggggu

SEQ ID NO: 17912 - RNA, 22 nt, Homo sapiens
aggggagucccugggguggggg

SEQ ID NO: 17913 - RNA, 17 nt, Homo sapiens
aggggauggcagagggg

SEQ ID NO: 17914 - RNA, 17 nt, Homo sapiens
cccgccccauagagucc

SEQ ID NO: 17915 - RNA, 16 nt, Homo sapiens
cggaaaggagaagcgg

SEQ ID NO: 17916 - RNA, 21 nt, Homo sapiens
cuauagcauuuaaaaacuccc

SEQ ID NO: 17917 - RNA, 22 nt, Homo sapiens
ggcgggcggcucgcccacgggc

SEQ ID NO: 17918 - RNA, 21 nt, Homo sapiens
gggccggggcgggucuccggg

SEQ ID NO: 17919 - RNA, 17 nt, Homo sapiens
uggcuccgggcucggcu

SEQ ID NO: 17920 - RNA, 20 nt, Homo sapiens
gagguugguauuuccccucu

SEQ ID NO: 17921 - RNA, 18 nt, Homo sapiens
ucacagaggagcuagaga

SEQ ID NO: 17922 - RNA, 18 nt, Homo sapiens
ucucccaagaaaaucugc

SEQ ID NO: 17923 - RNA, 25 nt, Homo sapiens
agaaauguggaaaaaaaaaucacaa

SEQ ID NO: 17924 - RNA, 19 nt, Homo sapiens
agcaugucucacaguuuuc

SEQ ID NO: 17925 - RNA, 25 nt, Homo sapiens
aggcagaguuuugaaugaguaauuu

SEQ ID NO: 17926 - RNA, 17 nt, Homo sapiens
caugucucacaguuuuc

SEQ ID NO: 17927 - RNA, 20 nt, Homo sapiens
ccgccggccgccgggauucc

SEQ ID NO: 17928 - RNA, 18 nt, Homo sapiens
cugucuucucuaccucua

SEQ ID NO: 17929 - RNA, 22 nt, Homo sapiens
uaaaccacauuuuuaauugcca

SEQ ID NO: 17930 - RNA, 16 nt, Homo sapiens
gagccgagcgagcggc

SEQ ID NO: 17931 - RNA, 15 nt, Homo sapiens
guuagggaaccaagg

SEQ ID NO: 17932 - RNA, 23 nt, Homo sapiens
uaaauucugaagguagcuaugcu

SEQ ID NO: 17933 - RNA, 20 nt, Homo sapiens
ugaguggugagaauacaaca

SEQ ID NO: 17934 - RNA, 18 nt, Homo sapiens
gcacaguuuucauaaagg

SEQ ID NO: 17935 - RNA, 21 nt, Homo sapiens
ucaaugguaacagucaauguu

SEQ ID NO: 17936 - RNA, 22 nt, Homo sapiens
aauauauauauuuuauauauau

SEQ ID NO: 17937 - RNA, 16 nt, Homo sapiens
acauucuugggcaggg

SEQ ID NO: 17938 - RNA, 22 nt, Homo sapiens
auaaacauauauauauauauau

SEQ ID NO: 17939 - RNA, 19 nt, Homo sapiens
auauauaauauauauauau

SEQ ID NO: 17940 - RNA, 23 nt, Homo sapiens
auauauauaauauauauauauau

SEQ ID NO: 17941 - RNA, 22 nt, Homo sapiens
auauauauauauauaaauguau

SEQ ID NO: 17942 - RNA, 22 nt, Homo sapiens
auauauauauuuuauauauaua

SEQ ID NO: 17943 - RNA, 19 nt, Homo sapiens
cacauucuugggcagggga

SEQ ID NO: 17944 - RNA, 24 nt, Homo sapiens
cauaaacauauauauauauauaua

SEQ ID NO: 17945 - RNA, 18 nt, Homo sapiens
cauauauauauauauaua

SEQ ID NO: 17946 - RNA, 22 nt, Homo sapiens
ccagggcuggguuugucggugu

SEQ ID NO: 17947 - RNA, 25 nt, Homo sapiens
ccgccuccgggggcgggcuccggcc

SEQ ID NO: 17948 - RNA, 19 nt, Homo sapiens
ccggcucgggcuguggggc

SEQ ID NO: 17949 - RNA, 22 nt, Homo sapiens
ccggcugcggcuccucccggcc

SEQ ID NO: 17950 - RNA, 17 nt, Homo sapiens
ccucccccuccuccggc

SEQ ID NO: 17951 - RNA, 21 nt, Homo sapiens
cuccgggggcgggcuccggcc

SEQ ID NO: 17952 - RNA, 20 nt, Homo sapiens
cucgcggcuccgcucggcuc

SEQ ID NO: 17953 - RNA, 18 nt, Homo sapiens
gagcgcgcgcgcuggagc

SEQ ID NO: 17954 - RNA, 21 nt, Homo sapiens
gaggacccuggccccaccaag

SEQ ID NO: 17955 - RNA, 20 nt, Homo sapiens
gcccccucuccucuuccuuc

SEQ ID NO: 17956 - RNA, 22 nt, Homo sapiens
gccccugggggcgagaugcgcg

SEQ ID NO: 17957 - RNA, 16 nt, Homo sapiens
gccgagucgccacugc

SEQ ID NO: 17958 - RNA, 19 nt, Homo sapiens
gccgcguccacuguccgcc

SEQ ID NO: 17959 - RNA, 21 nt, Homo sapiens
gggcacguggauccugcccug

SEQ ID NO: 17960 - RNA, 23 nt, Homo sapiens
ggggaggaggugguaacuggggc

SEQ ID NO: 17961 - RNA, 17 nt, Homo sapiens
gugggugugucuacagg

SEQ ID NO: 17962 - RNA, 24 nt, Homo sapiens
uacauaaacauauauauauauaua

SEQ ID NO: 17963 - RNA, 24 nt, Homo sapiens
uauacauaaacauauauauauaua

SEQ ID NO: 17964 - RNA, 23 nt, Homo sapiens
uauauauaauauauauauauaua

SEQ ID NO: 17965 - RNA, 23 nt, Homo sapiens
uauauauauaauauauauauaua

SEQ ID NO: 17966 - RNA, 25 nt, Homo sapiens
uauauauauaauauauauauauaua

SEQ ID NO: 17967 - RNA, 23 nt, Homo sapiens
uauauauauauaauauauauaua

SEQ ID NO: 17968 - RNA, 25 nt, Homo sapiens
uauauauauauaauauauauauaua

SEQ ID NO: 17969 - RNA, 24 nt, Homo sapiens
uauauauauauauacacacaaaua

SEQ ID NO: 17970 - RNA, 18 nt, Homo sapiens
uauauauauauauauaca

SEQ ID NO: 17971 - RNA, 20 nt, Homo sapiens
uccaacaaugugucucuucu

SEQ ID NO: 17972 - RNA, 18 nt, Homo sapiens
ucuccucuuccuucucuu

SEQ ID NO: 17973 - RNA, 21 nt, Homo sapiens
ugauggugugguggcggcagc

SEQ ID NO: 17974 - RNA, 15 nt, Homo sapiens
ugcggcccccucucc

SEQ ID NO: 17975 - RNA, 22 nt, Homo sapiens
uggggagccaggggaucgggga

SEQ ID NO: 17976 - RNA, 21 nt, Homo sapiens
uugcacauucuugggcagggg

SEQ ID NO: 17977 - RNA, 23 nt, Homo sapiens
uuucuuguuugguuugaacauau

SEQ ID NO: 17978 - RNA, 18 nt, Homo sapiens
cucccagucuccucuucc

SEQ ID NO: 17979 - RNA, 15 nt, Homo sapiens
gccggggccgcccgc

SEQ ID NO: 17980 - RNA, 20 nt, Homo sapiens
gcugccucccagucuccucu

SEQ ID NO: 17981 - RNA, 16 nt, Homo sapiens
ucuugcugccucccag

SEQ ID NO: 17982 - RNA, 21 nt, Homo sapiens
ugaggggaggaagagccaguu

SEQ ID NO: 17983 - RNA, 19 nt, Homo sapiens
aggcuggaggggcucgugg

SEQ ID NO: 17984 - RNA, 20 nt, Homo sapiens
aggggggcgccggcgcgcgc

SEQ ID NO: 17985 - RNA, 15 nt, Homo sapiens
ccgacggggacgucc

SEQ ID NO: 17986 - RNA, 24 nt, Homo sapiens
ccgccucggcuccgagcgguggcc

SEQ ID NO: 17987 - RNA, 19 nt, Homo sapiens
ccggcgcgcgcgcgcggcg

SEQ ID NO: 17988 - RNA, 16 nt, Homo sapiens
cggcgcggcuccgggc

SEQ ID NO: 17989 - RNA, 19 nt, Homo sapiens
cgggggcgcgcgggggcgg

SEQ ID NO: 17990 - RNA, 23 nt, Homo sapiens
cgucccgugggcugggcucagcu

SEQ ID NO: 17991 - RNA, 16 nt, Homo sapiens
gcccggggacaggggc

SEQ ID NO: 17992 - RNA, 20 nt, Homo sapiens
gcgcgcgcgcgcggcggggg

SEQ ID NO: 17993 - RNA, 18 nt, Homo sapiens
gcgcggcgggggcgcgcg

SEQ ID NO: 17994 - RNA, 19 nt, Homo sapiens
gggaagaucgggacgcguc

SEQ ID NO: 17995 - RNA, 24 nt, Homo sapiens
gggcgccggcgcgcgcgcgcggcg

SEQ ID NO: 17996 - RNA, 23 nt, Homo sapiens
ucacagcgacuuggagaggcugg

SEQ ID NO: 17997 - RNA, 23 nt, Homo sapiens
ugggcuggcccccggucacccgc

SEQ ID NO: 17998 - RNA, 23 nt, Homo sapiens
agaggguuuuucauauguaauuc

SEQ ID NO: 17999 - RNA, 21 nt, Homo sapiens
gcccgcccugccucguccucc

SEQ ID NO: 18000 - RNA, 20 nt, Homo sapiens
ggagucugaaagcucauagu

SEQ ID NO: 18001 - RNA, 18 nt, Homo sapiens
ucucugccagcugcgugg

SEQ ID NO: 18002 - RNA, 19 nt, Homo sapiens
uugcaaagcuuuuauuuca

SEQ ID NO: 18003 - RNA, 16 nt, Homo sapiens
cuuuauuuucucucuu

SEQ ID NO: 18004 - RNA, 17 nt, Homo sapiens
agcuggagcgcgcucaa

SEQ ID NO: 18005 - RNA, 15 nt, Homo sapiens
aggggcccgcaggcc

SEQ ID NO: 18006 - RNA, 19 nt, Homo sapiens
cccgacacggugcucgggc

SEQ ID NO: 18007 - RNA, 21 nt, Homo sapiens
cccgccgccuccguccuaggu

SEQ ID NO: 18008 - RNA, 19 nt, Homo sapiens
ccuguggaguugggugggg

SEQ ID NO: 18009 - RNA, 16 nt, Homo sapiens
cgcagcuggccugggg

SEQ ID NO: 18010 - RNA, 16 nt, Homo sapiens
cgcgccccagcugggg

SEQ ID NO: 18011 - RNA, 18 nt, Homo sapiens
cgcugugggggccagggc

SEQ ID NO: 18012 - RNA, 17 nt, Homo sapiens
cucccggcacagcuguc

SEQ ID NO: 18013 - RNA, 25 nt, Homo sapiens
cugguugucuccucagcccgccuuc

SEQ ID NO: 18014 - RNA, 20 nt, Homo sapiens
gagcagccgcuagggcugcu

SEQ ID NO: 18015 - RNA, 22 nt, Homo sapiens
gagcgccagcucuggggaggag

SEQ ID NO: 18016 - RNA, 17 nt, Homo sapiens
gccgcccagcgcccgcc

SEQ ID NO: 18017 - RNA, 21 nt, Homo sapiens
gcggagcuugcagggagcaga

SEQ ID NO: 18018 - RNA, 21 nt, Homo sapiens
gcgugaacccgggaggcggag

SEQ ID NO: 18019 - RNA, 22 nt, Homo sapiens
ggaacaagacauucauuuuuaa

SEQ ID NO: 18020 - RNA, 20 nt, Homo sapiens
ggaggcaaaacagcccugug

SEQ ID NO: 18021 - RNA, 23 nt, Homo sapiens
ggcguggcccagggugugcagga

SEQ ID NO: 18022 - RNA, 19 nt, Homo sapiens
gggcaccuggccugggccg

SEQ ID NO: 18023 - RNA, 21 nt, Homo sapiens
ggggaggaacagccgaggggc

SEQ ID NO: 18024 - RNA, 20 nt, Homo sapiens
gguguggccggcguggccca

SEQ ID NO: 18025 - RNA, 16 nt, Homo sapiens
guggaguugggugggg

SEQ ID NO: 18026 - RNA, 20 nt, Homo sapiens
gugggggaugcucccuuuug

SEQ ID NO: 18027 - RNA, 18 nt, Homo sapiens
uacaggggaggaacagcc

SEQ ID NO: 18028 - RNA, 17 nt, Homo sapiens
uccuccuuggcuccccu

SEQ ID NO: 18029 - RNA, 22 nt, Homo sapiens
ucuaaaugcuggaguuuaaauc

SEQ ID NO: 18030 - RNA, 17 nt, Homo sapiens
uggccgcagcuggccug

SEQ ID NO: 18031 - RNA, 19 nt, Homo sapiens
ugugauggauccucugcgg

SEQ ID NO: 18032 - RNA, 17 nt, Homo sapiens
uugggaggccgaggcgg

SEQ ID NO: 18033 - RNA, 22 nt, Homo sapiens
uuugucaaacauuuuuauccac

SEQ ID NO: 18034 - RNA, 21 nt, Homo sapiens
aaacgcuuaagccgucucugu

SEQ ID NO: 18035 - RNA, 20 nt, Homo sapiens
auauagauagauauacuuaa

SEQ ID NO: 18036 - RNA, 22 nt, Homo sapiens
caggagccaagggucccucugu

SEQ ID NO: 18037 - RNA, 20 nt, Homo sapiens
ggagccuggaugaaaaguug

SEQ ID NO: 18038 - RNA, 19 nt, Homo sapiens
ucauuaauucuucaaauuc

SEQ ID NO: 18039 - RNA, 19 nt, Homo sapiens
ugaaaaguuggaaaguugc

SEQ ID NO: 18040 - RNA, 18 nt, Homo sapiens
ugugugugugugugugug

SEQ ID NO: 18041 - RNA, 19 nt, Homo sapiens
ugugugugugugugugugu

SEQ ID NO: 18042 - RNA, 17 nt, Homo sapiens
uuccagaucgauaggau

SEQ ID NO: 18043 - RNA, 23 nt, Homo sapiens
uuugugugugugugugugugugu

SEQ ID NO: 18044 - RNA, 20 nt, Homo sapiens
agccacacccgggcggccac

SEQ ID NO: 18045 - RNA, 16 nt, Homo sapiens
caccggcugcaccccc

SEQ ID NO: 18046 - RNA, 19 nt, Homo sapiens
cagccgcguggggcucugg

SEQ ID NO: 18047 - RNA, 21 nt, Homo sapiens
ccccggccuccuccucucggg

SEQ ID NO: 18048 - RNA, 16 nt, Homo sapiens
ccucugugugugugug

SEQ ID NO: 18049 - RNA, 19 nt, Homo sapiens
cugguguggacugggcugc

SEQ ID NO: 18050 - RNA, 20 nt, Homo sapiens
cugguguggacugggcugcu

SEQ ID NO: 18051 - RNA, 21 nt, Homo sapiens
gcccccguuaggagauggggc

SEQ ID NO: 18052 - RNA, 21 nt, Homo sapiens
gccuccuccucucgggcccgg

SEQ ID NO: 18053 - RNA, 19 nt, Homo sapiens
gccugcgcgccccgcggcc

SEQ ID NO: 18054 - RNA, 23 nt, Homo sapiens
gcgugcacacguggucccucugu

SEQ ID NO: 18055 - RNA, 22 nt, Homo sapiens
ggaccuggggaggggacauggc

SEQ ID NO: 18056 - RNA, 18 nt, Homo sapiens
ggaggccucacaggaaaa

SEQ ID NO: 18057 - RNA, 15 nt, Homo sapiens
ggaggggggccgggg

SEQ ID NO: 18058 - RNA, 15 nt, Homo sapiens
ggcaggcaggcuggc

SEQ ID NO: 18059 - RNA, 20 nt, Homo sapiens
gggaagauggcagggcgagg

SEQ ID NO: 18060 - RNA, 19 nt, Homo sapiens
gggcgagggguugggggag

SEQ ID NO: 18061 - RNA, 22 nt, Homo sapiens
guggaggcugcagggccaaggc

SEQ ID NO: 18062 - RNA, 18 nt, Homo sapiens
ucucgggcccgggcgcgc

SEQ ID NO: 18063 - RNA, 18 nt, Homo sapiens
ucugagcugccucugccc

SEQ ID NO: 18064 - RNA, 17 nt, Homo sapiens
ucuggucaaccccaggg

SEQ ID NO: 18065 - RNA, 16 nt, Homo sapiens
ugaagaagguucagaa

SEQ ID NO: 18066 - RNA, 18 nt, Homo sapiens
ugcccugggcuccgagcc

SEQ ID NO: 18067 - RNA, 19 nt, Homo sapiens
ugcgagagcuaccgaaagc

SEQ ID NO: 18068 - RNA, 18 nt, Homo sapiens
uggcaagaccaggaaggg

SEQ ID NO: 18069 - RNA, 18 nt, Homo sapiens
uggcagggcgagggguug

SEQ ID NO: 18070 - RNA, 15 nt, Homo sapiens
uggccuggaaguggc

SEQ ID NO: 18071 - RNA, 16 nt, Homo sapiens
ugggaaggcgggaggc

SEQ ID NO: 18072 - RNA, 16 nt, Homo sapiens
uggggggcgaggaugc

SEQ ID NO: 18073 - RNA, 18 nt, Homo sapiens
ugguccacugauggggga

SEQ ID NO: 18074 - RNA, 22 nt, Homo sapiens
ugguguguacauaaggacccac

SEQ ID NO: 18075 - RNA, 17 nt, Homo sapiens
uuuccaccacgcacagg

SEQ ID NO: 18076 - RNA, 17 nt, Homo sapiens
cucccagagugcuggga

SEQ ID NO: 18077 - RNA, 24 nt, Homo sapiens
aauaugccaaucaauguuaauaaa

SEQ ID NO: 18078 - RNA, 16 nt, Homo sapiens
agcauuccaaaggagg

SEQ ID NO: 18079 - RNA, 19 nt, Homo sapiens
agucucagguucgggcucc

SEQ ID NO: 18080 - RNA, 21 nt, Homo sapiens
caaaauacagcuuucaacugu

SEQ ID NO: 18081 - RNA, 18 nt, Homo sapiens
cagcacgugggcaugcgu

SEQ ID NO: 18082 - RNA, 24 nt, Homo sapiens
cagccgcggcgucucugcgcggcg

SEQ ID NO: 18083 - RNA, 21 nt, Homo sapiens
ccaaaggagggaaagggugca

SEQ ID NO: 18084 - RNA, 16 nt, Homo sapiens
ccgcggcuucccgcga

SEQ ID NO: 18085 - RNA, 21 nt, Homo sapiens
ccgcuucuugccccucguccc

SEQ ID NO: 18086 - RNA, 20 nt, Homo sapiens
ccgggucucugcgagcuggg

SEQ ID NO: 18087 - RNA, 22 nt, Homo sapiens
ccucagguccagucucagguuc

SEQ ID NO: 18088 - RNA, 20 nt, Homo sapiens
cgagccuggggcggcggggg

SEQ ID NO: 18089 - RNA, 19 nt, Homo sapiens
cgccgcccgaacaccgccc

SEQ ID NO: 18090 - RNA, 21 nt, Homo sapiens
cgcggacuuuccggcagaggc

SEQ ID NO: 18091 - RNA, 16 nt, Homo sapiens
cgcggcggcggccugc

SEQ ID NO: 18092 - RNA, 16 nt, Homo sapiens
cggcccggcgccgccc

SEQ ID NO: 18093 - RNA, 19 nt, Homo sapiens
gcaaacauguuuuagacca

SEQ ID NO: 18094 - RNA, 16 nt, Homo sapiens
gccgaccuuguccgcg

SEQ ID NO: 18095 - RNA, 20 nt, Homo sapiens
gccuagucgcagccgcggcg

SEQ ID NO: 18096 - RNA, 18 nt, Homo sapiens
gcgcggcggcggccugcg

SEQ ID NO: 18097 - RNA, 22 nt, Homo sapiens
gcggacgguggcggcagcggcg

SEQ ID NO: 18098 - RNA, 18 nt, Homo sapiens
gcggcagcggcggcgcgg

SEQ ID NO: 18099 - RNA, 23 nt, Homo sapiens
ggcgucucugcgcggcggcggcc

SEQ ID NO: 18100 - RNA, 19 nt, Homo sapiens
uccggugcugggggaucug

SEQ ID NO: 18101 - RNA, 21 nt, Homo sapiens
cccgaaagcucugcgcgccuc

SEQ ID NO: 18102 - RNA, 18 nt, Homo sapiens
ccgccucgccgcgccccc

SEQ ID NO: 18103 - RNA, 22 nt, Homo sapiens
ccgcgcccccgccccccgcucg

SEQ ID NO: 18104 - RNA, 21 nt, Homo sapiens
cgccgcgcccccgccccccgc

SEQ ID NO: 18105 - RNA, 16 nt, Homo sapiens
cgccucgccgcgcccc

SEQ ID NO: 18106 - RNA, 19 nt, Homo sapiens
gagcgccucgucacggccg

SEQ ID NO: 18107 - RNA, 18 nt, Homo sapiens
gaggaagagggggcuucc

SEQ ID NO: 18108 - RNA, 19 nt, Homo sapiens
ggccccccauccuggggcc

SEQ ID NO: 18109 - RNA, 18 nt, Homo sapiens
ucaggucagacuccgugu

SEQ ID NO: 18110 - RNA, 17 nt, Homo sapiens
agggcaggggguggggg

SEQ ID NO: 18111 - RNA, 22 nt, Homo sapiens
auauauauguauauauauauau

SEQ ID NO: 18112 - RNA, 22 nt, Homo sapiens
auauauguauauauauauauau

SEQ ID NO: 18113 - RNA, 25 nt, Homo sapiens
caaguuaaaccaggggagcaucggg

SEQ ID NO: 18114 - RNA, 18 nt, Homo sapiens
cagagagauaaccccaga

SEQ ID NO: 18115 - RNA, 25 nt, Homo sapiens
cauuaugcaauaaauuaaagagcca

SEQ ID NO: 18116 - RNA, 24 nt, Homo sapiens
cauuaugcaauaaauuaagagcca

SEQ ID NO: 18117 - RNA, 23 nt, Homo sapiens
cuggugccaggcgcugccuccuu

SEQ ID NO: 18118 - RNA, 16 nt, Homo sapiens
gagaaugagacaugug

SEQ ID NO: 18119 - RNA, 17 nt, Homo sapiens
gcgcggggcacgccagc

SEQ ID NO: 18120 - RNA, 18 nt, Homo sapiens
gcgggagggaagggcagg

SEQ ID NO: 18121 - RNA, 17 nt, Homo sapiens
ggaagggcagggggugg

SEQ ID NO: 18122 - RNA, 17 nt, Homo sapiens
gggcagggggugggggg

SEQ ID NO: 18123 - RNA, 18 nt, Homo sapiens
gggggguggaggaugggg

SEQ ID NO: 18124 - RNA, 19 nt, Homo sapiens
gggguggccagcgcggggg

SEQ ID NO: 18125 - RNA, 17 nt, Homo sapiens
uaaauuaucauuuugaa

SEQ ID NO: 18126 - RNA, 18 nt, Homo sapiens
uauauauauguauauaua

SEQ ID NO: 18127 - RNA, 21 nt, Homo sapiens
uauauauauguauauauauaa

SEQ ID NO: 18128 - RNA, 22 nt, Homo sapiens
uauauauauguauauauauaua

SEQ ID NO: 18129 - RNA, 23 nt, Homo sapiens
uauauauauguauauauauauau

SEQ ID NO: 18130 - RNA, 25 nt, Homo sapiens
uauauauauguauauauauauauau

SEQ ID NO: 18131 - RNA, 22 nt, Homo sapiens
uauauauguauauauauauaua

SEQ ID NO: 18132 - RNA, 23 nt, Homo sapiens
uauauauguauauauauauauau

SEQ ID NO: 18133 - RNA, 21 nt, Homo sapiens
uauauguauauauauauauau

SEQ ID NO: 18134 - RNA, 25 nt, Homo sapiens
uauauuuauauauauguauauauau

SEQ ID NO: 18135 - RNA, 19 nt, Homo sapiens
uauguauauauauauauau

SEQ ID NO: 18136 - RNA, 25 nt, Homo sapiens
uauuuauauauauguauauauauau

SEQ ID NO: 18137 - RNA, 19 nt, Homo sapiens
ucacagcggggccacagcc

SEQ ID NO: 18138 - RNA, 22 nt, Homo sapiens
ugagaaaaagaaaauguauuuc

SEQ ID NO: 18139 - RNA, 16 nt, Homo sapiens
ugauugacugcgcuuc

SEQ ID NO: 18140 - RNA, 23 nt, Homo sapiens
uggcauauuugagaaaaagaaaa

SEQ ID NO: 18141 - RNA, 17 nt, Homo sapiens
uuuuggaauaaucccaa

SEQ ID NO: 18142 - RNA, 22 nt, Homo sapiens
agcuuccccucaagacccucca

SEQ ID NO: 18143 - RNA, 18 nt, Homo sapiens
cagaagagggguggcagc

SEQ ID NO: 18144 - RNA, 20 nt, Homo sapiens
cgcuuccccagcgccgccgc

SEQ ID NO: 18145 - RNA, 18 nt, Homo sapiens
uagaccuucucacaccau

SEQ ID NO: 18146 - RNA, 19 nt, Homo sapiens
cccucucucccguccaaaa

SEQ ID NO: 18147 - RNA, 19 nt, Homo sapiens
cuucucuuuguugaguauc

SEQ ID NO: 18148 - RNA, 18 nt, Homo sapiens
ggcugggcagcuugaagg

SEQ ID NO: 18149 - RNA, 20 nt, Homo sapiens
ugccacaggagguccuggca

SEQ ID NO: 18150 - RNA, 20 nt, Homo sapiens
acgcggugacagguuggguu

SEQ ID NO: 18151 - RNA, 21 nt, Homo sapiens
agaaggaggaugaaugcaaag

SEQ ID NO: 18152 - RNA, 20 nt, Homo sapiens
cccuguguuuccuggggccu

SEQ ID NO: 18153 - RNA, 15 nt, Homo sapiens
gcagaggagcuuugg

SEQ ID NO: 18154 - RNA, 18 nt, Homo sapiens
ggaggugggcucagggac

SEQ ID NO: 18155 - RNA, 21 nt, Homo sapiens
ggugggcagaggagcuuuggg

SEQ ID NO: 18156 - RNA, 21 nt, Homo sapiens
ugcacuuuggaaaguucaaag

SEQ ID NO: 18157 - RNA, 17 nt, Homo sapiens
uggaaaguucaaagggc

SEQ ID NO: 18158 - RNA, 17 nt, Homo sapiens
uguccuuaggcaaagcc

SEQ ID NO: 18159 - RNA, 19 nt, Homo sapiens
aacuaacuguguucccaua

SEQ ID NO: 18160 - RNA, 21 nt, Homo sapiens
aaggggcgggcgccgcggcgg

SEQ ID NO: 18161 - RNA, 18 nt, Homo sapiens
acucugcucgggcccggc

SEQ ID NO: 18162 - RNA, 18 nt, Homo sapiens
agagggggcgggcggcgg

SEQ ID NO: 18163 - RNA, 21 nt, Homo sapiens
agcgggcggggggagaggggg

SEQ ID NO: 18164 - RNA, 16 nt, Homo sapiens
aggaggcggccggccg

SEQ ID NO: 18165 - RNA, 15 nt, Homo sapiens
agggggcgggcggcg

SEQ ID NO: 18166 - RNA, 15 nt, Homo sapiens
ccacuuucuguaacu

SEQ ID NO: 18167 - RNA, 16 nt, Homo sapiens
ccccgccucccucgcc

SEQ ID NO: 18168 - RNA, 22 nt, Homo sapiens
ccgggccggcgcuccgcuuccc

SEQ ID NO: 18169 - RNA, 17 nt, Homo sapiens
cgccgcggcggcggcgg

SEQ ID NO: 18170 - RNA, 17 nt, Homo sapiens
cgccuccucccgcccuc

SEQ ID NO: 18171 - RNA, 27 nt, Homo sapiens
cggcggcggcggggcuuacgcggaagc

SEQ ID NO: 18172 - RNA, 21 nt, Homo sapiens
gcccgcccuggccgcgccucc

SEQ ID NO: 18173 - RNA, 20 nt, Homo sapiens
gcccuggccgcgccuccucc

SEQ ID NO: 18174 - RNA, 18 nt, Homo sapiens
gcgggggaaggggcgggc

SEQ ID NO: 18175 - RNA, 22 nt, Homo sapiens
gcucgcucggccgcugcucguc

SEQ ID NO: 18176 - RNA, 20 nt, Homo sapiens
ggcggcgggggaaggggcgg

SEQ ID NO: 18177 - RNA, 20 nt, Homo sapiens
ggcgggcgaggaggcggccg

SEQ ID NO: 18178 - RNA, 20 nt, Homo sapiens
ggcggggggagagggggcgg

SEQ ID NO: 18179 - RNA, 18 nt, Homo sapiens
gggcggggggagaggggg

SEQ ID NO: 18180 - RNA, 18 nt, Homo sapiens
ggggaaggggcgggcgcc

SEQ ID NO: 18181 - RNA, 23 nt, Homo sapiens
uaacugcccauucuuuuaaagaa

SEQ ID NO: 18182 - RNA, 21 nt, Homo sapiens
uacaggaaaauacuuuugaag

SEQ ID NO: 18183 - RNA, 24 nt, Homo sapiens
ucccccuuccuccugcgccuccgc

SEQ ID NO: 18184 - RNA, 22 nt, Homo sapiens
cccgugggagggcugcagggaa

SEQ ID NO: 18185 - RNA, 21 nt, Homo sapiens
ccgugggagggcugcagggaa

SEQ ID NO: 18186 - RNA, 18 nt, Homo sapiens
ccuaagcccacuacucag

SEQ ID NO: 18187 - RNA, 21 nt, Homo sapiens
guggcugcagcggcggcggcg

SEQ ID NO: 18188 - RNA, 22 nt, Homo sapiens
uccugcuucucuauccacagcc

SEQ ID NO: 18189 - RNA, 15 nt, Homo sapiens
ugcaguggcugcagc

SEQ ID NO: 18190 - RNA, 18 nt, Homo sapiens
aagaaucggugaugaugg

SEQ ID NO: 18191 - RNA, 23 nt, Homo sapiens
aagcugauggaaaggagcaaguu

SEQ ID NO: 18192 - RNA, 21 nt, Homo sapiens
caggcugcaggcagcgccgcc

SEQ ID NO: 18193 - RNA, 18 nt, Homo sapiens
cgcacuggcucgccggcc

SEQ ID NO: 18194 - RNA, 20 nt, Homo sapiens
gaugauggggguggugggug

SEQ ID NO: 18195 - RNA, 16 nt, Homo sapiens
gcucaaagcaaccauc

SEQ ID NO: 18196 - RNA, 19 nt, Homo sapiens
uugaagaaagaggugggag

SEQ ID NO: 18197 - RNA, 26 nt, Homo sapiens
aagugagcuuuggguauaacuuagcc

SEQ ID NO: 18198 - RNA, 21 nt, Homo sapiens
accaguauguaggcaguuuuc

SEQ ID NO: 18199 - RNA, 27 nt, Homo sapiens
agugagcuuuggguauaacuuagcccc

SEQ ID NO: 18200 - RNA, 19 nt, Homo sapiens
augacaaauggucuacugu

SEQ ID NO: 18201 - RNA, 22 nt, Homo sapiens
caacuaaggagagauuugcugc

SEQ ID NO: 18202 - RNA, 20 nt, Homo sapiens
ccaagcaauucauuuuuccu

SEQ ID NO: 18203 - RNA, 16 nt, Homo sapiens
ucccugcucuugagga

SEQ ID NO: 18204 - RNA, 20 nt, Homo sapiens
ugaguguagcaaaaauaaug

SEQ ID NO: 18205 - RNA, 21 nt, Homo sapiens
uguagagaaaguaguugaaaa

SEQ ID NO: 18206 - RNA, 17 nt, Homo sapiens
uguuugguguuuucugc

SEQ ID NO: 18207 - RNA, 19 nt, Homo sapiens
uuaaugcuacccaauguca

SEQ ID NO: 18208 - RNA, 16 nt, Homo sapiens
uucugcccuuauccag

SEQ ID NO: 18209 - RNA, 17 nt, Homo sapiens
aauauauuauagucuac

SEQ ID NO: 18210 - RNA, 21 nt, Homo sapiens
auuacugucccccaagucccc

SEQ ID NO: 18211 - RNA, 20 nt, Homo sapiens
ugaggggugucggccgagag

SEQ ID NO: 18212 - RNA, 18 nt, Homo sapiens
ugcuuaaguacaaaacaa

SEQ ID NO: 18213 - RNA, 16 nt, Homo sapiens
cauguugccaguuuuc

SEQ ID NO: 18214 - RNA, 16 nt, Homo sapiens
cgagaccagccugggg

SEQ ID NO: 18215 - RNA, 16 nt, Homo sapiens
gaguucgagaccagcc

SEQ ID NO: 18216 - RNA, 20 nt, Homo sapiens
uagaaucagggauuacuuua

SEQ ID NO: 18217 - RNA, 18 nt, Homo sapiens
uugccaguuuucccuauu

SEQ ID NO: 18218 - RNA, 18 nt, Homo sapiens
aagaaacugaauaggauu

SEQ ID NO: 18219 - RNA, 22 nt, Homo sapiens
cuuuacaagcuuguagacacac

SEQ ID NO: 18220 - RNA, 22 nt, Homo sapiens
uauaguaauggaugugaacaag

SEQ ID NO: 18221 - RNA, 19 nt, Homo sapiens
aaaaaaaaaaaaaaaaaag

SEQ ID NO: 18222 - RNA, 19 nt, Homo sapiens
aagugggugggggggugaa

SEQ ID NO: 18223 - RNA, 19 nt, Homo sapiens
aggaggaggaggaacaaga

SEQ ID NO: 18224 - RNA, 22 nt, Homo sapiens
aggaggaggaggaacaagagga

SEQ ID NO: 18225 - RNA, 18 nt, Homo sapiens
aucaugcacaauauaugu

SEQ ID NO: 18226 - RNA, 17 nt, Homo sapiens
cagccgccccuccuucc

SEQ ID NO: 18227 - RNA, 17 nt, Homo sapiens
cccccucccccuccccc

SEQ ID NO: 18228 - RNA, 16 nt, Homo sapiens
cccuccccccuccccc

SEQ ID NO: 18229 - RNA, 22 nt, Homo sapiens
ccggcccggcucgcacuuucuc

SEQ ID NO: 18230 - RNA, 19 nt, Homo sapiens
ccggucccuccccccuccc

SEQ ID NO: 18231 - RNA, 15 nt, Homo sapiens
ccguuuuucccucuc

SEQ ID NO: 18232 - RNA, 18 nt, Homo sapiens
ccuccacuagccccucgc

SEQ ID NO: 18233 - RNA, 20 nt, Homo sapiens
ccuccacuagccccucgccc

SEQ ID NO: 18234 - RNA, 25 nt, Homo sapiens
cgacccaccucgcgaaguccuagcc

SEQ ID NO: 18235 - RNA, 22 nt, Homo sapiens
cuccguuuuucccucucugcuu

SEQ ID NO: 18236 - RNA, 19 nt, Homo sapiens
gcgccgcgcggcgcuggcc

SEQ ID NO: 18237 - RNA, 17 nt, Homo sapiens
gcgcgccgcgcggcgcu

SEQ ID NO: 18238 - RNA, 17 nt, Homo sapiens
gcuuucggccgcccacc

SEQ ID NO: 18239 - RNA, 16 nt, Homo sapiens
ugcccuuuuaaaggca

SEQ ID NO: 18240 - RNA, 21 nt, Homo sapiens
uggcgcgcgcgcgccgcgcgg

SEQ ID NO: 18241 - RNA, 24 nt, Homo sapiens
acaauugcaauuaacaagauguag

SEQ ID NO: 18242 - RNA, 23 nt, Homo sapiens
agcagggaggggguguuggcggg

SEQ ID NO: 18243 - RNA, 18 nt, Homo sapiens
agggguggcggcgguugg

SEQ ID NO: 18244 - RNA, 19 nt, Homo sapiens
aucaccacuguuuuagaca

SEQ ID NO: 18245 - RNA, 19 nt, Homo sapiens
cagaauuuguuagaaaaca

SEQ ID NO: 18246 - RNA, 20 nt, Homo sapiens
ccugucccgggcaccccucc

SEQ ID NO: 18247 - RNA, 22 nt, Homo sapiens
gagggaggagaagggaggagaa

SEQ ID NO: 18248 - RNA, 17 nt, Homo sapiens
gcggggggaggaggagg

SEQ ID NO: 18249 - RNA, 20 nt, Homo sapiens
gcugcaacuuuccgucacug

SEQ ID NO: 18250 - RNA, 18 nt, Homo sapiens
ggaggggguguuggcggg

SEQ ID NO: 18251 - RNA, 21 nt, Homo sapiens
ggaggggguguuggcgggggg

SEQ ID NO: 18252 - RNA, 16 nt, Homo sapiens
ggcacgguuuaagacu

SEQ ID NO: 18253 - RNA, 21 nt, Homo sapiens
ggggguguuggcggggggagg

SEQ ID NO: 18254 - RNA, 21 nt, Homo sapiens
ggguguuggcggggggaggag

SEQ ID NO: 18255 - RNA, 18 nt, Homo sapiens
ucuugcccaaaaccuucc

SEQ ID NO: 18256 - RNA, 18 nt, Homo sapiens
uuuaaacucgcaguuaaa

SEQ ID NO: 18257 - RNA, 21 nt, Homo sapiens
uuuaagaauggggugugcaga

SEQ ID NO: 18258 - RNA, 19 nt, Homo sapiens
cuguggcgaggagacccga

SEQ ID NO: 18259 - RNA, 18 nt, Homo sapiens
ugcccuggcgucuuagcu

SEQ ID NO: 18260 - RNA, 22 nt, Homo sapiens
agggaucacucggaccgagggc

SEQ ID NO: 18261 - RNA, 23 nt, Homo sapiens
ccgccgcgggggaggguggcugg

SEQ ID NO: 18262 - RNA, 19 nt, Homo sapiens
gguggcugggcucgaccac

SEQ ID NO: 18263 - RNA, 17 nt, Homo sapiens
uggccgagagaccucgc

SEQ ID NO: 18264 - RNA, 22 nt, Homo sapiens
acaggguuuugccauguuggcc

SEQ ID NO: 18265 - RNA, 20 nt, Homo sapiens
agcaaaacaauguccaaaaa

SEQ ID NO: 18266 - RNA, 23 nt, Homo sapiens
agcugggacagaggagccccggg

SEQ ID NO: 18267 - RNA, 21 nt, Homo sapiens
cacuugaauuuuuauuuaaaa

SEQ ID NO: 18268 - RNA, 22 nt, Homo sapiens
cagcacuuuggggggccgaggc

SEQ ID NO: 18269 - RNA, 15 nt, Homo sapiens
ccgccgccuccucgg

SEQ ID NO: 18270 - RNA, 24 nt, Homo sapiens
ccgggugcaguggcucacaccugu

SEQ ID NO: 18271 - RNA, 16 nt, Homo sapiens
gaacccaggaggcgga

SEQ ID NO: 18272 - RNA, 22 nt, Homo sapiens
gagguugcagugagccaagauc

SEQ ID NO: 18273 - RNA, 17 nt, Homo sapiens
gcgugguggcgggcgcc

SEQ ID NO: 18274 - RNA, 20 nt, Homo sapiens
uaugugcacaauaaccacug

SEQ ID NO: 18275 - RNA, 23 nt, Homo sapiens
ucacucucaguuguaagaucugu

SEQ ID NO: 18276 - RNA, 23 nt, Homo sapiens
ucgaacuccuggccucaggugau

SEQ ID NO: 18277 - RNA, 18 nt, Homo sapiens
ugugagagauaaaguaaa

SEQ ID NO: 18278 - RNA, 21 nt, Homo sapiens
uuguaaaauacgugugagaga

SEQ ID NO: 18279 - RNA, 16 nt, Homo sapiens
uuuugcccaacugcag

SEQ ID NO: 18280 - RNA, 19 nt, Homo sapiens
uucaguugcucuuuccauc

SEQ ID NO: 18281 - RNA, 24 nt, Homo sapiens
uugauuucugugaaaaugcauuuc

SEQ ID NO: 18282 - RNA, 20 nt, Homo sapiens
caaagaggugucucauuagg

SEQ ID NO: 18283 - RNA, 18 nt, Homo sapiens
ccugaguucacuggcucu

SEQ ID NO: 18284 - RNA, 18 nt, Homo sapiens
gucaaaccccauccaagc

SEQ ID NO: 18285 - RNA, 19 nt, Homo sapiens
ucugcagcaggaggcuggc

SEQ ID NO: 18286 - RNA, 23 nt, Homo sapiens
uugugucuucugcugcauuccug

SEQ ID NO: 18287 - RNA, 17 nt, Homo sapiens
aagugaucaacacaggg

SEQ ID NO: 18288 - RNA, 17 nt, Homo sapiens
aggcagacggaggcgac

SEQ ID NO: 18289 - RNA, 16 nt, Homo sapiens
cagcgucagacgcugg

SEQ ID NO: 18290 - RNA, 23 nt, Homo sapiens
cagggccuggagaaggcggaagc

SEQ ID NO: 18291 - RNA, 16 nt, Homo sapiens
gggccuggagaaggcg

SEQ ID NO: 18292 - RNA, 15 nt, Homo sapiens
ggguuuggaugugcc

SEQ ID NO: 18293 - RNA, 18 nt, Homo sapiens
ugauaaugagacagaacc

SEQ ID NO: 18294 - RNA, 18 nt, Homo sapiens
gagaaaacaugagggaag

SEQ ID NO: 18295 - RNA, 18 nt, Homo sapiens
aaaaaaaaaaaaaaaaga

SEQ ID NO: 18296 - RNA, 23 nt, Homo sapiens
aacaaaugauugggcgcggggaa

SEQ ID NO: 18297 - RNA, 22 nt, Homo sapiens
acagaaacagcaucgaggaaua

SEQ ID NO: 18298 - RNA, 17 nt, Homo sapiens
accauguuguccaggcu

SEQ ID NO: 18299 - RNA, 17 nt, Homo sapiens
cacgccccggcacaccc

SEQ ID NO: 18300 - RNA, 18 nt, Homo sapiens
gcccccuccccgcgcccg

SEQ ID NO: 18301 - RNA, 20 nt, Homo sapiens
gggagaauaguuugaacccg

SEQ ID NO: 18302 - RNA, 17 nt, Homo sapiens
uugggaggccgaggcgg

SEQ ID NO: 18303 - RNA, 23 nt, Homo sapiens
agcuggccuccagggaggugguu

SEQ ID NO: 18304 - RNA, 23 nt, Homo sapiens
ccagcauggugugggacccagcc

SEQ ID NO: 18305 - RNA, 19 nt, Homo sapiens
cccuucaguuaggcaguuu

SEQ ID NO: 18306 - RNA, 22 nt, Homo sapiens
gcccgcccgcccgcgcgcagcc

SEQ ID NO: 18307 - RNA, 18 nt, Homo sapiens
gcccgcccgcgcgcagcc

SEQ ID NO: 18308 - RNA, 21 nt, Homo sapiens
gcccuugggggcaagaguggc

SEQ ID NO: 18309 - RNA, 22 nt, Homo sapiens
gcugggagggcaggacagggcc

SEQ ID NO: 18310 - RNA, 22 nt, Homo sapiens
ggcccccuucuugagcagggcc

SEQ ID NO: 18311 - RNA, 16 nt, Homo sapiens
guucuuuaggaggaga

SEQ ID NO: 18312 - RNA, 19 nt, Homo sapiens
ucuauguacagggccacuc

SEQ ID NO: 18313 - RNA, 17 nt, Homo sapiens
ucuugcugucuucucac

SEQ ID NO: 18314 - RNA, 19 nt, Homo sapiens
ccauagucuucacauuuuu

SEQ ID NO: 18315 - RNA, 24 nt, Homo sapiens
uccagggggucccggcgucuuagc

SEQ ID NO: 18316 - RNA, 20 nt, Homo sapiens
gagacggagucucgcucugu

SEQ ID NO: 18317 - RNA, 19 nt, Homo sapiens
ugcaguggcgugaucucgg

SEQ ID NO: 18318 - RNA, 17 nt, Homo sapiens
aaguaugugacuguuca

SEQ ID NO: 18319 - RNA, 18 nt, Homo sapiens
acucucggcugggcgcag

SEQ ID NO: 18320 - RNA, 20 nt, Homo sapiens
aggucagcaguucaaaauca

SEQ ID NO: 18321 - RNA, 17 nt, Homo sapiens
acccccaaugaacucag

SEQ ID NO: 18322 - RNA, 18 nt, Homo sapiens
agcaaccccgagcuucug

SEQ ID NO: 18323 - RNA, 22 nt, Homo sapiens
agccgucugugcgggcaaaccu

SEQ ID NO: 18324 - RNA, 17 nt, Homo sapiens
ccaggugacuuggaggc

SEQ ID NO: 18325 - RNA, 16 nt, Homo sapiens
cggucguccguccccg

SEQ ID NO: 18326 - RNA, 20 nt, Homo sapiens
gagaccaagaauauccauga

SEQ ID NO: 18327 - RNA, 18 nt, Homo sapiens
gccuguccaagccccucc

SEQ ID NO: 18328 - RNA, 24 nt, Homo sapiens
gcgccgggcccaucaccgcggccg

SEQ ID NO: 18329 - RNA, 22 nt, Homo sapiens
guguacccugguguucauccag

SEQ ID NO: 18330 - RNA, 18 nt, Homo sapiens
ugacuuggaggcuggaaa

SEQ ID NO: 18331 - RNA, 18 nt, Homo sapiens
ccuaugucccagcacaug

SEQ ID NO: 18332 - RNA, 17 nt, Homo sapiens
gagcuugguggucccau

SEQ ID NO: 18333 - RNA, 18 nt, Homo sapiens
ucucagaaucagugagac

SEQ ID NO: 18334 - RNA, 22 nt, Homo sapiens
aggugugagccaccgcuccggg

SEQ ID NO: 18335 - RNA, 21 nt, Homo sapiens
caucaacucuaaaugaauggg

SEQ ID NO: 18336 - RNA, 21 nt, Homo sapiens
ccugggaguaauaggcaguuu

SEQ ID NO: 18337 - RNA, 21 nt, Homo sapiens
ucuaaugucaauuaaagcuuu

SEQ ID NO: 18338 - RNA, 19 nt, Homo sapiens
uguaagguucucuccagua

SEQ ID NO: 18339 - RNA, 22 nt, Homo sapiens
accgcccggggccaucgguggc

SEQ ID NO: 18340 - RNA, 23 nt, Homo sapiens
caaaaaaauaaaagagugguuau

SEQ ID NO: 18341 - RNA, 17 nt, Homo sapiens
cauacauucauaguuuu

SEQ ID NO: 18342 - RNA, 18 nt, Homo sapiens
guccugguugacagaugc

SEQ ID NO: 18343 - RNA, 14 nt, Homo sapiens
uggugaauaaagug

SEQ ID NO: 18344 - RNA, 19 nt, Homo sapiens
aaguauucgggagucuuag

SEQ ID NO: 18345 - RNA, 18 nt, Homo sapiens
auuucuauaacuuuucuc

SEQ ID NO: 18346 - RNA, 20 nt, Homo sapiens
caugugcaaaaagaugagca

SEQ ID NO: 18347 - RNA, 18 nt, Homo sapiens
uacaguaagaugugacaa

SEQ ID NO: 18348 - RNA, 21 nt, Homo sapiens
uauuaaguaugaacauugcua

SEQ ID NO: 18349 - RNA, 19 nt, Homo sapiens
ugaggaugugguaaagacu

SEQ ID NO: 18350 - RNA, 18 nt, Homo sapiens
uuuugcauuuccagggga

SEQ ID NO: 18351 - RNA, 19 nt, Homo sapiens
cucagauuuccagacagcc

SEQ ID NO: 18352 - RNA, 18 nt, Homo sapiens
cacagcacacuguggugc

SEQ ID NO: 18353 - RNA, 19 nt, Homo sapiens
cacuguggugcccugguga

SEQ ID NO: 18354 - RNA, 20 nt, Homo sapiens
ucaugccauugcacuccagc

SEQ ID NO: 18355 - RNA, 18 nt, Homo sapiens
ugcccuggugaucauaug

SEQ ID NO: 18356 - RNA, 22 nt, Homo sapiens
cacuugcccaauauuuauuuuu

SEQ ID NO: 18357 - RNA, 17 nt, Homo sapiens
accgggugcaugucgcc

SEQ ID NO: 18358 - RNA, 19 nt, Homo sapiens
caaacaccuuccgugugaa

SEQ ID NO: 18359 - RNA, 18 nt, Homo sapiens
cgcggucccugggagugg

SEQ ID NO: 18360 - RNA, 20 nt, Homo sapiens
cuucuugucaguuuuuugca

SEQ ID NO: 18361 - RNA, 19 nt, Homo sapiens
gcuagccuuuacuagccaa

SEQ ID NO: 18362 - RNA, 18 nt, Homo sapiens
ggaagaguuuugucuucu

SEQ ID NO: 18363 - RNA, 17 nt, Homo sapiens
ggcccaguggcuccggc

SEQ ID NO: 18364 - RNA, 23 nt, Homo sapiens
guagaucacucaucuuuauuaaa

SEQ ID NO: 18365 - RNA, 19 nt, Homo sapiens
ucuagaaacgaagguucuc

SEQ ID NO: 18366 - RNA, 20 nt, Homo sapiens
ccuagaacaagaaauaagga

SEQ ID NO: 18367 - RNA, 25 nt, Homo sapiens
uacuuggcagucauaauauguacac

SEQ ID NO: 18368 - RNA, 21 nt, Homo sapiens
cccgguucuggcugcgcuccg

SEQ ID NO: 18369 - RNA, 19 nt, Homo sapiens
gcgcuccgcggaacgaacc

SEQ ID NO: 18370 - RNA, 18 nt, Homo sapiens
uccgaaagacacugcaag

SEQ ID NO: 18371 - RNA, 21 nt, Homo sapiens
aguaugaauccccaugugggg

SEQ ID NO: 18372 - RNA, 19 nt, Homo sapiens
gcaaccacacaccacacuc

SEQ ID NO: 18373 - RNA, 20 nt, Homo sapiens
gccagagagccaagcucucg

SEQ ID NO: 18374 - RNA, 16 nt, Homo sapiens
uaccuuuuuaggcagc

SEQ ID NO: 18375 - RNA, 24 nt, Homo sapiens
ucguuucgcggggccuccgggacc

SEQ ID NO: 18376 - RNA, 21 nt, Homo sapiens
cccucuuuuuggccaagcccc

SEQ ID NO: 18377 - RNA, 20 nt, Homo sapiens
cccugggcgccccgcucccc

SEQ ID NO: 18378 - RNA, 20 nt, Homo sapiens
ccgcucccccuuuccuggcc

SEQ ID NO: 18379 - RNA, 18 nt, Homo sapiens
ccucgcccucccccaucg

SEQ ID NO: 18380 - RNA, 17 nt, Homo sapiens
cgcccucgcccuccccc

SEQ ID NO: 18381 - RNA, 20 nt, Homo sapiens
gcccuuucucgcccucgccc

SEQ ID NO: 18382 - RNA, 20 nt, Homo sapiens
gccuccgccgucugcagaca

SEQ ID NO: 18383 - RNA, 23 nt, Homo sapiens
gggcaccugcggcagugggggcc

SEQ ID NO: 18384 - RNA, 24 nt, Homo sapiens
aaaauaaauguccaauaguuccug

SEQ ID NO: 18385 - RNA, 18 nt, Homo sapiens
agaagcaggagaaacgag

SEQ ID NO: 18386 - RNA, 21 nt, Homo sapiens
uccaaaccuauuagacuggau

SEQ ID NO: 18387 - RNA, 21 nt, Homo sapiens
agagagaaacaaaagaaaaau

SEQ ID NO: 18388 - RNA, 17 nt, Homo sapiens
agaugagacuuguggcu

SEQ ID NO: 18389 - RNA, 19 nt, Homo sapiens
agcagggguggggugggga

SEQ ID NO: 18390 - RNA, 20 nt, Homo sapiens
aggggugggguggggagggg

SEQ ID NO: 18391 - RNA, 19 nt, Homo sapiens
agguguuagaugauggcuu

SEQ ID NO: 18392 - RNA, 20 nt, Homo sapiens
auugagaaacuucacaagaa

SEQ ID NO: 18393 - RNA, 18 nt, Homo sapiens
caagggcugugccuugaa

SEQ ID NO: 18394 - RNA, 19 nt, Homo sapiens
caggguaugugggggccuu

SEQ ID NO: 18395 - RNA, 15 nt, Homo sapiens
caugguggcaggguu

SEQ ID NO: 18396 - RNA, 18 nt, Homo sapiens
cauugcauagaacguuag

SEQ ID NO: 18397 - RNA, 16 nt, Homo sapiens
ccagggagacagagau

SEQ ID NO: 18398 - RNA, 23 nt, Homo sapiens
cccuauugcuucuaagucaacau

SEQ ID NO: 18399 - RNA, 24 nt, Homo sapiens
cggggucgcgcugcgcccgggccg

SEQ ID NO: 18400 - RNA, 19 nt, Homo sapiens
gaagagagaaagggggaga

SEQ ID NO: 18401 - RNA, 18 nt, Homo sapiens
gccagauuguagaugugu

SEQ ID NO: 18402 - RNA, 18 nt, Homo sapiens
gccgcugccgccgccauc

SEQ ID NO: 18403 - RNA, 18 nt, Homo sapiens
gcggcugugggaaguacg

SEQ ID NO: 18404 - RNA, 16 nt, Homo sapiens
gggagaggcaagggag

SEQ ID NO: 18405 - RNA, 22 nt, Homo sapiens
gggccuuuuacugccugcccug

SEQ ID NO: 18406 - RNA, 20 nt, Homo sapiens
ggggugagcagggagcauag

SEQ ID NO: 18407 - RNA, 18 nt, Homo sapiens
gggguggggagggguggg

SEQ ID NO: 18408 - RNA, 17 nt, Homo sapiens
ggggugggguggggagg

SEQ ID NO: 18409 - RNA, 19 nt, Homo sapiens
gggucccucgggcacagcc

SEQ ID NO: 18410 - RNA, 15 nt, Homo sapiens
gggugggguggggag

SEQ ID NO: 18411 - RNA, 22 nt, Homo sapiens
gggugggguggggagggguggg

SEQ ID NO: 18412 - RNA, 23 nt, Homo sapiens
ggucauguggaggacucggguca

SEQ ID NO: 18413 - RNA, 23 nt, Homo sapiens
uagagccugagacuaggccugcu

SEQ ID NO: 18414 - RNA, 20 nt, Homo sapiens
uccauggaccagaggccugc

SEQ ID NO: 18415 - RNA, 20 nt, Homo sapiens
uccccagguguacagacgag

SEQ ID NO: 18416 - RNA, 19 nt, Homo sapiens
ugaaggagagguucugagg

SEQ ID NO: 18417 - RNA, 22 nt, Homo sapiens
ugagccaagagaagagagaaag

SEQ ID NO: 18418 - RNA, 20 nt, Homo sapiens
ugccacaggucaaacaugcc

SEQ ID NO: 18419 - RNA, 17 nt, Homo sapiens
ugcccuugcguggugcc

SEQ ID NO: 18420 - RNA, 16 nt, Homo sapiens
ugcggaccccugagaa

SEQ ID NO: 18421 - RNA, 18 nt, Homo sapiens
uggagaagggggugagca

SEQ ID NO: 18422 - RNA, 22 nt, Homo sapiens
uggggauuccuuuuuaccugcu

SEQ ID NO: 18423 - RNA, 21 nt, Homo sapiens
ugggguggggagggguggggg

SEQ ID NO: 18424 - RNA, 24 nt, Homo sapiens
ugugucuguugcucucuacuuucc

SEQ ID NO: 18425 - RNA, 21 nt, Homo sapiens
uuacagcauggggguggguaa

SEQ ID NO: 18426 - RNA, 18 nt, Homo sapiens
agacacaaguuuauuggu

SEQ ID NO: 18427 - RNA, 18 nt, Homo sapiens
agagagaggccgggccgg

SEQ ID NO: 18428 - RNA, 16 nt, Homo sapiens
cgaacugcagcgacug

SEQ ID NO: 18429 - RNA, 23 nt, Homo sapiens
cgacuguggcgcgcggaguccga

SEQ ID NO: 18430 - RNA, 20 nt, Homo sapiens
gcgggcuuuggggccccugc

SEQ ID NO: 18431 - RNA, 17 nt, Homo sapiens
gggccauguggggaggg

SEQ ID NO: 18432 - RNA, 18 nt, Homo sapiens
ggggcuggggcugaggcu

SEQ ID NO: 18433 - RNA, 16 nt, Homo sapiens
cccagggcggggaucc

SEQ ID NO: 18434 - RNA, 18 nt, Homo sapiens
gccgcgucucggguggcc

SEQ ID NO: 18435 - RNA, 19 nt, Homo sapiens
gccggagcgugcgcgccgc

SEQ ID NO: 18436 - RNA, 21 nt, Homo sapiens
gcgccgcgucucggguggccg

SEQ ID NO: 18437 - RNA, 18 nt, Homo sapiens
ggccgagggcgcgggugc

SEQ ID NO: 18438 - RNA, 18 nt, Homo sapiens
ucccugcaggaugggcga

SEQ ID NO: 18439 - RNA, 18 nt, Homo sapiens
ugaggugggggcaggugg

SEQ ID NO: 18440 - RNA, 21 nt, Homo sapiens
ugggaggggcuagacaucaaa

SEQ ID NO: 18441 - RNA, 25 nt, Homo sapiens
ccagcagcugcccuguccagugugg

SEQ ID NO: 18442 - RNA, 16 nt, Homo sapiens
cgguggcuacuggagc

SEQ ID NO: 18443 - RNA, 18 nt, Homo sapiens
gaauggagagauuaucua

SEQ ID NO: 18444 - RNA, 17 nt, Homo sapiens
accugguuucaucugcc

SEQ ID NO: 18445 - RNA, 28 nt, Homo sapiens
cuccccguucuccgggcgagcuucucgg

SEQ ID NO: 18446 - RNA, 15 nt, Homo sapiens
uccuccccguucucc

SEQ ID NO: 18447 - RNA, 15 nt, Homo sapiens
accccaggaaggcag

SEQ ID NO: 18448 - RNA, 16 nt, Homo sapiens
cagggcuggugcacgg

SEQ ID NO: 18449 - RNA, 20 nt, Homo sapiens
ccacuaaccucuucuccccc

SEQ ID NO: 18450 - RNA, 18 nt, Homo sapiens
ccggggcugcgagcccgg

SEQ ID NO: 18451 - RNA, 22 nt, Homo sapiens
ccuccuccuccucccgcgcguc

SEQ ID NO: 18452 - RNA, 18 nt, Homo sapiens
cggcagggagacgcgcac

SEQ ID NO: 18453 - RNA, 18 nt, Homo sapiens
cggcggcggcggcggcgg

SEQ ID NO: 18454 - RNA, 16 nt, Homo sapiens
cgucgucggcgacggc

SEQ ID NO: 18455 - RNA, 21 nt, Homo sapiens
ggcggcggcggcggggcggcc

SEQ ID NO: 18456 - RNA, 17 nt, Homo sapiens
ucauuggcauccaagcu

SEQ ID NO: 18457 - RNA, 21 nt, Homo sapiens
ucucuguuuugccuuaacaga

SEQ ID NO: 18458 - RNA, 23 nt, Homo sapiens
cuauaauugcaccaaaaauuuag

SEQ ID NO: 18459 - RNA, 23 nt, Homo sapiens
gaagaauuaaaggauacaaugug

SEQ ID NO: 18460 - RNA, 24 nt, Homo sapiens
uauacacacacauauauauauaua

SEQ ID NO: 18461 - RNA, 24 nt, Homo sapiens
uauauacacacacauauauauaua

SEQ ID NO: 18462 - RNA, 20 nt, Homo sapiens
uauauauacacacacauaua

SEQ ID NO: 18463 - RNA, 24 nt, Homo sapiens
uauauauacacacacauauauaua

SEQ ID NO: 18464 - RNA, 24 nt, Homo sapiens
uauauauauacacacacauauaua

SEQ ID NO: 18465 - RNA, 24 nt, Homo sapiens
uauauauauauacacacacauaua

SEQ ID NO: 18466 - RNA, 21 nt, Homo sapiens
aguagacagagcaccauagca

SEQ ID NO: 18467 - RNA, 17 nt, Homo sapiens
ccaguccagaagacaga

SEQ ID NO: 18468 - RNA, 22 nt, Homo sapiens
ccgccgcugagcucuucuagcc

SEQ ID NO: 18469 - RNA, 19 nt, Homo sapiens
ccugaagccccuuggcucu

SEQ ID NO: 18470 - RNA, 20 nt, Homo sapiens
cuguccgaguuggcccgggg

SEQ ID NO: 18471 - RNA, 17 nt, Homo sapiens
gcagcagcucucgggcc

SEQ ID NO: 18472 - RNA, 16 nt, Homo sapiens
gcccggcggcgagcgc

SEQ ID NO: 18473 - RNA, 21 nt, Homo sapiens
gcccggggacuaggaagagcg

SEQ ID NO: 18474 - RNA, 17 nt, Homo sapiens
gcgucgcgcgcgcgccg

SEQ ID NO: 18475 - RNA, 20 nt, Homo sapiens
ggaacaccgggaaagugaaa

SEQ ID NO: 18476 - RNA, 21 nt, Homo sapiens
ggguaguugggggacugcuuu

SEQ ID NO: 18477 - RNA, 15 nt, Homo sapiens
uacagaaacaccacc

SEQ ID NO: 18478 - RNA, 18 nt, Homo sapiens
ucucuauccugguguggc

SEQ ID NO: 18479 - RNA, 23 nt, Homo sapiens
ucuuuguccaauaucuacgaaua

SEQ ID NO: 18480 - RNA, 24 nt, Homo sapiens
ugcgucgcgcgcgcgccguucugg

SEQ ID NO: 18481 - RNA, 20 nt, Homo sapiens
uggcuacaccuuaagauucc

SEQ ID NO: 18482 - RNA, 22 nt, Homo sapiens
uuaaaaaaguuuccccccgugu

SEQ ID NO: 18483 - RNA, 19 nt, Homo sapiens
aggcagucguggccuuugg

SEQ ID NO: 18484 - RNA, 18 nt, Homo sapiens
gaggagcccucugugacc

SEQ ID NO: 18485 - RNA, 19 nt, Homo sapiens
gcuguguacacacagugaa

SEQ ID NO: 18486 - RNA, 21 nt, Homo sapiens
aagcgguuuaccuagaaaggu

SEQ ID NO: 18487 - RNA, 20 nt, Homo sapiens
caaauauuccaaaaugcuca

SEQ ID NO: 18488 - RNA, 19 nt, Homo sapiens
ccuuuauuaguuagaguuu

SEQ ID NO: 18489 - RNA, 24 nt, Homo sapiens
gucauucuuuucauucaugcuucu

SEQ ID NO: 18490 - RNA, 20 nt, Homo sapiens
uacauauuuuagcuauaguu

SEQ ID NO: 18491 - RNA, 19 nt, Homo sapiens
accccacccucacccuucc

SEQ ID NO: 18492 - RNA, 18 nt, Homo sapiens
agggaccuggauaaaggg

SEQ ID NO: 18493 - RNA, 18 nt, Homo sapiens
uacaguauuugcugcugu

SEQ ID NO: 18494 - RNA, 23 nt, Homo sapiens
uguacauuuacaguauuugcugc

SEQ ID NO: 18495 - RNA, 18 nt, Homo sapiens
aaaaaaaaaaaaaagcca

SEQ ID NO: 18496 - RNA, 20 nt, Homo sapiens
aauuccuuuucucuuucucu

SEQ ID NO: 18497 - RNA, 16 nt, Homo sapiens
aaguuuagucucccuu

SEQ ID NO: 18498 - RNA, 18 nt, Homo sapiens
uaagccauauagucauca

SEQ ID NO: 18499 - RNA, 20 nt, Homo sapiens
uagaauguguguuacaauga

SEQ ID NO: 18500 - RNA, 21 nt, Homo sapiens
aagggggaggggaggcacagg

SEQ ID NO: 18501 - RNA, 16 nt, Homo sapiens
agaggaugcacaaagc

SEQ ID NO: 18502 - RNA, 16 nt, Homo sapiens
accccaccccccccuc

SEQ ID NO: 18503 - RNA, 19 nt, Homo sapiens
agguaagugguauucaggu

SEQ ID NO: 18504 - RNA, 21 nt, Homo sapiens
ccccuguguuuacagcaguuu

SEQ ID NO: 18505 - RNA, 19 nt, Homo sapiens
ccgcuucgccucgaccgcc

SEQ ID NO: 18506 - RNA, 18 nt, Homo sapiens
ccuaacuugcagaaaugg

SEQ ID NO: 18507 - RNA, 15 nt, Homo sapiens
cgccgcuaccgccgc

SEQ ID NO: 18508 - RNA, 15 nt, Homo sapiens
cgccucgaccgcccc

SEQ ID NO: 18509 - RNA, 17 nt, Homo sapiens
cggcggcgguggguggg

SEQ ID NO: 18510 - RNA, 15 nt, Homo sapiens
cgguggagguggagg

SEQ ID NO: 18511 - RNA, 18 nt, Homo sapiens
cgguuuuucucacccgcc

SEQ ID NO: 18512 - RNA, 19 nt, Homo sapiens
cuguugcuuaggcugccgc

SEQ ID NO: 18513 - RNA, 20 nt, Homo sapiens
gaaaagagagagggagaggg

SEQ ID NO: 18514 - RNA, 15 nt, Homo sapiens
gagagagagagagag

SEQ ID NO: 18515 - RNA, 19 nt, Homo sapiens
gagagagggagagggagag

SEQ ID NO: 18516 - RNA, 19 nt, Homo sapiens
gagagggagagagagagag

SEQ ID NO: 18517 - RNA, 18 nt, Homo sapiens
gaggagaggaggaggcgc

SEQ ID NO: 18518 - RNA, 22 nt, Homo sapiens
gaggaggagaggaggaggcgcu

SEQ ID NO: 18519 - RNA, 19 nt, Homo sapiens
gaggaggaggaggagagga

SEQ ID NO: 18520 - RNA, 18 nt, Homo sapiens
gcgcgcgcugcccgggcu

SEQ ID NO: 18521 - RNA, 18 nt, Homo sapiens
gcgggagcaggcagcggc

SEQ ID NO: 18522 - RNA, 17 nt, Homo sapiens
gcgggcaccgggagcac

SEQ ID NO: 18523 - RNA, 21 nt, Homo sapiens
gcggggcgagcgcgagcuggc

SEQ ID NO: 18524 - RNA, 19 nt, Homo sapiens
ggagguggcgguggaggug

SEQ ID NO: 18525 - RNA, 19 nt, Homo sapiens
ggcggcggugggugggugc

SEQ ID NO: 18526 - RNA, 27 nt, Homo sapiens
gggaggaggaggaggagaggaggaggc

SEQ ID NO: 18527 - RNA, 16 nt, Homo sapiens
gguggagguagcaaga

SEQ ID NO: 18528 - RNA, 20 nt, Homo sapiens
guuugcuuacuucccuuuuu

SEQ ID NO: 18529 - RNA, 20 nt, Homo sapiens
ucuuugguguucuaaacaga

SEQ ID NO: 18530 - RNA, 21 nt, Homo sapiens
ugagugugugugagugugagu

SEQ ID NO: 18531 - RNA, 25 nt, Homo sapiens
ugagugugugugagugugugugagu

SEQ ID NO: 18532 - RNA, 18 nt, Homo sapiens
ugccucccgccgccgcua

SEQ ID NO: 18533 - RNA, 21 nt, Homo sapiens
uggccacaagcuuuuuuuuuc

SEQ ID NO: 18534 - RNA, 16 nt, Homo sapiens
ugggugccggaggugg

SEQ ID NO: 18535 - RNA, 14 nt, Homo sapiens
uugcuuacuucccu

SEQ ID NO: 18536 - RNA, 21 nt, Homo sapiens
aggcuggaguggggcacacag

SEQ ID NO: 18537 - RNA, 19 nt, Homo sapiens
agggagcaggcauggcacc

SEQ ID NO: 18538 - RNA, 19 nt, Homo sapiens
caagugcgugccgucgaga

SEQ ID NO: 18539 - RNA, 25 nt, Homo sapiens
caccaggcagguggggcaccagcug

SEQ ID NO: 18540 - RNA, 17 nt, Homo sapiens
cacccgggagccgcggc

SEQ ID NO: 18541 - RNA, 17 nt, Homo sapiens
cacuggauggugagggg

SEQ ID NO: 18542 - RNA, 18 nt, Homo sapiens
cagcucagacgcccagaa

SEQ ID NO: 18543 - RNA, 19 nt, Homo sapiens
caguagcucuguuugccca

SEQ ID NO: 18544 - RNA, 15 nt, Homo sapiens
cgcaccggccgggcc

SEQ ID NO: 18545 - RNA, 21 nt, Homo sapiens
cgugcgugggccccgccggcc

SEQ ID NO: 18546 - RNA, 21 nt, Homo sapiens
gcacuugcuuguugugguggg

SEQ ID NO: 18547 - RNA, 20 nt, Homo sapiens
gccagaaggggcugccgggc

SEQ ID NO: 18548 - RNA, 17 nt, Homo sapiens
gccguguccggcuucgu

SEQ ID NO: 18549 - RNA, 24 nt, Homo sapiens
ggagaccaaaagcugcuccugggc

SEQ ID NO: 18550 - RNA, 18 nt, Homo sapiens
ggagggggagggggaagc

SEQ ID NO: 18551 - RNA, 19 nt, Homo sapiens
ggccgccggcucccuguau

SEQ ID NO: 18552 - RNA, 14 nt, Homo sapiens
gggcaccagcugcu

SEQ ID NO: 18553 - RNA, 19 nt, Homo sapiens
gggccugggacacccggga

SEQ ID NO: 18554 - RNA, 18 nt, Homo sapiens
gggugccuggccgcggug

SEQ ID NO: 18555 - RNA, 20 nt, Homo sapiens
ucagggcugugccacaggcc

SEQ ID NO: 18556 - RNA, 16 nt, Homo sapiens
ucccagagcaggaggu

SEQ ID NO: 18557 - RNA, 19 nt, Homo sapiens
ugacgcuggaccacuuggc

SEQ ID NO: 18558 - RNA, 19 nt, Homo sapiens
uggguugcggggaaccgga

SEQ ID NO: 18559 - RNA, 15 nt, Homo sapiens
gcgcggcggccggag

SEQ ID NO: 18560 - RNA, 19 nt, Homo sapiens
aguggccgagugugauggg

SEQ ID NO: 18561 - RNA, 21 nt, Homo sapiens
cagcgguuccuaaacauauuu

SEQ ID NO: 18562 - RNA, 19 nt, Homo sapiens
gaaacggcauuccuggugg

SEQ ID NO: 18563 - RNA, 18 nt, Homo sapiens
gaggcaggagggggacga

SEQ ID NO: 18564 - RNA, 18 nt, Homo sapiens
gaguaaccuaccaauacc

SEQ ID NO: 18565 - RNA, 20 nt, Homo sapiens
gcugugaggcgaggguggca

SEQ ID NO: 18566 - RNA, 22 nt, Homo sapiens
gucugcguuugauggagguggg

SEQ ID NO: 18567 - RNA, 23 nt, Homo sapiens
uagauaaucgguuccugggucaa

SEQ ID NO: 18568 - RNA, 17 nt, Homo sapiens
uagcugcggagagccug

SEQ ID NO: 18569 - RNA, 19 nt, Homo sapiens
ucgcucaggccuguuuuga

SEQ ID NO: 18570 - RNA, 30 nt, Homo sapiens
ugggaacaaauauagauaaucgguuccugc

SEQ ID NO: 18571 - RNA, 17 nt, Homo sapiens
ugugaggcgaggguggc

SEQ ID NO: 18572 - RNA, 18 nt, Homo sapiens
gcgcuccgaagcgacgcc

SEQ ID NO: 18573 - RNA, 18 nt, Homo sapiens
ggcggcggggcucgcggg

SEQ ID NO: 18574 - RNA, 19 nt, Homo sapiens
ggugaggaggggauggggc

SEQ ID NO: 18575 - RNA, 15 nt, Homo sapiens
guggggugaggaggg

SEQ ID NO: 18576 - RNA, 16 nt, Homo sapiens
ugaggaggggaugggg

SEQ ID NO: 18577 - RNA, 18 nt, Homo sapiens
uaaaagagccuuuggggu

SEQ ID NO: 18578 - RNA, 20 nt, Homo sapiens
aaaaagcguuggguuggggg

SEQ ID NO: 18579 - RNA, 24 nt, Homo sapiens
aggcaggccagucccaugcuggag

SEQ ID NO: 18580 - RNA, 24 nt, Homo sapiens
gaggccggcucgaaucucuggcuc

SEQ ID NO: 18581 - RNA, 20 nt, Homo sapiens
ggagaaggaaaugauggaag

SEQ ID NO: 18582 - RNA, 18 nt, Homo sapiens
ggucuggaggagcucgcc

SEQ ID NO: 18583 - RNA, 22 nt, Homo sapiens
ucaucuuccacccccgccgccc

SEQ ID NO: 18584 - RNA, 25 nt, Homo sapiens
ucgcuggagagggcuggcugggcga

SEQ ID NO: 18585 - RNA, 20 nt, Homo sapiens
uggguugggggagaaggaaa

SEQ ID NO: 18586 - RNA, 20 nt, Homo sapiens
aggggcccuaaaaagggccu

SEQ ID NO: 18587 - RNA, 19 nt, Homo sapiens
accucggcggcccggcucc

SEQ ID NO: 18588 - RNA, 17 nt, Homo sapiens
cagccccgaccucggcg

SEQ ID NO: 18589 - RNA, 17 nt, Homo sapiens
cccagugaaacuauggg

SEQ ID NO: 18590 - RNA, 23 nt, Homo sapiens
ccgcucggccgcgcgcagucccg

SEQ ID NO: 18591 - RNA, 21 nt, Homo sapiens
ccugcaggcccggcccgcgac

SEQ ID NO: 18592 - RNA, 23 nt, Homo sapiens
gugaaacuauggggcuucuguga

SEQ ID NO: 18593 - RNA, 23 nt, Homo sapiens
uaaguuucagcucugccauuucc

SEQ ID NO: 18594 - RNA, 16 nt, Homo sapiens
uuccagaccggagaau

SEQ ID NO: 18595 - RNA, 17 nt, Homo sapiens
uuuaaauuaggaaggua

SEQ ID NO: 18596 - RNA, 20 nt, Homo sapiens
aauuucuuuuccacggugca

SEQ ID NO: 18597 - RNA, 15 nt, Homo sapiens
caccgcgaucccaga

SEQ ID NO: 18598 - RNA, 20 nt, Homo sapiens
aaccucuaucuuggguccuu

SEQ ID NO: 18599 - RNA, 18 nt, Homo sapiens
aagagcaccagcaccagg

SEQ ID NO: 18600 - RNA, 20 nt, Homo sapiens
agacagaucaaugguaaugg

SEQ ID NO: 18601 - RNA, 20 nt, Homo sapiens
auuauuuuaaauucccaacu

SEQ ID NO: 18602 - RNA, 19 nt, Homo sapiens
cugucauugauauauacca

SEQ ID NO: 18603 - RNA, 18 nt, Homo sapiens
uaccucauaacaguaaac

SEQ ID NO: 18604 - RNA, 18 nt, Homo sapiens
ucuuggguccuuuucucu

SEQ ID NO: 18605 - RNA, 18 nt, Homo sapiens
ugagaugcaaaaugccag

SEQ ID NO: 18606 - RNA, 18 nt, Homo sapiens
gcccggcggcacgaggcc

SEQ ID NO: 18607 - RNA, 21 nt, Homo sapiens
accgcagccgccgccgccgcg

SEQ ID NO: 18608 - RNA, 15 nt, Homo sapiens
agaggcgcgcgagga

SEQ ID NO: 18609 - RNA, 18 nt, Homo sapiens
aggagcgcugugcgguug

SEQ ID NO: 18610 - RNA, 22 nt, Homo sapiens
aucucaguaaccacaucuuucc

SEQ ID NO: 18611 - RNA, 20 nt, Homo sapiens
auuucaggcgcuaucucccc

SEQ ID NO: 18612 - RNA, 14 nt, Homo sapiens
cgcaauccaccgcc

SEQ ID NO: 18613 - RNA, 18 nt, Homo sapiens
gagggggagggggcaaaa

SEQ ID NO: 18614 - RNA, 18 nt, Homo sapiens
gccuccgccuccuucucc

SEQ ID NO: 18615 - RNA, 17 nt, Homo sapiens
gcuuucggcccgcuccc

SEQ ID NO: 18616 - RNA, 22 nt, Homo sapiens
ggcucccggcuggcggcgccgc

SEQ ID NO: 18617 - RNA, 16 nt, Homo sapiens
ggggagaacccgggug

SEQ ID NO: 18618 - RNA, 23 nt, Homo sapiens
ggggcugccaggggcacggccgg

SEQ ID NO: 18619 - RNA, 18 nt, Homo sapiens
uccgucgagcccaagccg

SEQ ID NO: 18620 - RNA, 22 nt, Homo sapiens
uguggaguucuguaccuuaaga

SEQ ID NO: 18621 - RNA, 24 nt, Homo sapiens
uuucaauuucuguuuacguuuugc

SEQ ID NO: 18622 - RNA, 20 nt, Homo sapiens
uuucggcccgcucccccggc

SEQ ID NO: 18623 - RNA, 19 nt, Homo sapiens
uuugcaggagcugaguugu

SEQ ID NO: 18624 - RNA, 18 nt, Homo sapiens
auauuguugucauuaacc

SEQ ID NO: 18625 - RNA, 21 nt, Homo sapiens
caguguaacacaaauuugcuu

SEQ ID NO: 18626 - RNA, 14 nt, Homo sapiens
ccugauuuuaccac

SEQ ID NO: 18627 - RNA, 20 nt, Homo sapiens
gagacggcuccgggguugcg

SEQ ID NO: 18628 - RNA, 18 nt, Homo sapiens
aaagcaacaagucaucac

SEQ ID NO: 18629 - RNA, 20 nt, Homo sapiens
caaggggaaaaaugcauucc

SEQ ID NO: 18630 - RNA, 20 nt, Homo sapiens
ccuacuccacgucuccuugg

SEQ ID NO: 18631 - RNA, 19 nt, Homo sapiens
ccugcagcagggggaucgc

SEQ ID NO: 18632 - RNA, 15 nt, Homo sapiens
gcgggagggggcagg

SEQ ID NO: 18633 - RNA, 20 nt, Homo sapiens
gcgggagggggcaggggagg

SEQ ID NO: 18634 - RNA, 17 nt, Homo sapiens
ggggugggaaagguggg

SEQ ID NO: 18635 - RNA, 23 nt, Homo sapiens
gggugggaaagguggggaggggc

SEQ ID NO: 18636 - RNA, 21 nt, Homo sapiens
ucugggcuccaguuuggcccc

SEQ ID NO: 18637 - RNA, 21 nt, Homo sapiens
uuaacuuuccuuuauuaugag

SEQ ID NO: 18638 - RNA, 23 nt, Homo sapiens
agccuuuggguuuuaagacugau

SEQ ID NO: 18639 - RNA, 15 nt, Homo sapiens
cccugaaaagggccu

SEQ ID NO: 18640 - RNA, 16 nt, Homo sapiens
ugcaaggaaaggccug

SEQ ID NO: 18641 - RNA, 18 nt, Homo sapiens
ugaugguaagcuccugga

SEQ ID NO: 18642 - RNA, 18 nt, Homo sapiens
ugggagcugacagaauuu

SEQ ID NO: 18643 - RNA, 18 nt, Homo sapiens
uuuuccccgguuucccag

SEQ ID NO: 18644 - RNA, 24 nt, Homo sapiens
caacguuggcccccagcggugcgg

SEQ ID NO: 18645 - RNA, 19 nt, Homo sapiens
gaugcuggccucugggaug

SEQ ID NO: 18646 - RNA, 19 nt, Homo sapiens
gcgcgucacaacacccgcc

SEQ ID NO: 18647 - RNA, 16 nt, Homo sapiens
gcggcacgccacggcg

SEQ ID NO: 18648 - RNA, 24 nt, Homo sapiens
gcguccugcggcacgccacggcgu

SEQ ID NO: 18649 - RNA, 18 nt, Homo sapiens
uggcagcagggaaaagaa

SEQ ID NO: 18650 - RNA, 18 nt, Homo sapiens
ccaggcccccuucuuccc

SEQ ID NO: 18651 - RNA, 18 nt, Homo sapiens
ccccgcccccuccgggcc

SEQ ID NO: 18652 - RNA, 17 nt, Homo sapiens
ccugagauaccaggccc

SEQ ID NO: 18653 - RNA, 22 nt, Homo sapiens
gaggaggaguuuaaagaggagc

SEQ ID NO: 18654 - RNA, 20 nt, Homo sapiens
gaggugguuaaacacccuua

SEQ ID NO: 18655 - RNA, 18 nt, Homo sapiens
guuccuagucaaagacga

SEQ ID NO: 18656 - RNA, 23 nt, Homo sapiens
ucagagagaaagaacuaagguag

SEQ ID NO: 18657 - RNA, 15 nt, Homo sapiens
uccccgcccccuccg

SEQ ID NO: 18658 - RNA, 19 nt, Homo sapiens
uccccucuuuaccuuagcu

SEQ ID NO: 18659 - RNA, 19 nt, Homo sapiens
ucucccagcccauggcugc

SEQ ID NO: 18660 - RNA, 16 nt, Homo sapiens
ugccaaguccagcaau

SEQ ID NO: 18661 - RNA, 17 nt, Homo sapiens
uggaccagcucaaggcc

SEQ ID NO: 18662 - RNA, 19 nt, Homo sapiens
uggaguggaggggaugcug

SEQ ID NO: 18663 - RNA, 19 nt, Homo sapiens
agcuaguuuucuauaaagu

SEQ ID NO: 18664 - RNA, 20 nt, Homo sapiens
auacuuaauuuaccaaugug

SEQ ID NO: 18665 - RNA, 17 nt, Homo sapiens
caggaagagaaaaggcc

SEQ ID NO: 18666 - RNA, 16 nt, Homo sapiens
gcuuaguagcaacaga

SEQ ID NO: 18667 - RNA, 21 nt, Homo sapiens
guugcuuauguauaaucacug

SEQ ID NO: 18668 - RNA, 19 nt, Homo sapiens
uccaaaaaggugauuggca

SEQ ID NO: 18669 - RNA, 18 nt, Homo sapiens
ugaucagccuuaaguuug

SEQ ID NO: 18670 - RNA, 20 nt, Homo sapiens
caccccggcugucacgcccc

SEQ ID NO: 18671 - RNA, 18 nt, Homo sapiens
cagaggugggacggugcu

SEQ ID NO: 18672 - RNA, 16 nt, Homo sapiens
ccccagccccuccccc

SEQ ID NO: 18673 - RNA, 14 nt, Homo sapiens
cggcuccgcccccg

SEQ ID NO: 18674 - RNA, 18 nt, Homo sapiens
ggaggguggcagaggugg

SEQ ID NO: 18675 - RNA, 20 nt, Homo sapiens
caguggcuauaggcgcagca

SEQ ID NO: 18676 - RNA, 15 nt, Homo sapiens
ccagggcgcaguggc

SEQ ID NO: 18677 - RNA, 21 nt, Homo sapiens
gcaguggcuauaggcgcagca

SEQ ID NO: 18678 - RNA, 22 nt, Homo sapiens
ggcgcgcgcacgccccuccagc

SEQ ID NO: 18679 - RNA, 14 nt, Homo sapiens
uccuuuaccgcaga

SEQ ID NO: 18680 - RNA, 21 nt, Homo sapiens
uggaagggaaauaaauagagg

SEQ ID NO: 18681 - RNA, 21 nt, Homo sapiens
aauauauaucuacauauauau

SEQ ID NO: 18682 - RNA, 18 nt, Homo sapiens
gaagaaggagagacagaa

SEQ ID NO: 18683 - RNA, 20 nt, Homo sapiens
gaaugaacggaggacacaga

SEQ ID NO: 18684 - RNA, 18 nt, Homo sapiens
gcagcagcugccacaggc

SEQ ID NO: 18685 - RNA, 23 nt, Homo sapiens
ugauggcuauggggaagggaaug

SEQ ID NO: 18686 - RNA, 14 nt, Homo sapiens
ugccccagaugugu

SEQ ID NO: 18687 - RNA, 18 nt, Homo sapiens
uggcuauggggaagggaa

SEQ ID NO: 18688 - RNA, 17 nt, Homo sapiens
agcaagaguucuugcaa

SEQ ID NO: 18689 - RNA, 18 nt, Homo sapiens
agugaacuccacucagcc

SEQ ID NO: 18690 - RNA, 16 nt, Homo sapiens
gcagcacaggagcaca

SEQ ID NO: 18691 - RNA, 20 nt, Homo sapiens
ggaugacccagguacagaua

SEQ ID NO: 18692 - RNA, 18 nt, Homo sapiens
gguagaggaaaguggggg

SEQ ID NO: 18693 - RNA, 18 nt, Homo sapiens
ugagaugggaaaauuaag

SEQ ID NO: 18694 - RNA, 21 nt, Homo sapiens
ugaggugggugucguuguugu

SEQ ID NO: 18695 - RNA, 19 nt, Homo sapiens
ugagugaacuccacucagc

SEQ ID NO: 18696 - RNA, 23 nt, Homo sapiens
uuugccaaaagaauucgaguauc

SEQ ID NO: 18697 - RNA, 24 nt, Homo sapiens
uauccuuaguaauuuuacuaggca

SEQ ID NO: 18698 - RNA, 23 nt, Homo sapiens
uuuauacaauagcuuuaaaauaa

SEQ ID NO: 18699 - RNA, 22 nt, Homo sapiens
aagcauuuauuugaaggaggac

SEQ ID NO: 18700 - RNA, 18 nt, Homo sapiens
gaaggaggacaagggaga

SEQ ID NO: 18701 - RNA, 19 nt, Homo sapiens
augaauuucauaaaggacu

SEQ ID NO: 18702 - RNA, 21 nt, Homo sapiens
aaaaaaggaggaggaugaaga

SEQ ID NO: 18703 - RNA, 22 nt, Homo sapiens
agguguaccaaaaggggcguag

SEQ ID NO: 18704 - RNA, 23 nt, Homo sapiens
ggaggaggaugaagaaggaaaaa

SEQ ID NO: 18705 - RNA, 19 nt, Homo sapiens
uaaggcuucgucaguaacc

SEQ ID NO: 18706 - RNA, 22 nt, Homo sapiens
ucugcuggcucucugccuuggc

SEQ ID NO: 18707 - RNA, 23 nt, Homo sapiens
ucuggcugcagcacagugccgcg

SEQ ID NO: 18708 - RNA, 15 nt, Homo sapiens
uggcgcugggguggc

SEQ ID NO: 18709 - RNA, 18 nt, Homo sapiens
ugggaaagaugauaugca

SEQ ID NO: 18710 - RNA, 22 nt, Homo sapiens
uguucuguaagagaggggcauu

SEQ ID NO: 18711 - RNA, 21 nt, Homo sapiens
uuccuuaugcacgccgaaagg

SEQ ID NO: 18712 - RNA, 19 nt, Homo sapiens
ccuggagaggggagacugc

SEQ ID NO: 18713 - RNA, 19 nt, Homo sapiens
accccagcaccucucucuc

SEQ ID NO: 18714 - RNA, 21 nt, Homo sapiens
ggaguggggaugaugguccca

SEQ ID NO: 18715 - RNA, 20 nt, Homo sapiens
ggggugggauuggggguggg

SEQ ID NO: 18716 - RNA, 20 nt, Homo sapiens
ucuugaugauuuucucccag

SEQ ID NO: 18717 - RNA, 18 nt, Homo sapiens
uucccagggcuggaggug

SEQ ID NO: 18718 - RNA, 22 nt, Homo sapiens
ggaccccgcucggggagaggcg

SEQ ID NO: 18719 - RNA, 22 nt, Homo sapiens
ggggagaggcgccaguuggggg

SEQ ID NO: 18720 - RNA, 23 nt, Homo sapiens
ccgccgccgccgccucccggccg

SEQ ID NO: 18721 - RNA, 15 nt, Homo sapiens
gccgccccucgcgcg

SEQ ID NO: 18722 - RNA, 19 nt, Homo sapiens
ucaaugcuucaguucuaaa

SEQ ID NO: 18723 - RNA, 17 nt, Homo sapiens
ccuaacggcuccaacag

SEQ ID NO: 18724 - RNA, 19 nt, Homo sapiens
gaaucuuguguaauagucu

SEQ ID NO: 18725 - RNA, 17 nt, Homo sapiens
gugggaaaaaugaggga

SEQ ID NO: 18726 - RNA, 17 nt, Homo sapiens
uaaaauaccuggccaca

SEQ ID NO: 18727 - RNA, 23 nt, Homo sapiens
uaugacaauucauuucucuuuuc

SEQ ID NO: 18728 - RNA, 28 nt, Homo sapiens
ugugggaaaaaugagggaggaccuuugu

SEQ ID NO: 18729 - RNA, 22 nt, Homo sapiens
cacuaguuacugaaaaugagua

SEQ ID NO: 18730 - RNA, 15 nt, Homo sapiens
cagccgcggcggcgg

SEQ ID NO: 18731 - RNA, 17 nt, Homo sapiens
cagccgcggcggcggcg

SEQ ID NO: 18732 - RNA, 19 nt, Homo sapiens
cggcggcggcgggggcggc

SEQ ID NO: 18733 - RNA, 19 nt, Homo sapiens
cgggggcggcggcggcggc

SEQ ID NO: 18734 - RNA, 19 nt, Homo sapiens
cucggacucuggcgacucc

SEQ ID NO: 18735 - RNA, 22 nt, Homo sapiens
gccccugggcagccgcggcggc

SEQ ID NO: 18736 - RNA, 16 nt, Homo sapiens
gcggcggcgggggcgc

SEQ ID NO: 18737 - RNA, 17 nt, Homo sapiens
ggaaaaucaugucaauu

SEQ ID NO: 18738 - RNA, 19 nt, Homo sapiens
ggaagcacaggauaucuga

SEQ ID NO: 18739 - RNA, 17 nt, Homo sapiens
ggauggaaugguuagga

SEQ ID NO: 18740 - RNA, 21 nt, Homo sapiens
ggcggcggcggcggcggcggc

SEQ ID NO: 18741 - RNA, 16 nt, Homo sapiens
ggcuggggagcuggcc

SEQ ID NO: 18742 - RNA, 20 nt, Homo sapiens
gggagcuggccggccccugg

SEQ ID NO: 18743 - RNA, 19 nt, Homo sapiens
gugguagaauacagcaugc

SEQ ID NO: 18744 - RNA, 17 nt, Homo sapiens
uaaccuuuaugaccuaa

SEQ ID NO: 18745 - RNA, 19 nt, Homo sapiens
ucuagaucugauuuuuaca

SEQ ID NO: 18746 - RNA, 19 nt, Homo sapiens
ucucuagaaauaacucaga

SEQ ID NO: 18747 - RNA, 19 nt, Homo sapiens
ucuguaucauuaccuguua

SEQ ID NO: 18748 - RNA, 18 nt, Homo sapiens
ucuuaaguuacaguagac

SEQ ID NO: 18749 - RNA, 24 nt, Homo sapiens
ugagaauuuuaauuuucccacauu

SEQ ID NO: 18750 - RNA, 18 nt, Homo sapiens
uuacaguagacaggcaaa

SEQ ID NO: 18751 - RNA, 21 nt, Homo sapiens
aaggugagcccgaugugggcg

SEQ ID NO: 18752 - RNA, 24 nt, Homo sapiens
aggugagcccgaugugggcggccg

SEQ ID NO: 18753 - RNA, 18 nt, Homo sapiens
augaagaugggggaauaa

SEQ ID NO: 18754 - RNA, 25 nt, Homo sapiens
uaauuugugugugugcacgagggcu

SEQ ID NO: 18755 - RNA, 18 nt, Homo sapiens
ugugcacgagggcuuaag

SEQ ID NO: 18756 - RNA, 18 nt, Homo sapiens
uuaaguguggaugagugu

SEQ ID NO: 18757 - RNA, 19 nt, Homo sapiens
augaagucauuugcggaga

SEQ ID NO: 18758 - RNA, 18 nt, Homo sapiens
cccguggcgagacgcggc

SEQ ID NO: 18759 - RNA, 17 nt, Homo sapiens
aaaagagaacaagagga

SEQ ID NO: 18760 - RNA, 19 nt, Homo sapiens
cauccuggccucagccgcu

SEQ ID NO: 18761 - RNA, 20 nt, Homo sapiens
cgccguuccgacccgcaacc

SEQ ID NO: 18762 - RNA, 18 nt, Homo sapiens
gccgcuggucccaccgcc

SEQ ID NO: 18763 - RNA, 19 nt, Homo sapiens
uucacauugaaagcuuuua

SEQ ID NO: 18764 - RNA, 19 nt, Homo sapiens
gagaaaguugccgggagcu

SEQ ID NO: 18765 - RNA, 19 nt, Homo sapiens
ggagaaaguugccgggagc

SEQ ID NO: 18766 - RNA, 19 nt, Homo sapiens
ggcccaccuggcucugcuc

SEQ ID NO: 18767 - RNA, 19 nt, Homo sapiens
ggggugagccaguuuuggg

SEQ ID NO: 18768 - RNA, 27 nt, Homo sapiens
uaccugggggguugucucggggcgucc

SEQ ID NO: 18769 - RNA, 20 nt, Homo sapiens
uacuccggagugaucugucc

SEQ ID NO: 18770 - RNA, 25 nt, Homo sapiens
ucuccaagacaugcagaggaguggg

SEQ ID NO: 18771 - RNA, 23 nt, Homo sapiens
uucaacacacugcuugugcagcg

SEQ ID NO: 18772 - RNA, 22 nt, Homo sapiens
aaggacacucagggacggagga

SEQ ID NO: 18773 - RNA, 17 nt, Homo sapiens
cagccgccccuuguccc

SEQ ID NO: 18774 - RNA, 21 nt, Homo sapiens
ccugugaagacaccaugccua

SEQ ID NO: 18775 - RNA, 16 nt, Homo sapiens
ccuuaacugaucgggg

SEQ ID NO: 18776 - RNA, 19 nt, Homo sapiens
cucccaccugcgacccaag

SEQ ID NO: 18777 - RNA, 26 nt, Homo sapiens
gcccuggcucaaggauuucucccccg

SEQ ID NO: 18778 - RNA, 18 nt, Homo sapiens
uucuagauugagggcagc

SEQ ID NO: 18779 - RNA, 18 nt, Homo sapiens
ccagaggcccgaguccgg

SEQ ID NO: 18780 - RNA, 19 nt, Homo sapiens
ggugggcggggccagacgg

SEQ ID NO: 18781 - RNA, 16 nt, Homo sapiens
ugcucuuccgcggggc

SEQ ID NO: 18782 - RNA, 19 nt, Homo sapiens
caauuaacuuuuacuuauc

SEQ ID NO: 18783 - RNA, 19 nt, Homo sapiens
cuacuaggaauaugcuggc

SEQ ID NO: 18784 - RNA, 19 nt, Homo sapiens
guucauucgcacgcaaugc

SEQ ID NO: 18785 - RNA, 22 nt, Homo sapiens
uauauaucacccaucugcaaca

SEQ ID NO: 18786 - RNA, 16 nt, Homo sapiens
ucacaaugccccgucu

SEQ ID NO: 18787 - RNA, 17 nt, Homo sapiens
ucuauaucuccccucca

SEQ ID NO: 18788 - RNA, 24 nt, Homo sapiens
ugagauuaguuggacucgagguau

SEQ ID NO: 18789 - RNA, 18 nt, Homo sapiens
ugcuguggcaguuacaaa

SEQ ID NO: 18790 - RNA, 21 nt, Homo sapiens
ugggaagucaguugcuauaag

SEQ ID NO: 18791 - RNA, 21 nt, Homo sapiens
uguguuuaaaacacccuagga

SEQ ID NO: 18792 - RNA, 19 nt, Homo sapiens
uugacagaauuguggcuau

SEQ ID NO: 18793 - RNA, 22 nt, Homo sapiens
uugcgcuacugcagggucacag

SEQ ID NO: 18794 - RNA, 17 nt, Homo sapiens
uuuauuagaauacuaug

SEQ ID NO: 18795 - RNA, 18 nt, Homo sapiens
uuuguuaguugaguuaca

SEQ ID NO: 18796 - RNA, 15 nt, Homo sapiens
cagcugcggcggcgg

SEQ ID NO: 18797 - RNA, 18 nt, Homo sapiens
cccccgccuucccucucc

SEQ ID NO: 18798 - RNA, 18 nt, Homo sapiens
cccuuccagcccuccccc

SEQ ID NO: 18799 - RNA, 18 nt, Homo sapiens
ccgcgcacagaggcggag

SEQ ID NO: 18800 - RNA, 17 nt, Homo sapiens
ccuucccucuccucucg

SEQ ID NO: 18801 - RNA, 16 nt, Homo sapiens
cggcggcggcgcgggc

SEQ ID NO: 18802 - RNA, 25 nt, Homo sapiens
cugguuuuccuuuaaauuauuauga

SEQ ID NO: 18803 - RNA, 17 nt, Homo sapiens
cuugcccggaggcggcu

SEQ ID NO: 18804 - RNA, 21 nt, Homo sapiens
gcagcagcugcggcggcggcg

SEQ ID NO: 18805 - RNA, 19 nt, Homo sapiens
gccgcccgagcccacucca

SEQ ID NO: 18806 - RNA, 18 nt, Homo sapiens
gcgcacagaggcggaggc

SEQ ID NO: 18807 - RNA, 21 nt, Homo sapiens
gcgccgcgcgggcagagagcc

SEQ ID NO: 18808 - RNA, 23 nt, Homo sapiens
ggcaccggcuccggagaagcggc

SEQ ID NO: 18809 - RNA, 18 nt, Homo sapiens
ggcggcggcgcgggcggc

SEQ ID NO: 18810 - RNA, 21 nt, Homo sapiens
uuggauaaugcaucagcggca

SEQ ID NO: 18811 - RNA, 17 nt, Homo sapiens
uuucaacggauuccggg

SEQ ID NO: 18812 - RNA, 21 nt, Homo sapiens
ccagcccgggcgguggggcca

SEQ ID NO: 18813 - RNA, 21 nt, Homo sapiens
ggcggcuggagggcggggacc

SEQ ID NO: 18814 - RNA, 18 nt, Homo sapiens
ugcugaacguucucugcc

SEQ ID NO: 18815 - RNA, 21 nt, Homo sapiens
aaaagccauaaaaauuggaac

SEQ ID NO: 18816 - RNA, 19 nt, Homo sapiens
acauuaguuaauaaauagu

SEQ ID NO: 18817 - RNA, 18 nt, Homo sapiens
accaguaacauuuagaag

SEQ ID NO: 18818 - RNA, 21 nt, Homo sapiens
acgguuuuucuggcacuggau

SEQ ID NO: 18819 - RNA, 24 nt, Homo sapiens
agagaacagagugggaaucauugg

SEQ ID NO: 18820 - RNA, 17 nt, Homo sapiens
agaggaggacauuacau

SEQ ID NO: 18821 - RNA, 24 nt, Homo sapiens
cacaaccccauucauccaguccua

SEQ ID NO: 18822 - RNA, 22 nt, Homo sapiens
cauuggcuuuaaaagagcauaa

SEQ ID NO: 18823 - RNA, 18 nt, Homo sapiens
uacaggcuuaacaacauu

SEQ ID NO: 18824 - RNA, 18 nt, Homo sapiens
uacuugucugucacaaug

SEQ ID NO: 18825 - RNA, 18 nt, Homo sapiens
uaucauuauuaaaguuuc

SEQ ID NO: 18826 - RNA, 20 nt, Homo sapiens
ucagaaguuauaaaugguau

SEQ ID NO: 18827 - RNA, 18 nt, Homo sapiens
uggaaaucaaggcaucua

SEQ ID NO: 18828 - RNA, 19 nt, Homo sapiens
uggcagugcuuuauaucaa

SEQ ID NO: 18829 - RNA, 20 nt, Homo sapiens
uuucauuuuaaaaaugaucu

SEQ ID NO: 18830 - RNA, 18 nt, Homo sapiens
auggaggaaauaacucac

SEQ ID NO: 18831 - RNA, 22 nt, Homo sapiens
cauagucuugucuuauauuucu

SEQ ID NO: 18832 - RNA, 17 nt, Homo sapiens
cauugauaucauagucu

SEQ ID NO: 18833 - RNA, 20 nt, Homo sapiens
guggggaaagaaggccuucg

SEQ ID NO: 18834 - RNA, 18 nt, Homo sapiens
uaacagcagagccagucu

SEQ ID NO: 18835 - RNA, 23 nt, Homo sapiens
uacaagcugaagauaucuuaauu

SEQ ID NO: 18836 - RNA, 19 nt, Homo sapiens
cccggagaagggggggcgc

SEQ ID NO: 18837 - RNA, 18 nt, Homo sapiens
cgccgaauccggcggcgg

SEQ ID NO: 18838 - RNA, 16 nt, Homo sapiens
gccggagcgccggagc

SEQ ID NO: 18839 - RNA, 18 nt, Homo sapiens
uaaguuuggaaaaaccuc

SEQ ID NO: 18840 - RNA, 26 nt, Homo sapiens
uauuagaugaauauauacccauauaa

SEQ ID NO: 18841 - RNA, 20 nt, Homo sapiens
ugauuuauuagaugaauaua

SEQ ID NO: 18842 - RNA, 19 nt, Homo sapiens
agggcucggggcaccaggc

SEQ ID NO: 18843 - RNA, 21 nt, Homo sapiens
cccgagcuccgcagggcucgg

SEQ ID NO: 18844 - RNA, 20 nt, Homo sapiens
ggccccgagcuccgcagggc

SEQ ID NO: 18845 - RNA, 17 nt, Homo sapiens
uucacacauacacagac

SEQ ID NO: 18846 - RNA, 18 nt, Homo sapiens
uuuuccuccuuuuugcag

SEQ ID NO: 18847 - RNA, 22 nt, Homo sapiens
aaaaaggaaaaaaaaacacacu

SEQ ID NO: 18848 - RNA, 19 nt, Homo sapiens
auucacuucuguuuacagc

SEQ ID NO: 18849 - RNA, 22 nt, Homo sapiens
uauauauauauauauguauaua

SEQ ID NO: 18850 - RNA, 23 nt, Homo sapiens
uauauauauauauauguauauau

SEQ ID NO: 18851 - RNA, 20 nt, Homo sapiens
uauauauauauauguauaua

SEQ ID NO: 18852 - RNA, 25 nt, Homo sapiens
uauuuauauauauauauauguauau

SEQ ID NO: 18853 - RNA, 21 nt, Homo sapiens
ucuaaaaaaauauauuaagau

SEQ ID NO: 18854 - RNA, 16 nt, Homo sapiens
cagcgcacuguccccg

SEQ ID NO: 18855 - RNA, 22 nt, Homo sapiens
cuaauuuaaaaagaaaaaagua

SEQ ID NO: 18856 - RNA, 19 nt, Homo sapiens
ggcaggaagaaagagaccc

SEQ ID NO: 18857 - RNA, 18 nt, Homo sapiens
aagacaggugucaagccc

SEQ ID NO: 18858 - RNA, 17 nt, Homo sapiens
accagaaguggagggcu

SEQ ID NO: 18859 - RNA, 16 nt, Homo sapiens
agagauuaacggagag

SEQ ID NO: 18860 - RNA, 19 nt, Homo sapiens
caggacccgcagagcgucu

SEQ ID NO: 18861 - RNA, 23 nt, Homo sapiens
cguacaaccauucacacacgucc

SEQ ID NO: 18862 - RNA, 23 nt, Homo sapiens
gaagacagcuguaggcauuguuu

SEQ ID NO: 18863 - RNA, 18 nt, Homo sapiens
gcaacuucuuuuccuuuu

SEQ ID NO: 18864 - RNA, 21 nt, Homo sapiens
uagaacacaucuaggaaccag

SEQ ID NO: 18865 - RNA, 17 nt, Homo sapiens
ucacaauguaaaagguu

SEQ ID NO: 18866 - RNA, 22 nt, Homo sapiens
ucuuuuccuuuuuuucucuuca

SEQ ID NO: 18867 - RNA, 18 nt, Homo sapiens
agguggagguguaggcag

SEQ ID NO: 18868 - RNA, 21 nt, Homo sapiens
agugccacugucugucggggu

SEQ ID NO: 18869 - RNA, 19 nt, Homo sapiens
cccaagcccugguggcgga

SEQ ID NO: 18870 - RNA, 18 nt, Homo sapiens
cucuguucuucuucccaa

SEQ ID NO: 18871 - RNA, 18 nt, Homo sapiens
gcucgcccgcccccucac

SEQ ID NO: 18872 - RNA, 17 nt, Homo sapiens
ggaaacagccaagccac

SEQ ID NO: 18873 - RNA, 21 nt, Homo sapiens
uaaaagaucacuaucuuucau

SEQ ID NO: 18874 - RNA, 16 nt, Homo sapiens
uccagcaagugggugc

SEQ ID NO: 18875 - RNA, 18 nt, Homo sapiens
uggcccugcagaaugagg

SEQ ID NO: 18876 - RNA, 22 nt, Homo sapiens
uggccuggccuccucucuuccg

SEQ ID NO: 18877 - RNA, 23 nt, Homo sapiens
gaggggccaggccacucgggugc

SEQ ID NO: 18878 - RNA, 23 nt, Homo sapiens
gccacagguagaucccacugccg

SEQ ID NO: 18879 - RNA, 19 nt, Homo sapiens
gcggggggaggaagggagg

SEQ ID NO: 18880 - RNA, 19 nt, Homo sapiens
ucuaugagccacuguccga

SEQ ID NO: 18881 - RNA, 17 nt, Homo sapiens
ggaggaggagggaggag

SEQ ID NO: 18882 - RNA, 16 nt, Homo sapiens
uuuucacagcacauug

SEQ ID NO: 18883 - RNA, 23 nt, Homo sapiens
ccucggccucccaaagagcuggg

SEQ ID NO: 18884 - RNA, 16 nt, Homo sapiens
cuggccucugagacga

SEQ ID NO: 18885 - RNA, 21 nt, Homo sapiens
gggucuucagccucagagaca

SEQ ID NO: 18886 - RNA, 23 nt, Homo sapiens
uauuauaauaaagaaucccagag

SEQ ID NO: 18887 - RNA, 20 nt, Homo sapiens
acaauuaaccaugcugguuu

SEQ ID NO: 18888 - RNA, 20 nt, Homo sapiens
cagcaggccuuggccgccuc

SEQ ID NO: 18889 - RNA, 19 nt, Homo sapiens
ccagcaggccuuggccgcc

SEQ ID NO: 18890 - RNA, 19 nt, Homo sapiens
uauacccauuauacuacua

SEQ ID NO: 18891 - RNA, 19 nt, Homo sapiens
uguuggagauauaaugugu

SEQ ID NO: 18892 - RNA, 16 nt, Homo sapiens
uuacgugucugaauaa

SEQ ID NO: 18893 - RNA, 16 nt, Homo sapiens
cgcggcggccggggcc

SEQ ID NO: 18894 - RNA, 23 nt, Homo sapiens
gaacaaaaacggaaaaaaaagca

SEQ ID NO: 18895 - RNA, 18 nt, Homo sapiens
gcgcgcucgcucuugggc

SEQ ID NO: 18896 - RNA, 21 nt, Homo sapiens
gcggcgcaggcggcggcggcc

SEQ ID NO: 18897 - RNA, 22 nt, Homo sapiens
gcggcugguggucgcggcggcc

SEQ ID NO: 18898 - RNA, 19 nt, Homo sapiens
ggcgcaggcggcggcggcc

SEQ ID NO: 18899 - RNA, 23 nt, Homo sapiens
uucugaauggucauuagcgggcc

SEQ ID NO: 18900 - RNA, 18 nt, Homo sapiens
ugcccuugagcugagagc

SEQ ID NO: 18901 - RNA, 18 nt, Homo sapiens
agacguagugcaaauuuc

SEQ ID NO: 18902 - RNA, 18 nt, Homo sapiens
caggaaggacacgaagau

SEQ ID NO: 18903 - RNA, 20 nt, Homo sapiens
caggaaggacacgaagauga

SEQ ID NO: 18904 - RNA, 21 nt, Homo sapiens
cauccuccgccucccgcgccc

SEQ ID NO: 18905 - RNA, 18 nt, Homo sapiens
gagcagcugcagcgccca

SEQ ID NO: 18906 - RNA, 17 nt, Homo sapiens
gaggugggagagggagg

SEQ ID NO: 18907 - RNA, 18 nt, Homo sapiens
gccggcuccauccucggg

SEQ ID NO: 18908 - RNA, 18 nt, Homo sapiens
gcggcggcggcagcagcc

SEQ ID NO: 18909 - RNA, 18 nt, Homo sapiens
ggaguagggucgccgggg

SEQ ID NO: 18910 - RNA, 19 nt, Homo sapiens
ggaguggggugagcugggg

SEQ ID NO: 18911 - RNA, 20 nt, Homo sapiens
ggaguggggugagcuggggg

SEQ ID NO: 18912 - RNA, 23 nt, Homo sapiens
gggaguggggugagcugggggca

SEQ ID NO: 18913 - RNA, 16 nt, Homo sapiens
ggggagaaagucuucu

SEQ ID NO: 18914 - RNA, 23 nt, Homo sapiens
ucaaaagcuugagaagucgccuc

SEQ ID NO: 18915 - RNA, 18 nt, Homo sapiens
ucacaguaaaaaccugcc

SEQ ID NO: 18916 - RNA, 23 nt, Homo sapiens
ugugcguguguggauguguaaau

SEQ ID NO: 18917 - RNA, 22 nt, Homo sapiens
uuuggcacaaagaaauaucaca

SEQ ID NO: 18918 - RNA, 31 nt, Homo sapiens
aagaauauauacauggagcguguuuggggau

SEQ ID NO: 18919 - RNA, 25 nt, Homo sapiens
ccuccaccuccuggguacaagcggu

SEQ ID NO: 18920 - RNA, 19 nt, Homo sapiens
cuauaccccacacauuccg

SEQ ID NO: 18921 - RNA, 19 nt, Homo sapiens
gacuacaggugugugccac

SEQ ID NO: 18922 - RNA, 24 nt, Homo sapiens
gccguugucacugagccucaaaag

SEQ ID NO: 18923 - RNA, 21 nt, Homo sapiens
gcgagagccaccacgcccggc

SEQ ID NO: 18924 - RNA, 21 nt, Homo sapiens
gggucuccagugcgugcugcc

SEQ ID NO: 18925 - RNA, 16 nt, Homo sapiens
ugggaguaucuucagu

SEQ ID NO: 18926 - RNA, 22 nt, Homo sapiens
uggggaggagauggaguaagga

SEQ ID NO: 18927 - RNA, 23 nt, Homo sapiens
uuccuuuuucuauaccccacaca

SEQ ID NO: 18928 - RNA, 18 nt, Homo sapiens
cgucaccccagcuggggc

SEQ ID NO: 18929 - RNA, 16 nt, Homo sapiens
ugggagggagggagac

SEQ ID NO: 18930 - RNA, 17 nt, Homo sapiens
uuuucccuucuccccag

SEQ ID NO: 18931 - RNA, 20 nt, Homo sapiens
gauuacuaguauaaccacag

SEQ ID NO: 18932 - RNA, 17 nt, Homo sapiens
aucaucaggaagccgcu

SEQ ID NO: 18933 - RNA, 21 nt, Homo sapiens
ccaagauauaccgaggaauuc

SEQ ID NO: 18934 - RNA, 22 nt, Homo sapiens
ccgccuuggccucccaaagugc

SEQ ID NO: 18935 - RNA, 19 nt, Homo sapiens
ccuguauccaacuguucua

SEQ ID NO: 18936 - RNA, 19 nt, Homo sapiens
ggccauggcccaccaccug

SEQ ID NO: 18937 - RNA, 20 nt, Homo sapiens
gggcagaucaagaggucagg

SEQ ID NO: 18938 - RNA, 19 nt, Homo sapiens
gggcauggugguaggcgcc

SEQ ID NO: 18939 - RNA, 17 nt, Homo sapiens
gguaagagcgaugggac

SEQ ID NO: 18940 - RNA, 18 nt, Homo sapiens
uccaacuguucuaacucu

SEQ ID NO: 18941 - RNA, 17 nt, Homo sapiens
uugggaggccaaggugg

SEQ ID NO: 18942 - RNA, 15 nt, Homo sapiens
gguccugccgggggu

SEQ ID NO: 18943 - RNA, 18 nt, Homo sapiens
ucugauugaaacuaauau

SEQ ID NO: 18944 - RNA, 19 nt, Homo sapiens
accauccuugccucugccc

SEQ ID NO: 18945 - RNA, 21 nt, Homo sapiens
caccaguaccuuuugucccuu

SEQ ID NO: 18946 - RNA, 21 nt, Homo sapiens
cagcuucuucugccuagagcg

SEQ ID NO: 18947 - RNA, 18 nt, Homo sapiens
ccccccuccccuagcccg

SEQ ID NO: 18948 - RNA, 23 nt, Homo sapiens
cccucaccaguaccuuuuguccc

SEQ ID NO: 18949 - RNA, 18 nt, Homo sapiens
cuggaucagggccacucc

SEQ ID NO: 18950 - RNA, 15 nt, Homo sapiens
ucuugcccucaccag

SEQ ID NO: 18951 - RNA, 20 nt, Homo sapiens
ugagaggggauacgaagguc

SEQ ID NO: 18952 - RNA, 17 nt, Homo sapiens
uucccuaaguuucuuau

SEQ ID NO: 18953 - RNA, 19 nt, Homo sapiens
agaggguaacucugggcug

SEQ ID NO: 18954 - RNA, 21 nt, Homo sapiens
cagccuggucaacagagugag

SEQ ID NO: 18955 - RNA, 20 nt, Homo sapiens
gggaggauugcuugagccca

SEQ ID NO: 18956 - RNA, 17 nt, Homo sapiens
uaacaugcuaguuaagu

SEQ ID NO: 18957 - RNA, 24 nt, Homo sapiens
uagaacucaagguuuucauugaca

SEQ ID NO: 18958 - RNA, 22 nt, Homo sapiens
uauuccacuuuauuuuuucucu

SEQ ID NO: 18959 - RNA, 22 nt, Homo sapiens
ucagucuaauaauguauugggu

SEQ ID NO: 18960 - RNA, 19 nt, Homo sapiens
ucuaagacgccagcucuuu

SEQ ID NO: 18961 - RNA, 18 nt, Homo sapiens
ucuagaaugaaaaagaaa

SEQ ID NO: 18962 - RNA, 19 nt, Homo sapiens
ugggaggcugaagugggag

SEQ ID NO: 18963 - RNA, 20 nt, Homo sapiens
uguuguuucucuaaaaauuu

SEQ ID NO: 18964 - RNA, 17 nt, Homo sapiens
uugggaggcugaggugg

SEQ ID NO: 18965 - RNA, 21 nt, Homo sapiens
ccggccccggcuccccucggc

SEQ ID NO: 18966 - RNA, 23 nt, Homo sapiens
cggcucgggcucgggcuccggcc

SEQ ID NO: 18967 - RNA, 24 nt, Homo sapiens
gccuggccgcggcggcgcggggcc

SEQ ID NO: 18968 - RNA, 24 nt, Homo sapiens
gcucgggcucgggcuccggccccg

SEQ ID NO: 18969 - RNA, 22 nt, Homo sapiens
uccccucggcugcgacucuggc

SEQ ID NO: 18970 - RNA, 15 nt, Homo sapiens
uggcgcgcggcggac

SEQ ID NO: 18971 - RNA, 17 nt, Homo sapiens
aaggggccagaggggaa

SEQ ID NO: 18972 - RNA, 21 nt, Homo sapiens
cauuuuuauuucaucaucaac

SEQ ID NO: 18973 - RNA, 25 nt, Homo sapiens
ccagaggggaacuugacacaacgug

SEQ ID NO: 18974 - RNA, 16 nt, Homo sapiens
ugaugugcauggcacu

SEQ ID NO: 18975 - RNA, 18 nt, Homo sapiens
aauaaauguacauacaca

SEQ ID NO: 18976 - RNA, 16 nt, Homo sapiens
uugcuguggucauugu

SEQ ID NO: 18977 - RNA, 18 nt, Homo sapiens
agagguguggaaucccca

SEQ ID NO: 18978 - RNA, 16 nt, Homo sapiens
acuggauacauuacag

SEQ ID NO: 18979 - RNA, 22 nt, Homo sapiens
uaagacuaaagcuugaaacagc

SEQ ID NO: 18980 - RNA, 23 nt, Homo sapiens
cagcccccugccucauggcguuu

SEQ ID NO: 18981 - RNA, 21 nt, Homo sapiens
gggcaaaacgggaggcgaaac

SEQ ID NO: 18982 - RNA, 18 nt, Homo sapiens
uaugugugugugugugug

SEQ ID NO: 18983 - RNA, 23 nt, Homo sapiens
uguguauaugugugugugugugu

SEQ ID NO: 18984 - RNA, 18 nt, Homo sapiens
ugugugugugugugugug

SEQ ID NO: 18985 - RNA, 20 nt, Homo sapiens
ugugugugugugugugugua

SEQ ID NO: 18986 - RNA, 20 nt, Homo sapiens
uuuccauuggcaacagcggg

SEQ ID NO: 18987 - RNA, 20 nt, Homo sapiens
caaaauauaucccccaaaag

SEQ ID NO: 18988 - RNA, 22 nt, Homo sapiens
aagaggaaggggaggagcuagg

SEQ ID NO: 18989 - RNA, 20 nt, Homo sapiens
aagggugccucgcuuuggcu

SEQ ID NO: 18990 - RNA, 17 nt, Homo sapiens
aauaaagcauauaaaac

SEQ ID NO: 18991 - RNA, 21 nt, Homo sapiens
acuuucuagugguuucuaugc

SEQ ID NO: 18992 - RNA, 21 nt, Homo sapiens
aguucugcaagcuauaguuuu

SEQ ID NO: 18993 - RNA, 17 nt, Homo sapiens
augcucaaauacaugac

SEQ ID NO: 18994 - RNA, 17 nt, Homo sapiens
caagccauccaaaacaa

SEQ ID NO: 18995 - RNA, 18 nt, Homo sapiens
ccacaggaaaaccaaucu

SEQ ID NO: 18996 - RNA, 21 nt, Homo sapiens
ccucgcuuuggcuagugccaa

SEQ ID NO: 18997 - RNA, 15 nt, Homo sapiens
cuagugccaaaucca

SEQ ID NO: 18998 - RNA, 20 nt, Homo sapiens
gauguggcauguauuuagaa

SEQ ID NO: 18999 - RNA, 25 nt, Homo sapiens
gccaugaggagguaagccaguaagg

SEQ ID NO: 19000 - RNA, 19 nt, Homo sapiens
gguuugcaaagcugcaugc

SEQ ID NO: 19001 - RNA, 17 nt, Homo sapiens
uaauauaaaauauacca

SEQ ID NO: 19002 - RNA, 24 nt, Homo sapiens
uauauuuauacauuuauauauaua

SEQ ID NO: 19003 - RNA, 18 nt, Homo sapiens
ugccacaggaaaaccaau

SEQ ID NO: 19004 - RNA, 21 nt, Homo sapiens
aggcgggacggggcgcgggcc

SEQ ID NO: 19005 - RNA, 26 nt, Homo sapiens
gagaggaguccaaggcguuggugggg

SEQ ID NO: 19006 - RNA, 16 nt, Homo sapiens
ggaaaaggcagaugug

SEQ ID NO: 19007 - RNA, 18 nt, Homo sapiens
cggggggaggggaggggg

SEQ ID NO: 19008 - RNA, 21 nt, Homo sapiens
cugcaucccuguccaauuuga

SEQ ID NO: 19009 - RNA, 18 nt, Homo sapiens
cuggcuccugcugcauuc

SEQ ID NO: 19010 - RNA, 16 nt, Homo sapiens
ggggaggggaggggga

SEQ ID NO: 19011 - RNA, 18 nt, Homo sapiens
agacuuccauagggcugg

SEQ ID NO: 19012 - RNA, 19 nt, Homo sapiens
auccuuuccagcucagcua

SEQ ID NO: 19013 - RNA, 18 nt, Homo sapiens
cagccucccaaacaggcu

SEQ ID NO: 19014 - RNA, 20 nt, Homo sapiens
caugaggcaggcagacacaa

SEQ ID NO: 19015 - RNA, 18 nt, Homo sapiens
cccuccuggcuggguggc

SEQ ID NO: 19016 - RNA, 26 nt, Homo sapiens
ccucaggauucgggagaaauugcagg

SEQ ID NO: 19017 - RNA, 17 nt, Homo sapiens
cggccacggcuccaggc

SEQ ID NO: 19018 - RNA, 17 nt, Homo sapiens
gcccuggagcccuuggc

SEQ ID NO: 19019 - RNA, 26 nt, Homo sapiens
gggcugggggaguaccaggggcuggg

SEQ ID NO: 19020 - RNA, 23 nt, Homo sapiens
uacacauuucuguggcuugccuu

SEQ ID NO: 19021 - RNA, 22 nt, Homo sapiens
ucggccacggcuccaggcuggg

SEQ ID NO: 19022 - RNA, 18 nt, Homo sapiens
ugagcugcugcugucacg

SEQ ID NO: 19023 - RNA, 19 nt, Homo sapiens
ugcccagcugcuccccauc

SEQ ID NO: 19024 - RNA, 16 nt, Homo sapiens
uucaguguccccugug

SEQ ID NO: 19025 - RNA, 19 nt, Homo sapiens
aggggcuggcaccaaacca

SEQ ID NO: 19026 - RNA, 18 nt, Homo sapiens
ugaggaggagguggggga

SEQ ID NO: 19027 - RNA, 18 nt, Homo sapiens
agugggguggggaggagg

SEQ ID NO: 19028 - RNA, 19 nt, Homo sapiens
agcuccgcaugcgcagugc

SEQ ID NO: 19029 - RNA, 16 nt, Homo sapiens
cacgcggcccggggug

SEQ ID NO: 19030 - RNA, 19 nt, Homo sapiens
cagcgggcagggugugcag

SEQ ID NO: 19031 - RNA, 19 nt, Homo sapiens
cagcucccuggccaccagc

SEQ ID NO: 19032 - RNA, 18 nt, Homo sapiens
cccagcugcuaccagucc

SEQ ID NO: 19033 - RNA, 19 nt, Homo sapiens
cccgcaagcaccgcucccc

SEQ ID NO: 19034 - RNA, 18 nt, Homo sapiens
ccuccaccccacuacggu

SEQ ID NO: 19035 - RNA, 18 nt, Homo sapiens
gcccuugacaucauggcc

SEQ ID NO: 19036 - RNA, 18 nt, Homo sapiens
gcggccucugcaaacggc

SEQ ID NO: 19037 - RNA, 19 nt, Homo sapiens
ggaagguuaggaaggcccc

SEQ ID NO: 19038 - RNA, 18 nt, Homo sapiens
ggcccacagaaagccuug

SEQ ID NO: 19039 - RNA, 19 nt, Homo sapiens
ggcggccucugcaaacggc

SEQ ID NO: 19040 - RNA, 19 nt, Homo sapiens
ugggaggggaaggcgggca

SEQ ID NO: 19041 - RNA, 19 nt, Homo sapiens
aggaaaaugacuguaaaag

SEQ ID NO: 19042 - RNA, 23 nt, Homo sapiens
aggaaauaauggacuccacugug

SEQ ID NO: 19043 - RNA, 14 nt, Homo sapiens
cccagcaaucccuc

SEQ ID NO: 19044 - RNA, 20 nt, Homo sapiens
gaggaaauaauggacuccac

SEQ ID NO: 19045 - RNA, 22 nt, Homo sapiens
uauuauggaaggccauuagaaa

SEQ ID NO: 19046 - RNA, 18 nt, Homo sapiens
ucaaagugucacuuacuc

SEQ ID NO: 19047 - RNA, 20 nt, Homo sapiens
ugccuguuauagacccgccu

SEQ ID NO: 19048 - RNA, 16 nt, Homo sapiens
auacugcuuuuccuuu

SEQ ID NO: 19049 - RNA, 23 nt, Homo sapiens
caccaaaaggggguuugggggaa

SEQ ID NO: 19050 - RNA, 22 nt, Homo sapiens
cucugcugggcaguugcugaua

SEQ ID NO: 19051 - RNA, 19 nt, Homo sapiens
ggaauauagauucuuguuc

SEQ ID NO: 19052 - RNA, 24 nt, Homo sapiens
uacucugggccuggacuuguuccu

SEQ ID NO: 19053 - RNA, 14 nt, Homo sapiens
ucucuguugccaga

SEQ ID NO: 19054 - RNA, 21 nt, Homo sapiens
cagucucugguauuuggaauu

SEQ ID NO: 19055 - RNA, 19 nt, Homo sapiens
uuauuagaaacaauccucu

SEQ ID NO: 19056 - RNA, 23 nt, Homo sapiens
aaagacuuaagagaauaaaaaua

SEQ ID NO: 19057 - RNA, 18 nt, Homo sapiens
aacaucgguuauucucau

SEQ ID NO: 19058 - RNA, 18 nt, Homo sapiens
aagaaaaauauucuucaa

SEQ ID NO: 19059 - RNA, 20 nt, Homo sapiens
aauauacauacauauaauau

SEQ ID NO: 19060 - RNA, 22 nt, Homo sapiens
agacaaacagguuacaauguag

SEQ ID NO: 19061 - RNA, 18 nt, Homo sapiens
aguauucauuucacacag

SEQ ID NO: 19062 - RNA, 18 nt, Homo sapiens
cacuagguaaaccucagg

SEQ ID NO: 19063 - RNA, 16 nt, Homo sapiens
cucuauuccuuugguu

SEQ ID NO: 19064 - RNA, 21 nt, Homo sapiens
ucagcagucaauacauuucaa

SEQ ID NO: 19065 - RNA, 20 nt, Homo sapiens
ucugguuaacaacucugagc

SEQ ID NO: 19066 - RNA, 22 nt, Homo sapiens
uggagagcucuauaagugagaa

SEQ ID NO: 19067 - RNA, 18 nt, Homo sapiens
uuucuguucccuugcucc

SEQ ID NO: 19068 - RNA, 18 nt, Homo sapiens
acaggaaaggagacccuc

SEQ ID NO: 19069 - RNA, 20 nt, Homo sapiens
cauauuguuaagugcaggaa

SEQ ID NO: 19070 - RNA, 19 nt, Homo sapiens
ucuaacacagagcagaguc

SEQ ID NO: 19071 - RNA, 18 nt, Homo sapiens
ugguauuguaaacaugua

SEQ ID NO: 19072 - RNA, 19 nt, Homo sapiens
uuucuauuucauauuguua

SEQ ID NO: 19073 - RNA, 18 nt, Homo sapiens
aacugaguggaagagggg

SEQ ID NO: 19074 - RNA, 23 nt, Homo sapiens
acaaacagccagagcgugcgcac

SEQ ID NO: 19075 - RNA, 19 nt, Homo sapiens
acaaguaucucucucuucu

SEQ ID NO: 19076 - RNA, 21 nt, Homo sapiens
aguggguagaugguggguugc

SEQ ID NO: 19077 - RNA, 21 nt, Homo sapiens
cucucugcccucauccccauc

SEQ ID NO: 19078 - RNA, 22 nt, Homo sapiens
gcaugugaauuuaauguuuuuu

SEQ ID NO: 19079 - RNA, 22 nt, Homo sapiens
ggguggggaggggcaucuuggg

SEQ ID NO: 19080 - RNA, 18 nt, Homo sapiens
uaauauacauauauguag

SEQ ID NO: 19081 - RNA, 27 nt, Homo sapiens
uaauauacauauauguagaauauauau

SEQ ID NO: 19082 - RNA, 24 nt, Homo sapiens
uauacauauauguagaauauauau

SEQ ID NO: 19083 - RNA, 18 nt, Homo sapiens
uccuggaggaugggggaa

SEQ ID NO: 19084 - RNA, 19 nt, Homo sapiens
uggguagaugguggguugc

SEQ ID NO: 19085 - RNA, 20 nt, Homo sapiens
uaccuguuguggugccauca

SEQ ID NO: 19086 - RNA, 18 nt, Homo sapiens
ugcuuugaccuccugccu

SEQ ID NO: 19087 - RNA, 19 nt, Homo sapiens
aaaaaaaaaaaaaaaaaac

SEQ ID NO: 19088 - RNA, 23 nt, Homo sapiens
aacauuacaaaaccuguacuaua

SEQ ID NO: 19089 - RNA, 20 nt, Homo sapiens
cauuuuagcagauuaauccc

SEQ ID NO: 19090 - RNA, 21 nt, Homo sapiens
ccucuuggccaaaagacuugu

SEQ ID NO: 19091 - RNA, 19 nt, Homo sapiens
uauaaaauauacaaaacau

SEQ ID NO: 19092 - RNA, 22 nt, Homo sapiens
gcgcggggcgccaccgggaccg

SEQ ID NO: 19093 - RNA, 15 nt, Homo sapiens
cccguucccugcucc

SEQ ID NO: 19094 - RNA, 16 nt, Homo sapiens
cggggagguggggugg

SEQ ID NO: 19095 - RNA, 18 nt, Homo sapiens
gcgucagaagccccgaga

SEQ ID NO: 19096 - RNA, 18 nt, Homo sapiens
cuagaaaauccucacugc

SEQ ID NO: 19097 - RNA, 18 nt, Homo sapiens
acaaugagcuguaacagg

SEQ ID NO: 19098 - RNA, 15 nt, Homo sapiens
ccugccucuuccuuc

SEQ ID NO: 19099 - RNA, 20 nt, Homo sapiens
ccugccucuuccuucaugaa

SEQ ID NO: 19100 - RNA, 19 nt, Homo sapiens
cgucgccuuuucuccccuc

SEQ ID NO: 19101 - RNA, 17 nt, Homo sapiens
cguggccugccucuucc

SEQ ID NO: 19102 - RNA, 21 nt, Homo sapiens
uauuacgugaauaauaucuau

SEQ ID NO: 19103 - RNA, 18 nt, Homo sapiens
ucuuauuuccuguggccu

SEQ ID NO: 19104 - RNA, 19 nt, Homo sapiens
aaaugcccagggaggggcu

SEQ ID NO: 19105 - RNA, 24 nt, Homo sapiens
gaucuagguucaagcugucuucuu

SEQ ID NO: 19106 - RNA, 20 nt, Homo sapiens
gcgggggcggggucucgcgu

SEQ ID NO: 19107 - RNA, 19 nt, Homo sapiens
ugaggagcugagggugggg

SEQ ID NO: 19108 - RNA, 17 nt, Homo sapiens
agcugcaauguaaagca

SEQ ID NO: 19109 - RNA, 20 nt, Homo sapiens
cauaaaagugcauuguauac

SEQ ID NO: 19110 - RNA, 16 nt, Homo sapiens
cguuguugccuggcag

SEQ ID NO: 19111 - RNA, 22 nt, Homo sapiens
gccagagcuaaaauguagugcu

SEQ ID NO: 19112 - RNA, 18 nt, Homo sapiens
uacccuccuuguucauau

SEQ ID NO: 19113 - RNA, 23 nt, Homo sapiens
ucucuuguagucauucuccuugg

SEQ ID NO: 19114 - RNA, 23 nt, Homo sapiens
ugacaaaaauguuuucuucuccu

SEQ ID NO: 19115 - RNA, 18 nt, Homo sapiens
ugccuccugcgauugcuu

SEQ ID NO: 19116 - RNA, 22 nt, Homo sapiens
uuacaaauugcacauugaaaaa

SEQ ID NO: 19117 - RNA, 20 nt, Homo sapiens
uuuggcagacaugcaucuua

SEQ ID NO: 19118 - RNA, 18 nt, Homo sapiens
uuugggaaaccuuuuuug

SEQ ID NO: 19119 - RNA, 18 nt, Homo sapiens
cagaugagucucaguaga

SEQ ID NO: 19120 - RNA, 22 nt, Homo sapiens
uuuauugggagaauuuuaaugg

SEQ ID NO: 19121 - RNA, 15 nt, Homo sapiens
caccagcacucgcgu

SEQ ID NO: 19122 - RNA, 18 nt, Homo sapiens
caccaaagaucaaggugc

SEQ ID NO: 19123 - RNA, 14 nt, Homo sapiens
cgggcgcccagggg

SEQ ID NO: 19124 - RNA, 18 nt, Homo sapiens
cuucgccuuggcuggagc

SEQ ID NO: 19125 - RNA, 17 nt, Homo sapiens
gcccuccgacgggcgcc

SEQ ID NO: 19126 - RNA, 17 nt, Homo sapiens
gggcgagcagggguggg

SEQ ID NO: 19127 - RNA, 18 nt, Homo sapiens
ucacagauuuaauaccgc

SEQ ID NO: 19128 - RNA, 20 nt, Homo sapiens
ucacccccucucgacauucg

SEQ ID NO: 19129 - RNA, 24 nt, Homo sapiens
ucagccccgcgcccgcagggcccg

SEQ ID NO: 19130 - RNA, 17 nt, Homo sapiens
aaaagugaauuuuuguu

SEQ ID NO: 19131 - RNA, 18 nt, Homo sapiens
ccucagcuccgccgaccc

SEQ ID NO: 19132 - RNA, 18 nt, Homo sapiens
cgggagcucagggccggc

SEQ ID NO: 19133 - RNA, 22 nt, Homo sapiens
gcuuucauuucuuucuccgcuu

SEQ ID NO: 19134 - RNA, 17 nt, Homo sapiens
acaagccuggaggaaga

SEQ ID NO: 19135 - RNA, 18 nt, Homo sapiens
aguauguaucuuaugugu

SEQ ID NO: 19136 - RNA, 18 nt, Homo sapiens
ccgccgccgcgggcuccc

SEQ ID NO: 19137 - RNA, 24 nt, Homo sapiens
ccgccgccgcgggcucccuccucg

SEQ ID NO: 19138 - RNA, 21 nt, Homo sapiens
ccgccgcgggcucccuccucg

SEQ ID NO: 19139 - RNA, 22 nt, Homo sapiens
ugugcaguauuggaaaccaaug

SEQ ID NO: 19140 - RNA, 24 nt, Homo sapiens
acaacucuaaaugcucuacgugcc

SEQ ID NO: 19141 - RNA, 19 nt, Homo sapiens
aaaugaggaaauccauauu

SEQ ID NO: 19142 - RNA, 17 nt, Homo sapiens
aaaugcucucugaccaa

SEQ ID NO: 19143 - RNA, 17 nt, Homo sapiens
aauugaguuuuaaacuu

SEQ ID NO: 19144 - RNA, 23 nt, Homo sapiens
acacuauguuuuuaaaacaagua

SEQ ID NO: 19145 - RNA, 20 nt, Homo sapiens
acagcgccugcagguguggc

SEQ ID NO: 19146 - RNA, 21 nt, Homo sapiens
acaggggcuuggggccggggg

SEQ ID NO: 19147 - RNA, 17 nt, Homo sapiens
aucguggugaggugcag

SEQ ID NO: 19148 - RNA, 17 nt, Homo sapiens
cacagccaaacgcgauu

SEQ ID NO: 19149 - RNA, 19 nt, Homo sapiens
ccccaguuccgucauuccc

SEQ ID NO: 19150 - RNA, 18 nt, Homo sapiens
ccucuauuuugcagaccc

SEQ ID NO: 19151 - RNA, 17 nt, Homo sapiens
ggccggggggagggggg

SEQ ID NO: 19152 - RNA, 18 nt, Homo sapiens
ggcggggaaugaaaacac

SEQ ID NO: 19153 - RNA, 19 nt, Homo sapiens
gggcugcuaaagaaggugg

SEQ ID NO: 19154 - RNA, 24 nt, Homo sapiens
guacauggcaucagauggugagaa

SEQ ID NO: 19155 - RNA, 16 nt, Homo sapiens
ucaagucuccacagcc

SEQ ID NO: 19156 - RNA, 16 nt, Homo sapiens
ucugaaaagaaagccc

SEQ ID NO: 19157 - RNA, 19 nt, Homo sapiens
ugcuaaaauuuuagcuaag

SEQ ID NO: 19158 - RNA, 19 nt, Homo sapiens
uggcacuaagcuaaaaaac

SEQ ID NO: 19159 - RNA, 18 nt, Homo sapiens
ugggaauaauggugcuga

SEQ ID NO: 19160 - RNA, 21 nt, Homo sapiens
uguacagaccauuaaauguug

SEQ ID NO: 19161 - RNA, 19 nt, Homo sapiens
uuucuaugauccugaccaa

SEQ ID NO: 19162 - RNA, 16 nt, Homo sapiens
agccgccuccccgugg

SEQ ID NO: 19163 - RNA, 19 nt, Homo sapiens
aguuguuuaauauaguaca

SEQ ID NO: 19164 - RNA, 18 nt, Homo sapiens
guauaacagaaauaacau

SEQ ID NO: 19165 - RNA, 21 nt, Homo sapiens
uaacgucaggggcggcgcgcc

SEQ ID NO: 19166 - RNA, 24 nt, Homo sapiens
uagaaacaaugcaauucacaaaaa

SEQ ID NO: 19167 - RNA, 20 nt, Homo sapiens
uccucauuccucuuucuucu

SEQ ID NO: 19168 - RNA, 22 nt, Homo sapiens
ugucuugauuuccuugauauuu

SEQ ID NO: 19169 - RNA, 18 nt, Homo sapiens
uucccaagugacagucag

SEQ ID NO: 19170 - RNA, 22 nt, Homo sapiens
auauauauauauauggauauau

SEQ ID NO: 19171 - RNA, 23 nt, Homo sapiens
auauauauauauauggauauaua

SEQ ID NO: 19172 - RNA, 24 nt, Homo sapiens
auauauauauauauggauauauau

SEQ ID NO: 19173 - RNA, 26 nt, Homo sapiens
auauauauaugggauauauauauaua

SEQ ID NO: 19174 - RNA, 25 nt, Homo sapiens
auauauaugggauauauauauauau

SEQ ID NO: 19175 - RNA, 21 nt, Homo sapiens
augacaugagauauauauaug

SEQ ID NO: 19176 - RNA, 21 nt, Homo sapiens
ccaucugaagaucaucaaaaa

SEQ ID NO: 19177 - RNA, 20 nt, Homo sapiens
cuguuuucuccuuccaucug

SEQ ID NO: 19178 - RNA, 21 nt, Homo sapiens
uaguaaaguccacaguucagu

SEQ ID NO: 19179 - RNA, 22 nt, Homo sapiens
uauauauauauauggauauaua

SEQ ID NO: 19180 - RNA, 25 nt, Homo sapiens
uauauauaugggauauauauauaua

SEQ ID NO: 19181 - RNA, 26 nt, Homo sapiens
uauauauaugggauauauauauauau

SEQ ID NO: 19182 - RNA, 24 nt, Homo sapiens
ugcugaguaaucuggccuuucaag

SEQ ID NO: 19183 - RNA, 18 nt, Homo sapiens
uuuuacauaugagacacc

SEQ ID NO: 19184 - RNA, 17 nt, Homo sapiens
guuuugccauguuagcc

SEQ ID NO: 19185 - RNA, 23 nt, Homo sapiens
ucgaacuccugaccucaggugau

SEQ ID NO: 19186 - RNA, 15 nt, Homo sapiens
cucuagagggagggg

SEQ ID NO: 19187 - RNA, 18 nt, Homo sapiens
ugagguggagagugggcg

SEQ ID NO: 19188 - RNA, 19 nt, Homo sapiens
auggauuguugcgcuuucu

SEQ ID NO: 19189 - RNA, 20 nt, Homo sapiens
aaagaaagaaagaaaaaagc

SEQ ID NO: 19190 - RNA, 24 nt, Homo sapiens
aauaaauaucaagguccaacuugg

SEQ ID NO: 19191 - RNA, 22 nt, Homo sapiens
auauauaauauauauaauauau

SEQ ID NO: 19192 - RNA, 21 nt, Homo sapiens
auauauauauauauaauauau

SEQ ID NO: 19193 - RNA, 23 nt, Homo sapiens
auauauauauauauaauauauau

SEQ ID NO: 19194 - RNA, 19 nt, Homo sapiens
cgaagaccccccccccaaa

SEQ ID NO: 19195 - RNA, 18 nt, Homo sapiens
uagcccccuagccugggc

SEQ ID NO: 19196 - RNA, 23 nt, Homo sapiens
uauauauauauauaauauauaua

SEQ ID NO: 19197 - RNA, 23 nt, Homo sapiens
uauauauauauauauaauauaua

SEQ ID NO: 19198 - RNA, 25 nt, Homo sapiens
uauauauauauauauaauauauaua

SEQ ID NO: 19199 - RNA, 15 nt, Homo sapiens
ucgggaggucgaggc

SEQ ID NO: 19200 - RNA, 25 nt, Homo sapiens
caccccaacuuuagcuccguaguca

SEQ ID NO: 19201 - RNA, 18 nt, Homo sapiens
ccggcucggcgcgcaugg

SEQ ID NO: 19202 - RNA, 18 nt, Homo sapiens
cgcgcauggugccgccgc

SEQ ID NO: 19203 - RNA, 17 nt, Homo sapiens
cggcgcccccuuucccg

SEQ ID NO: 19204 - RNA, 18 nt, Homo sapiens
cggggcucggggcugggc

SEQ ID NO: 19205 - RNA, 19 nt, Homo sapiens
gcucggcgcgcauggugcc

SEQ ID NO: 19206 - RNA, 20 nt, Homo sapiens
guuccuucguccauuaggga

SEQ ID NO: 19207 - RNA, 22 nt, Homo sapiens
ucccgggcgccgcuccgugugg

SEQ ID NO: 19208 - RNA, 18 nt, Homo sapiens
ugcggggcggccgcgggc

SEQ ID NO: 19209 - RNA, 27 nt, Homo sapiens
caagagacuaaaguguacuaaugcaug

SEQ ID NO: 19210 - RNA, 23 nt, Homo sapiens
agagaacaaggugugaggcacug

SEQ ID NO: 19211 - RNA, 20 nt, Homo sapiens
ccagagggcacgcccgccuc

SEQ ID NO: 19212 - RNA, 18 nt, Homo sapiens
ccggagcaggcagcucgg

SEQ ID NO: 19213 - RNA, 19 nt, Homo sapiens
cuguuccuguucuccuggc

SEQ ID NO: 19214 - RNA, 15 nt, Homo sapiens
gcccuggagcucggc

SEQ ID NO: 19215 - RNA, 22 nt, Homo sapiens
gcgcgcggcucugagcggcuca

SEQ ID NO: 19216 - RNA, 27 nt, Homo sapiens
uacauucugcaggauuuugguguggau

SEQ ID NO: 19217 - RNA, 17 nt, Homo sapiens
ugcauagaaggcuuacc

SEQ ID NO: 19218 - RNA, 24 nt, Homo sapiens
aaggguaaaaauccuuuaagaggc

SEQ ID NO: 19219 - RNA, 20 nt, Homo sapiens
caaauaaaaccaauuucugg

SEQ ID NO: 19220 - RNA, 16 nt, Homo sapiens
ccgggcgggcggcgaa

SEQ ID NO: 19221 - RNA, 18 nt, Homo sapiens
ccggggcgcggggcucgg

SEQ ID NO: 19222 - RNA, 20 nt, Homo sapiens
cggaaacgggaggcgggggc

SEQ ID NO: 19223 - RNA, 23 nt, Homo sapiens
cggcggcgggcgcggggcaggcc

SEQ ID NO: 19224 - RNA, 19 nt, Homo sapiens
cggggcucggggcccgagc

SEQ ID NO: 19225 - RNA, 18 nt, Homo sapiens
gccggggcaggccggggc

SEQ ID NO: 19226 - RNA, 21 nt, Homo sapiens
gcgcggggcaggccggaagcg

SEQ ID NO: 19227 - RNA, 20 nt, Homo sapiens
ggagucggcgggcuuggaga

SEQ ID NO: 19228 - RNA, 21 nt, Homo sapiens
ggcaggccggggcgcggggcu

SEQ ID NO: 19229 - RNA, 19 nt, Homo sapiens
ggggcccgagcggggggag

SEQ ID NO: 19230 - RNA, 19 nt, Homo sapiens
uacggcccuccccgcgacu

SEQ ID NO: 19231 - RNA, 18 nt, Homo sapiens
aggagggcugggugugug

SEQ ID NO: 19232 - RNA, 15 nt, Homo sapiens
ccagaagagaaagag

SEQ ID NO: 19233 - RNA, 21 nt, Homo sapiens
ggccuguccugcugaggccac

SEQ ID NO: 19234 - RNA, 23 nt, Homo sapiens
aaguuuguagucauuucccuuaa

SEQ ID NO: 19235 - RNA, 20 nt, Homo sapiens
ccucauccuuuccuuucucu

SEQ ID NO: 19236 - RNA, 22 nt, Homo sapiens
cgucaauuuuguuuccaacuac

SEQ ID NO: 19237 - RNA, 20 nt, Homo sapiens
ugaaaguuaagaaaaagcaa

SEQ ID NO: 19238 - RNA, 18 nt, Homo sapiens
uguucuacagcagacuuu

SEQ ID NO: 19239 - RNA, 19 nt, Homo sapiens
uugguggagcuaccacugg

SEQ ID NO: 19240 - RNA, 18 nt, Homo sapiens
uuuuguuuugaaagcaga

SEQ ID NO: 19241 - RNA, 20 nt, Homo sapiens
accccagccaugccucuccc

SEQ ID NO: 19242 - RNA, 14 nt, Homo sapiens
aggauuaccuuagg

SEQ ID NO: 19243 - RNA, 20 nt, Homo sapiens
ccccaccacagcaccccgcc

SEQ ID NO: 19244 - RNA, 18 nt, Homo sapiens
ccugacccuaguguccag

SEQ ID NO: 19245 - RNA, 19 nt, Homo sapiens
cgugcgcccucuguccucg

SEQ ID NO: 19246 - RNA, 21 nt, Homo sapiens
cucacacaggggccaagagcu

SEQ ID NO: 19247 - RNA, 19 nt, Homo sapiens
uguagaauugcaggaccca

SEQ ID NO: 19248 - RNA, 18 nt, Homo sapiens
aaccaugauacuacuaau

SEQ ID NO: 19249 - RNA, 16 nt, Homo sapiens
acacacgccuguaauc

SEQ ID NO: 19250 - RNA, 18 nt, Homo sapiens
acauaugaaaaccaaucu

SEQ ID NO: 19251 - RNA, 22 nt, Homo sapiens
gagguugcagugagcccagauc

SEQ ID NO: 19252 - RNA, 18 nt, Homo sapiens
uauaugaaucacuaagag

SEQ ID NO: 19253 - RNA, 17 nt, Homo sapiens
uugggaggccaaggcgg

SEQ ID NO: 19254 - RNA, 21 nt, Homo sapiens
aggaggugagcuagggguugg

SEQ ID NO: 19255 - RNA, 18 nt, Homo sapiens
caagaagaaaagaaaaau

SEQ ID NO: 19256 - RNA, 15 nt, Homo sapiens
gcaagaagaaaagaa

SEQ ID NO: 19257 - RNA, 19 nt, Homo sapiens
aacauugccacaagggcuc

SEQ ID NO: 19258 - RNA, 21 nt, Homo sapiens
gcuugaugacagugccagggc

SEQ ID NO: 19259 - RNA, 21 nt, Homo sapiens
accuaugaugccuuuucuuag

SEQ ID NO: 19260 - RNA, 18 nt, Homo sapiens
gccuggcccccaaauugu

SEQ ID NO: 19261 - RNA, 24 nt, Homo sapiens
uaaaauaugucaaacaugguuaaa

SEQ ID NO: 19262 - RNA, 20 nt, Homo sapiens
uaacacugaagcagugggua

SEQ ID NO: 19263 - RNA, 17 nt, Homo sapiens
ggagggagggucaggaa

SEQ ID NO: 19264 - RNA, 20 nt, Homo sapiens
gggaggaucgcuugagccca

SEQ ID NO: 19265 - RNA, 15 nt, Homo sapiens
gcggacgcgaaaggg

SEQ ID NO: 19266 - RNA, 18 nt, Homo sapiens
ucgcggucccgggagcgg

SEQ ID NO: 19267 - RNA, 21 nt, Homo sapiens
ugcguuugucacacagcagca

SEQ ID NO: 19268 - RNA, 19 nt, Homo sapiens
aggcuggcgggcgccgcgg

SEQ ID NO: 19269 - RNA, 19 nt, Homo sapiens
caaaaaaagaaaaaaaaaa

SEQ ID NO: 19270 - RNA, 24 nt, Homo sapiens
ccagcauggauaaauuaaccaccu

SEQ ID NO: 19271 - RNA, 19 nt, Homo sapiens
gcccuggcuccgagcuucg

SEQ ID NO: 19272 - RNA, 17 nt, Homo sapiens
gcgcgggacaggcuggc

SEQ ID NO: 19273 - RNA, 15 nt, Homo sapiens
gcuggggcagaggcg

SEQ ID NO: 19274 - RNA, 23 nt, Homo sapiens
ggagucggggggaggaagcuggg

SEQ ID NO: 19275 - RNA, 18 nt, Homo sapiens
gggggagucggggggagg

SEQ ID NO: 19276 - RNA, 19 nt, Homo sapiens
ggggggagucggggggagg

SEQ ID NO: 19277 - RNA, 23 nt, Homo sapiens
ggggggagucggggggaggaagc

SEQ ID NO: 19278 - RNA, 22 nt, Homo sapiens
gggggggggagucggggggagg

SEQ ID NO: 19279 - RNA, 19 nt, Homo sapiens
uacaaugaacacacacugg

SEQ ID NO: 19280 - RNA, 16 nt, Homo sapiens
ucuagaauaagaagaa

SEQ ID NO: 19281 - RNA, 17 nt, Homo sapiens
ugccacaaauuacugcu

SEQ ID NO: 19282 - RNA, 16 nt, Homo sapiens
uggcgggcgccgcggc

SEQ ID NO: 19283 - RNA, 21 nt, Homo sapiens
cacugggugauguuggauggg

SEQ ID NO: 19284 - RNA, 20 nt, Homo sapiens
cuggccccuguagaaguugc

SEQ ID NO: 19285 - RNA, 16 nt, Homo sapiens
gaacccaggaggcgga

SEQ ID NO: 19286 - RNA, 21 nt, Homo sapiens
gacaagggaccugggaccgga

SEQ ID NO: 19287 - RNA, 19 nt, Homo sapiens
gcccaaacagggcucaagu

SEQ ID NO: 19288 - RNA, 21 nt, Homo sapiens
ggaagugggagaggauggaag

SEQ ID NO: 19289 - RNA, 15 nt, Homo sapiens
ucuuuggucccgacu

SEQ ID NO: 19290 - RNA, 28 nt, Homo sapiens
cacugggaaaucuuagggguguugugua

SEQ ID NO: 19291 - RNA, 17 nt, Homo sapiens
cauuguccaucaagcuu

SEQ ID NO: 19292 - RNA, 24 nt, Homo sapiens
uacaauacaugguagacaugacag

SEQ ID NO: 19293 - RNA, 18 nt, Homo sapiens
aaagcaaguauaauaaaa

SEQ ID NO: 19294 - RNA, 14 nt, Homo sapiens
gagcuauucugggg

SEQ ID NO: 19295 - RNA, 25 nt, Homo sapiens
uaaguuauuuuacucuuuuuaguca

SEQ ID NO: 19296 - RNA, 17 nt, Homo sapiens
uauuuugcaucacgucc

SEQ ID NO: 19297 - RNA, 20 nt, Homo sapiens
ucuauuuugauuauauaugu

SEQ ID NO: 19298 - RNA, 16 nt, Homo sapiens
ugccagccccuccucc

SEQ ID NO: 19299 - RNA, 18 nt, Homo sapiens
uguuagggagugaaagca

SEQ ID NO: 19300 - RNA, 20 nt, Homo sapiens
uuggauaagguuccagaggc

SEQ ID NO: 19301 - RNA, 18 nt, Homo sapiens
uuuaagacauuuaacuug

SEQ ID NO: 19302 - RNA, 15 nt, Homo sapiens
cggcagccgcugugc

SEQ ID NO: 19303 - RNA, 17 nt, Homo sapiens
cggugcggggaagcucg

SEQ ID NO: 19304 - RNA, 17 nt, Homo sapiens
uguccgcuccgcgcggc

SEQ ID NO: 19305 - RNA, 17 nt, Homo sapiens
uucuaauaaccugccuu

SEQ ID NO: 19306 - RNA, 20 nt, Homo sapiens
acgaguacacacgcgcgcgc

SEQ ID NO: 19307 - RNA, 15 nt, Homo sapiens
aggcagggagugggc

SEQ ID NO: 19308 - RNA, 24 nt, Homo sapiens
aggggaagucggagagaaagcucg

SEQ ID NO: 19309 - RNA, 20 nt, Homo sapiens
auauaggcuguguguguagg

SEQ ID NO: 19310 - RNA, 18 nt, Homo sapiens
ugcauguuugauauaggc

SEQ ID NO: 19311 - RNA, 19 nt, Homo sapiens
uguguaggcagggaguggg

SEQ ID NO: 19312 - RNA, 23 nt, Homo sapiens
uguguguguaggcagggaguggg

SEQ ID NO: 19313 - RNA, 18 nt, Homo sapiens
aacaaaugcaguuaacag

SEQ ID NO: 19314 - RNA, 19 nt, Homo sapiens
aggcaaauuccaaaacacc

SEQ ID NO: 19315 - RNA, 15 nt, Homo sapiens
ccgccgcuccggccc

SEQ ID NO: 19316 - RNA, 21 nt, Homo sapiens
ccuagguauuuauguaccagu

SEQ ID NO: 19317 - RNA, 18 nt, Homo sapiens
cgggcgcgggagccgcgc

SEQ ID NO: 19318 - RNA, 18 nt, Homo sapiens
cugagccaucaucccaga

SEQ ID NO: 19319 - RNA, 21 nt, Homo sapiens
gaaggcagugguacacucagu

SEQ ID NO: 19320 - RNA, 20 nt, Homo sapiens
gcgcggggccuggcggcgga

SEQ ID NO: 19321 - RNA, 20 nt, Homo sapiens
gcgggcgcgcacagccggcg

SEQ ID NO: 19322 - RNA, 21 nt, Homo sapiens
ggggagcgccgggcgcgggag

SEQ ID NO: 19323 - RNA, 24 nt, Homo sapiens
uaaaaagugggauguuugggagua

SEQ ID NO: 19324 - RNA, 21 nt, Homo sapiens
uauaaugauagcugcaaccuc

SEQ ID NO: 19325 - RNA, 14 nt, Homo sapiens
uaucuggcaagagu

SEQ ID NO: 19326 - RNA, 18 nt, Homo sapiens
uaugaaucuuacccucgc

SEQ ID NO: 19327 - RNA, 19 nt, Homo sapiens
uaugccuauuuauucucag

SEQ ID NO: 19328 - RNA, 19 nt, Homo sapiens
ucggcgcgagggcgcuggc

SEQ ID NO: 19329 - RNA, 19 nt, Homo sapiens
ugcuaauguguaaauuucc

SEQ ID NO: 19330 - RNA, 17 nt, Homo sapiens
cugggcuucauccuccu

SEQ ID NO: 19331 - RNA, 19 nt, Homo sapiens
ucacagagcauacccagca

SEQ ID NO: 19332 - RNA, 19 nt, Homo sapiens
ugucuaaguaauucugagu

SEQ ID NO: 19333 - RNA, 25 nt, Homo sapiens
ccgccgccucuugcuaccacaggcg

SEQ ID NO: 19334 - RNA, 19 nt, Homo sapiens
ccucaacaauggcugcucc

SEQ ID NO: 19335 - RNA, 19 nt, Homo sapiens
cucccuggggcugugaggg

SEQ ID NO: 19336 - RNA, 15 nt, Homo sapiens
cugucuucugcuccc

SEQ ID NO: 19337 - RNA, 23 nt, Homo sapiens
gaggcaaaugcccuggggggugg

SEQ ID NO: 19338 - RNA, 18 nt, Homo sapiens
gcccgccccgcggcggcc

SEQ ID NO: 19339 - RNA, 22 nt, Homo sapiens
gcccgcccgcccuccccaggcc

SEQ ID NO: 19340 - RNA, 16 nt, Homo sapiens
gcgcccgccggcugcc

SEQ ID NO: 19341 - RNA, 22 nt, Homo sapiens
ggccaggagagguacgggggag

SEQ ID NO: 19342 - RNA, 17 nt, Homo sapiens
ggccgggggccaggggg

SEQ ID NO: 19343 - RNA, 23 nt, Homo sapiens
gggccggccuggggggcgggggg

SEQ ID NO: 19344 - RNA, 25 nt, Homo sapiens
gggcugacggggggacaacuucagc

SEQ ID NO: 19345 - RNA, 19 nt, Homo sapiens
ggggccagggggccggccu

SEQ ID NO: 19346 - RNA, 18 nt, Homo sapiens
ucuguagaggccaggccc

SEQ ID NO: 19347 - RNA, 23 nt, Homo sapiens
agugagcacauauuaaaugauaa

SEQ ID NO: 19348 - RNA, 23 nt, Homo sapiens
uccacaguuuuaagucgccccuu

SEQ ID NO: 19349 - RNA, 17 nt, Homo sapiens
uugggaggccgaggugg

SEQ ID NO: 19350 - RNA, 22 nt, Homo sapiens
ucggaggcagcccucuuccucc

SEQ ID NO: 19351 - RNA, 16 nt, Homo sapiens
cccaccggccuagccc

SEQ ID NO: 19352 - RNA, 17 nt, Homo sapiens
cccaccgggccuagccc

SEQ ID NO: 19353 - RNA, 17 nt, Homo sapiens
gcaguuccagguguccu

SEQ ID NO: 19354 - RNA, 27 nt, Homo sapiens
ucggucccgccucaagcaccggguggc

SEQ ID NO: 19355 - RNA, 19 nt, Homo sapiens
uggaggaugcagucaccuc

SEQ ID NO: 19356 - RNA, 21 nt, Homo sapiens
aagauacuggauccacagaaa

SEQ ID NO: 19357 - RNA, 17 nt, Homo sapiens
agcgacgcccacggccc

SEQ ID NO: 19358 - RNA, 19 nt, Homo sapiens
aggaacugaggaccuuguu

SEQ ID NO: 19359 - RNA, 20 nt, Homo sapiens
agucugucagccagcaaguu

SEQ ID NO: 19360 - RNA, 22 nt, Homo sapiens
caagguggcgccccacccagcc

SEQ ID NO: 19361 - RNA, 17 nt, Homo sapiens
caucaaacgucuccagc

SEQ ID NO: 19362 - RNA, 18 nt, Homo sapiens
gaaguccgagugugcaaa

SEQ ID NO: 19363 - RNA, 17 nt, Homo sapiens
gagcgccguggccggca

SEQ ID NO: 19364 - RNA, 17 nt, Homo sapiens
gcauggggcagguccac

SEQ ID NO: 19365 - RNA, 18 nt, Homo sapiens
ggggcucgggguagaccu

SEQ ID NO: 19366 - RNA, 19 nt, Homo sapiens
guggcgccccacccagccc

SEQ ID NO: 19367 - RNA, 18 nt, Homo sapiens
uagaacacuuguucuacg

SEQ ID NO: 19368 - RNA, 19 nt, Homo sapiens
ucacagaguggauugaugu

SEQ ID NO: 19369 - RNA, 22 nt, Homo sapiens
uccggggcucgggguagaccug

SEQ ID NO: 19370 - RNA, 18 nt, Homo sapiens
ugcggugagacgagggcc

SEQ ID NO: 19371 - RNA, 19 nt, Homo sapiens
ugguuugaucgucuccauu

SEQ ID NO: 19372 - RNA, 19 nt, Homo sapiens
ugucuggauucaucaguca

SEQ ID NO: 19373 - RNA, 15 nt, Homo sapiens
agcggcgagccucgg

SEQ ID NO: 19374 - RNA, 18 nt, Homo sapiens
aggcagggcaggcggucc

SEQ ID NO: 19375 - RNA, 16 nt, Homo sapiens
agggaggggucaggag

SEQ ID NO: 19376 - RNA, 24 nt, Homo sapiens
cggugagguggaaggcauuuauuu

SEQ ID NO: 19377 - RNA, 16 nt, Homo sapiens
gcagguuacagccaca

SEQ ID NO: 19378 - RNA, 20 nt, Homo sapiens
uguggacagugagcagccaa

SEQ ID NO: 19379 - RNA, 18 nt, Homo sapiens
uuuacaaaugagaaaaau

SEQ ID NO: 19380 - RNA, 19 nt, Homo sapiens
acauauauagagacuaggg

SEQ ID NO: 19381 - RNA, 15 nt, Homo sapiens
cagaagaaggguuag

SEQ ID NO: 19382 - RNA, 20 nt, Homo sapiens
ccucuuaucuuuccuggaca

SEQ ID NO: 19383 - RNA, 21 nt, Homo sapiens
gaagucgagcgacgguggaga

SEQ ID NO: 19384 - RNA, 20 nt, Homo sapiens
ucuuaaaaaaaaaaagcaca

SEQ ID NO: 19385 - RNA, 19 nt, Homo sapiens
ugagugcaugcuguuuugu

SEQ ID NO: 19386 - RNA, 17 nt, Homo sapiens
uuggaaagauugccuaa

SEQ ID NO: 19387 - RNA, 17 nt, Homo sapiens
ugucauaagacaagcag

SEQ ID NO: 19388 - RNA, 18 nt, Homo sapiens
caguggcgccgcgggcag

SEQ ID NO: 19389 - RNA, 18 nt, Homo sapiens
ccucuguccggaagcccg

SEQ ID NO: 19390 - RNA, 17 nt, Homo sapiens
gagaccaccaucgagag

SEQ ID NO: 19391 - RNA, 18 nt, Homo sapiens
uaauucugaauaggguag

SEQ ID NO: 19392 - RNA, 18 nt, Homo sapiens
ugaugggaggaaauuugc

SEQ ID NO: 19393 - RNA, 23 nt, Homo sapiens
uuccgcgcucuggcugccucggc

SEQ ID NO: 19394 - RNA, 21 nt, Homo sapiens
ccguccucgauucuccccucc

SEQ ID NO: 19395 - RNA, 21 nt, Homo sapiens
aaguggagaaacaggagacag

SEQ ID NO: 19396 - RNA, 23 nt, Homo sapiens
aguacuauauuccaacccuaucu

SEQ ID NO: 19397 - RNA, 16 nt, Homo sapiens
uaaagcuccccaucug

SEQ ID NO: 19398 - RNA, 21 nt, Homo sapiens
ucuuacauguuuaauaccaaa

SEQ ID NO: 19399 - RNA, 18 nt, Homo sapiens
uucacucacuccucuuau

SEQ ID NO: 19400 - RNA, 22 nt, Homo sapiens
aauaauagaaauauauaggaga

SEQ ID NO: 19401 - RNA, 22 nt, Homo sapiens
aauggggaagaaggagaggagg

SEQ ID NO: 19402 - RNA, 21 nt, Homo sapiens
aguaguauaauuaguaagguu

SEQ ID NO: 19403 - RNA, 18 nt, Homo sapiens
cccaagacgguggcuugg

SEQ ID NO: 19404 - RNA, 29 nt, Homo sapiens
ccggccccgccucugaggucggccggagc

SEQ ID NO: 19405 - RNA, 17 nt, Homo sapiens
cgggagcucgggcugcg

SEQ ID NO: 19406 - RNA, 17 nt, Homo sapiens
gagaggaggcggagcgg

SEQ ID NO: 19407 - RNA, 18 nt, Homo sapiens
gggcugcgccgccccgcc

SEQ ID NO: 19408 - RNA, 15 nt, Homo sapiens
uacgcgacgcgacgc

SEQ ID NO: 19409 - RNA, 20 nt, Homo sapiens
uguucaaauagcauuaaaaa

SEQ ID NO: 19410 - RNA, 19 nt, Homo sapiens
uuuauaaaaagucauauuc

SEQ ID NO: 19411 - RNA, 17 nt, Homo sapiens
agcaggguccggcugca

SEQ ID NO: 19412 - RNA, 23 nt, Homo sapiens
cguauuuuuuuuggauuguuguc

SEQ ID NO: 19413 - RNA, 16 nt, Homo sapiens
gcccaggguguggggc

SEQ ID NO: 19414 - RNA, 20 nt, Homo sapiens
acgugguccccaccuggagc

SEQ ID NO: 19415 - RNA, 21 nt, Homo sapiens
ccagugggcaccaaccucagg

SEQ ID NO: 19416 - RNA, 23 nt, Homo sapiens
cccagcugucagcaagccguggc

SEQ ID NO: 19417 - RNA, 14 nt, Homo sapiens
cucucggcagggcc

SEQ ID NO: 19418 - RNA, 19 nt, Homo sapiens
gcuggaguuugguuuucag

SEQ ID NO: 19419 - RNA, 19 nt, Homo sapiens
ggcaggcgucuguggcuug

SEQ ID NO: 19420 - RNA, 18 nt, Homo sapiens
ggcagggcccaggagcac

SEQ ID NO: 19421 - RNA, 21 nt, Homo sapiens
ggggaggagcuggccucgagc

SEQ ID NO: 19422 - RNA, 22 nt, Homo sapiens
ggggggccggcuggcaguggag

SEQ ID NO: 19423 - RNA, 22 nt, Homo sapiens
gugggugaugugaguuucaaaa

SEQ ID NO: 19424 - RNA, 22 nt, Homo sapiens
ucuccagucucaaggagcuggg

SEQ ID NO: 19425 - RNA, 19 nt, Homo sapiens
ugcccuggcccuugagccc

SEQ ID NO: 19426 - RNA, 19 nt, Homo sapiens
uguggcaccaccagccgca

SEQ ID NO: 19427 - RNA, 19 nt, Homo sapiens
agagcagagcagaaugcag

SEQ ID NO: 19428 - RNA, 20 nt, Homo sapiens
acaggugugagccaccacgc

SEQ ID NO: 19429 - RNA, 18 nt, Homo sapiens
agaugcccagaccccucc

SEQ ID NO: 19430 - RNA, 18 nt, Homo sapiens
caaugggccuccuuacug

SEQ ID NO: 19431 - RNA, 18 nt, Homo sapiens
ccagauuugggaaccacu

SEQ ID NO: 19432 - RNA, 23 nt, Homo sapiens
ccucccagaacugggauggaaaa

SEQ ID NO: 19433 - RNA, 20 nt, Homo sapiens
gagaaacuuaauuaugacgu

SEQ ID NO: 19434 - RNA, 20 nt, Homo sapiens
gagacggaguccuucucugu

SEQ ID NO: 19435 - RNA, 19 nt, Homo sapiens
uaagcucagaaguagguga

SEQ ID NO: 19436 - RNA, 18 nt, Homo sapiens
ucaggcgauccaccugcc

SEQ ID NO: 19437 - RNA, 16 nt, Homo sapiens
ucgaagcaucacagcc

SEQ ID NO: 19438 - RNA, 20 nt, Homo sapiens
ucuaacucccagguucaagu

SEQ ID NO: 19439 - RNA, 18 nt, Homo sapiens
ugcccagaccccuccuuc

SEQ ID NO: 19440 - RNA, 18 nt, Homo sapiens
ugugauccgccugccuug

SEQ ID NO: 19441 - RNA, 18 nt, Homo sapiens
acacaaaucaaaugggua

SEQ ID NO: 19442 - RNA, 21 nt, Homo sapiens
gcgcugaaaaggugaccgacg

SEQ ID NO: 19443 - RNA, 21 nt, Homo sapiens
uaauaggaauuaaauguguga

SEQ ID NO: 19444 - RNA, 20 nt, Homo sapiens
uauaaaguuugaacauucuu

SEQ ID NO: 19445 - RNA, 20 nt, Homo sapiens
gaaggggauacugcuaaaca

SEQ ID NO: 19446 - RNA, 17 nt, Homo sapiens
gaggaaaagggucauuu

SEQ ID NO: 19447 - RNA, 18 nt, Homo sapiens
ugcaacuuuacuccaaca

SEQ ID NO: 19448 - RNA, 19 nt, Homo sapiens
ugggaaggggauacugcua

SEQ ID NO: 19449 - RNA, 18 nt, Homo sapiens
uucaucauccgcaagugc

SEQ ID NO: 19450 - RNA, 20 nt, Homo sapiens
acaugagggacauaaauggg

SEQ ID NO: 19451 - RNA, 19 nt, Homo sapiens
acccaguggugccaguggc

SEQ ID NO: 19452 - RNA, 15 nt, Homo sapiens
aggcucuggaccauc

SEQ ID NO: 19453 - RNA, 22 nt, Homo sapiens
agggucguggagcaggucucag

SEQ ID NO: 19454 - RNA, 18 nt, Homo sapiens
cacacugggccuggggaa

SEQ ID NO: 19455 - RNA, 20 nt, Homo sapiens
cucuguguccugccucggcg

SEQ ID NO: 19456 - RNA, 19 nt, Homo sapiens
ggccuggggaaggguuggg

SEQ ID NO: 19457 - RNA, 21 nt, Homo sapiens
ggggugggggccagggccggg

SEQ ID NO: 19458 - RNA, 20 nt, Homo sapiens
uccccggccugggagccccg

SEQ ID NO: 19459 - RNA, 21 nt, Homo sapiens
ucggcucuuugcggcugcugg

SEQ ID NO: 19460 - RNA, 18 nt, Homo sapiens
agggucccgcagcccgcc

SEQ ID NO: 19461 - RNA, 19 nt, Homo sapiens
cccacagcaagccccgcgg

SEQ ID NO: 19462 - RNA, 20 nt, Homo sapiens
cccgagcucgcggguccucc

SEQ ID NO: 19463 - RNA, 18 nt, Homo sapiens
cucccgagcucgcggguc

SEQ ID NO: 19464 - RNA, 19 nt, Homo sapiens
cucccgagcucgcgggucc

SEQ ID NO: 19465 - RNA, 18 nt, Homo sapiens
gccugggugagggaggac

SEQ ID NO: 19466 - RNA, 18 nt, Homo sapiens
gcucucccgagcucgcgg

SEQ ID NO: 19467 - RNA, 19 nt, Homo sapiens
ucucgguccuucacacucc

SEQ ID NO: 19468 - RNA, 16 nt, Homo sapiens
ugcgcuucccgccuuu

SEQ ID NO: 19469 - RNA, 19 nt, Homo sapiens
ccgggggacccggcggugg

SEQ ID NO: 19470 - RNA, 20 nt, Homo sapiens
gagaggaacaggagagagag

SEQ ID NO: 19471 - RNA, 18 nt, Homo sapiens
gagcggggccggcgccca

SEQ ID NO: 19472 - RNA, 22 nt, Homo sapiens
gaggaacaggagagagagggag

SEQ ID NO: 19473 - RNA, 17 nt, Homo sapiens
gccuagccccggcccgg

SEQ ID NO: 19474 - RNA, 21 nt, Homo sapiens
ggcgguaacagcggcgguggc

SEQ ID NO: 19475 - RNA, 22 nt, Homo sapiens
gggacccggcgguggggggccu

SEQ ID NO: 19476 - RNA, 19 nt, Homo sapiens
gggcgcgcggacuggcggg

SEQ ID NO: 19477 - RNA, 16 nt, Homo sapiens
uaauccugagcuccgc

SEQ ID NO: 19478 - RNA, 17 nt, Homo sapiens
uggauaaaaccgagggg

SEQ ID NO: 19479 - RNA, 17 nt, Homo sapiens
gugcugaguagaccguc

SEQ ID NO: 19480 - RNA, 16 nt, Homo sapiens
cggcgcgcaccggagc

SEQ ID NO: 19481 - RNA, 15 nt, Homo sapiens
cggcggcggcggcgc

SEQ ID NO: 19482 - RNA, 22 nt, Homo sapiens
gcggggucugccggcggcggcg

SEQ ID NO: 19483 - RNA, 16 nt, Homo sapiens
ggagugugggugauga

SEQ ID NO: 19484 - RNA, 18 nt, Homo sapiens
aagugcaaaaaaggcaaa

SEQ ID NO: 19485 - RNA, 24 nt, Homo sapiens
cggaucccaccaggaagugcuucg

SEQ ID NO: 19486 - RNA, 20 nt, Homo sapiens
gcacuguagagcaugucuuc

SEQ ID NO: 19487 - RNA, 19 nt, Homo sapiens
ugagauggcucuucccucu

SEQ ID NO: 19488 - RNA, 19 nt, Homo sapiens
agccagacaauuaaaacag

SEQ ID NO: 19489 - RNA, 19 nt, Homo sapiens
aggccaacacggggaacuc

SEQ ID NO: 19490 - RNA, 18 nt, Homo sapiens
cugaggacuggaugaugc

SEQ ID NO: 19491 - RNA, 19 nt, Homo sapiens
ggggcuagguuugggaucu

SEQ ID NO: 19492 - RNA, 18 nt, Homo sapiens
ucacccuccccuugcucc

SEQ ID NO: 19493 - RNA, 20 nt, Homo sapiens
uccccucuucuagucucacu

SEQ ID NO: 19494 - RNA, 22 nt, Homo sapiens
ugucggggcucgaucccagccg

SEQ ID NO: 19495 - RNA, 20 nt, Homo sapiens
aagaggaagccaggggcagg

SEQ ID NO: 19496 - RNA, 21 nt, Homo sapiens
aagcaauaggagauugagagg

SEQ ID NO: 19497 - RNA, 19 nt, Homo sapiens
ccuguccuccagccugggu

SEQ ID NO: 19498 - RNA, 19 nt, Homo sapiens
ccuguucccugcucagggc

SEQ ID NO: 19499 - RNA, 17 nt, Homo sapiens
gagaagaaaggaugaag

SEQ ID NO: 19500 - RNA, 19 nt, Homo sapiens
gcaugcgccauaaagguca

SEQ ID NO: 19501 - RNA, 19 nt, Homo sapiens
gcugcagagcgagggccgg

SEQ ID NO: 19502 - RNA, 19 nt, Homo sapiens
ggaugggagccuggacacc

SEQ ID NO: 19503 - RNA, 14 nt, Homo sapiens
ggcggugggcaggg

SEQ ID NO: 19504 - RNA, 19 nt, Homo sapiens
uaaccaauggggacacauc

SEQ ID NO: 19505 - RNA, 18 nt, Homo sapiens
uaccaggacagcacuaga

SEQ ID NO: 19506 - RNA, 17 nt, Homo sapiens
ucucccgggcuucuccu

SEQ ID NO: 19507 - RNA, 19 nt, Homo sapiens
uguuuugacugcugcugcc

SEQ ID NO: 19508 - RNA, 21 nt, Homo sapiens
acaaagugccacaugccaggc

SEQ ID NO: 19509 - RNA, 26 nt, Homo sapiens
aggggcguggcugggggagugguaag

SEQ ID NO: 19510 - RNA, 20 nt, Homo sapiens
auugcacaguaucgugaaug

SEQ ID NO: 19511 - RNA, 15 nt, Homo sapiens
cacuugagggcagga

SEQ ID NO: 19512 - RNA, 19 nt, Homo sapiens
cagcggggaggggcguggc

SEQ ID NO: 19513 - RNA, 15 nt, Homo sapiens
caucuuggccuccca

SEQ ID NO: 19514 - RNA, 21 nt, Homo sapiens
ccccagcuccagccccaucuc

SEQ ID NO: 19515 - RNA, 19 nt, Homo sapiens
ccggcccggucccugaccc

SEQ ID NO: 19516 - RNA, 15 nt, Homo sapiens
ccggucccugacccg

SEQ ID NO: 19517 - RNA, 19 nt, Homo sapiens
cugcacucaggcugcucug

SEQ ID NO: 19518 - RNA, 18 nt, Homo sapiens
gcccaggaagcagaguuu

SEQ ID NO: 19519 - RNA, 18 nt, Homo sapiens
gccccugcccggggcccg

SEQ ID NO: 19520 - RNA, 20 nt, Homo sapiens
gccgcuugccagccagcccg

SEQ ID NO: 19521 - RNA, 18 nt, Homo sapiens
gcgcggagccacugccgc

SEQ ID NO: 19522 - RNA, 20 nt, Homo sapiens
ggaggcggggcuggaggagc

SEQ ID NO: 19523 - RNA, 22 nt, Homo sapiens
ggggaggcggggcuggaggagc

SEQ ID NO: 19524 - RNA, 24 nt, Homo sapiens
ggggaggcggggcuggaggagcgg

SEQ ID NO: 19525 - RNA, 23 nt, Homo sapiens
ggggaggggcguggcugggggag

SEQ ID NO: 19526 - RNA, 26 nt, Homo sapiens
ggggaggggcguggcugggggagugg

SEQ ID NO: 19527 - RNA, 20 nt, Homo sapiens
ggggggcggggccgaacggg

SEQ ID NO: 19528 - RNA, 20 nt, Homo sapiens
gguggguguggucugucccg

SEQ ID NO: 19529 - RNA, 21 nt, Homo sapiens
guuugauccuguuucagauuc

SEQ ID NO: 19530 - RNA, 21 nt, Homo sapiens
uacaggcgugagccaccaggc

SEQ ID NO: 19531 - RNA, 21 nt, Homo sapiens
ucagacaccagugcgucgugg

SEQ ID NO: 19532 - RNA, 19 nt, Homo sapiens
ugaggggaugagguugcgg

SEQ ID NO: 19533 - RNA, 28 nt, Homo sapiens
ugggaucacguuucuucugggagagcuc

SEQ ID NO: 19534 - RNA, 20 nt, Homo sapiens
ugggcaccuccccaguacag

SEQ ID NO: 19535 - RNA, 22 nt, Homo sapiens
uguguagagaugggaucccccu

SEQ ID NO: 19536 - RNA, 20 nt, Homo sapiens
uuggggagcagaguuggggg

SEQ ID NO: 19537 - RNA, 19 nt, Homo sapiens
uguaacacauauagcaaua

SEQ ID NO: 19538 - RNA, 19 nt, Homo sapiens
cagugcugggccugaaggg

SEQ ID NO: 19539 - RNA, 22 nt, Homo sapiens
gagaaaggcaggggcaaagggu

SEQ ID NO: 19540 - RNA, 17 nt, Homo sapiens
gcaggggcagaaaaaga

SEQ ID NO: 19541 - RNA, 21 nt, Homo sapiens
gcuaugcuccuacagugucac

SEQ ID NO: 19542 - RNA, 21 nt, Homo sapiens
gcucgcccaccccuucugacc

SEQ ID NO: 19543 - RNA, 18 nt, Homo sapiens
gggcccccuuaaccuacg

SEQ ID NO: 19544 - RNA, 17 nt, Homo sapiens
ucccacggagucucggc

SEQ ID NO: 19545 - RNA, 17 nt, Homo sapiens
ugcaaagugccgucggc

SEQ ID NO: 19546 - RNA, 20 nt, Homo sapiens
ugcugggccugaaggggcuc

SEQ ID NO: 19547 - RNA, 24 nt, Homo sapiens
uggccaggggcagggcagggugag

SEQ ID NO: 19548 - RNA, 18 nt, Homo sapiens
uggguugggggagaaagg

SEQ ID NO: 19549 - RNA, 21 nt, Homo sapiens
uguguugcaacaaccugaaaa

SEQ ID NO: 19550 - RNA, 19 nt, Homo sapiens
caaggcuauugaggugagc

SEQ ID NO: 19551 - RNA, 20 nt, Homo sapiens
gcuaggccucccugcacgcc

SEQ ID NO: 19552 - RNA, 19 nt, Homo sapiens
caaguccugggaguggggg

SEQ ID NO: 19553 - RNA, 22 nt, Homo sapiens
cgugaaggccccuggugggcgg

SEQ ID NO: 19554 - RNA, 22 nt, Homo sapiens
guggcugggacagggccuccuu

SEQ ID NO: 19555 - RNA, 21 nt, Homo sapiens
gagcagguguaacccggcggu

SEQ ID NO: 19556 - RNA, 18 nt, Homo sapiens
cacccaugugcccacacc

SEQ ID NO: 19557 - RNA, 16 nt, Homo sapiens
caucugccgucuaccc

SEQ ID NO: 19558 - RNA, 15 nt, Homo sapiens
ccacacccaugugcc

SEQ ID NO: 19559 - RNA, 19 nt, Homo sapiens
gccacacccaugugcccac

SEQ ID NO: 19560 - RNA, 20 nt, Homo sapiens
uuuaaacuuuuauuugccua

SEQ ID NO: 19561 - RNA, 19 nt, Homo sapiens
auuugugcacuucacccag

SEQ ID NO: 19562 - RNA, 21 nt, Homo sapiens
ucugcuucucuuucuucaagu

SEQ ID NO: 19563 - RNA, 24 nt, Homo sapiens
acuccaggaggagaaaccaggaca

SEQ ID NO: 19564 - RNA, 20 nt, Homo sapiens
aggguguguguauguguucc

SEQ ID NO: 19565 - RNA, 19 nt, Homo sapiens
ucuaacaucuguucucacc

SEQ ID NO: 19566 - RNA, 16 nt, Homo sapiens
cagcaggcgagcuccu

SEQ ID NO: 19567 - RNA, 19 nt, Homo sapiens
gacagugcaagaagagagg

SEQ ID NO: 19568 - RNA, 17 nt, Homo sapiens
gaggcaaacuguucccg

SEQ ID NO: 19569 - RNA, 16 nt, Homo sapiens
gggugccagcaaguug

SEQ ID NO: 19570 - RNA, 22 nt, Homo sapiens
ugucuuguacaguuuucucaga

SEQ ID NO: 19571 - RNA, 18 nt, Homo sapiens
cagcuuugguucuucaga

SEQ ID NO: 19572 - RNA, 19 nt, Homo sapiens
ccgcuccgcccuuuccucg

SEQ ID NO: 19573 - RNA, 23 nt, Homo sapiens
ucaugccuagucagcccauuucu

SEQ ID NO: 19574 - RNA, 21 nt, Homo sapiens
aagcugucccagagcaaguua

SEQ ID NO: 19575 - RNA, 22 nt, Homo sapiens
aagugccuuccaggaucugugg

SEQ ID NO: 19576 - RNA, 22 nt, Homo sapiens
agaggaguagguaggcacaccc

SEQ ID NO: 19577 - RNA, 17 nt, Homo sapiens
gcucuuggcucagcacu

SEQ ID NO: 19578 - RNA, 18 nt, Homo sapiens
ggagcauugugggcccuu

SEQ ID NO: 19579 - RNA, 18 nt, Homo sapiens
ucuaaaacaaccaagccc

SEQ ID NO: 19580 - RNA, 20 nt, Homo sapiens
ugaagcugccuaggccaggc

SEQ ID NO: 19581 - RNA, 20 nt, Homo sapiens
uggcucagcacuuucuguga

SEQ ID NO: 19582 - RNA, 20 nt, Homo sapiens
aagaggaugcagccugaugu

SEQ ID NO: 19583 - RNA, 18 nt, Homo sapiens
aagcagcuuuccucccag

SEQ ID NO: 19584 - RNA, 19 nt, Homo sapiens
acaugcccuugagggcucu

SEQ ID NO: 19585 - RNA, 19 nt, Homo sapiens
acggaggggagaagugaca

SEQ ID NO: 19586 - RNA, 15 nt, Homo sapiens
acugagaaacugagc

SEQ ID NO: 19587 - RNA, 16 nt, Homo sapiens
agaguugggcccacag

SEQ ID NO: 19588 - RNA, 21 nt, Homo sapiens
ccauucucauacagcaaccgg

SEQ ID NO: 19589 - RNA, 20 nt, Homo sapiens
ccuagcauucccucuucccc

SEQ ID NO: 19590 - RNA, 16 nt, Homo sapiens
ccuggcauucagguuc

SEQ ID NO: 19591 - RNA, 16 nt, Homo sapiens
cugcugugccauacca

SEQ ID NO: 19592 - RNA, 18 nt, Homo sapiens
cuggauaguaauggccau

SEQ ID NO: 19593 - RNA, 23 nt, Homo sapiens
gagguugcagugagccaagauca

SEQ ID NO: 19594 - RNA, 19 nt, Homo sapiens
gggcaccuggcaugugagg

SEQ ID NO: 19595 - RNA, 21 nt, Homo sapiens
uaucuguaagagcugcaucua

SEQ ID NO: 19596 - RNA, 16 nt, Homo sapiens
uccuucauccuaccug

SEQ ID NO: 19597 - RNA, 22 nt, Homo sapiens
ugaaaccacaagggagggggag

SEQ ID NO: 19598 - RNA, 18 nt, Homo sapiens
ugaaaggaggaugacaug

SEQ ID NO: 19599 - RNA, 20 nt, Homo sapiens
ugaaaugaccuagcaccagg

SEQ ID NO: 19600 - RNA, 23 nt, Homo sapiens
ugccgccucuuuuaccacaggcg

SEQ ID NO: 19601 - RNA, 19 nt, Homo sapiens
cuucaggaguagaugcugu

SEQ ID NO: 19602 - RNA, 19 nt, Homo sapiens
ucaggaguagaugcuguca

SEQ ID NO: 19603 - RNA, 21 nt, Homo sapiens
ugagagaaguuacauguucau

SEQ ID NO: 19604 - RNA, 22 nt, Homo sapiens
agugggcagccccccacuucca

SEQ ID NO: 19605 - RNA, 18 nt, Homo sapiens
cggggcucggggcugggc

SEQ ID NO: 19606 - RNA, 17 nt, Homo sapiens
cugugucgggggagggg

SEQ ID NO: 19607 - RNA, 23 nt, Homo sapiens
gauggggugaggcuggggcggug

SEQ ID NO: 19608 - RNA, 18 nt, Homo sapiens
gcugggaggggaugggag

SEQ ID NO: 19609 - RNA, 24 nt, Homo sapiens
ggcggucagcagaauggccccggg

SEQ ID NO: 19610 - RNA, 19 nt, Homo sapiens
ggcugggaggggaugggag

SEQ ID NO: 19611 - RNA, 22 nt, Homo sapiens
ggcugggggcggugggcccggg

SEQ ID NO: 19612 - RNA, 16 nt, Homo sapiens
ugacgcccccaaagcc

SEQ ID NO: 19613 - RNA, 18 nt, Homo sapiens
uggggugaggcuggggcg

SEQ ID NO: 19614 - RNA, 19 nt, Homo sapiens
aagcagcagccuggugggc

SEQ ID NO: 19615 - RNA, 26 nt, Homo sapiens
acugccuuccccguggucgcgcgcgc

SEQ ID NO: 19616 - RNA, 17 nt, Homo sapiens
agcgcgcggccaggccc

SEQ ID NO: 19617 - RNA, 22 nt, Homo sapiens
aggcggggcugggggcgguggg

SEQ ID NO: 19618 - RNA, 21 nt, Homo sapiens
aggggcggcaggcggggcugg

SEQ ID NO: 19619 - RNA, 20 nt, Homo sapiens
cacccggaaggcgagggcag

SEQ ID NO: 19620 - RNA, 18 nt, Homo sapiens
ccgcggcuccacccgucc

SEQ ID NO: 19621 - RNA, 19 nt, Homo sapiens
cgcccggcugcugcggggc

SEQ ID NO: 19622 - RNA, 19 nt, Homo sapiens
cggagagcgccgcggggcg

SEQ ID NO: 19623 - RNA, 16 nt, Homo sapiens
cggcgcgcaccagcag

SEQ ID NO: 19624 - RNA, 20 nt, Homo sapiens
cggcggucccgggagagcgu

SEQ ID NO: 19625 - RNA, 18 nt, Homo sapiens
cggggcggugggccgggg

SEQ ID NO: 19626 - RNA, 18 nt, Homo sapiens
cggggcucggggcugggc

SEQ ID NO: 19627 - RNA, 18 nt, Homo sapiens
gcccggcugcugcggggc

SEQ ID NO: 19628 - RNA, 18 nt, Homo sapiens
gccggagcuugcaacugc

SEQ ID NO: 19629 - RNA, 20 nt, Homo sapiens
gcggcggucccgggagagcg

SEQ ID NO: 19630 - RNA, 23 nt, Homo sapiens
gcggggcggggcggagggggagg

SEQ ID NO: 19631 - RNA, 18 nt, Homo sapiens
ggcccuggggaacuaggc

SEQ ID NO: 19632 - RNA, 18 nt, Homo sapiens
gggaggggaugggaggag

SEQ ID NO: 19633 - RNA, 21 nt, Homo sapiens
gggaggggaugggaggagugg

SEQ ID NO: 19634 - RNA, 18 nt, Homo sapiens
gggaggggcggcaggcgg

SEQ ID NO: 19635 - RNA, 18 nt, Homo sapiens
gggcaguccggcuggcac

SEQ ID NO: 19636 - RNA, 19 nt, Homo sapiens
ggggaggggcggcaggcgg

SEQ ID NO: 19637 - RNA, 20 nt, Homo sapiens
ggggcggggcggagggggag

SEQ ID NO: 19638 - RNA, 18 nt, Homo sapiens
ggguggggucagacgggg

SEQ ID NO: 19639 - RNA, 22 nt, Homo sapiens
gguggcuggcgggcuucggggc

SEQ ID NO: 19640 - RNA, 17 nt, Homo sapiens
ugccuuccccguggggc

SEQ ID NO: 19641 - RNA, 20 nt, Homo sapiens
ugccuuccccguggggcucc

SEQ ID NO: 19642 - RNA, 18 nt, Homo sapiens
uggggugaggcuggggcg

SEQ ID NO: 19643 - RNA, 17 nt, Homo sapiens
ccacugucccugcuucc

SEQ ID NO: 19644 - RNA, 15 nt, Homo sapiens
cugucacuccagaca

SEQ ID NO: 19645 - RNA, 17 nt, Homo sapiens
gcuucccgcagcgcuuc

SEQ ID NO: 19646 - RNA, 23 nt, Homo sapiens
gguacaugcagucugagacacgu

SEQ ID NO: 19647 - RNA, 18 nt, Homo sapiens
uccaacaucagcugcaag

SEQ ID NO: 19648 - RNA, 22 nt, Homo sapiens
aagaggcggcggcaggccggag

SEQ ID NO: 19649 - RNA, 20 nt, Homo sapiens
ccggcucucugagcaccuuu

SEQ ID NO: 19650 - RNA, 16 nt, Homo sapiens
cgccgggccgcuccgg

SEQ ID NO: 19651 - RNA, 15 nt, Homo sapiens
cgcgggugggcucuc

SEQ ID NO: 19652 - RNA, 21 nt, Homo sapiens
cgggcggcugcggccucggcg

SEQ ID NO: 19653 - RNA, 21 nt, Homo sapiens
gcaguggaauuuuagggcuuu

SEQ ID NO: 19654 - RNA, 21 nt, Homo sapiens
gcggcugcggccucggcggcg

SEQ ID NO: 19655 - RNA, 20 nt, Homo sapiens
ggcgagcgggagcgcggcgg

SEQ ID NO: 19656 - RNA, 21 nt, Homo sapiens
ugucuuguggacaacgcagug

SEQ ID NO: 19657 - RNA, 24 nt, Homo sapiens
aagagccuugaugucaagaagagc

SEQ ID NO: 19658 - RNA, 20 nt, Homo sapiens
cucugauuuucuucucaaau

SEQ ID NO: 19659 - RNA, 21 nt, Homo sapiens
uuuggaacucgagcaucuccc

SEQ ID NO: 19660 - RNA, 19 nt, Homo sapiens
caccgggcaaaguccgcgc

SEQ ID NO: 19661 - RNA, 20 nt, Homo sapiens
ccagguccugggaguuuggg

SEQ ID NO: 19662 - RNA, 15 nt, Homo sapiens
cgccgcggcuggggu

SEQ ID NO: 19663 - RNA, 17 nt, Homo sapiens
gcugcgggcaggcaccc

SEQ ID NO: 19664 - RNA, 20 nt, Homo sapiens
gcuggggccugcaggccccc

SEQ ID NO: 19665 - RNA, 15 nt, Homo sapiens
ggaagcaggguacag

SEQ ID NO: 19666 - RNA, 18 nt, Homo sapiens
gggcaacggugcccggga

SEQ ID NO: 19667 - RNA, 16 nt, Homo sapiens
guccgcggacacgcag

SEQ ID NO: 19668 - RNA, 18 nt, Homo sapiens
gucgguggguccuugcua

SEQ ID NO: 19669 - RNA, 17 nt, Homo sapiens
uggcuguggggcggggg

SEQ ID NO: 19670 - RNA, 18 nt, Homo sapiens
uggggcgggggcggggca

SEQ ID NO: 19671 - RNA, 18 nt, Homo sapiens
aaccccuuguuuuaaauc

SEQ ID NO: 19672 - RNA, 25 nt, Homo sapiens
aacuuuuuuguacaauugcauagac

SEQ ID NO: 19673 - RNA, 22 nt, Homo sapiens
aaugauuuaaaaaucaaaaaga

SEQ ID NO: 19674 - RNA, 17 nt, Homo sapiens
acuuacuuacaaaccug

SEQ ID NO: 19675 - RNA, 16 nt, Homo sapiens
agcaaaauaaucucag

SEQ ID NO: 19676 - RNA, 15 nt, Homo sapiens
agccgccgggcuccc

SEQ ID NO: 19677 - RNA, 18 nt, Homo sapiens
agcuuuuccucuugagcu

SEQ ID NO: 19678 - RNA, 22 nt, Homo sapiens
caccuguuucuuccacuccggu

SEQ ID NO: 19679 - RNA, 14 nt, Homo sapiens
cagcacugauccug

SEQ ID NO: 19680 - RNA, 16 nt, Homo sapiens
cauagccaagcacaga

SEQ ID NO: 19681 - RNA, 18 nt, Homo sapiens
ccaugugauguuuaugcu

SEQ ID NO: 19682 - RNA, 24 nt, Homo sapiens
cugacagcuguuugcagaccuccu

SEQ ID NO: 19683 - RNA, 16 nt, Homo sapiens
cugcuccuucuucauc

SEQ ID NO: 19684 - RNA, 17 nt, Homo sapiens
gcaugaaagaguaaagc

SEQ ID NO: 19685 - RNA, 22 nt, Homo sapiens
gccaagcacagauaaagcaggc

SEQ ID NO: 19686 - RNA, 17 nt, Homo sapiens
ggaguuguaaaacauuu

SEQ ID NO: 19687 - RNA, 15 nt, Homo sapiens
ggcuuccggcuccgg

SEQ ID NO: 19688 - RNA, 16 nt, Homo sapiens
guggcauugcuagcag

SEQ ID NO: 19689 - RNA, 18 nt, Homo sapiens
uaaauuuuuaaacaaccc

SEQ ID NO: 19690 - RNA, 26 nt, Homo sapiens
uaacuuuuuuguacaauugcauagac

SEQ ID NO: 19691 - RNA, 26 nt, Homo sapiens
uaauuuguuaccuuagagcuuugggu

SEQ ID NO: 19692 - RNA, 18 nt, Homo sapiens
uauaauaaguccugugua

SEQ ID NO: 19693 - RNA, 18 nt, Homo sapiens
uaugugugugugugugug

SEQ ID NO: 19694 - RNA, 19 nt, Homo sapiens
uaugugugugugugugugu

SEQ ID NO: 19695 - RNA, 26 nt, Homo sapiens
ugagaggaguucaaauauacaucaaa

SEQ ID NO: 19696 - RNA, 18 nt, Homo sapiens
ugccgugaauagugaggu

SEQ ID NO: 19697 - RNA, 22 nt, Homo sapiens
uggauccuuuuucuuuuggcag

SEQ ID NO: 19698 - RNA, 21 nt, Homo sapiens
uguguaugugugugugugugu

SEQ ID NO: 19699 - RNA, 19 nt, Homo sapiens
uguguguguguuuguuuug

SEQ ID NO: 19700 - RNA, 14 nt, Homo sapiens
uguguguguuuguu

SEQ ID NO: 19701 - RNA, 18 nt, Homo sapiens
uuuugcugauuucccugu

SEQ ID NO: 19702 - RNA, 18 nt, Homo sapiens
agcuuuuccucuugagcu

SEQ ID NO: 19703 - RNA, 21 nt, Homo sapiens
cgaggaggucuaggaggcgcc

SEQ ID NO: 19704 - RNA, 20 nt, Homo sapiens
gacuugcucaagcuuuucuu

SEQ ID NO: 19705 - RNA, 15 nt, Homo sapiens
gccucacaaaagcag

SEQ ID NO: 19706 - RNA, 24 nt, Homo sapiens
uaguagucauuuggugugguggua

SEQ ID NO: 19707 - RNA, 24 nt, Homo sapiens
uaguggucaguccaggagcuaggu

SEQ ID NO: 19708 - RNA, 18 nt, Homo sapiens
auguaacagcuaauuaga

SEQ ID NO: 19709 - RNA, 18 nt, Homo sapiens
gcgacgcgcgcgccuggc

SEQ ID NO: 19710 - RNA, 28 nt, Homo sapiens
gcgcgcgccuggcugugaagucggccug

SEQ ID NO: 19711 - RNA, 22 nt, Homo sapiens
guggcauuucuucauagaagca

SEQ ID NO: 19712 - RNA, 20 nt, Homo sapiens
ccccugccccuuccuuaguc

SEQ ID NO: 19713 - RNA, 16 nt, Homo sapiens
cgcuggaucggagccc

SEQ ID NO: 19714 - RNA, 20 nt, Homo sapiens
gccccuuccuuagucucugg

SEQ ID NO: 19715 - RNA, 19 nt, Homo sapiens
ggcagaagugcccgccaaa

SEQ ID NO: 19716 - RNA, 18 nt, Homo sapiens
uccagccgcagcggaggc

SEQ ID NO: 19717 - RNA, 17 nt, Homo sapiens
ucacagcccaacccggc

SEQ ID NO: 19718 - RNA, 16 nt, Homo sapiens
gccuccucucagggcu

SEQ ID NO: 19719 - RNA, 18 nt, Homo sapiens
ggggcggaggggaggcca

SEQ ID NO: 19720 - RNA, 21 nt, Homo sapiens
uuucuagaccuguuagcugga

SEQ ID NO: 19721 - RNA, 21 nt, Homo sapiens
uuuauuauuaugucuugugug

SEQ ID NO: 19722 - RNA, 18 nt, Homo sapiens
cagcauccugcccccuuu

SEQ ID NO: 19723 - RNA, 18 nt, Homo sapiens
ggcggcgguguggcggcg

SEQ ID NO: 19724 - RNA, 23 nt, Homo sapiens
ggcgguguggcggcgguguggcg

SEQ ID NO: 19725 - RNA, 15 nt, Homo sapiens
ccugaacaccaagcc

SEQ ID NO: 19726 - RNA, 19 nt, Homo sapiens
gcggcgacggcggcggggg

SEQ ID NO: 19727 - RNA, 14 nt, Homo sapiens
guggagguggggga

SEQ ID NO: 19728 - RNA, 20 nt, Homo sapiens
ucccgcagucuguccgcccg

SEQ ID NO: 19729 - RNA, 19 nt, Homo sapiens
agcagaguauguaaauugg

SEQ ID NO: 19730 - RNA, 21 nt, Homo sapiens
cugguggaauuucuguuugca

SEQ ID NO: 19731 - RNA, 28 nt, Homo sapiens
uaugacacaugaugauacauggaggcug

SEQ ID NO: 19732 - RNA, 24 nt, Homo sapiens
ucacaauauggaguguccuuucug

SEQ ID NO: 19733 - RNA, 19 nt, Homo sapiens
ugccugguggagagcaaag

SEQ ID NO: 19734 - RNA, 21 nt, Homo sapiens
aggagcccccagcuggggccu

SEQ ID NO: 19735 - RNA, 19 nt, Homo sapiens
ccaggcucaacagcccugc

SEQ ID NO: 19736 - RNA, 18 nt, Homo sapiens
cccagccacaccuagccc

SEQ ID NO: 19737 - RNA, 20 nt, Homo sapiens
cccuauuugucccuuugggc

SEQ ID NO: 19738 - RNA, 18 nt, Homo sapiens
ccuagccccaccuggccc

SEQ ID NO: 19739 - RNA, 16 nt, Homo sapiens
ccucagggcugugaag

SEQ ID NO: 19740 - RNA, 19 nt, Homo sapiens
cguucccuaaaucccacuc

SEQ ID NO: 19741 - RNA, 21 nt, Homo sapiens
gaugaugaaggaacaaggcca

SEQ ID NO: 19742 - RNA, 22 nt, Homo sapiens
gcaaguuccaggucguuucaug

SEQ ID NO: 19743 - RNA, 20 nt, Homo sapiens
gccaaaacauuccccucccc

SEQ ID NO: 19744 - RNA, 26 nt, Homo sapiens
gcucaacagcccugcccuucuaucag

SEQ ID NO: 19745 - RNA, 19 nt, Homo sapiens
gcuccucuuggcuaaaggu

SEQ ID NO: 19746 - RNA, 18 nt, Homo sapiens
gcucuccuggcccccagc

SEQ ID NO: 19747 - RNA, 24 nt, Homo sapiens
gggcaggggaaaggagggguuggg

SEQ ID NO: 19748 - RNA, 17 nt, Homo sapiens
ucagugguuuuccaacu

SEQ ID NO: 19749 - RNA, 17 nt, Homo sapiens
ucccaccaccaccagau

SEQ ID NO: 19750 - RNA, 16 nt, Homo sapiens
ugccgggauccgggcc

SEQ ID NO: 19751 - RNA, 19 nt, Homo sapiens
ugcucagcuccccaccccc

SEQ ID NO: 19752 - RNA, 18 nt, Homo sapiens
uggcaaggagcccccagc

SEQ ID NO: 19753 - RNA, 17 nt, Homo sapiens
ugggagaggaggguggc

SEQ ID NO: 19754 - RNA, 17 nt, Homo sapiens
cacugcccugaucuggg

SEQ ID NO: 19755 - RNA, 23 nt, Homo sapiens
ccgcuucucccggacccccgccc

SEQ ID NO: 19756 - RNA, 24 nt, Homo sapiens
gcguggugcguucccgcggcgccg

SEQ ID NO: 19757 - RNA, 19 nt, Homo sapiens
ucagaacuaaacagggaua

SEQ ID NO: 19758 - RNA, 23 nt, Homo sapiens
ucuccugucccgcgaccccgccg

SEQ ID NO: 19759 - RNA, 18 nt, Homo sapiens
accucggcgggggcaucc

SEQ ID NO: 19760 - RNA, 22 nt, Homo sapiens
cugccccuccccgcucuguggu

SEQ ID NO: 19761 - RNA, 20 nt, Homo sapiens
gaccucuggucagcauggcg

SEQ ID NO: 19762 - RNA, 20 nt, Homo sapiens
gccccugugccccucgcucc

SEQ ID NO: 19763 - RNA, 17 nt, Homo sapiens
gguugauguuuuacaga

SEQ ID NO: 19764 - RNA, 18 nt, Homo sapiens
cuuaaacauuuuauuaug

SEQ ID NO: 19765 - RNA, 17 nt, Homo sapiens
gcagggagaggcccagg

SEQ ID NO: 19766 - RNA, 18 nt, Homo sapiens
aaccacccuccccgggcc

SEQ ID NO: 19767 - RNA, 19 nt, Homo sapiens
agagaaguuuuuuggugcu

SEQ ID NO: 19768 - RNA, 17 nt, Homo sapiens
gagggggacuguccugg

SEQ ID NO: 19769 - RNA, 18 nt, Homo sapiens
uccccgggccugcucacc

SEQ ID NO: 19770 - RNA, 19 nt, Homo sapiens
aauuuaguaacuuacuaga

SEQ ID NO: 19771 - RNA, 27 nt, Homo sapiens
ccagaaagagugugugugugugugugu

SEQ ID NO: 19772 - RNA, 23 nt, Homo sapiens
cccaggauucccuccugucaucu

SEQ ID NO: 19773 - RNA, 22 nt, Homo sapiens
cccccuagcguucauuguagaa

SEQ ID NO: 19774 - RNA, 15 nt, Homo sapiens
cggagcggcuggagc

SEQ ID NO: 19775 - RNA, 17 nt, Homo sapiens
gaauccagguuugaggu

SEQ ID NO: 19776 - RNA, 20 nt, Homo sapiens
gcucucggagcggcuggagc

SEQ ID NO: 19777 - RNA, 18 nt, Homo sapiens
uauuuuguuuguucuuuu

SEQ ID NO: 19778 - RNA, 17 nt, Homo sapiens
ucagaaaguguucuucu

SEQ ID NO: 19779 - RNA, 28 nt, Homo sapiens
ugaaugggguggggagauagcauagcug

SEQ ID NO: 19780 - RNA, 18 nt, Homo sapiens
ugugugugugugugugug

SEQ ID NO: 19781 - RNA, 19 nt, Homo sapiens
ugugugugugugugugugu

SEQ ID NO: 19782 - RNA, 20 nt, Homo sapiens
ugugugugugugugugugua

SEQ ID NO: 19783 - RNA, 22 nt, Homo sapiens
uguguuugugugugugugugua

SEQ ID NO: 19784 - RNA, 15 nt, Homo sapiens
caugccuggugaugg

SEQ ID NO: 19785 - RNA, 19 nt, Homo sapiens
cccagcuagagcugccugg

SEQ ID NO: 19786 - RNA, 21 nt, Homo sapiens
gcccaguucucuggggcuuua

SEQ ID NO: 19787 - RNA, 18 nt, Homo sapiens
gcucccuugguccagcug

SEQ ID NO: 19788 - RNA, 21 nt, Homo sapiens
gcuggaucuugggugcugggc

SEQ ID NO: 19789 - RNA, 20 nt, Homo sapiens
uccuguccccugcuggaucu

SEQ ID NO: 19790 - RNA, 19 nt, Homo sapiens
gugggucugugucauuucc

SEQ ID NO: 19791 - RNA, 21 nt, Homo sapiens
uaauacuaagggaaaaggcug

SEQ ID NO: 19792 - RNA, 17 nt, Homo sapiens
uuugcagaguagguugu

SEQ ID NO: 19793 - RNA, 18 nt, Homo sapiens
aaaaacaaaaccgaacaa

SEQ ID NO: 19794 - RNA, 16 nt, Homo sapiens
aguguuauuguguugu

SEQ ID NO: 19795 - RNA, 17 nt, Homo sapiens
cgaacaaaacaaagcgc

SEQ ID NO: 19796 - RNA, 21 nt, Homo sapiens
gaccaggcaagcggagagggu

SEQ ID NO: 19797 - RNA, 17 nt, Homo sapiens
gagggggagaaaaacac

SEQ ID NO: 19798 - RNA, 19 nt, Homo sapiens
gagggggagaaaaacaccc

SEQ ID NO: 19799 - RNA, 20 nt, Homo sapiens
gcaagcggagaggguggcaa

SEQ ID NO: 19800 - RNA, 18 nt, Homo sapiens
gcagagccgugagcaagc

SEQ ID NO: 19801 - RNA, 18 nt, Homo sapiens
gccccacccugcccuccc

SEQ ID NO: 19802 - RNA, 19 nt, Homo sapiens
gcccggccgccgagucucc

SEQ ID NO: 19803 - RNA, 18 nt, Homo sapiens
ucaugcaagucaaauauu

SEQ ID NO: 19804 - RNA, 20 nt, Homo sapiens
ucauguauaucuuccuugcu

SEQ ID NO: 19805 - RNA, 20 nt, Homo sapiens
uuccaauaauuucaaggucu

SEQ ID NO: 19806 - RNA, 17 nt, Homo sapiens
cccggccgcucgcagcc

SEQ ID NO: 19807 - RNA, 21 nt, Homo sapiens
ccgccgccgcugcccucgccc

SEQ ID NO: 19808 - RNA, 23 nt, Homo sapiens
ccgccgcugcccucgcccggccg

SEQ ID NO: 19809 - RNA, 19 nt, Homo sapiens
ccgcgcgccccucgcgucg

SEQ ID NO: 19810 - RNA, 23 nt, Homo sapiens
ccgcuccgcgccuuugcacgccc

SEQ ID NO: 19811 - RNA, 17 nt, Homo sapiens
ccgucccgcuccgcgcc

SEQ ID NO: 19812 - RNA, 23 nt, Homo sapiens
cgcccggccgcucgcagccuccg

SEQ ID NO: 19813 - RNA, 21 nt, Homo sapiens
ugaguucuauugcuaaaauaa

SEQ ID NO: 19814 - RNA, 22 nt, Homo sapiens
uguaucaaguaccuguaugaau

SEQ ID NO: 19815 - RNA, 15 nt, Homo sapiens
uuuauccuuagcugu

SEQ ID NO: 19816 - RNA, 22 nt, Homo sapiens
aagggaaggcagcaaagcagga

SEQ ID NO: 19817 - RNA, 19 nt, Homo sapiens
agcaggagggaggagacac

SEQ ID NO: 19818 - RNA, 22 nt, Homo sapiens
cccugcucgucugcccgcugcc

SEQ ID NO: 19819 - RNA, 22 nt, Homo sapiens
gcccgcccccugcucgucugcc

SEQ ID NO: 19820 - RNA, 24 nt, Homo sapiens
ggaggaggguggcuggggaggugg

SEQ ID NO: 19821 - RNA, 19 nt, Homo sapiens
gggaaggaaagggaaccca

SEQ ID NO: 19822 - RNA, 21 nt, Homo sapiens
gggggagggagcggcaccugg

SEQ ID NO: 19823 - RNA, 23 nt, Homo sapiens
uccucggcccccugcucugccgg

SEQ ID NO: 19824 - RNA, 15 nt, Homo sapiens
ccagagcgccgcagc

SEQ ID NO: 19825 - RNA, 22 nt, Homo sapiens
cgaggcuguuggggagacuugc

SEQ ID NO: 19826 - RNA, 18 nt, Homo sapiens
cugugaccaacagaaagu

SEQ ID NO: 19827 - RNA, 17 nt, Homo sapiens
gaacaccccuaucaccc

SEQ ID NO: 19828 - RNA, 16 nt, Homo sapiens
uccugagcucccugcu

SEQ ID NO: 19829 - RNA, 17 nt, Homo sapiens
acaauaccaauuuggau

SEQ ID NO: 19830 - RNA, 18 nt, Homo sapiens
aguggaaagaugaaugga

SEQ ID NO: 19831 - RNA, 18 nt, Homo sapiens
auacuuccacaaguuugg

SEQ ID NO: 19832 - RNA, 20 nt, Homo sapiens
caaagagugcaaaguuagau

SEQ ID NO: 19833 - RNA, 17 nt, Homo sapiens
gaggggaccggagaagg

SEQ ID NO: 19834 - RNA, 18 nt, Homo sapiens
ggaacggaggcuagaggc

SEQ ID NO: 19835 - RNA, 19 nt, Homo sapiens
uaaaacauauacugucugu

SEQ ID NO: 19836 - RNA, 21 nt, Homo sapiens
ccagggaaggguggacagguc

SEQ ID NO: 19837 - RNA, 19 nt, Homo sapiens
ccccaacccuggagccucc

SEQ ID NO: 19838 - RNA, 18 nt, Homo sapiens
caggggcggcaggcgcuc

SEQ ID NO: 19839 - RNA, 19 nt, Homo sapiens
cccagcccuuuccccuucc

SEQ ID NO: 19840 - RNA, 20 nt, Homo sapiens
ccccccuccucaucuugguc

SEQ ID NO: 19841 - RNA, 20 nt, Homo sapiens
gcccagcccuuuccccuucc

SEQ ID NO: 19842 - RNA, 20 nt, Homo sapiens
ggguccuuaagaccuggguu

SEQ ID NO: 19843 - RNA, 20 nt, Homo sapiens
gguguggugggugauggugg

SEQ ID NO: 19844 - RNA, 16 nt, Homo sapiens
ucagggcaaagggaaa

SEQ ID NO: 19845 - RNA, 22 nt, Homo sapiens
aggcaugcaccaccgugcucgg

SEQ ID NO: 19846 - RNA, 18 nt, Homo sapiens
aaaaagaaugguaccuca

SEQ ID NO: 19847 - RNA, 18 nt, Homo sapiens
cagcuuccaaucucaguu

SEQ ID NO: 19848 - RNA, 18 nt, Homo sapiens
cccaccacuucugggucu

SEQ ID NO: 19849 - RNA, 17 nt, Homo sapiens
cgagcacauaacuuuug

SEQ ID NO: 19850 - RNA, 20 nt, Homo sapiens
cugcagcugaugaagacugg

SEQ ID NO: 19851 - RNA, 19 nt, Homo sapiens
gcagcagcucccgacaggc

SEQ ID NO: 19852 - RNA, 19 nt, Homo sapiens
gccucuucuggacauauuu

SEQ ID NO: 19853 - RNA, 20 nt, Homo sapiens
ggcauuaguaauauggccca

SEQ ID NO: 19854 - RNA, 17 nt, Homo sapiens
ggcucugggagguggcu

SEQ ID NO: 19855 - RNA, 18 nt, Homo sapiens
uagggaagaagccauuga

SEQ ID NO: 19856 - RNA, 22 nt, Homo sapiens
ucagugugauuuaccaaaauuc

SEQ ID NO: 19857 - RNA, 18 nt, Homo sapiens
uuaaacuauauauuaaac

SEQ ID NO: 19858 - RNA, 19 nt, Homo sapiens
ucugcaguuggaucagucu

SEQ ID NO: 19859 - RNA, 14 nt, Homo sapiens
aaaauaccuggcaa

SEQ ID NO: 19860 - RNA, 21 nt, Homo sapiens
cucgagauccacccggcugcg

SEQ ID NO: 19861 - RNA, 22 nt, Homo sapiens
ucucuuauucagugugauauuu

SEQ ID NO: 19862 - RNA, 17 nt, Homo sapiens
ugcuuuuggucuaagua

SEQ ID NO: 19863 - RNA, 18 nt, Homo sapiens
uuaaggagagaaauagaa

SEQ ID NO: 19864 - RNA, 18 nt, Homo sapiens
aaucaggaagagggcaca

SEQ ID NO: 19865 - RNA, 19 nt, Homo sapiens
cggcgucccgcaguuccga

SEQ ID NO: 19866 - RNA, 16 nt, Homo sapiens
ggagcaaggacgcccc

SEQ ID NO: 19867 - RNA, 16 nt, Homo sapiens
agggcaccgcgacccg

SEQ ID NO: 19868 - RNA, 18 nt, Homo sapiens
cccccuacccaaaagggc

SEQ ID NO: 19869 - RNA, 21 nt, Homo sapiens
ccgagcagagagcagcgcuua

SEQ ID NO: 19870 - RNA, 23 nt, Homo sapiens
ccggacccuccccuccuggcccg

SEQ ID NO: 19871 - RNA, 20 nt, Homo sapiens
ccucggcaccugggguccgg

SEQ ID NO: 19872 - RNA, 19 nt, Homo sapiens
cgcccggccccgcggagcc

SEQ ID NO: 19873 - RNA, 19 nt, Homo sapiens
uagauuuagaaggugcucc

SEQ ID NO: 19874 - RNA, 16 nt, Homo sapiens
uguccucuccaagcag

SEQ ID NO: 19875 - RNA, 18 nt, Homo sapiens
agcgagugccuccccaug

SEQ ID NO: 19876 - RNA, 15 nt, Homo sapiens
caccgggcgcugcag

SEQ ID NO: 19877 - RNA, 23 nt, Homo sapiens
cagggagcguguguguucaccaa

SEQ ID NO: 19878 - RNA, 15 nt, Homo sapiens
caucgggacauuagg

SEQ ID NO: 19879 - RNA, 17 nt, Homo sapiens
ccccagccccacucccu

SEQ ID NO: 19880 - RNA, 21 nt, Homo sapiens
gaugaugauggaauuacagcc

SEQ ID NO: 19881 - RNA, 22 nt, Homo sapiens
gcagagcccuggguaacagaac

SEQ ID NO: 19882 - RNA, 23 nt, Homo sapiens
gcagccagcccuuuccccagccc

SEQ ID NO: 19883 - RNA, 18 nt, Homo sapiens
uacaagacuagguaagcu

SEQ ID NO: 19884 - RNA, 21 nt, Homo sapiens
uccaugagugaugcagaugug

SEQ ID NO: 19885 - RNA, 18 nt, Homo sapiens
uccgugugacaaguccgg

SEQ ID NO: 19886 - RNA, 20 nt, Homo sapiens
ugauguuguuuuucccagaa

SEQ ID NO: 19887 - RNA, 19 nt, Homo sapiens
gagggggcaggugcccuga

SEQ ID NO: 19888 - RNA, 18 nt, Homo sapiens
uggggaaggagggggagg

SEQ ID NO: 19889 - RNA, 19 nt, Homo sapiens
aaggaaaaaaaugcaguuc

SEQ ID NO: 19890 - RNA, 17 nt, Homo sapiens
agugagggagguaggga

SEQ ID NO: 19891 - RNA, 18 nt, Homo sapiens
cagggaggaguggcagaa

SEQ ID NO: 19892 - RNA, 20 nt, Homo sapiens
cuaagggcugcuuagcucua

SEQ ID NO: 19893 - RNA, 22 nt, Homo sapiens
gcuuuucuucuaauccuugcag

SEQ ID NO: 19894 - RNA, 16 nt, Homo sapiens
ggcuacuuaacuauga

SEQ ID NO: 19895 - RNA, 24 nt, Homo sapiens
uaggagcagacaaaaucacuuugc

SEQ ID NO: 19896 - RNA, 18 nt, Homo sapiens
aguggaagucaaaacaag

SEQ ID NO: 19897 - RNA, 15 nt, Homo sapiens
cagcggugucaggug

SEQ ID NO: 19898 - RNA, 18 nt, Homo sapiens
cgacuucaugcuuggaag

SEQ ID NO: 19899 - RNA, 16 nt, Homo sapiens
gaacccaggaggcgga

SEQ ID NO: 19900 - RNA, 20 nt, Homo sapiens
ggcaugguggcaugagccug

SEQ ID NO: 19901 - RNA, 20 nt, Homo sapiens
guacagggaaggacauccau

SEQ ID NO: 19902 - RNA, 19 nt, Homo sapiens
ucagguggcaguuacagcc

SEQ ID NO: 19903 - RNA, 23 nt, Homo sapiens
ucucagaaaagguuuucagucag

SEQ ID NO: 19904 - RNA, 18 nt, Homo sapiens
ugcccgagaccgcagucc

SEQ ID NO: 19905 - RNA, 18 nt, Homo sapiens
uuuaaggguuagaguaau

SEQ ID NO: 19906 - RNA, 19 nt, Homo sapiens
ccgcagcucuuucccccuc

SEQ ID NO: 19907 - RNA, 18 nt, Homo sapiens
cucguuccuuccaguguc

SEQ ID NO: 19908 - RNA, 20 nt, Homo sapiens
gccgcagucgucacuccccg

SEQ ID NO: 19909 - RNA, 19 nt, Homo sapiens
gggcggagggagaagccgg

SEQ ID NO: 19910 - RNA, 18 nt, Homo sapiens
cucuccugugccgugcag

SEQ ID NO: 19911 - RNA, 24 nt, Homo sapiens
ugauaucuuuucuccugcauuaac

SEQ ID NO: 19912 - RNA, 20 nt, Homo sapiens
accaggcuggcuuagggagc

SEQ ID NO: 19913 - RNA, 19 nt, Homo sapiens
agaaagaggaggaguaaga

SEQ ID NO: 19914 - RNA, 22 nt, Homo sapiens
agaaagaggaggaguaagaaaa

SEQ ID NO: 19915 - RNA, 20 nt, Homo sapiens
agagaaagaggggcaggaag

SEQ ID NO: 19916 - RNA, 19 nt, Homo sapiens
aggaggaguaagaaaagag

SEQ ID NO: 19917 - RNA, 20 nt, Homo sapiens
cugugccccagguccucccu

SEQ ID NO: 19918 - RNA, 20 nt, Homo sapiens
gcaaacacaugagaaaagaa

SEQ ID NO: 19919 - RNA, 17 nt, Homo sapiens
gcaguggccaggcagca

SEQ ID NO: 19920 - RNA, 18 nt, Homo sapiens
gcaguggccaggcagcag

SEQ ID NO: 19921 - RNA, 18 nt, Homo sapiens
gcauggaccaggcuggcu

SEQ ID NO: 19922 - RNA, 20 nt, Homo sapiens
ggggagagaaagaggaggag

SEQ ID NO: 19923 - RNA, 21 nt, Homo sapiens
ggguagggguggggagagggc

SEQ ID NO: 19924 - RNA, 18 nt, Homo sapiens
uccagcugcagccugagc

SEQ ID NO: 19925 - RNA, 18 nt, Homo sapiens
ugagaaaagaagggugca

SEQ ID NO: 19926 - RNA, 17 nt, Homo sapiens
ugagggccgaagaggaa

SEQ ID NO: 19927 - RNA, 20 nt, Homo sapiens
ugccccagguccucccucag

SEQ ID NO: 19928 - RNA, 18 nt, Homo sapiens
agucuccaagucggcagc

SEQ ID NO: 19929 - RNA, 18 nt, Homo sapiens
cagcaccccacggguggc

SEQ ID NO: 19930 - RNA, 16 nt, Homo sapiens
caggggcccagcuccu

SEQ ID NO: 19931 - RNA, 19 nt, Homo sapiens
ccgcugccgucucucuggc

SEQ ID NO: 19932 - RNA, 17 nt, Homo sapiens
cgaggcuggagcgcggc

SEQ ID NO: 19933 - RNA, 17 nt, Homo sapiens
cgcuggguguggccggg

SEQ ID NO: 19934 - RNA, 19 nt, Homo sapiens
cggagagcgaggcuggagc

SEQ ID NO: 19935 - RNA, 19 nt, Homo sapiens
cgggacccacacgcugccu

SEQ ID NO: 19936 - RNA, 21 nt, Homo sapiens
cgggcggcggugcgggcggcg

SEQ ID NO: 19937 - RNA, 20 nt, Homo sapiens
gaggugccgugggaggcggc

SEQ ID NO: 19938 - RNA, 21 nt, Homo sapiens
gccgcagccagcaggcuuggg

SEQ ID NO: 19939 - RNA, 19 nt, Homo sapiens
ggaggcggcgggugggugg

SEQ ID NO: 19940 - RNA, 24 nt, Homo sapiens
ggcggcgggugggugggacaugcc

SEQ ID NO: 19941 - RNA, 19 nt, Homo sapiens
gggcgcgggcggcggugcg

SEQ ID NO: 19942 - RNA, 22 nt, Homo sapiens
gggcggcggugcgggcggcgga

SEQ ID NO: 19943 - RNA, 20 nt, Homo sapiens
ggugcgggcggcggagagcg

SEQ ID NO: 19944 - RNA, 17 nt, Homo sapiens
uccgguggcaggcgggg

SEQ ID NO: 19945 - RNA, 24 nt, Homo sapiens
ugagggcgcgggcggcggugcggg

SEQ ID NO: 19946 - RNA, 18 nt, Homo sapiens
ugggguggggauggugga

SEQ ID NO: 19947 - RNA, 16 nt, Homo sapiens
ugggguggggugggga

SEQ ID NO: 19948 - RNA, 18 nt, Homo sapiens
uggggugggguggggaug

SEQ ID NO: 19949 - RNA, 19 nt, Homo sapiens
ugggguggggugggguggg

SEQ ID NO: 19950 - RNA, 19 nt, Homo sapiens
uugcauggcgggggugggg

SEQ ID NO: 19951 - RNA, 23 nt, Homo sapiens
aucuuuauugaccuuuuccauuu

SEQ ID NO: 19952 - RNA, 19 nt, Homo sapiens
agaagggugggacaagaga

SEQ ID NO: 19953 - RNA, 16 nt, Homo sapiens
ggcuggagaucggccg

SEQ ID NO: 19954 - RNA, 16 nt, Homo sapiens
ggacaccgcgggcacg

SEQ ID NO: 19955 - RNA, 16 nt, Homo sapiens
aacugccugagaagug

SEQ ID NO: 19956 - RNA, 18 nt, Homo sapiens
cagcaguuccucccaucu

SEQ ID NO: 19957 - RNA, 19 nt, Homo sapiens
cagccgccuuccaaagccc

SEQ ID NO: 19958 - RNA, 17 nt, Homo sapiens
ggcaaauauucuggggu

SEQ ID NO: 19959 - RNA, 16 nt, Homo sapiens
uagcggcggguggccu

SEQ ID NO: 19960 - RNA, 17 nt, Homo sapiens
uagcggcggguggccug

SEQ ID NO: 19961 - RNA, 19 nt, Homo sapiens
uuaucucccucucucuucu

SEQ ID NO: 19962 - RNA, 20 nt, Homo sapiens
uucugcccaucuucucucag

SEQ ID NO: 19963 - RNA, 23 nt, Homo sapiens
ccgaccccggcucggcuccggcc

SEQ ID NO: 19964 - RNA, 20 nt, Homo sapiens
cugcaucugcugcguuucug

SEQ ID NO: 19965 - RNA, 21 nt, Homo sapiens
ugagaggaaggaaaagugagg

SEQ ID NO: 19966 - RNA, 24 nt, Homo sapiens
ugaggacgguugcaugagugggcu

SEQ ID NO: 19967 - RNA, 21 nt, Homo sapiens
uguuacaacaaaacacagaaa

SEQ ID NO: 19968 - RNA, 17 nt, Homo sapiens
caggcucugcagauuuu

SEQ ID NO: 19969 - RNA, 19 nt, Homo sapiens
uacagggugccacugcagg

SEQ ID NO: 19970 - RNA, 18 nt, Homo sapiens
ucugaagggagugacuga

SEQ ID NO: 19971 - RNA, 17 nt, Homo sapiens
uguacagggugccacug

SEQ ID NO: 19972 - RNA, 22 nt, Homo sapiens
uuuaagaacugauacagccauc

SEQ ID NO: 19973 - RNA, 18 nt, Homo sapiens
cauugguugcaugugaaa

SEQ ID NO: 19974 - RNA, 19 nt, Homo sapiens
cugcuuucgcuggugcucc

SEQ ID NO: 19975 - RNA, 25 nt, Homo sapiens
uauaaugaucaauucauccuaccuc

SEQ ID NO: 19976 - RNA, 16 nt, Homo sapiens
uguuagaaucacuguc

SEQ ID NO: 19977 - RNA, 21 nt, Homo sapiens
uuacaugcagcugaaaaauga

SEQ ID NO: 19978 - RNA, 24 nt, Homo sapiens
aauccaaggagcaaaccaagaagc

SEQ ID NO: 19979 - RNA, 14 nt, Homo sapiens
gucccgacacgcag

SEQ ID NO: 19980 - RNA, 19 nt, Homo sapiens
agacaacagggagaacuca

SEQ ID NO: 19981 - RNA, 20 nt, Homo sapiens
uagagaauucaaacaaagaa

SEQ ID NO: 19982 - RNA, 19 nt, Homo sapiens
uauggcacuuuauauccua

SEQ ID NO: 19983 - RNA, 17 nt, Homo sapiens
cagucgcugcagauccc

SEQ ID NO: 19984 - RNA, 19 nt, Homo sapiens
gagacagaggcuggcccug

SEQ ID NO: 19985 - RNA, 22 nt, Homo sapiens
ucugggcuauugugccagcccc

SEQ ID NO: 19986 - RNA, 23 nt, Homo sapiens
ugcagggucccuggguuaggaag

SEQ ID NO: 19987 - RNA, 19 nt, Homo sapiens
acucuugggcucaagcauu

SEQ ID NO: 19988 - RNA, 19 nt, Homo sapiens
cacgcaaggccaugugucc

SEQ ID NO: 19989 - RNA, 16 nt, Homo sapiens
ccugacuccuuggacu

SEQ ID NO: 19990 - RNA, 18 nt, Homo sapiens
cuguguacccccuccccc

SEQ ID NO: 19991 - RNA, 18 nt, Homo sapiens
gagaggaaguaacuugcc

SEQ ID NO: 19992 - RNA, 19 nt, Homo sapiens
ucccacugccuggagcauc

SEQ ID NO: 19993 - RNA, 19 nt, Homo sapiens
ucucaucuucccucacccg

SEQ ID NO: 19994 - RNA, 20 nt, Homo sapiens
acucagcauuaucuaucaaa

SEQ ID NO: 19995 - RNA, 23 nt, Homo sapiens
gagguugcagugagcccagauca

SEQ ID NO: 19996 - RNA, 21 nt, Homo sapiens
gcgugaacccgggaggcggag

SEQ ID NO: 19997 - RNA, 17 nt, Homo sapiens
gcgugguggcgggcgcc

SEQ ID NO: 19998 - RNA, 20 nt, Homo sapiens
guggaucacgaggucaggag

SEQ ID NO: 19999 - RNA, 23 nt, Homo sapiens
ugccuguaauccuagcacuuugg

SEQ ID NO: 20000 - RNA, 17 nt, Homo sapiens
uugggaggccgaggcgg

SEQ ID NO: 20001 - RNA, 17 nt, Homo sapiens
ggcggccgggcuggggc

SEQ ID NO: 20002 - RNA, 19 nt, Homo sapiens
uaagcgcaaaaggagauga

SEQ ID NO: 20003 - RNA, 22 nt, Homo sapiens
uaguggaaguuagcuugugaau

SEQ ID NO: 20004 - RNA, 20 nt, Homo sapiens
aaggagcauguuuauacuuu

SEQ ID NO: 20005 - RNA, 18 nt, Homo sapiens
acuuuggacuuuguauca

SEQ ID NO: 20006 - RNA, 19 nt, Homo sapiens
cauaaccacagcaauggca

SEQ ID NO: 20007 - RNA, 19 nt, Homo sapiens
gcaguggcggcaacggcag

SEQ ID NO: 20008 - RNA, 20 nt, Homo sapiens
ucgcgccgcucuuuggccgg

SEQ ID NO: 20009 - RNA, 24 nt, Homo sapiens
accauuaauacucuuccccacccc

SEQ ID NO: 20010 - RNA, 19 nt, Homo sapiens
ggaagucauacugggcugg

SEQ ID NO: 20011 - RNA, 16 nt, Homo sapiens
guauaugugggauuau

SEQ ID NO: 20012 - RNA, 22 nt, Homo sapiens
uacauuguuuauuaugguucua

SEQ ID NO: 20013 - RNA, 25 nt, Homo sapiens
uacauuguuuauuaugguucuagcc

SEQ ID NO: 20014 - RNA, 22 nt, Homo sapiens
uccagaauucaaggggccaaua

SEQ ID NO: 20015 - RNA, 19 nt, Homo sapiens
ugggauuauuuucuugugg

SEQ ID NO: 20016 - RNA, 23 nt, Homo sapiens
uugaauauacauaauuguuagug

SEQ ID NO: 20017 - RNA, 21 nt, Homo sapiens
ccgccgccgcugcugcugcag

SEQ ID NO: 20018 - RNA, 19 nt, Homo sapiens
cuguccaugaccaugaggu

SEQ ID NO: 20019 - RNA, 15 nt, Homo sapiens
gcccggcggcugcgc

SEQ ID NO: 20020 - RNA, 18 nt, Homo sapiens
uagugggagcggguggga

SEQ ID NO: 20021 - RNA, 27 nt, Homo sapiens
aggccauuucuacaccauguggccucc

SEQ ID NO: 20022 - RNA, 18 nt, Homo sapiens
ccccucaaagggcccgag

SEQ ID NO: 20023 - RNA, 19 nt, Homo sapiens
ggggcaguguguacaagcu

SEQ ID NO: 20024 - RNA, 17 nt, Homo sapiens
uacaagcuguggacaug

SEQ ID NO: 20025 - RNA, 21 nt, Homo sapiens
uauaauucuuguagacauucu

SEQ ID NO: 20026 - RNA, 23 nt, Homo sapiens
ucuuugggaaggugacauuuggc

SEQ ID NO: 20027 - RNA, 20 nt, Homo sapiens
uuugaaauauaaaaauuggu

SEQ ID NO: 20028 - RNA, 21 nt, Homo sapiens
aauauauacauauauauauau

SEQ ID NO: 20029 - RNA, 22 nt, Homo sapiens
auauacauauauauauauauau

SEQ ID NO: 20030 - RNA, 23 nt, Homo sapiens
auauauacauauauauauauaua

SEQ ID NO: 20031 - RNA, 23 nt, Homo sapiens
caggugguuuagaugcauuauaa

SEQ ID NO: 20032 - RNA, 22 nt, Homo sapiens
cgccguugccgccgccacccgg

SEQ ID NO: 20033 - RNA, 22 nt, Homo sapiens
uauacauauauauauauauaua

SEQ ID NO: 20034 - RNA, 22 nt, Homo sapiens
uauauacauauauauauauaua

SEQ ID NO: 20035 - RNA, 24 nt, Homo sapiens
uauauacauauauauauauauaua

SEQ ID NO: 20036 - RNA, 24 nt, Homo sapiens
ucggccgugcgcgcgugggcuggg

SEQ ID NO: 20037 - RNA, 21 nt, Homo sapiens
ucuucauaaauuagcagaaug

SEQ ID NO: 20038 - RNA, 22 nt, Homo sapiens
aaguugauaugauuaagucuuu

SEQ ID NO: 20039 - RNA, 18 nt, Homo sapiens
aggacacugaggccuaga

SEQ ID NO: 20040 - RNA, 18 nt, Homo sapiens
aggggaaacagagggcag

SEQ ID NO: 20041 - RNA, 17 nt, Homo sapiens
aucaagcaguaacgagg

SEQ ID NO: 20042 - RNA, 21 nt, Homo sapiens
cuucauacugauucaucuucu

SEQ ID NO: 20043 - RNA, 17 nt, Homo sapiens
ggaauacuucccccauu

SEQ ID NO: 20044 - RNA, 18 nt, Homo sapiens
gggcuccccacaggaccu

SEQ ID NO: 20045 - RNA, 21 nt, Homo sapiens
uaaccugcacuuugcucacag

SEQ ID NO: 20046 - RNA, 19 nt, Homo sapiens
uguauaucagaggaucuau

SEQ ID NO: 20047 - RNA, 18 nt, Homo sapiens
uugugggaugaaaauugu

SEQ ID NO: 20048 - RNA, 21 nt, Homo sapiens
agcggccgguuagcggcgugu

SEQ ID NO: 20049 - RNA, 18 nt, Homo sapiens
cggcggcggugggcggac

SEQ ID NO: 20050 - RNA, 20 nt, Homo sapiens
cggcggcggugggcggaccg

SEQ ID NO: 20051 - RNA, 17 nt, Homo sapiens
gcggcggugggcggacc

SEQ ID NO: 20052 - RNA, 22 nt, Homo sapiens
cagcagaaaaguuuuauuccuu

SEQ ID NO: 20053 - RNA, 24 nt, Homo sapiens
aggcagugggcugcagcagguggg

SEQ ID NO: 20054 - RNA, 18 nt, Homo sapiens
auauauauauauauauau

SEQ ID NO: 20055 - RNA, 21 nt, Homo sapiens
auauauauauauauauauaua

SEQ ID NO: 20056 - RNA, 22 nt, Homo sapiens
auauauauauauauauauauau

SEQ ID NO: 20057 - RNA, 24 nt, Homo sapiens
auauauauauauauauauauauau

SEQ ID NO: 20058 - RNA, 23 nt, Homo sapiens
auauauauauauauauauauauu

SEQ ID NO: 20059 - RNA, 20 nt, Homo sapiens
gaagcaggcuccacucucua

SEQ ID NO: 20060 - RNA, 24 nt, Homo sapiens
uaauauauauauauauauauauaa

SEQ ID NO: 20061 - RNA, 25 nt, Homo sapiens
uaauauauauauauauauauauaua

SEQ ID NO: 20062 - RNA, 22 nt, Homo sapiens
uauauauauauauauauauaua

SEQ ID NO: 20063 - RNA, 24 nt, Human papillomavirus type 25
uauauauauauauauauauauaua

SEQ ID NO: 20064 - RNA, 21 nt, Homo sapiens
aaagaggggaggagagugggg

SEQ ID NO: 20065 - RNA, 15 nt, Homo sapiens
acccgcccacccccc

SEQ ID NO: 20066 - RNA, 20 nt, Homo sapiens
aggaaaggagacaggggagg

SEQ ID NO: 20067 - RNA, 18 nt, Homo sapiens
ccgaggggggucucuguc

SEQ ID NO: 20068 - RNA, 19 nt, Homo sapiens
ccgccgccgccaucuuggu

SEQ ID NO: 20069 - RNA, 17 nt, Homo sapiens
ccucuucgucccgcucc

SEQ ID NO: 20070 - RNA, 23 nt, Homo sapiens
gagagggagaaggggguaggaag

SEQ ID NO: 20071 - RNA, 20 nt, Homo sapiens
gcccaccccccaagaagcag

SEQ ID NO: 20072 - RNA, 17 nt, Homo sapiens
gcccccaggagcugagg

SEQ ID NO: 20073 - RNA, 20 nt, Homo sapiens
ggagggaggacugagguggu

SEQ ID NO: 20074 - RNA, 20 nt, Homo sapiens
gugcucugagagucucaggc

SEQ ID NO: 20075 - RNA, 16 nt, Homo sapiens
uggggagagaagggag

SEQ ID NO: 20076 - RNA, 19 nt, Homo sapiens
aggcugcagaugacagcug

SEQ ID NO: 20077 - RNA, 19 nt, Homo sapiens
gcagucccccacccagccc

SEQ ID NO: 20078 - RNA, 19 nt, Homo sapiens
gccuggugggaagcacugg

SEQ ID NO: 20079 - RNA, 18 nt, Homo sapiens
gggaagcacugguccuga

SEQ ID NO: 20080 - RNA, 24 nt, Homo sapiens
gugggcagucccccacccagcccc

SEQ ID NO: 20081 - RNA, 23 nt, Homo sapiens
ugccgggcuggaggcagaggcug

SEQ ID NO: 20082 - RNA, 20 nt, Homo sapiens
uggaggagguggcccagggc

SEQ ID NO: 20083 - RNA, 20 nt, Homo sapiens
ccgccgaguccguuucccuc

SEQ ID NO: 20084 - RNA, 17 nt, Homo sapiens
acagcaccauuuuacac

SEQ ID NO: 20085 - RNA, 21 nt, Homo sapiens
aagagaauaggaaagccacuu

SEQ ID NO: 20086 - RNA, 23 nt, Homo sapiens
cacaugccucugcaagaagggcu

SEQ ID NO: 20087 - RNA, 22 nt, Homo sapiens
ccuccauugucagcaggucuuu

SEQ ID NO: 20088 - RNA, 19 nt, Homo sapiens
cggaggcugcagcuggagc

SEQ ID NO: 20089 - RNA, 18 nt, Homo sapiens
gugaaaaugucacagcgc

SEQ ID NO: 20090 - RNA, 20 nt, Homo sapiens
guggaauguuccggaauaaa

SEQ ID NO: 20091 - RNA, 15 nt, Homo sapiens
agagaaaguggagag

SEQ ID NO: 20092 - RNA, 18 nt, Homo sapiens
agagggaggugucugucu

SEQ ID NO: 20093 - RNA, 19 nt, Homo sapiens
cacgcggguccacccccuc

SEQ ID NO: 20094 - RNA, 20 nt, Homo sapiens
ccugugagagaaaguggaga

SEQ ID NO: 20095 - RNA, 17 nt, Homo sapiens
cgguggccagcuggagc

SEQ ID NO: 20096 - RNA, 16 nt, Homo sapiens
ggaugggaacaguggc

SEQ ID NO: 20097 - RNA, 18 nt, Homo sapiens
gggaggugucugucugau

SEQ ID NO: 20098 - RNA, 18 nt, Homo sapiens
ggggccugcguugguggg

SEQ ID NO: 20099 - RNA, 19 nt, Homo sapiens
ccaaccaugauaacccagc

SEQ ID NO: 20100 - RNA, 16 nt, Homo sapiens
ggcuggguaugagcuu

SEQ ID NO: 20101 - RNA, 18 nt, Homo sapiens
uagccaggccacaugucc

SEQ ID NO: 20102 - RNA, 16 nt, Homo sapiens
ucccaggugugccaca

SEQ ID NO: 20103 - RNA, 18 nt, Homo sapiens
ucgcgggugggggcgagg

SEQ ID NO: 20104 - RNA, 21 nt, Homo sapiens
ugccugauaccccccucuccc

SEQ ID NO: 20105 - RNA, 18 nt, Homo sapiens
ugcgcgcgcgggugcccg

SEQ ID NO: 20106 - RNA, 18 nt, Homo sapiens
ugcggccuccucuccucc

SEQ ID NO: 20107 - RNA, 17 nt, Homo sapiens
agcgggagggggcugcg

SEQ ID NO: 20108 - RNA, 21 nt, Homo sapiens
gcaaagcaaggugcccuuggu

SEQ ID NO: 20109 - RNA, 29 nt, Homo sapiens
gccaauuuuuuguaccuuuaguagagacg

SEQ ID NO: 20110 - RNA, 17 nt, Homo sapiens
gcccgccucggccuccc

SEQ ID NO: 20111 - RNA, 22 nt, Homo sapiens
uuacauuuacuguuacuuacug

SEQ ID NO: 20112 - RNA, 18 nt, Homo sapiens
cuucccugaagagggcuc

SEQ ID NO: 20113 - RNA, 22 nt, Homo sapiens
gggagaacagcccucagaagcg

SEQ ID NO: 20114 - RNA, 17 nt, Homo sapiens
aaaaaucggccuggaga

SEQ ID NO: 20115 - RNA, 23 nt, Homo sapiens
ccugaggaaggcggcuuuggagg

SEQ ID NO: 20116 - RNA, 20 nt, Homo sapiens
cgccuggcgcccggcgugac

SEQ ID NO: 20117 - RNA, 18 nt, Homo sapiens
gcgcccggcgugacguga

SEQ ID NO: 20118 - RNA, 20 nt, Homo sapiens
ggauggccugaucaauguau

SEQ ID NO: 20119 - RNA, 22 nt, Homo sapiens
ucacgcaaauuucccugaggaa

SEQ ID NO: 20120 - RNA, 18 nt, Homo sapiens
ugcugcacgccugggucc

SEQ ID NO: 20121 - RNA, 17 nt, Homo sapiens
caccuguggccagguga

SEQ ID NO: 20122 - RNA, 19 nt, Homo sapiens
ggagagcuggagaacuggc

SEQ ID NO: 20123 - RNA, 16 nt, Homo sapiens
ggccugcaaggugacc

SEQ ID NO: 20124 - RNA, 19 nt, Homo sapiens
gggcucuggccucagucca

SEQ ID NO: 20125 - RNA, 20 nt, Homo sapiens
uuuuuuuuucaucucugacu

SEQ ID NO: 20126 - RNA, 21 nt, Homo sapiens
ccacgccuuccgcggaggggc

SEQ ID NO: 20127 - RNA, 19 nt, Homo sapiens
gccuuggggauaccaccug

SEQ ID NO: 20128 - RNA, 15 nt, Homo sapiens
gcucuggagcagcag

SEQ ID NO: 20129 - RNA, 19 nt, Homo sapiens
cccgaguuuaauuacagaa

SEQ ID NO: 20130 - RNA, 17 nt, Homo sapiens
gcgccggcgcgacugcc

SEQ ID NO: 20131 - RNA, 21 nt, Homo sapiens
uaauaauaauucuaguuccau

SEQ ID NO: 20132 - RNA, 20 nt, Homo sapiens
ugaaauaguuauggcagcaa

SEQ ID NO: 20133 - RNA, 18 nt, Homo sapiens
uucuaguuccauagguuu

SEQ ID NO: 20134 - RNA, 18 nt, Homo sapiens
cagcauuuccagccggcc

SEQ ID NO: 20135 - RNA, 18 nt, Homo sapiens
ccucaugcuaugugguca

SEQ ID NO: 20136 - RNA, 22 nt, Homo sapiens
cucagcaauaaaugccuuugga

SEQ ID NO: 20137 - RNA, 16 nt, Homo sapiens
cugaaaagguggccau

SEQ ID NO: 20138 - RNA, 19 nt, Homo sapiens
gaaaaaauguccaggaggu

SEQ ID NO: 20139 - RNA, 18 nt, Homo sapiens
gcuggagcgcugcgccgc

SEQ ID NO: 20140 - RNA, 19 nt, Homo sapiens
ggaaaacaugagaaaugga

SEQ ID NO: 20141 - RNA, 18 nt, Homo sapiens
ucgugaagucccuucugc

SEQ ID NO: 20142 - RNA, 20 nt, Homo sapiens
ucuucucccucucuaugucc

SEQ ID NO: 20143 - RNA, 19 nt, Homo sapiens
uggccucaugcuauguggu

SEQ ID NO: 20144 - RNA, 24 nt, Homo sapiens
uucacaaugcuaucucacuacaga

SEQ ID NO: 20145 - RNA, 22 nt, Homo sapiens
aaggcugaaggaugggagccau

SEQ ID NO: 20146 - RNA, 22 nt, Homo sapiens
uaacugaaggcugaaccacacc

SEQ ID NO: 20147 - RNA, 23 nt, Homo sapiens
ugucaagauucuuugaagcucua

SEQ ID NO: 20148 - RNA, 18 nt, Homo sapiens
uguccuaauuauagguau

SEQ ID NO: 20149 - RNA, 21 nt, Homo sapiens
uucacaaucaucagcauggac

SEQ ID NO: 20150 - RNA, 19 nt, Homo sapiens
aggggcuguggccggggcg

SEQ ID NO: 20151 - RNA, 20 nt, Homo sapiens
caccacugucgcggucgccu

SEQ ID NO: 20152 - RNA, 20 nt, Homo sapiens
cccccaccacugucgcgguc

SEQ ID NO: 20153 - RNA, 18 nt, Homo sapiens
cggcggcgcagggcgcgg

SEQ ID NO: 20154 - RNA, 19 nt, Homo sapiens
cggggcggugggcgggcgg

SEQ ID NO: 20155 - RNA, 17 nt, Homo sapiens
ggccgagauccuucuuc

SEQ ID NO: 20156 - RNA, 20 nt, Homo sapiens
ggcgcgggccacgggcgggu

SEQ ID NO: 20157 - RNA, 15 nt, Homo sapiens
uggagcgcgcgcggc

SEQ ID NO: 20158 - RNA, 20 nt, Homo sapiens
agcugcacuguuuauuugcc

SEQ ID NO: 20159 - RNA, 22 nt, Homo sapiens
uacaauuucugagcugcacugu

SEQ ID NO: 20160 - RNA, 20 nt, Homo sapiens
ccuuuuuuaaauuucacaca

SEQ ID NO: 20161 - RNA, 22 nt, Homo sapiens
ucccuuuuuuaaauuucacaca

SEQ ID NO: 20162 - RNA, 21 nt, Homo sapiens
ggacuggaacugcuggcgccg

SEQ ID NO: 20163 - RNA, 18 nt, Homo sapiens
acacagagaaacaagaag

SEQ ID NO: 20164 - RNA, 19 nt, Homo sapiens
cagggcccaauucaaucca

SEQ ID NO: 20165 - RNA, 18 nt, Homo sapiens
ccggcucugggacggggc

SEQ ID NO: 20166 - RNA, 18 nt, Homo sapiens
ccuguucccuugccuggc

SEQ ID NO: 20167 - RNA, 19 nt, Homo sapiens
gccggcucugggacggggc

SEQ ID NO: 20168 - RNA, 17 nt, Homo sapiens
ggaaauaaaaacacaca

SEQ ID NO: 20169 - RNA, 22 nt, Homo sapiens
guuguuggguccuggauaaggg

SEQ ID NO: 20170 - RNA, 17 nt, Homo sapiens
uaaaacagaugcguuga

SEQ ID NO: 20171 - RNA, 17 nt, Homo sapiens
ucagcugcuuaacuagg

SEQ ID NO: 20172 - RNA, 18 nt, Homo sapiens
ucccagaagaggguggag

SEQ ID NO: 20173 - RNA, 15 nt, Homo sapiens
ugccacagccccgcc

SEQ ID NO: 20174 - RNA, 18 nt, Homo sapiens
uuagagacagcaguuugg

SEQ ID NO: 20175 - RNA, 18 nt, Homo sapiens
agcccgcagccgcggugc

SEQ ID NO: 20176 - RNA, 20 nt, Homo sapiens
gagguuaucaucaaaguuuu

SEQ ID NO: 20177 - RNA, 27 nt, Homo sapiens
ccggcaggccacggcuccggcucuggc

SEQ ID NO: 20178 - RNA, 21 nt, Homo sapiens
gcuccggcucuggcuuccucg

SEQ ID NO: 20179 - RNA, 18 nt, Homo sapiens
aucucagaccacaucuuc

SEQ ID NO: 20180 - RNA, 21 nt, Homo sapiens
cucaauuauucacagggauaa

SEQ ID NO: 20181 - RNA, 21 nt, Homo sapiens
ucccaccaagcugggaucugg

SEQ ID NO: 20182 - RNA, 21 nt, Homo sapiens
ugggcauaagcaaaccuaaga

SEQ ID NO: 20183 - RNA, 23 nt, Homo sapiens
caauucuugaagcaguuucaaug

SEQ ID NO: 20184 - RNA, 22 nt, Homo sapiens
guauuaaaacauauauuuauau

SEQ ID NO: 20185 - RNA, 21 nt, Homo sapiens
uacuuugcuaccaagccuccc

SEQ ID NO: 20186 - RNA, 16 nt, Homo sapiens
gcggagcgcagcgcgg

SEQ ID NO: 20187 - RNA, 15 nt, Homo sapiens
cuugauauaggucca

SEQ ID NO: 20188 - RNA, 20 nt, Homo sapiens
ggucggaaccuuccgagacc

SEQ ID NO: 20189 - RNA, 17 nt, Homo sapiens
ccucuuagcgaguggag

SEQ ID NO: 20190 - RNA, 19 nt, Homo sapiens
ggagcgccgccgccugccu

SEQ ID NO: 20191 - RNA, 18 nt, Homo sapiens
uguuggaauacaacugua

SEQ ID NO: 20192 - RNA, 16 nt, Homo sapiens
cgacggggcgacgcgg

SEQ ID NO: 20193 - RNA, 22 nt, Homo sapiens
gggggccgacuugagcuuugga

SEQ ID NO: 20194 - RNA, 19 nt, Homo sapiens
uggcaugggacuggcucug

SEQ ID NO: 20195 - RNA, 19 nt, Homo sapiens
gcgccugcggaggcguccu

SEQ ID NO: 20196 - RNA, 19 nt, Homo sapiens
gaggacccuugcccgggug

SEQ ID NO: 20197 - RNA, 18 nt, Homo sapiens
aggaggggggucggaggc

SEQ ID NO: 20198 - RNA, 24 nt, Homo sapiens
agggggcuggccagggagcagcgg

SEQ ID NO: 20199 - RNA, 22 nt, Homo sapiens
auagaaccuggggggcacagaa

SEQ ID NO: 20200 - RNA, 18 nt, Homo sapiens
ccgucguccguccgucag

SEQ ID NO: 20201 - RNA, 22 nt, Homo sapiens
ccgucguccguccgucagucug

SEQ ID NO: 20202 - RNA, 21 nt, Homo sapiens
ccuggagaauggcugcuccgc

SEQ ID NO: 20203 - RNA, 22 nt, Homo sapiens
ccuguccgucguccguccguca

SEQ ID NO: 20204 - RNA, 17 nt, Homo sapiens
cgaggaggcugggccug

SEQ ID NO: 20205 - RNA, 18 nt, Homo sapiens
cuuugguauggggagggg

SEQ ID NO: 20206 - RNA, 17 nt, Homo sapiens
gagccaucuccacagcc

SEQ ID NO: 20207 - RNA, 18 nt, Homo sapiens
gcacuggugggcugggga

SEQ ID NO: 20208 - RNA, 21 nt, Homo sapiens
gcucccuccugaagccaggcc

SEQ ID NO: 20209 - RNA, 23 nt, Homo sapiens
gcuccuggcugggcccagguggg

SEQ ID NO: 20210 - RNA, 17 nt, Homo sapiens
gggccuguggguggggg

SEQ ID NO: 20211 - RNA, 19 nt, Homo sapiens
gggcuggaggacggcccgg

SEQ ID NO: 20212 - RNA, 17 nt, Homo sapiens
ggggagggcugaggagg

SEQ ID NO: 20213 - RNA, 18 nt, Homo sapiens
ggggaggggcuggggggg

SEQ ID NO: 20214 - RNA, 19 nt, Homo sapiens
ggggauggggcgggggagg

SEQ ID NO: 20215 - RNA, 17 nt, Homo sapiens
ggggggacacauccgcc

SEQ ID NO: 20216 - RNA, 19 nt, Homo sapiens
gggugggggagggcugagg

SEQ ID NO: 20217 - RNA, 19 nt, Homo sapiens
uugugugaagucucuuggg

SEQ ID NO: 20218 - RNA, 22 nt, Homo sapiens
ugauuuauuagaguguuacagu

SEQ ID NO: 20219 - RNA, 16 nt, Homo sapiens
aggcagcaggcgaggc

SEQ ID NO: 20220 - RNA, 17 nt, Homo sapiens
cacccuuuccuggggaa

SEQ ID NO: 20221 - RNA, 19 nt, Homo sapiens
ccccgcucccuccuggucc

SEQ ID NO: 20222 - RNA, 16 nt, Homo sapiens
ccccguccuguccugg

SEQ ID NO: 20223 - RNA, 18 nt, Homo sapiens
cccgaccccgcucccucc

SEQ ID NO: 20224 - RNA, 18 nt, Homo sapiens
ccgaccgaccaggauacc

SEQ ID NO: 20225 - RNA, 24 nt, Homo sapiens
ccgcucccuccugguccccgccca

SEQ ID NO: 20226 - RNA, 22 nt, Homo sapiens
cguguggcacagguccccgggc

SEQ ID NO: 20227 - RNA, 16 nt, Homo sapiens
guggaggugguugggg

SEQ ID NO: 20228 - RNA, 23 nt, Homo sapiens
ucucccucccaccagaggaacuc

SEQ ID NO: 20229 - RNA, 24 nt, Homo sapiens
ucucugcccugggaacaaagagag

SEQ ID NO: 20230 - RNA, 19 nt, Homo sapiens
uggggagggcccuaaaacc

SEQ ID NO: 20231 - RNA, 22 nt, Homo sapiens
uguggcacagguccccgggccu

SEQ ID NO: 20232 - RNA, 21 nt, Homo sapiens
aagcagagggucaccagcggg

SEQ ID NO: 20233 - RNA, 16 nt, Homo sapiens
aauaaagcccaaauca

SEQ ID NO: 20234 - RNA, 23 nt, Homo sapiens
acacuugguacggcccaggcauu

SEQ ID NO: 20235 - RNA, 24 nt, Homo sapiens
caguugaaagaaaauaguccaaag

SEQ ID NO: 20236 - RNA, 21 nt, Homo sapiens
cgucuuacgcaugggaggggg

SEQ ID NO: 20237 - RNA, 24 nt, Homo sapiens
cuccccccuccccccaccccucgc

SEQ ID NO: 20238 - RNA, 18 nt, Homo sapiens
cucuguucuccuauugca

SEQ ID NO: 20239 - RNA, 17 nt, Homo sapiens
gacccuugucuuucaau

SEQ ID NO: 20240 - RNA, 18 nt, Homo sapiens
gaucggcacaucccaucu

SEQ ID NO: 20241 - RNA, 23 nt, Homo sapiens
gccccggggccucaucugugggg

SEQ ID NO: 20242 - RNA, 20 nt, Homo sapiens
gcuuaaaacaucauguuucc

SEQ ID NO: 20243 - RNA, 21 nt, Homo sapiens
ggaagcagagggucaccagcg

SEQ ID NO: 20244 - RNA, 19 nt, Homo sapiens
gggaggaaagggaaggaac

SEQ ID NO: 20245 - RNA, 20 nt, Homo sapiens
guccuuuuuuaugaggagaa

SEQ ID NO: 20246 - RNA, 21 nt, Homo sapiens
uuuaugaggagaaauucugga

SEQ ID NO: 20247 - RNA, 23 nt, Homo sapiens
cggcgaggcgcgggcgcugcucu

SEQ ID NO: 20248 - RNA, 17 nt, Homo sapiens
gcccggccccgggcgcc

SEQ ID NO: 20249 - RNA, 19 nt, Homo sapiens
ugaggccagcuuggggcuc

SEQ ID NO: 20250 - RNA, 16 nt, Homo sapiens
gacaauaagauccgcc

SEQ ID NO: 20251 - RNA, 18 nt, Homo sapiens
uccgccgugacccucgug

SEQ ID NO: 20252 - RNA, 25 nt, Homo sapiens
ugcaaauacgcaacaaauauguuca

SEQ ID NO: 20253 - RNA, 19 nt, Homo sapiens
augcuuuccgugacaaaaa

SEQ ID NO: 20254 - RNA, 16 nt, Homo sapiens
cuccagcccucggcgc

SEQ ID NO: 20255 - RNA, 22 nt, Homo sapiens
uaucauaaaauaagcaguaucc

SEQ ID NO: 20256 - RNA, 23 nt, Homo sapiens
uuggcgaaucuuggucagauauu

SEQ ID NO: 20257 - RNA, 17 nt, Homo sapiens
gcaggacugcggcagca

SEQ ID NO: 20258 - RNA, 18 nt, Homo sapiens
auucuuuugcacauuaag

SEQ ID NO: 20259 - RNA, 20 nt, Homo sapiens
ugauucuuuugcacauuaag

SEQ ID NO: 20260 - RNA, 18 nt, Homo sapiens
uuucaauaugucauuauu

SEQ ID NO: 20261 - RNA, 17 nt, Homo sapiens
cgcugucgggcggggag

SEQ ID NO: 20262 - RNA, 20 nt, Homo sapiens
gcggggagggggccgggagg

SEQ ID NO: 20263 - RNA, 20 nt, Homo sapiens
ggcccgagcggccgcugucg

SEQ ID NO: 20264 - RNA, 18 nt, Homo sapiens
gggcggggagggggccgg

SEQ ID NO: 20265 - RNA, 22 nt, Homo sapiens
uccaccuuaaaaaaaaagagag

SEQ ID NO: 20266 - RNA, 17 nt, Homo sapiens
ggcuggaggaggguuag

SEQ ID NO: 20267 - RNA, 18 nt, Homo sapiens
ucgcuguuugccguuucc

SEQ ID NO: 20268 - RNA, 19 nt, Homo sapiens
ccggagggaggcucuggag

SEQ ID NO: 20269 - RNA, 21 nt, Homo sapiens
agcauacauaucccuugggga

SEQ ID NO: 20270 - RNA, 18 nt, Homo sapiens
aggugcccgggacccgcc

SEQ ID NO: 20271 - RNA, 22 nt, Homo sapiens
ccagugucucaaauuuuuauga

SEQ ID NO: 20272 - RNA, 22 nt, Homo sapiens
cgaguucaaugaagacauucca

SEQ ID NO: 20273 - RNA, 19 nt, Homo sapiens
cgggacccgcccaccacgc

SEQ ID NO: 20274 - RNA, 23 nt, Homo sapiens
uacaauuuucgaaguacuuacca

SEQ ID NO: 20275 - RNA, 18 nt, Homo sapiens
uuucuuugggcauuuccu

SEQ ID NO: 20276 - RNA, 17 nt, Homo sapiens
aaugacagccacagcgc

SEQ ID NO: 20277 - RNA, 22 nt, Homo sapiens
acacagacgcuguccgugguuu

SEQ ID NO: 20278 - RNA, 21 nt, Homo sapiens
acuaaaucuagaaacagagau

SEQ ID NO: 20279 - RNA, 21 nt, Homo sapiens
agagcggcuggaagcuggacu

SEQ ID NO: 20280 - RNA, 18 nt, Homo sapiens
caaugcuauuuaauacaa

SEQ ID NO: 20281 - RNA, 23 nt, Homo sapiens
caggagaccgcaauggccacgug

SEQ ID NO: 20282 - RNA, 18 nt, Homo sapiens
caucugccccgccccucg

SEQ ID NO: 20283 - RNA, 28 nt, Homo sapiens
ccgcacgcugcuuucccugcagaucccc

SEQ ID NO: 20284 - RNA, 25 nt, Homo sapiens
ccucgccaucugccccgccccucgc

SEQ ID NO: 20285 - RNA, 22 nt, Homo sapiens
ccuggaaggcuggcagguucac

SEQ ID NO: 20286 - RNA, 17 nt, Homo sapiens
cucgccccgcucccucg

SEQ ID NO: 20287 - RNA, 22 nt, Homo sapiens
gcccggaacagccgcggcgccg

SEQ ID NO: 20288 - RNA, 14 nt, Homo sapiens
gccucaaaaagcag

SEQ ID NO: 20289 - RNA, 16 nt, Homo sapiens
uacaaauacaaaugcc

SEQ ID NO: 20290 - RNA, 23 nt, Homo sapiens
uagcuauuccccaaugcuauuua

SEQ ID NO: 20291 - RNA, 20 nt, Homo sapiens
ucuagaaacagagaugaaca

SEQ ID NO: 20292 - RNA, 17 nt, Homo sapiens
ugacgaguucuugaagu

SEQ ID NO: 20293 - RNA, 20 nt, Homo sapiens
ccacccccaugccagagagc

SEQ ID NO: 20294 - RNA, 19 nt, Homo sapiens
uacagguuuaaggugcagg

SEQ ID NO: 20295 - RNA, 19 nt, Homo sapiens
ccuccggcuggaugccguc

SEQ ID NO: 20296 - RNA, 22 nt, Homo sapiens
auauauauauauauauauauau

SEQ ID NO: 20297 - RNA, 20 nt, Homo sapiens
cuguguguguguguguguaa

SEQ ID NO: 20298 - RNA, 21 nt, Homo sapiens
cugugugugugugugugugua

SEQ ID NO: 20299 - RNA, 23 nt, Homo sapiens
gaaaagauaucuuuguuauccac

SEQ ID NO: 20300 - RNA, 18 nt, Homo sapiens
uauauauauauauauaua

SEQ ID NO: 20301 - RNA, 19 nt, Homo sapiens
uauauauauauauauauau

SEQ ID NO: 20302 - RNA, 20 nt, Homo sapiens
uauauauauauauauauaua

SEQ ID NO: 20303 - RNA, 21 nt, Homo sapiens
uauauauauauauauauauau

SEQ ID NO: 20304 - RNA, 22 nt, Homo sapiens
uauauauauauauauauauaua

SEQ ID NO: 20305 - RNA, 23 nt, Homo sapiens
uauauauauauauauauauauau

SEQ ID NO: 20306 - RNA, 24 nt, Human papillomavirus type 25
uauauauauauauauauauauaua

SEQ ID NO: 20307 - RNA, 19 nt, Homo sapiens
uauauaugugcgugugugu

SEQ ID NO: 20308 - RNA, 19 nt, Homo sapiens
uaugugcgugugugugugu

SEQ ID NO: 20309 - RNA, 20 nt, Homo sapiens
uauucucugcucucuuuuca

SEQ ID NO: 20310 - RNA, 23 nt, Homo sapiens
ucucugcucucuuuucaguucuc

SEQ ID NO: 20311 - RNA, 24 nt, Homo sapiens
ugcacuuggagcagaaauguggag

SEQ ID NO: 20312 - RNA, 19 nt, Homo sapiens
ugcgugugugugugugugu

SEQ ID NO: 20313 - RNA, 21 nt, Homo sapiens
ugugcgugugugugugugugu

SEQ ID NO: 20314 - RNA, 18 nt, Homo sapiens
ugugugugugugugugug

SEQ ID NO: 20315 - RNA, 21 nt, Homo sapiens
aaacagguuacagacaggugu

SEQ ID NO: 20316 - RNA, 15 nt, Homo sapiens
auccccccucccccg

SEQ ID NO: 20317 - RNA, 25 nt, Homo sapiens
ccaggagucgcaagauuuggcugga

SEQ ID NO: 20318 - RNA, 16 nt, Homo sapiens
cccgggccgggguggg

SEQ ID NO: 20319 - RNA, 17 nt, Homo sapiens
ccuauccccccuccccc

SEQ ID NO: 20320 - RNA, 17 nt, Homo sapiens
ccucaggaggcagcugg

SEQ ID NO: 20321 - RNA, 18 nt, Homo sapiens
cucaaaccaucucugcca

SEQ ID NO: 20322 - RNA, 20 nt, Homo sapiens
gcagcuggggguccgcgggg

SEQ ID NO: 20323 - RNA, 20 nt, Homo sapiens
gguccgcgggggggagaggg

SEQ ID NO: 20324 - RNA, 17 nt, Homo sapiens
ggugguggggguggggg

SEQ ID NO: 20325 - RNA, 20 nt, Homo sapiens
gugcaggcuggugggaugcu

SEQ ID NO: 20326 - RNA, 18 nt, Homo sapiens
ucacggaacuauaccugu

SEQ ID NO: 20327 - RNA, 20 nt, Homo sapiens
ugagaccaccuaggggaaag

SEQ ID NO: 20328 - RNA, 16 nt, Homo sapiens
ugagacccuaauaacc

SEQ ID NO: 20329 - RNA, 15 nt, Homo sapiens
ugaugugagaaucca

SEQ ID NO: 20330 - RNA, 16 nt, Homo sapiens
ugcccagcgucucauc

SEQ ID NO: 20331 - RNA, 16 nt, Homo sapiens
uuguagggcagauuuc

SEQ ID NO: 20332 - RNA, 18 nt, Homo sapiens
cacaaaaccuuaauguau

SEQ ID NO: 20333 - RNA, 18 nt, Homo sapiens
uccccucccgcccgacuc

SEQ ID NO: 20334 - RNA, 20 nt, Homo sapiens
ucuccccucccgcccgacuc

SEQ ID NO: 20335 - RNA, 16 nt, Homo sapiens
ugccuuuaaauucuga

SEQ ID NO: 20336 - RNA, 20 nt, Homo sapiens
uguucaaaacuuuuuuaaag

SEQ ID NO: 20337 - RNA, 22 nt, Homo sapiens
ccuugcugcauuguuaucugcu

SEQ ID NO: 20338 - RNA, 19 nt, Homo sapiens
gcugggggcugaagggagc

SEQ ID NO: 20339 - RNA, 22 nt, Homo sapiens
gggugggacaugggggaggggc

SEQ ID NO: 20340 - RNA, 16 nt, Homo sapiens
uggguguaggguuauc

SEQ ID NO: 20341 - RNA, 15 nt, Homo sapiens
ugucaggaacgggga

SEQ ID NO: 20342 - RNA, 20 nt, Homo sapiens
cgggcggcgggcggccugcg

SEQ ID NO: 20343 - RNA, 20 nt, Homo sapiens
gcucccaggagaggccuggc

SEQ ID NO: 20344 - RNA, 17 nt, Homo sapiens
ggcgcgggcggcgggcg

SEQ ID NO: 20345 - RNA, 16 nt, Homo sapiens
ggcggcgggcggccug

SEQ ID NO: 20346 - RNA, 19 nt, Homo sapiens
gggcgaguggcucccagga

SEQ ID NO: 20347 - RNA, 21 nt, Homo sapiens
gggcggcgggcggccugcggg

SEQ ID NO: 20348 - RNA, 18 nt, Homo sapiens
ucccuguggccagagcug

SEQ ID NO: 20349 - RNA, 18 nt, Homo sapiens
agaggagacggggaccag

SEQ ID NO: 20350 - RNA, 18 nt, Homo sapiens
cagcagcgcccccguggc

SEQ ID NO: 20351 - RNA, 16 nt, Homo sapiens
ccggccgcucccaccc

SEQ ID NO: 20352 - RNA, 18 nt, Homo sapiens
cggggccgccgccugccu

SEQ ID NO: 20353 - RNA, 19 nt, Homo sapiens
gcgccgccgccgccgcccg

SEQ ID NO: 20354 - RNA, 20 nt, Homo sapiens
gcgccgccgccgccgcccgg

SEQ ID NO: 20355 - RNA, 25 nt, Homo sapiens
gcgcuccagcagcucuggcgccgcc

SEQ ID NO: 20356 - RNA, 20 nt, Homo sapiens
aacuaacccccuuuagggcc

SEQ ID NO: 20357 - RNA, 18 nt, Homo sapiens
acaauaccuagucaagau

SEQ ID NO: 20358 - RNA, 18 nt, Homo sapiens
agaauacuuuucucagcu

SEQ ID NO: 20359 - RNA, 22 nt, Homo sapiens
agaccagcuugggcaacauagc

SEQ ID NO: 20360 - RNA, 20 nt, Homo sapiens
aguuggggagcugggcaggu

SEQ ID NO: 20361 - RNA, 17 nt, Homo sapiens
cgccgggugcggucggg

SEQ ID NO: 20362 - RNA, 19 nt, Homo sapiens
cuaacccccuuuagggcca

SEQ ID NO: 20363 - RNA, 16 nt, Homo sapiens
gaguuugagaccagcc

SEQ ID NO: 20364 - RNA, 20 nt, Homo sapiens
gcacaugggucuggggcccg

SEQ ID NO: 20365 - RNA, 22 nt, Homo sapiens
gccuguggucccagcuacuugg

SEQ ID NO: 20366 - RNA, 18 nt, Homo sapiens
gcuggccggggacgccgg

SEQ ID NO: 20367 - RNA, 21 nt, Homo sapiens
ggagcugggcaggugcagugg

SEQ ID NO: 20368 - RNA, 21 nt, Homo sapiens
uacagugagcuaugaucacau

SEQ ID NO: 20369 - RNA, 18 nt, Homo sapiens
ugagguagacccaccuca

SEQ ID NO: 20370 - RNA, 24 nt, Homo sapiens
uggaggcugggcacagcagcucau

SEQ ID NO: 20371 - RNA, 17 nt, Homo sapiens
uuagucaugcguagugg

SEQ ID NO: 20372 - RNA, 15 nt, Homo sapiens
uucugcauuucccag

SEQ ID NO: 20373 - RNA, 18 nt, Homo sapiens
uuggaauuuugaauauuc

SEQ ID NO: 20374 - RNA, 19 nt, Homo sapiens
gacuacaggugcgcgccac

SEQ ID NO: 20375 - RNA, 19 nt, Homo sapiens
ggauagcuuaaaagaaaaa

SEQ ID NO: 20376 - RNA, 19 nt, Homo sapiens
guggacaguuucaugaagc

SEQ ID NO: 20377 - RNA, 17 nt, Homo sapiens
ucaugaagcugucaguu

SEQ ID NO: 20378 - RNA, 21 nt, Homo sapiens
ucugcuguccuuccucccucu

SEQ ID NO: 20379 - RNA, 16 nt, Homo sapiens
ugcucuguugccagac

SEQ ID NO: 20380 - RNA, 23 nt, Homo sapiens
uuauacaaagagcagauuuuuau

SEQ ID NO: 20381 - RNA, 16 nt, Homo sapiens
acauugcacaaggcac

SEQ ID NO: 20382 - RNA, 16 nt, Homo sapiens
aucggcugauaaagca

SEQ ID NO: 20383 - RNA, 21 nt, Homo sapiens
cacaaggcacugcugggcaca

SEQ ID NO: 20384 - RNA, 17 nt, Homo sapiens
caccuggugaccccauc

SEQ ID NO: 20385 - RNA, 19 nt, Homo sapiens
cagccccaagaauucuccc

SEQ ID NO: 20386 - RNA, 17 nt, Homo sapiens
ccaggcuuucaggaggc

SEQ ID NO: 20387 - RNA, 19 nt, Homo sapiens
ccagggcggucccacagcc

SEQ ID NO: 20388 - RNA, 18 nt, Homo sapiens
ccccaagggaaagccagc

SEQ ID NO: 20389 - RNA, 19 nt, Homo sapiens
cccugagccccccuccucc

SEQ ID NO: 20390 - RNA, 15 nt, Homo sapiens
cccugcucccagccc

SEQ ID NO: 20391 - RNA, 24 nt, Homo sapiens
cccuggguccccgccggaggcugg

SEQ ID NO: 20392 - RNA, 16 nt, Homo sapiens
cguggaggagcggcug

SEQ ID NO: 20393 - RNA, 16 nt, Homo sapiens
gcgcggggcgucgcgc

SEQ ID NO: 20394 - RNA, 19 nt, Homo sapiens
gcgcggggcgucgcgccgc

SEQ ID NO: 20395 - RNA, 21 nt, Homo sapiens
gcgucgcgccgcccacccgga

SEQ ID NO: 20396 - RNA, 24 nt, Homo sapiens
ggaagggaggggacacgcggagca

SEQ ID NO: 20397 - RNA, 18 nt, Homo sapiens
ggccugcuccccuccuuc

SEQ ID NO: 20398 - RNA, 21 nt, Homo sapiens
gggaaagcugagggcaaagga

SEQ ID NO: 20399 - RNA, 19 nt, Homo sapiens
ucccggcauggcgagccuc

SEQ ID NO: 20400 - RNA, 17 nt, Homo sapiens
ucucaugggggucugcu

SEQ ID NO: 20401 - RNA, 19 nt, Homo sapiens
aacugcucagcugacaaaa

SEQ ID NO: 20402 - RNA, 20 nt, Homo sapiens
acccuugguugacuggcagc

SEQ ID NO: 20403 - RNA, 20 nt, Homo sapiens
gcauguggccggggaagaug

SEQ ID NO: 20404 - RNA, 17 nt, Homo sapiens
ggccaggaguucgagac

SEQ ID NO: 20405 - RNA, 21 nt, Homo sapiens
ggggagagagcgugcugggag

SEQ ID NO: 20406 - RNA, 19 nt, Homo sapiens
ucucacggagcagggcccc

SEQ ID NO: 20407 - RNA, 19 nt, Homo sapiens
ugagggucugaagucuguu

SEQ ID NO: 20408 - RNA, 19 nt, Homo sapiens
uggaggugcagugagccaa

SEQ ID NO: 20409 - RNA, 20 nt, Homo sapiens
uggggcggggagcauggaga

SEQ ID NO: 20410 - RNA, 18 nt, Homo sapiens
cccgugagcuccguucuc

SEQ ID NO: 20411 - RNA, 18 nt, Homo sapiens
uccaucacagaguuuucc

SEQ ID NO: 20412 - RNA, 20 nt, Homo sapiens
ucgaacuccuggccucagau

SEQ ID NO: 20413 - RNA, 22 nt, Homo sapiens
ugagaaauaugagaacaauagu

SEQ ID NO: 20414 - RNA, 16 nt, Homo sapiens
gcccggguaguggucc

SEQ ID NO: 20415 - RNA, 20 nt, Homo sapiens
uaaguuauuuauuuaagcca

SEQ ID NO: 20416 - RNA, 22 nt, Homo sapiens
uuucaaaguauuuguuaauugu

SEQ ID NO: 20417 - RNA, 22 nt, Homo sapiens
caaaguaauuauucagaacucu

SEQ ID NO: 20418 - RNA, 17 nt, Homo sapiens
uaagugaaaaaaauuag

SEQ ID NO: 20419 - RNA, 22 nt, Homo sapiens
uagaggagugaaaaucucuagg

SEQ ID NO: 20420 - RNA, 20 nt, Homo sapiens
uagcuaggcauaugaguuuc

SEQ ID NO: 20421 - RNA, 18 nt, Homo sapiens
ucagaaagcguucuucug

SEQ ID NO: 20422 - RNA, 19 nt, Homo sapiens
uccagagauguuagaggag

SEQ ID NO: 20423 - RNA, 18 nt, Homo sapiens
ugucauguuucacaggcc

SEQ ID NO: 20424 - RNA, 20 nt, Homo sapiens
ccgagcuggggcaccugcuc

SEQ ID NO: 20425 - RNA, 23 nt, Homo sapiens
ugccuguaaucucagcacuuugg

SEQ ID NO: 20426 - RNA, 18 nt, Homo sapiens
aacaauaugauauaagaa

SEQ ID NO: 20427 - RNA, 25 nt, Homo sapiens
agaccagauauuuaaaucaacuggu

SEQ ID NO: 20428 - RNA, 19 nt, Homo sapiens
augaacuuguuuuucccgu

SEQ ID NO: 20429 - RNA, 21 nt, Homo sapiens
ccccgggcacgggcggccggg

SEQ ID NO: 20430 - RNA, 19 nt, Homo sapiens
uacaaaagguccaagaaca

SEQ ID NO: 20431 - RNA, 22 nt, Homo sapiens
uguuaauaccauguacaugaau

SEQ ID NO: 20432 - RNA, 22 nt, Homo sapiens
gaaugagaggagcccuauauuc

SEQ ID NO: 20433 - RNA, 18 nt, Homo sapiens
agaggaaaaggagcagga

SEQ ID NO: 20434 - RNA, 19 nt, Homo sapiens
aggggaagcuggccuggcc

SEQ ID NO: 20435 - RNA, 14 nt, Homo sapiens
ccacaccuggagug

SEQ ID NO: 20436 - RNA, 19 nt, Homo sapiens
ccagaggcccugggcccgg

SEQ ID NO: 20437 - RNA, 18 nt, Homo sapiens
ccagggcagcaaauggcc

SEQ ID NO: 20438 - RNA, 19 nt, Homo sapiens
ccgcggcccggcccggccc

SEQ ID NO: 20439 - RNA, 20 nt, Homo sapiens
ccuccagcccccaucuucuc

SEQ ID NO: 20440 - RNA, 21 nt, Homo sapiens
gaguguaagcagcacguuguc

SEQ ID NO: 20441 - RNA, 20 nt, Homo sapiens
gcagggcauugcugguggca

SEQ ID NO: 20442 - RNA, 25 nt, Homo sapiens
gccccccaaagcccugcccuggcug

SEQ ID NO: 20443 - RNA, 18 nt, Homo sapiens
gccuggugaggagaugcc

SEQ ID NO: 20444 - RNA, 18 nt, Homo sapiens
gcuagugguccugcccca

SEQ ID NO: 20445 - RNA, 19 nt, Homo sapiens
gcucucgcucgccccuucc

SEQ ID NO: 20446 - RNA, 15 nt, Homo sapiens
ggcauugcugguggc

SEQ ID NO: 20447 - RNA, 17 nt, Homo sapiens
ggcgggcggcugcgggc

SEQ ID NO: 20448 - RNA, 18 nt, Homo sapiens
uagugcuguggccgcaag

SEQ ID NO: 20449 - RNA, 17 nt, Homo sapiens
ucagugggggcugcggc

SEQ ID NO: 20450 - RNA, 22 nt, Homo sapiens
ucaucguggugagucagaggcu

SEQ ID NO: 20451 - RNA, 20 nt, Homo sapiens
ugcccuggcuguccaguccc

SEQ ID NO: 20452 - RNA, 19 nt, Homo sapiens
uggacaugggcaggucagu

SEQ ID NO: 20453 - RNA, 17 nt, Homo sapiens
uggaggccugggggggu

SEQ ID NO: 20454 - RNA, 17 nt, Homo sapiens
uucccaguggugucgga

SEQ ID NO: 20455 - RNA, 19 nt, Homo sapiens
acacgggacaugggacaca

SEQ ID NO: 20456 - RNA, 19 nt, Homo sapiens
acgucugccucgggcgcau

SEQ ID NO: 20457 - RNA, 18 nt, Homo sapiens
agagagacggggccggag

SEQ ID NO: 20458 - RNA, 20 nt, Homo sapiens
agggggcgggagggagucgg

SEQ ID NO: 20459 - RNA, 20 nt, Homo sapiens
ccgcuccguggccuccuucc

SEQ ID NO: 20460 - RNA, 18 nt, Homo sapiens
gcccgcuccguggccucc

SEQ ID NO: 20461 - RNA, 18 nt, Homo sapiens
gccgcccgcuccguggcc

SEQ ID NO: 20462 - RNA, 22 nt, Homo sapiens
gcgggagggagucggggggagg

SEQ ID NO: 20463 - RNA, 19 nt, Homo sapiens
gcgggggaagggggcggga

SEQ ID NO: 20464 - RNA, 21 nt, Homo sapiens
gcgggggaagggggcgggagg

SEQ ID NO: 20465 - RNA, 22 nt, Homo sapiens
ggccggaggggugcaggcuggg

SEQ ID NO: 20466 - RNA, 21 nt, Homo sapiens
gggaggagggaccgccaggca

SEQ ID NO: 20467 - RNA, 19 nt, Homo sapiens
gggaggggaggggcgcagg

SEQ ID NO: 20468 - RNA, 23 nt, Homo sapiens
gggccggaggggugcaggcuggg

SEQ ID NO: 20469 - RNA, 22 nt, Homo sapiens
ggggcgggagggagucgggggg

SEQ ID NO: 20470 - RNA, 16 nt, Homo sapiens
ggggggaggggagggg

SEQ ID NO: 20471 - RNA, 21 nt, Homo sapiens
ggugcaaggagaggggaggag

SEQ ID NO: 20472 - RNA, 23 nt, Homo sapiens
uggguacuuucuuucuccuuauc

SEQ ID NO: 20473 - RNA, 17 nt, Homo sapiens
aacccauauugcuuuuc

SEQ ID NO: 20474 - RNA, 17 nt, Homo sapiens
acuaccucuccuuagug

SEQ ID NO: 20475 - RNA, 19 nt, Homo sapiens
guccuugaaaauauacgug

SEQ ID NO: 20476 - RNA, 18 nt, Homo sapiens
uaauaugacuuaugaaua

SEQ ID NO: 20477 - RNA, 18 nt, Homo sapiens
uguuguauuauccacuga

SEQ ID NO: 20478 - RNA, 20 nt, Homo sapiens
uuucuugcugucuaacauac

SEQ ID NO: 20479 - RNA, 23 nt, Homo sapiens
uacaguaggcugguauacauuag

SEQ ID NO: 20480 - RNA, 22 nt, Homo sapiens
ucggcguugcccaggcggguca

SEQ ID NO: 20481 - RNA, 22 nt, Homo sapiens
ucggcuguugcguccgcacgcc

SEQ ID NO: 20482 - RNA, 19 nt, Homo sapiens
agagaaaguguaagcagag

SEQ ID NO: 20483 - RNA, 18 nt, Homo sapiens
augugugugugugugugu

SEQ ID NO: 20484 - RNA, 24 nt, Homo sapiens
ccagaggaggcaugggaaaggugu

SEQ ID NO: 20485 - RNA, 15 nt, Homo sapiens
ccuacauauugcuuu

SEQ ID NO: 20486 - RNA, 20 nt, Homo sapiens
cugggcucaucuagcccuaa

SEQ ID NO: 20487 - RNA, 19 nt, Homo sapiens
gcauggugucuacuucuua

SEQ ID NO: 20488 - RNA, 15 nt, Homo sapiens
gcgagaacaguuugg

SEQ ID NO: 20489 - RNA, 19 nt, Homo sapiens
gggguggggcaggaguggg

SEQ ID NO: 20490 - RNA, 22 nt, Homo sapiens
ggugggguggggcaggaguggg

SEQ ID NO: 20491 - RNA, 15 nt, Homo sapiens
uccacggugcuuuuu

SEQ ID NO: 20492 - RNA, 20 nt, Homo sapiens
ucuuugucucccugagagau

SEQ ID NO: 20493 - RNA, 20 nt, Homo sapiens
cccgucggccagcucuggau

SEQ ID NO: 20494 - RNA, 28 nt, Homo sapiens
ccggcccuggcucgcggaaugggcggcc

SEQ ID NO: 20495 - RNA, 16 nt, Homo sapiens
cucgcggaaugggcgg

SEQ ID NO: 20496 - RNA, 15 nt, Homo sapiens
uggcagcgccagucc

SEQ ID NO: 20497 - RNA, 18 nt, Homo sapiens
ugcccaauuuuaugagaa

SEQ ID NO: 20498 - RNA, 21 nt, Homo sapiens
uggcacaacuagaagaggaaa

SEQ ID NO: 20499 - RNA, 19 nt, Homo sapiens
caugugguuugagucuguu

SEQ ID NO: 20500 - RNA, 18 nt, Homo sapiens
ucuuugcgucauagacac

SEQ ID NO: 20501 - RNA, 24 nt, Homo sapiens
agagguuguagugagccaagauca

SEQ ID NO: 20502 - RNA, 21 nt, Homo sapiens
agcugcacaguucggaggcca

SEQ ID NO: 20503 - RNA, 21 nt, Homo sapiens
agggaaaucaggaggaggagu

SEQ ID NO: 20504 - RNA, 22 nt, Homo sapiens
gaggaggagggagagugucucu

SEQ ID NO: 20505 - RNA, 21 nt, Homo sapiens
gaucauggaaaccaagggagg

SEQ ID NO: 20506 - RNA, 17 nt, Homo sapiens
ggagaaagcuggcaaag

SEQ ID NO: 20507 - RNA, 19 nt, Homo sapiens
gggcaaggugguaggugcc

SEQ ID NO: 20508 - RNA, 17 nt, Homo sapiens
uauguuggaugacacug

SEQ ID NO: 20509 - RNA, 18 nt, Homo sapiens
ucagacagcucuugcacc

SEQ ID NO: 20510 - RNA, 18 nt, Homo sapiens
ucuuggggcugcagaggg

SEQ ID NO: 20511 - RNA, 16 nt, Homo sapiens
ugagaggaggguucgg

SEQ ID NO: 20512 - RNA, 15 nt, Homo sapiens
ugccaaguucugcau

SEQ ID NO: 20513 - RNA, 19 nt, Homo sapiens
ugggagauggggugaaugg

SEQ ID NO: 20514 - RNA, 23 nt, Homo sapiens
aaagggauggggugggucggggc

SEQ ID NO: 20515 - RNA, 23 nt, Homo sapiens
aauaaaaaaguccccaaagucuc

SEQ ID NO: 20516 - RNA, 19 nt, Homo sapiens
acuuggcgugagccagggc

SEQ ID NO: 20517 - RNA, 22 nt, Homo sapiens
cagggcccugcccuacccugcc

SEQ ID NO: 20518 - RNA, 20 nt, Homo sapiens
ccagagagggcgggcuuguc

SEQ ID NO: 20519 - RNA, 16 nt, Homo sapiens
cuccaguugcuauggc

SEQ ID NO: 20520 - RNA, 20 nt, Homo sapiens
gaagaccccuuggucguggg

SEQ ID NO: 20521 - RNA, 22 nt, Homo sapiens
gagcgcaagggcggggcgcgcg

SEQ ID NO: 20522 - RNA, 16 nt, Homo sapiens
gcgccgcgccgcagcc

SEQ ID NO: 20523 - RNA, 16 nt, Homo sapiens
gcgcgcggccggagcc

SEQ ID NO: 20524 - RNA, 16 nt, Homo sapiens
ggcgcgcggccggagc

SEQ ID NO: 20525 - RNA, 21 nt, Homo sapiens
gggcaggggagaggggcuggg

SEQ ID NO: 20526 - RNA, 22 nt, Homo sapiens
uccaaguuugcucaagucgaua

SEQ ID NO: 20527 - RNA, 19 nt, Homo sapiens
ucccccacagggggacugc

SEQ ID NO: 20528 - RNA, 20 nt, Homo sapiens
ucgcgcgagcacguaccggg

SEQ ID NO: 20529 - RNA, 17 nt, Homo sapiens
ugcccucuugagagcag

SEQ ID NO: 20530 - RNA, 16 nt, Homo sapiens
uggaguugcuaggggc

SEQ ID NO: 20531 - RNA, 18 nt, Homo sapiens
uggcacuccuccccagcc

SEQ ID NO: 20532 - RNA, 19 nt, Homo sapiens
ccccgccccguccccgccc

SEQ ID NO: 20533 - RNA, 19 nt, Homo sapiens
aaggccaugcauugccuuc

SEQ ID NO: 20534 - RNA, 15 nt, Homo sapiens
accauaauuacugcu

SEQ ID NO: 20535 - RNA, 16 nt, Homo sapiens
gcaauuaugaaaaaca

SEQ ID NO: 20536 - RNA, 24 nt, Homo sapiens
aaaaaggaaagaaagaguuacuau

SEQ ID NO: 20537 - RNA, 22 nt, Homo sapiens
aaaaugaagagauaaauauaag

SEQ ID NO: 20538 - RNA, 20 nt, Homo sapiens
aaauucccucucccaccccu

SEQ ID NO: 20539 - RNA, 23 nt, Homo sapiens
aauauauauauauguauauauaa

SEQ ID NO: 20540 - RNA, 24 nt, Homo sapiens
aauauauauauauguauauauaua

SEQ ID NO: 20541 - RNA, 15 nt, Homo sapiens
acaguguggcagcaa

SEQ ID NO: 20542 - RNA, 17 nt, Homo sapiens
aggaaagagggccaagg

SEQ ID NO: 20543 - RNA, 21 nt, Homo sapiens
auauauauauauguauauaua

SEQ ID NO: 20544 - RNA, 24 nt, Homo sapiens
auauauauauauguauauauauau

SEQ ID NO: 20545 - RNA, 23 nt, Homo sapiens
auauauauauauguauauauauu

SEQ ID NO: 20546 - RNA, 22 nt, Homo sapiens
auauauauauguauauauauau

SEQ ID NO: 20547 - RNA, 22 nt, Homo sapiens
auauauauguauauauauauau

SEQ ID NO: 20548 - RNA, 22 nt, Homo sapiens
auauauguauauauauauauau

SEQ ID NO: 20549 - RNA, 22 nt, Homo sapiens
auauguauauauauauauauau

SEQ ID NO: 20550 - RNA, 19 nt, Homo sapiens
cagugcggaugaacugcag

SEQ ID NO: 20551 - RNA, 22 nt, Homo sapiens
caucaagcauguugggaggggc

SEQ ID NO: 20552 - RNA, 19 nt, Homo sapiens
gccgaagucgccgccuggc

SEQ ID NO: 20553 - RNA, 19 nt, Homo sapiens
ggguagaaagggaagagac

SEQ ID NO: 20554 - RNA, 19 nt, Homo sapiens
gguagauuaaucuuugccc

SEQ ID NO: 20555 - RNA, 14 nt, Homo sapiens
uacuagaugagaca

SEQ ID NO: 20556 - RNA, 19 nt, Homo sapiens
uauauauauauauauauau

SEQ ID NO: 20557 - RNA, 24 nt, Homo sapiens
uauauauauauauaugaacccaga

SEQ ID NO: 20558 - RNA, 22 nt, Homo sapiens
uauauauauauguauauauaua

SEQ ID NO: 20559 - RNA, 24 nt, Homo sapiens
uauauauauauguauauauauaua

SEQ ID NO: 20560 - RNA, 22 nt, Homo sapiens
uauauauauguauauauauaua

SEQ ID NO: 20561 - RNA, 24 nt, Homo sapiens
uauauauauguauauauauauaua

SEQ ID NO: 20562 - RNA, 22 nt, Homo sapiens
uauauauguauauauauauaua

SEQ ID NO: 20563 - RNA, 24 nt, Homo sapiens
uauauauguauauauauauauaua

SEQ ID NO: 20564 - RNA, 22 nt, Homo sapiens
uauauguauauauauauauaua

SEQ ID NO: 20565 - RNA, 24 nt, Homo sapiens
uauauguauauauauauauauaua

SEQ ID NO: 20566 - RNA, 22 nt, Homo sapiens
uauguauauauauauauauaua

SEQ ID NO: 20567 - RNA, 23 nt, Homo sapiens
uauguauauauauauauauauau

SEQ ID NO: 20568 - RNA, 21 nt, Homo sapiens
ucugccagcaauuuacagugc

SEQ ID NO: 20569 - RNA, 20 nt, Homo sapiens
ugcccauuccugcaaaaguu

SEQ ID NO: 20570 - RNA, 18 nt, Homo sapiens
uggguuuguaccgugcag

SEQ ID NO: 20571 - RNA, 17 nt, Homo sapiens
uuacuugggauuguuuu

SEQ ID NO: 20572 - RNA, 23 nt, Homo sapiens
uuuuuugcuuuuuucccccccuu

SEQ ID NO: 20573 - RNA, 16 nt, Homo sapiens
auugaucaucucaauu

SEQ ID NO: 20574 - RNA, 19 nt, Homo sapiens
gcccuuugggaauggggca

SEQ ID NO: 20575 - RNA, 18 nt, Homo sapiens
uacaguaagcaagacagg

SEQ ID NO: 20576 - RNA, 19 nt, Homo sapiens
ugccaguaagacaaaggca

SEQ ID NO: 20577 - RNA, 18 nt, Homo sapiens
gcccccguuugucccuga

SEQ ID NO: 20578 - RNA, 18 nt, Homo sapiens
ucagaaagaaaaagguag

SEQ ID NO: 20579 - RNA, 19 nt, Homo sapiens
acuucacgauccgcccccc

SEQ ID NO: 20580 - RNA, 21 nt, Homo sapiens
cacugccaauuacuuuugaac

SEQ ID NO: 20581 - RNA, 20 nt, Homo sapiens
gagacggagucucgcucugu

SEQ ID NO: 20582 - RNA, 19 nt, Homo sapiens
ucgcgggaggccggagcgg

SEQ ID NO: 20583 - RNA, 24 nt, Homo sapiens
agggucccaagcagggguguguua

SEQ ID NO: 20584 - RNA, 19 nt, Homo sapiens
ggguguguuacuguuagau

SEQ ID NO: 20585 - RNA, 19 nt, Homo sapiens
agguggguggcggcagcgg

SEQ ID NO: 20586 - RNA, 21 nt, Homo sapiens
cacccggaggggagggaaggc

SEQ ID NO: 20587 - RNA, 21 nt, Homo sapiens
cgggaagccucgcgcgccugg

SEQ ID NO: 20588 - RNA, 20 nt, Homo sapiens
cucuggcgaguucucccugg

SEQ ID NO: 20589 - RNA, 22 nt, Homo sapiens
gaaccccggcucgggguaagca

SEQ ID NO: 20590 - RNA, 18 nt, Homo sapiens
gagagaggggcccguuug

SEQ ID NO: 20591 - RNA, 17 nt, Homo sapiens
ggccccgggagugagca

SEQ ID NO: 20592 - RNA, 21 nt, Homo sapiens
ggccgggaggagggaaccccg

SEQ ID NO: 20593 - RNA, 21 nt, Homo sapiens
ggcgaggaaggcgccagacag

SEQ ID NO: 20594 - RNA, 19 nt, Homo sapiens
gggagggcgggcaggcggg

SEQ ID NO: 20595 - RNA, 18 nt, Homo sapiens
ggggagggcgggcaggcg

SEQ ID NO: 20596 - RNA, 17 nt, Homo sapiens
ucuguguccaaguccag

SEQ ID NO: 20597 - RNA, 21 nt, Homo sapiens
uggccccgggagugagcaggg

SEQ ID NO: 20598 - RNA, 16 nt, Homo sapiens
ugggggcuccgagggc

SEQ ID NO: 20599 - RNA, 20 nt, Homo sapiens
cacaauguagggcucaaucu

SEQ ID NO: 20600 - RNA, 19 nt, Homo sapiens
caaacuaaguauugaaucc

SEQ ID NO: 20601 - RNA, 22 nt, Homo sapiens
cguaaagaggaauuucuuucuc

SEQ ID NO: 20602 - RNA, 20 nt, Homo sapiens
uuacuggugucacuccacag

SEQ ID NO: 20603 - RNA, 24 nt, Homo sapiens
acaaggauagcacagugacugauu

SEQ ID NO: 20604 - RNA, 21 nt, Homo sapiens
uacaacagauuaagucacaga

SEQ ID NO: 20605 - RNA, 21 nt, Homo sapiens
acaggacuggagcugggcgga

SEQ ID NO: 20606 - RNA, 18 nt, Homo sapiens
aggcggugggcgcggcuu

SEQ ID NO: 20607 - RNA, 21 nt, Homo sapiens
ccccgggccgggggcucgggg

SEQ ID NO: 20608 - RNA, 14 nt, Homo sapiens
cccgccucccagcc

SEQ ID NO: 20609 - RNA, 16 nt, Homo sapiens
cccggccccucccucc

SEQ ID NO: 20610 - RNA, 23 nt, Homo sapiens
cggggguggggguccuagguggg

SEQ ID NO: 20611 - RNA, 25 nt, Homo sapiens
cguggaggauggaacacggacggcc

SEQ ID NO: 20612 - RNA, 21 nt, Homo sapiens
gagggcuggggguuggggcug

SEQ ID NO: 20613 - RNA, 25 nt, Homo sapiens
gccccuccccgggccgggggcucgg

SEQ ID NO: 20614 - RNA, 16 nt, Homo sapiens
gcccuggagcccuggc

SEQ ID NO: 20615 - RNA, 18 nt, Homo sapiens
gcugggugggagaaaggg

SEQ ID NO: 20616 - RNA, 17 nt, Homo sapiens
ggagguggggaaggggg

SEQ ID NO: 20617 - RNA, 19 nt, Homo sapiens
ggagguggggaaggggugg

SEQ ID NO: 20618 - RNA, 20 nt, Homo sapiens
gggcuagggggugagggcug

SEQ ID NO: 20619 - RNA, 22 nt, Homo sapiens
gggcuagggggugagggcuggg

SEQ ID NO: 20620 - RNA, 20 nt, Homo sapiens
ggggguuggggcuggguggg

SEQ ID NO: 20621 - RNA, 21 nt, Homo sapiens
gggugagggcuggggguuggg

SEQ ID NO: 20622 - RNA, 18 nt, Homo sapiens
ucagggccucagccuggc

SEQ ID NO: 20623 - RNA, 21 nt, Homo sapiens
ucgcgagggucgggggugggg

SEQ ID NO: 20624 - RNA, 17 nt, Homo sapiens
ugaggaggggggcgcgg

SEQ ID NO: 20625 - RNA, 19 nt, Homo sapiens
ugaggaggggggcgcggga

SEQ ID NO: 20626 - RNA, 18 nt, Homo sapiens
uggggguuggggcugggu

SEQ ID NO: 20627 - RNA, 19 nt, Homo sapiens
accauccuccccauccacc

SEQ ID NO: 20628 - RNA, 21 nt, Homo sapiens
gcuuauuucacuucgcauaau

SEQ ID NO: 20629 - RNA, 22 nt, Homo sapiens
guugcuacaauaaagaacaacu

SEQ ID NO: 20630 - RNA, 20 nt, Homo sapiens
uaggggcaagaaucaccguc

SEQ ID NO: 20631 - RNA, 19 nt, Homo sapiens
uaucuguucaagucccugc

SEQ ID NO: 20632 - RNA, 19 nt, Homo sapiens
ucaaguauuuauaguuggu

SEQ ID NO: 20633 - RNA, 18 nt, Homo sapiens
ugugauuguuuacugaaa

SEQ ID NO: 20634 - RNA, 19 nt, Homo sapiens
uuaugccuguuaugacacu

SEQ ID NO: 20635 - RNA, 18 nt, Homo sapiens
cgggucuucccggagcuc

SEQ ID NO: 20636 - RNA, 19 nt, Homo sapiens
ggggaccugugugcacugc

SEQ ID NO: 20637 - RNA, 20 nt, Homo sapiens
ccgccucggccgcccccgcc

SEQ ID NO: 20638 - RNA, 16 nt, Homo sapiens
ugaugucuucgugggg

SEQ ID NO: 20639 - RNA, 22 nt, Homo sapiens
ugcugagugaaugcauuccagg

SEQ ID NO: 20640 - RNA, 22 nt, Homo sapiens
ugggaaaggugauacguuuucc

SEQ ID NO: 20641 - RNA, 15 nt, Homo sapiens
uucugccaccccgau

SEQ ID NO: 20642 - RNA, 19 nt, Homo sapiens
aaggauaggcggacggccg

SEQ ID NO: 20643 - RNA, 19 nt, Homo sapiens
cggagaaagcggagggggc

SEQ ID NO: 20644 - RNA, 20 nt, Homo sapiens
gcggaaggcucgcgaggucg

SEQ ID NO: 20645 - RNA, 16 nt, Homo sapiens
gucgcugcucgcuacc

SEQ ID NO: 20646 - RNA, 17 nt, Homo sapiens
uagaauguccuaucacu

SEQ ID NO: 20647 - RNA, 21 nt, Homo sapiens
aggaggccugggccacagccu

SEQ ID NO: 20648 - RNA, 18 nt, Homo sapiens
cccuguuccccgccagac

SEQ ID NO: 20649 - RNA, 17 nt, Homo sapiens
ccgccacugccucaggg

SEQ ID NO: 20650 - RNA, 18 nt, Homo sapiens
ccgccagacagggccugu

SEQ ID NO: 20651 - RNA, 15 nt, Homo sapiens
gcaggcccagcuccu

SEQ ID NO: 20652 - RNA, 18 nt, Homo sapiens
uggucccuguuccccgcc

SEQ ID NO: 20653 - RNA, 21 nt, Homo sapiens
cggcuucuucgcgguuccccc

SEQ ID NO: 20654 - RNA, 18 nt, Homo sapiens
cggggccaagggcagggc

SEQ ID NO: 20655 - RNA, 24 nt, Homo sapiens
cggggccaagggcagggcggcgcu

SEQ ID NO: 20656 - RNA, 17 nt, Homo sapiens
gcagggcggcgcuuuuc

SEQ ID NO: 20657 - RNA, 22 nt, Homo sapiens
ggaugugaagagccucaccucc

SEQ ID NO: 20658 - RNA, 21 nt, Homo sapiens
ccagaggggagcccaccaguc

SEQ ID NO: 20659 - RNA, 21 nt, Homo sapiens
ggucuuucccgcgucccgggc

SEQ ID NO: 20660 - RNA, 20 nt, Homo sapiens
gugucuacacaacauuucag

SEQ ID NO: 20661 - RNA, 19 nt, Homo sapiens
uaccuagcaaguacccuuc

SEQ ID NO: 20662 - RNA, 17 nt, Homo sapiens
ucccaagagggcagggg

SEQ ID NO: 20663 - RNA, 21 nt, Homo sapiens
ugcaagccuggugaccacuca

SEQ ID NO: 20664 - RNA, 22 nt, Homo sapiens
uucaaguaugacuaagaaucau

SEQ ID NO: 20665 - RNA, 19 nt, Homo sapiens
aaauguuucaggccuggag

SEQ ID NO: 20666 - RNA, 21 nt, Homo sapiens
aauacagaucuaaagucuggg

SEQ ID NO: 20667 - RNA, 20 nt, Homo sapiens
aaugugggguaaagucaaga

SEQ ID NO: 20668 - RNA, 18 nt, Homo sapiens
acggacggauggagagag

SEQ ID NO: 20669 - RNA, 18 nt, Homo sapiens
aggaaaaaagaaagaaaa

SEQ ID NO: 20670 - RNA, 21 nt, Homo sapiens
aggcaggugccaaaacaccca

SEQ ID NO: 20671 - RNA, 21 nt, Homo sapiens
agggcaggcauggggcagggg

SEQ ID NO: 20672 - RNA, 21 nt, Homo sapiens
aggguuaggggucugaaggaa

SEQ ID NO: 20673 - RNA, 16 nt, Homo sapiens
cagcacccugcgagca

SEQ ID NO: 20674 - RNA, 15 nt, Homo sapiens
ccagcgccgcccgcc

SEQ ID NO: 20675 - RNA, 21 nt, Homo sapiens
ccgcccgccgccgccgcggcc

SEQ ID NO: 20676 - RNA, 19 nt, Homo sapiens
ccgccgcggccgcgcuucc

SEQ ID NO: 20677 - RNA, 26 nt, Homo sapiens
ccgcgcuuccgcuccccacucucccg

SEQ ID NO: 20678 - RNA, 21 nt, Homo sapiens
cggcggcggcgcgcggcgcgg

SEQ ID NO: 20679 - RNA, 19 nt, Homo sapiens
cgggucccagcgccgcccg

SEQ ID NO: 20680 - RNA, 16 nt, Homo sapiens
gagcaguuagcgcacc

SEQ ID NO: 20681 - RNA, 20 nt, Homo sapiens
gcaggcauggggcaggggua

SEQ ID NO: 20682 - RNA, 21 nt, Homo sapiens
gccgcaggcugccacacgugg

SEQ ID NO: 20683 - RNA, 16 nt, Homo sapiens
gcgcgcggcgcggccc

SEQ ID NO: 20684 - RNA, 21 nt, Homo sapiens
gcgcggcgcggcccagcggcu

SEQ ID NO: 20685 - RNA, 17 nt, Homo sapiens
ggcggcggcgcgcggcg

SEQ ID NO: 20686 - RNA, 16 nt, Homo sapiens
gggucccagcgccgcc

SEQ ID NO: 20687 - RNA, 20 nt, Homo sapiens
gggugggagcggaauggagc

SEQ ID NO: 20688 - RNA, 17 nt, Homo sapiens
uaaugugggguaaaguc

SEQ ID NO: 20689 - RNA, 19 nt, Homo sapiens
ucaugcaugggugaaguug

SEQ ID NO: 20690 - RNA, 20 nt, Homo sapiens
ucgcagcacccugcgagcag

SEQ ID NO: 20691 - RNA, 18 nt, Homo sapiens
ugaggggcugcugaagca

SEQ ID NO: 20692 - RNA, 17 nt, Homo sapiens
ugccugauggggugggg

SEQ ID NO: 20693 - RNA, 21 nt, Homo sapiens
uuugggaaucaccagcauauc

SEQ ID NO: 20694 - RNA, 15 nt, Homo sapiens
ccugucccugcccgg

SEQ ID NO: 20695 - RNA, 17 nt, Homo sapiens
ucaggcaagucuggaug

SEQ ID NO: 20696 - RNA, 17 nt, Homo sapiens
auacagauacuauacac

SEQ ID NO: 20697 - RNA, 23 nt, Homo sapiens
ccuggccaggccgagcggggacg

SEQ ID NO: 20698 - RNA, 19 nt, Homo sapiens
cgaggugaagguggggaug

SEQ ID NO: 20699 - RNA, 24 nt, Homo sapiens
cgggucuccuaugggucuggguuc

SEQ ID NO: 20700 - RNA, 18 nt, Homo sapiens
cuccacuucuuucuccgu

SEQ ID NO: 20701 - RNA, 24 nt, Homo sapiens
gaggucuugcugggagaugcuggg

SEQ ID NO: 20702 - RNA, 15 nt, Homo sapiens
gccccaagacagguu

SEQ ID NO: 20703 - RNA, 19 nt, Homo sapiens
gcugguuggccuccuuccg

SEQ ID NO: 20704 - RNA, 21 nt, Homo sapiens
ggauggcacugucgggcuggu

SEQ ID NO: 20705 - RNA, 19 nt, Homo sapiens
ugcuuuuccuucagucagu

SEQ ID NO: 20706 - RNA, 18 nt, Homo sapiens
agcgggcuggcccagccc

SEQ ID NO: 20707 - RNA, 17 nt, Homo sapiens
aggggaggggguguggg

SEQ ID NO: 20708 - RNA, 19 nt, Homo sapiens
aggggggcgagggaggggc

SEQ ID NO: 20709 - RNA, 18 nt, Homo sapiens
caccucccuccacccccc

SEQ ID NO: 20710 - RNA, 19 nt, Homo sapiens
cacgaggcgcgacgggggc

SEQ ID NO: 20711 - RNA, 19 nt, Homo sapiens
cccccgaagccucggccgg

SEQ ID NO: 20712 - RNA, 19 nt, Homo sapiens
ccucccgccggcuucggug

SEQ ID NO: 20713 - RNA, 21 nt, Homo sapiens
cgccgaguccuggcucccggg

SEQ ID NO: 20714 - RNA, 19 nt, Homo sapiens
cgccucgccuuccucugcc

SEQ ID NO: 20715 - RNA, 20 nt, Homo sapiens
cgcucuucuccgcccggccg

SEQ ID NO: 20716 - RNA, 20 nt, Homo sapiens
cgcuucggggcugcgcgccc

SEQ ID NO: 20717 - RNA, 18 nt, Homo sapiens
cuguccaucaguguccag

SEQ ID NO: 20718 - RNA, 17 nt, Homo sapiens
gcacagcgggcuggccc

SEQ ID NO: 20719 - RNA, 17 nt, Homo sapiens
gccgcgcugcgcucgga

SEQ ID NO: 20720 - RNA, 18 nt, Homo sapiens
gcucccgggcgaucgagc

SEQ ID NO: 20721 - RNA, 18 nt, Homo sapiens
gcugcgcgcccucucccc

SEQ ID NO: 20722 - RNA, 19 nt, Homo sapiens
ggccaggaggcagugugga

SEQ ID NO: 20723 - RNA, 15 nt, Homo sapiens
gggaaaaagggggau

SEQ ID NO: 20724 - RNA, 24 nt, Homo sapiens
gggaagguggcaaggggggcgagg

SEQ ID NO: 20725 - RNA, 20 nt, Homo sapiens
gguagcccggcagccucgcg

SEQ ID NO: 20726 - RNA, 19 nt, Homo sapiens
ggucuucccgcagaggucu

SEQ ID NO: 20727 - RNA, 24 nt, Homo sapiens
gugagggccagcuccuuccauggc

SEQ ID NO: 20728 - RNA, 18 nt, Homo sapiens
guguguggaaggguggca

SEQ ID NO: 20729 - RNA, 19 nt, Homo sapiens
uggcaaggggggcgaggga

SEQ ID NO: 20730 - RNA, 18 nt, Homo sapiens
ugugugugugugugugug

SEQ ID NO: 20731 - RNA, 19 nt, Homo sapiens
ugugugugugugugugugu

SEQ ID NO: 20732 - RNA, 23 nt, Homo sapiens
uuugugugugugugugugugugu

SEQ ID NO: 20733 - RNA, 19 nt, Homo sapiens
caaaggcccaggaaagcaa

SEQ ID NO: 20734 - RNA, 16 nt, Homo sapiens
cucucgguccgauccc

SEQ ID NO: 20735 - RNA, 17 nt, Homo sapiens
cuguccccagcccuggc

SEQ ID NO: 20736 - RNA, 18 nt, Homo sapiens
cuuggccgauggggcucc

SEQ ID NO: 20737 - RNA, 18 nt, Homo sapiens
gagguacccuguuuacuu

SEQ ID NO: 20738 - RNA, 18 nt, Homo sapiens
gcacagcagggaggccac

SEQ ID NO: 20739 - RNA, 17 nt, Homo sapiens
gcucccgcccgccggcc

SEQ ID NO: 20740 - RNA, 22 nt, Homo sapiens
ggccagggugucauccgagacc

SEQ ID NO: 20741 - RNA, 19 nt, Homo sapiens
ggcccgagggucuaaagaa

SEQ ID NO: 20742 - RNA, 20 nt, Homo sapiens
ucccuggucaucuccucagu

SEQ ID NO: 20743 - RNA, 21 nt, Homo sapiens
aaaaacaaaccaaggaacaaa

SEQ ID NO: 20744 - RNA, 25 nt, Homo sapiens
gggggaggacgucuuaaaagggagg

SEQ ID NO: 20745 - RNA, 18 nt, Homo sapiens
uaaaagaagcaaauaaaa

SEQ ID NO: 20746 - RNA, 23 nt, Homo sapiens
ugacuuacaaagacauuuacuaa

SEQ ID NO: 20747 - RNA, 20 nt, Homo sapiens
ugccaggcucacaguaacua

SEQ ID NO: 20748 - RNA, 19 nt, Homo sapiens
accggaguggcggaguccg

SEQ ID NO: 20749 - RNA, 21 nt, Homo sapiens
aggcaggccggcaggcgggag

SEQ ID NO: 20750 - RNA, 19 nt, Homo sapiens
cagcugcuuccuuugcucg

SEQ ID NO: 20751 - RNA, 25 nt, Homo sapiens
ccaaaacaucagcuucucuccacag

SEQ ID NO: 20752 - RNA, 23 nt, Homo sapiens
cggccgcgaauucgcggccgcgu

SEQ ID NO: 20753 - RNA, 16 nt, Homo sapiens
gaggcaccagauaaaa

SEQ ID NO: 20754 - RNA, 17 nt, Homo sapiens
gccgcgaauucgcggcc

SEQ ID NO: 20755 - RNA, 19 nt, Homo sapiens
ggagaaaggagcugggagc

SEQ ID NO: 20756 - RNA, 21 nt, Homo sapiens
uacagauauacaguuuacagc

SEQ ID NO: 20757 - RNA, 23 nt, Homo sapiens
ucaguguucugaguucauguccu

SEQ ID NO: 20758 - RNA, 16 nt, Homo sapiens
cacaaacacugccaag

SEQ ID NO: 20759 - RNA, 22 nt, Homo sapiens
aacaaaaaagguucaaggucuu

SEQ ID NO: 20760 - RNA, 18 nt, Homo sapiens
gcagggaggggaagcguc

SEQ ID NO: 20761 - RNA, 22 nt, Homo sapiens
aaaaagcucuucaaaaggauca

SEQ ID NO: 20762 - RNA, 19 nt, Homo sapiens
aaggaucaaugagaucuag

SEQ ID NO: 20763 - RNA, 19 nt, Homo sapiens
agaagggcagaguuggggu

SEQ ID NO: 20764 - RNA, 24 nt, Homo sapiens
ccucugcuuucugauguccgcucc

SEQ ID NO: 20765 - RNA, 18 nt, Homo sapiens
cuccugcugagguucuug

SEQ ID NO: 20766 - RNA, 19 nt, Homo sapiens
gauugguuuuugggaagcu

SEQ ID NO: 20767 - RNA, 16 nt, Homo sapiens
gucuguuuugaguucc

SEQ ID NO: 20768 - RNA, 22 nt, Homo sapiens
uacuucuuugccuucuuccucg

SEQ ID NO: 20769 - RNA, 16 nt, Homo sapiens
uccucacccucuuccu

SEQ ID NO: 20770 - RNA, 18 nt, Homo sapiens
ucucggucgccgcccguc

SEQ ID NO: 20771 - RNA, 21 nt, Homo sapiens
ucuguuuugaguuccgguuca

SEQ ID NO: 20772 - RNA, 19 nt, Homo sapiens
aagggaggggacucucagg

SEQ ID NO: 20773 - RNA, 22 nt, Homo sapiens
caacugcagcccacugagagug

SEQ ID NO: 20774 - RNA, 17 nt, Homo sapiens
gcuucucgguauccuuu

SEQ ID NO: 20775 - RNA, 23 nt, Homo sapiens
gggcaggagugugugcgcguggg

SEQ ID NO: 20776 - RNA, 26 nt, Homo sapiens
gguccuuuucccuccucuccuucccc

SEQ ID NO: 20777 - RNA, 19 nt, Homo sapiens
uacucuuguucuccugaug

SEQ ID NO: 20778 - RNA, 26 nt, Homo sapiens
ugagagugggagcuggguuuacucuu

SEQ ID NO: 20779 - RNA, 15 nt, Homo sapiens
ugcaguggucagcaa

SEQ ID NO: 20780 - RNA, 18 nt, Homo sapiens
ugggagaagggaggggac

SEQ ID NO: 20781 - RNA, 19 nt, Homo sapiens
uucuuuuuccuuuuugcag

SEQ ID NO: 20782 - RNA, 29 nt, Homo sapiens
gcucugcuugggugucugugcgaaugacg

SEQ ID NO: 20783 - RNA, 17 nt, Homo sapiens
aacagacaagugugagg

SEQ ID NO: 20784 - RNA, 18 nt, Homo sapiens
aggucugggcccugaggg

SEQ ID NO: 20785 - RNA, 18 nt, Homo sapiens
ccuggaguccccuccucc

SEQ ID NO: 20786 - RNA, 17 nt, Homo sapiens
gcccugaggggcuuggg

SEQ ID NO: 20787 - RNA, 21 nt, Homo sapiens
gcugcuuggcaucccugcacg

SEQ ID NO: 20788 - RNA, 23 nt, Homo sapiens
ggcccugaggggcuuggggaggg

SEQ ID NO: 20789 - RNA, 16 nt, Homo sapiens
ugggcccuguggaacc

SEQ ID NO: 20790 - RNA, 18 nt, Homo sapiens
ccaccaccaacuaccgcc

SEQ ID NO: 20791 - RNA, 19 nt, Homo sapiens
gaggcggugucccuggggu

SEQ ID NO: 20792 - RNA, 19 nt, Homo sapiens
ugcgggaacgcacccauca

SEQ ID NO: 20793 - RNA, 17 nt, Homo sapiens
ugggagauguugggcac

SEQ ID NO: 20794 - RNA, 17 nt, Homo sapiens
ugggccccuguuucaac

SEQ ID NO: 20795 - RNA, 20 nt, Homo sapiens
acgcagcccggcccgccccc

SEQ ID NO: 20796 - RNA, 23 nt, Homo sapiens
ccggcccggguccguucggcgcc

SEQ ID NO: 20797 - RNA, 18 nt, Homo sapiens
ccgggucccgccgcccgc

SEQ ID NO: 20798 - RNA, 18 nt, Homo sapiens
gacgcuggcggcaggggc

SEQ ID NO: 20799 - RNA, 21 nt, Homo sapiens
guggacccggggcuccuggag

SEQ ID NO: 20800 - RNA, 15 nt, Homo sapiens
guggaccugacgcug

SEQ ID NO: 20801 - RNA, 19 nt, Homo sapiens
ucacaaugaagacaaacag

SEQ ID NO: 20802 - RNA, 23 nt, Homo sapiens
uccagggcugagucacggguauc

SEQ ID NO: 20803 - RNA, 18 nt, Homo sapiens
ucucggaccaguguccag

SEQ ID NO: 20804 - RNA, 20 nt, Homo sapiens
ucucucacagaggcuguugg

SEQ ID NO: 20805 - RNA, 22 nt, Homo sapiens
ucugaaaccuagaagagaggcu

SEQ ID NO: 20806 - RNA, 24 nt, Homo sapiens
uggggcgccgggagaauccugggg

SEQ ID NO: 20807 - RNA, 17 nt, Homo sapiens
aacauuguugcuuuguu

SEQ ID NO: 20808 - RNA, 25 nt, Homo sapiens
aauuguguuuccaaaaauaacauuu

SEQ ID NO: 20809 - RNA, 23 nt, Homo sapiens
caacauucuuacauaacaucugu

SEQ ID NO: 20810 - RNA, 19 nt, Homo sapiens
cgaggugggaggggaccgg

SEQ ID NO: 20811 - RNA, 17 nt, Homo sapiens
gcccucggggccacggc

SEQ ID NO: 20812 - RNA, 18 nt, Homo sapiens
uacauaacaucuguuuua

SEQ ID NO: 20813 - RNA, 17 nt, Homo sapiens
ucuaaauauucuuccau

SEQ ID NO: 20814 - RNA, 21 nt, Homo sapiens
ugaaugacagacaccauauuc

SEQ ID NO: 20815 - RNA, 19 nt, Homo sapiens
ugcagacuuuccagcugac

SEQ ID NO: 20816 - RNA, 21 nt, Homo sapiens
uuuuauggugauaaauuacau

SEQ ID NO: 20817 - RNA, 17 nt, Homo sapiens
caaaauauauuugcaaa

SEQ ID NO: 20818 - RNA, 18 nt, Homo sapiens
cuugaugccagcagaagu

SEQ ID NO: 20819 - RNA, 16 nt, Homo sapiens
gaggggugggggccgg

SEQ ID NO: 20820 - RNA, 21 nt, Homo sapiens
gcgcggggcgcggggugcugc

SEQ ID NO: 20821 - RNA, 17 nt, Homo sapiens
ggcgcggggcgcggggu

SEQ ID NO: 20822 - RNA, 19 nt, Homo sapiens
ggugggggccgggcgcgcg

SEQ ID NO: 20823 - RNA, 20 nt, Homo sapiens
ucgcuuuuguucuuagacac

SEQ ID NO: 20824 - RNA, 22 nt, Homo sapiens
aggcucguugggagcugauggg

SEQ ID NO: 20825 - RNA, 16 nt, Homo sapiens
caccgcgccgcguccc

SEQ ID NO: 20826 - RNA, 19 nt, Homo sapiens
caccuggggcuccggcagc

SEQ ID NO: 20827 - RNA, 20 nt, Homo sapiens
ccggagugagccgggggccg

SEQ ID NO: 20828 - RNA, 18 nt, Homo sapiens
cuggucaccuggggcucc

SEQ ID NO: 20829 - RNA, 18 nt, Homo sapiens
gaagaggggguaggauua

SEQ ID NO: 20830 - RNA, 18 nt, Homo sapiens
gaggaggagcgaaggggg

SEQ ID NO: 20831 - RNA, 19 nt, Homo sapiens
gauggcauugcccuggccc

SEQ ID NO: 20832 - RNA, 17 nt, Homo sapiens
gcucguugggagcugau

SEQ ID NO: 20833 - RNA, 18 nt, Homo sapiens
ggaggagagggcgugggg

SEQ ID NO: 20834 - RNA, 17 nt, Homo sapiens
ggcucugggcccuggcu

SEQ ID NO: 20835 - RNA, 23 nt, Homo sapiens
gggccgcgccgccccaccgcgcc

SEQ ID NO: 20836 - RNA, 19 nt, Homo sapiens
ggggaggagagggcguggg

SEQ ID NO: 20837 - RNA, 20 nt, Homo sapiens
uccgccccagcccuuggggc

SEQ ID NO: 20838 - RNA, 23 nt, Homo sapiens
ugagauagguuucugccucccac

SEQ ID NO: 20839 - RNA, 19 nt, Homo sapiens
ugcuuugaagaggggguag

SEQ ID NO: 20840 - RNA, 17 nt, Homo sapiens
aggcgggcuuucacaug

SEQ ID NO: 20841 - RNA, 21 nt, Homo sapiens
auacauagagaaucuaagcuu

SEQ ID NO: 20842 - RNA, 21 nt, Homo sapiens
caauagaggagaaucucaugu

SEQ ID NO: 20843 - RNA, 16 nt, Homo sapiens
cacaaaugugcuguug

SEQ ID NO: 20844 - RNA, 14 nt, Homo sapiens
cacauggccgggug

SEQ ID NO: 20845 - RNA, 18 nt, Homo sapiens
caucaugucccguuuugc

SEQ ID NO: 20846 - RNA, 18 nt, Homo sapiens
cauucuuaauguacuaag

SEQ ID NO: 20847 - RNA, 18 nt, Homo sapiens
cauuuugaucucuuccca

SEQ ID NO: 20848 - RNA, 21 nt, Homo sapiens
ccaaggguuuucaccagguga

SEQ ID NO: 20849 - RNA, 20 nt, Homo sapiens
ccucccuguucccacucccc

SEQ ID NO: 20850 - RNA, 21 nt, Homo sapiens
cggugaaccgcuccgcgcacc

SEQ ID NO: 20851 - RNA, 17 nt, Homo sapiens
cuguagacuuuccacac

SEQ ID NO: 20852 - RNA, 18 nt, Homo sapiens
gcgggcuuucacauggcc

SEQ ID NO: 20853 - RNA, 17 nt, Homo sapiens
gucacaucaugucccgu

SEQ ID NO: 20854 - RNA, 18 nt, Homo sapiens
uaagcuuguguccaggcu

SEQ ID NO: 20855 - RNA, 18 nt, Homo sapiens
uauuguccaugguaagga

SEQ ID NO: 20856 - RNA, 18 nt, Homo sapiens
ugagagguuucagcauug

SEQ ID NO: 20857 - RNA, 21 nt, Homo sapiens
uggugguuuucugccccuccc

SEQ ID NO: 20858 - RNA, 19 nt, Homo sapiens
ugguuugagccuccccaac

SEQ ID NO: 20859 - RNA, 19 nt, Homo sapiens
uguucugacugccccccuu

SEQ ID NO: 20860 - RNA, 19 nt, Homo sapiens
uuuuucguuuuuuugcuuu

SEQ ID NO: 20861 - RNA, 21 nt, Homo sapiens
acacgacacgacccgcccccc

SEQ ID NO: 20862 - RNA, 23 nt, Homo sapiens
acccauugggggcggagggggag

SEQ ID NO: 20863 - RNA, 20 nt, Homo sapiens
cacagcguucacccuccaca

SEQ ID NO: 20864 - RNA, 22 nt, Homo sapiens
caggcacgcaguuaaugucugc

SEQ ID NO: 20865 - RNA, 19 nt, Homo sapiens
ccgcaccccucugcuccuu

SEQ ID NO: 20866 - RNA, 19 nt, Homo sapiens
gaggccucugccagcaagc

SEQ ID NO: 20867 - RNA, 20 nt, Homo sapiens
gagugcggcgcgacgcugac

SEQ ID NO: 20868 - RNA, 19 nt, Homo sapiens
ggagggcucgggguccuga

SEQ ID NO: 20869 - RNA, 18 nt, Homo sapiens
ggccccuguggcuggagc

SEQ ID NO: 20870 - RNA, 16 nt, Homo sapiens
gggacaguucugucuc

SEQ ID NO: 20871 - RNA, 18 nt, Homo sapiens
gggcuguggccccugugg

SEQ ID NO: 20872 - RNA, 19 nt, Homo sapiens
ucacagccugggugcagcc

SEQ ID NO: 20873 - RNA, 21 nt, Homo sapiens
ucgcaagccaguccuggggcc

SEQ ID NO: 20874 - RNA, 17 nt, Homo sapiens
ugaggcccaucgagacc

SEQ ID NO: 20875 - RNA, 19 nt, Homo sapiens
uguucccaucccgcuuucc

SEQ ID NO: 20876 - RNA, 19 nt, Homo sapiens
acuuugcagcuggugagaa

SEQ ID NO: 20877 - RNA, 22 nt, Homo sapiens
gcgccgccgccgccgccgccgg

SEQ ID NO: 20878 - RNA, 20 nt, Homo sapiens
gucccgcgcgccgacucgcg

SEQ ID NO: 20879 - RNA, 16 nt, Homo sapiens
acuaauccugucaguu

SEQ ID NO: 20880 - RNA, 22 nt, Homo sapiens
cagcagcuucugaggguggcaa

SEQ ID NO: 20881 - RNA, 18 nt, Homo sapiens
uaauuggugcacuauugc

SEQ ID NO: 20882 - RNA, 18 nt, Homo sapiens
uacauauagucaacgaaa

SEQ ID NO: 20883 - RNA, 20 nt, Homo sapiens
ucaacuggugcuacacaugc

SEQ ID NO: 20884 - RNA, 16 nt, Homo sapiens
ugaugccuacaguaac

SEQ ID NO: 20885 - RNA, 21 nt, Homo sapiens
uucaaguauuuuccuauuuga

SEQ ID NO: 20886 - RNA, 20 nt, Homo sapiens
caaucggaggggcggcccac

SEQ ID NO: 20887 - RNA, 18 nt, Homo sapiens
ggauaaacaaccagggaa

SEQ ID NO: 20888 - RNA, 24 nt, Homo sapiens
uaaguauuuucuucauaaauauuu

SEQ ID NO: 20889 - RNA, 19 nt, Homo sapiens
ccuuuucuucucuuucaau

SEQ ID NO: 20890 - RNA, 23 nt, Homo sapiens
cuuuuuuuuuuuuuuuuuugacu

SEQ ID NO: 20891 - RNA, 20 nt, Homo sapiens
acagccuuuagaacaacauu

SEQ ID NO: 20892 - RNA, 18 nt, Homo sapiens
ugccaaguuucaaaagau

SEQ ID NO: 20893 - RNA, 17 nt, Homo sapiens
uucagauucugauacag

SEQ ID NO: 20894 - RNA, 18 nt, Homo sapiens
uuuuucuuuccacggacu

SEQ ID NO: 20895 - RNA, 22 nt, Homo sapiens
cccgggcgcgacucucucaccu

SEQ ID NO: 20896 - RNA, 16 nt, Homo sapiens
uagguucuucucaccu

SEQ ID NO: 20897 - RNA, 20 nt, Homo sapiens
aggaggcagggcugggucgg

SEQ ID NO: 20898 - RNA, 21 nt, Homo sapiens
aggcgcgggcggaggaggccc

SEQ ID NO: 20899 - RNA, 18 nt, Homo sapiens
aggggaggggagaggagg

SEQ ID NO: 20900 - RNA, 19 nt, Homo sapiens
ccccggccccgcgcgggga

SEQ ID NO: 20901 - RNA, 17 nt, Homo sapiens
cggcggcggcgggcggg

SEQ ID NO: 20902 - RNA, 23 nt, Homo sapiens
cggcgguggcgcggggcgcgcgu

SEQ ID NO: 20903 - RNA, 19 nt, Homo sapiens
cugccgugccaggcaucgc

SEQ ID NO: 20904 - RNA, 25 nt, Homo sapiens
gaauccaggucuccuaccucuggug

SEQ ID NO: 20905 - RNA, 16 nt, Homo sapiens
gcagccguggcagcgg

SEQ ID NO: 20906 - RNA, 22 nt, Homo sapiens
gcucccaguuugucccaaaccc

SEQ ID NO: 20907 - RNA, 20 nt, Homo sapiens
ggccgggggccgcuggggag

SEQ ID NO: 20908 - RNA, 24 nt, Homo sapiens
ggcggcggcgggcgggaaggagcc

SEQ ID NO: 20909 - RNA, 20 nt, Homo sapiens
gggcggaggcgcgggcggag

SEQ ID NO: 20910 - RNA, 17 nt, Homo sapiens
ggggcgcgcguguccug

SEQ ID NO: 20911 - RNA, 19 nt, Homo sapiens
gugguaggguauugaggga

SEQ ID NO: 20912 - RNA, 18 nt, Homo sapiens
uccauuguccuccccccu

SEQ ID NO: 20913 - RNA, 17 nt, Homo sapiens
ucucggcggcggcgggc

SEQ ID NO: 20914 - RNA, 26 nt, Homo sapiens
ugggcaacuagagugugggguggggg

SEQ ID NO: 20915 - RNA, 20 nt, Homo sapiens
uguggggugggggcucccag

SEQ ID NO: 20916 - RNA, 18 nt, Homo sapiens
ccucaagcauaaagcaaa

SEQ ID NO: 20917 - RNA, 20 nt, Homo sapiens
uaauauauacacaaacuugg

SEQ ID NO: 20918 - RNA, 22 nt, Homo sapiens
ucccuguggaucuauacagugg

SEQ ID NO: 20919 - RNA, 19 nt, Homo sapiens
cugguccccuuuacccgcc

SEQ ID NO: 20920 - RNA, 21 nt, Homo sapiens
uccugguccccuuuacccgcc

SEQ ID NO: 20921 - RNA, 17 nt, Homo sapiens
uuaauuuagaaaggaag

SEQ ID NO: 20922 - RNA, 22 nt, Homo sapiens
uacaguuuuccucaucugcucu

SEQ ID NO: 20923 - RNA, 24 nt, Homo sapiens
uggugugaauggaagguuggucug

SEQ ID NO: 20924 - RNA, 18 nt, Homo sapiens
acgccgcccucccuuauu

SEQ ID NO: 20925 - RNA, 18 nt, Homo sapiens
agcagcggggggaggggg

SEQ ID NO: 20926 - RNA, 26 nt, Homo sapiens
cgccggggcugccggguggcggcgga

SEQ ID NO: 20927 - RNA, 19 nt, Homo sapiens
gccggagcugcgccggggc

SEQ ID NO: 20928 - RNA, 15 nt, Homo sapiens
gcgcggcggcggcgg

SEQ ID NO: 20929 - RNA, 22 nt, Homo sapiens
gcggcggggcggcgcauggggg

SEQ ID NO: 20930 - RNA, 17 nt, Homo sapiens
ggcugccggagcugcgc

SEQ ID NO: 20931 - RNA, 19 nt, Homo sapiens
gguggcggggcccgggcgg

SEQ ID NO: 20932 - RNA, 18 nt, Homo sapiens
uaaccauuuuuccuuuuc

SEQ ID NO: 20933 - RNA, 19 nt, Homo sapiens
ugaggaggggguggcgggg

SEQ ID NO: 20934 - RNA, 18 nt, Homo sapiens
ugcgggacgggugagagu

SEQ ID NO: 20935 - RNA, 18 nt, Homo sapiens
uguggcgcggcggcggcg

SEQ ID NO: 20936 - RNA, 18 nt, Homo sapiens
acccuuuggguccagggc

SEQ ID NO: 20937 - RNA, 19 nt, Homo sapiens
agggggagaguuauuggac

SEQ ID NO: 20938 - RNA, 16 nt, Homo sapiens
caccgggugccuacgc

SEQ ID NO: 20939 - RNA, 19 nt, Homo sapiens
ccguucccuagaacagcgg

SEQ ID NO: 20940 - RNA, 18 nt, Homo sapiens
ccucgccccaccuccucc

SEQ ID NO: 20941 - RNA, 17 nt, Homo sapiens
ccucuguggccugcucg

SEQ ID NO: 20942 - RNA, 19 nt, Homo sapiens
cgggcuggccccgagagcc

SEQ ID NO: 20943 - RNA, 15 nt, Homo sapiens
gcacgcgcuggaggc

SEQ ID NO: 20944 - RNA, 24 nt, Homo sapiens
gcagcggcgguggccucgugaccg

SEQ ID NO: 20945 - RNA, 20 nt, Homo sapiens
ggcgggcagcggcgguggcc

SEQ ID NO: 20946 - RNA, 15 nt, Homo sapiens
gucucaaguucucag

SEQ ID NO: 20947 - RNA, 22 nt, Homo sapiens
uaacagaugggggagacugaag

SEQ ID NO: 20948 - RNA, 23 nt, Homo sapiens
uacaaucuucuuuuucacacccc

SEQ ID NO: 20949 - RNA, 22 nt, Homo sapiens
ucaggggaucgucgcgggcugg

SEQ ID NO: 20950 - RNA, 22 nt, Homo sapiens
ucugaaagcugugaauggagcc

SEQ ID NO: 20951 - RNA, 18 nt, Homo sapiens
agcggcucgggcucggcc

SEQ ID NO: 20952 - RNA, 19 nt, Homo sapiens
agggagaaagaacucaccc

SEQ ID NO: 20953 - RNA, 18 nt, Homo sapiens
caccgggccgaagcgcag

SEQ ID NO: 20954 - RNA, 23 nt, Homo sapiens
cagccgcagccagggaaguggcg

SEQ ID NO: 20955 - RNA, 18 nt, Homo sapiens
ccauuuaggaaaggguac

SEQ ID NO: 20956 - RNA, 16 nt, Homo sapiens
cccccaccuuccuggc

SEQ ID NO: 20957 - RNA, 20 nt, Homo sapiens
ccccgggaauccgagcuggg

SEQ ID NO: 20958 - RNA, 18 nt, Homo sapiens
cccucccgccuagcggcu

SEQ ID NO: 20959 - RNA, 17 nt, Homo sapiens
ccgccgcuccugcaccc

SEQ ID NO: 20960 - RNA, 22 nt, Homo sapiens
ccggcuccgcuccggcagcggc

SEQ ID NO: 20961 - RNA, 17 nt, Homo sapiens
cgccggcggcccccgcc

SEQ ID NO: 20962 - RNA, 18 nt, Homo sapiens
cuucgccgccgcuccugc

SEQ ID NO: 20963 - RNA, 18 nt, Homo sapiens
gagaggugagauugcggc

SEQ ID NO: 20964 - RNA, 19 nt, Homo sapiens
gaggaaacgaacuuccuug

SEQ ID NO: 20965 - RNA, 16 nt, Homo sapiens
gcagaaaaaaauggaa

SEQ ID NO: 20966 - RNA, 22 nt, Homo sapiens
gccccgggccugucgcccugag

SEQ ID NO: 20967 - RNA, 20 nt, Homo sapiens
gccggccgcuguggccgcgu

SEQ ID NO: 20968 - RNA, 18 nt, Homo sapiens
gccggcggcccccgccac

SEQ ID NO: 20969 - RNA, 18 nt, Homo sapiens
gcggggagggggcggggg

SEQ ID NO: 20970 - RNA, 18 nt, Homo sapiens
gcuaaagcucgggcgugc

SEQ ID NO: 20971 - RNA, 22 nt, Homo sapiens
ggggagggggcgggggacugag

SEQ ID NO: 20972 - RNA, 25 nt, Homo sapiens
gguggggcgaggcgacaggggcggg

SEQ ID NO: 20973 - RNA, 17 nt, Homo sapiens
guuucucgcuagccggg

SEQ ID NO: 20974 - RNA, 19 nt, Homo sapiens
uccuccgcccccugcccga

SEQ ID NO: 20975 - RNA, 21 nt, Homo sapiens
ugggagaggugagauugcggc

SEQ ID NO: 20976 - RNA, 14 nt, Homo sapiens
uuccaauccugccu

SEQ ID NO: 20977 - RNA, 24 nt, Homo sapiens
uuggcgcccgcagccuugggccug

SEQ ID NO: 20978 - RNA, 21 nt, Homo sapiens
uuuucuuuuaagcacaaagca

SEQ ID NO: 20979 - RNA, 18 nt, Homo sapiens
agauggcacaagggcucu

SEQ ID NO: 20980 - RNA, 24 nt, Homo sapiens
aggagagacaggaagacagccaga

SEQ ID NO: 20981 - RNA, 18 nt, Homo sapiens
caaggcaccaggauucug

SEQ ID NO: 20982 - RNA, 18 nt, Homo sapiens
gagggagggccggguggc

SEQ ID NO: 20983 - RNA, 15 nt, Homo sapiens
gcuggagggagggcc

SEQ ID NO: 20984 - RNA, 20 nt, Homo sapiens
uacagcacucgauucuguac

SEQ ID NO: 20985 - RNA, 19 nt, Homo sapiens
uggcacaagggcucugggg

SEQ ID NO: 20986 - RNA, 19 nt, Homo sapiens
uguucugugggauuaaaac

SEQ ID NO: 20987 - RNA, 20 nt, Homo sapiens
acauaccacacaaauucaau

SEQ ID NO: 20988 - RNA, 18 nt, Homo sapiens
agcagagccggccucccg

SEQ ID NO: 20989 - RNA, 21 nt, Homo sapiens
caguuucuccaccacagcagu

SEQ ID NO: 20990 - RNA, 21 nt, Homo sapiens
ucagaaaaaaacacagaaaga

SEQ ID NO: 20991 - RNA, 18 nt, Homo sapiens
ugcgcggagaggcugagg

SEQ ID NO: 20992 - RNA, 15 nt, Homo sapiens
ccccucccgucugcc

SEQ ID NO: 20993 - RNA, 21 nt, Homo sapiens
gcuuccugaccucugugccca

SEQ ID NO: 20994 - RNA, 18 nt, Homo sapiens
gggccggaugccuggugg

SEQ ID NO: 20995 - RNA, 17 nt, Homo sapiens
gucucggggaccacagg

SEQ ID NO: 20996 - RNA, 19 nt, Homo sapiens
ggcaaaguagaaaacaacc

SEQ ID NO: 20997 - RNA, 18 nt, Homo sapiens
gucugugucacuuaaauu

SEQ ID NO: 20998 - RNA, 19 nt, Homo sapiens
uacuaaagaauuuguucau

SEQ ID NO: 20999 - RNA, 18 nt, Homo sapiens
agaggagggggagggcag

SEQ ID NO: 21000 - RNA, 18 nt, Homo sapiens
cacagucguccgugccuu

SEQ ID NO: 21001 - RNA, 17 nt, Homo sapiens
cagggcucagaucacaa

SEQ ID NO: 21002 - RNA, 17 nt, Homo sapiens
caguggcuaacugacga

SEQ ID NO: 21003 - RNA, 21 nt, Homo sapiens
ccggggccgaggccggugguc

SEQ ID NO: 21004 - RNA, 18 nt, Homo sapiens
gaggggcgcuccggccug

SEQ ID NO: 21005 - RNA, 19 nt, Homo sapiens
gcagaagugaaagcuggaa

SEQ ID NO: 21006 - RNA, 19 nt, Homo sapiens
gcggggcaggacucgcugc

SEQ ID NO: 21007 - RNA, 19 nt, Homo sapiens
gcggggugugggagggagc

SEQ ID NO: 21008 - RNA, 22 nt, Homo sapiens
gggcuacgcacacccugcucug

SEQ ID NO: 21009 - RNA, 24 nt, Homo sapiens
uauccagcgugggggcacguggcc

SEQ ID NO: 21010 - RNA, 21 nt, Homo sapiens
ucaccagacuccacccaaugg

SEQ ID NO: 21011 - RNA, 22 nt, Homo sapiens
ucuggguagacacgugggauga

SEQ ID NO: 21012 - RNA, 17 nt, Homo sapiens
uuguuugguucugaccc

SEQ ID NO: 21013 - RNA, 17 nt, Homo sapiens
uuugacuuucagaccau

SEQ ID NO: 21014 - RNA, 26 nt, Homo sapiens
agcuuuaaaugagucaaguauucugc

SEQ ID NO: 21015 - RNA, 18 nt, Homo sapiens
augcucuuuuucguacag

SEQ ID NO: 21016 - RNA, 22 nt, Homo sapiens
uaagaaaaaaaauacuagaaga

SEQ ID NO: 21017 - RNA, 18 nt, Homo sapiens
uuuugcauaauuuucaaa

SEQ ID NO: 21018 - RNA, 16 nt, Homo sapiens
uagaaaguuaaagggc

SEQ ID NO: 21019 - RNA, 18 nt, Homo sapiens
uuccucaucugacacugu

SEQ ID NO: 21020 - RNA, 23 nt, Homo sapiens
cagcacaugugcugggcaccagg

SEQ ID NO: 21021 - RNA, 19 nt, Homo sapiens
gcccugaggagcaagagac

SEQ ID NO: 21022 - RNA, 17 nt, Homo sapiens
ggagaguggcagccgga

SEQ ID NO: 21023 - RNA, 14 nt, Homo sapiens
gugcugggcaccag

SEQ ID NO: 21024 - RNA, 17 nt, Homo sapiens
uaagaaagugguucccu

SEQ ID NO: 21025 - RNA, 17 nt, Homo sapiens
uucgaaaacauaacaca

SEQ ID NO: 21026 - RNA, 20 nt, Homo sapiens
agcggccgguggguggggcg

SEQ ID NO: 21027 - RNA, 23 nt, Homo sapiens
aggcgaggugccgccuaggcagc

SEQ ID NO: 21028 - RNA, 18 nt, Homo sapiens
agggggcggaggaggagg

SEQ ID NO: 21029 - RNA, 16 nt, Homo sapiens
ccgccgccuccucagg

SEQ ID NO: 21030 - RNA, 20 nt, Homo sapiens
cgcgaggccgggaccgccgc

SEQ ID NO: 21031 - RNA, 18 nt, Homo sapiens
cgggcgcucccgcugggc

SEQ ID NO: 21032 - RNA, 21 nt, Homo sapiens
cugggcggccccggcgcgcug

SEQ ID NO: 21033 - RNA, 22 nt, Homo sapiens
gagcgcucugcagguguggugg

SEQ ID NO: 21034 - RNA, 22 nt, Homo sapiens
gaggagcggccggugggugggg

SEQ ID NO: 21035 - RNA, 15 nt, Homo sapiens
gaggaggaggguggg

SEQ ID NO: 21036 - RNA, 20 nt, Homo sapiens
gaggcggcgggggaggggag

SEQ ID NO: 21037 - RNA, 19 nt, Homo sapiens
gcaaggcgcggagggggcg

SEQ ID NO: 21038 - RNA, 20 nt, Homo sapiens
gccucgccgccugcgcucgg

SEQ ID NO: 21039 - RNA, 18 nt, Homo sapiens
gcgcgcgggcggcgaggc

SEQ ID NO: 21040 - RNA, 20 nt, Homo sapiens
gcgcucggggccccggcggc

SEQ ID NO: 21041 - RNA, 20 nt, Homo sapiens
gcggaggaggagggugggga

SEQ ID NO: 21042 - RNA, 18 nt, Homo sapiens
gcggcgggggaggggagg

SEQ ID NO: 21043 - RNA, 18 nt, Homo sapiens
gcgggggaggggaggggg

SEQ ID NO: 21044 - RNA, 19 nt, Homo sapiens
gcgggggaggggagggggc

SEQ ID NO: 21045 - RNA, 15 nt, Homo sapiens
gggagaggggaggag

SEQ ID NO: 21046 - RNA, 18 nt, Homo sapiens
gggaggagcggccggugg

SEQ ID NO: 21047 - RNA, 19 nt, Homo sapiens
gggagggcgcgagagcggc

SEQ ID NO: 21048 - RNA, 16 nt, Homo sapiens
ggggagaggggaggag

SEQ ID NO: 21049 - RNA, 17 nt, Homo sapiens
ggggagaggggaggagc

SEQ ID NO: 21050 - RNA, 19 nt, Homo sapiens
ggggagaggggaggagcgg

SEQ ID NO: 21051 - RNA, 19 nt, Homo sapiens
ggggaggagcggccggugg

SEQ ID NO: 21052 - RNA, 15 nt, Homo sapiens
ucacaugauaauguu

SEQ ID NO: 21053 - RNA, 18 nt, Homo sapiens
cgacugguaggcaguuac

SEQ ID NO: 21054 - RNA, 19 nt, Homo sapiens
gcuuccucccaagcuggag

SEQ ID NO: 21055 - RNA, 17 nt, Homo sapiens
gggcagaggagcgugug

SEQ ID NO: 21056 - RNA, 17 nt, Homo sapiens
uuuuugugagaaaaaga

SEQ ID NO: 21057 - RNA, 18 nt, Homo sapiens
aagggugucaggaggugg

SEQ ID NO: 21058 - RNA, 16 nt, Homo sapiens
agagaggcauagagag

SEQ ID NO: 21059 - RNA, 18 nt, Homo sapiens
ccggcgcggugggugcgc

SEQ ID NO: 21060 - RNA, 20 nt, Homo sapiens
ccuccaccccccgcccgguc

SEQ ID NO: 21061 - RNA, 17 nt, Homo sapiens
cggcgguggcggcgccg

SEQ ID NO: 21062 - RNA, 19 nt, Homo sapiens
gcgcggugggugcgcgcuc

SEQ ID NO: 21063 - RNA, 17 nt, Homo sapiens
gcuccgcgccgggccgg

SEQ ID NO: 21064 - RNA, 17 nt, Homo sapiens
ggaagagggugggagag

SEQ ID NO: 21065 - RNA, 21 nt, Homo sapiens
uagagaggcauagagagacca

SEQ ID NO: 21066 - RNA, 16 nt, Homo sapiens
uccggcgcggccacgg

SEQ ID NO: 21067 - RNA, 20 nt, Homo sapiens
ugccuaggagagugggagaa

SEQ ID NO: 21068 - RNA, 17 nt, Homo sapiens
aggggagguaaauucca

SEQ ID NO: 21069 - RNA, 21 nt, Homo sapiens
gggagcauggggcugggggac

SEQ ID NO: 21070 - RNA, 21 nt, Homo sapiens
ugggggacgggaagcaagcag

SEQ ID NO: 21071 - RNA, 19 nt, Homo sapiens
cagcaggcccaggagccgg

SEQ ID NO: 21072 - RNA, 22 nt, Homo sapiens
cagcaggcccaggagccggcuc

SEQ ID NO: 21073 - RNA, 18 nt, Homo sapiens
ccaggccggcccugaggc

SEQ ID NO: 21074 - RNA, 22 nt, Homo sapiens
gcgggggugggggcgucgaagg

SEQ ID NO: 21075 - RNA, 16 nt, Homo sapiens
ggaaucaaaacacauc

SEQ ID NO: 21076 - RNA, 18 nt, Homo sapiens
ggggcgggggugggggcg

SEQ ID NO: 21077 - RNA, 16 nt, Homo sapiens
gggguccagagcugac

SEQ ID NO: 21078 - RNA, 21 nt, Homo sapiens
ugaggcccuggagcagaggcc

SEQ ID NO: 21079 - RNA, 18 nt, Homo sapiens
uuggauaggaacacugac

SEQ ID NO: 21080 - RNA, 19 nt, Homo sapiens
agccaauuuuaauauacau

SEQ ID NO: 21081 - RNA, 19 nt, Homo sapiens
aggaggccggcagggccgg

SEQ ID NO: 21082 - RNA, 20 nt, Homo sapiens
auguacaguacugcagcaua

SEQ ID NO: 21083 - RNA, 22 nt, Homo sapiens
ccgcccgcgccggacccggccg

SEQ ID NO: 21084 - RNA, 18 nt, Homo sapiens
ccgccgcccuccgucugc

SEQ ID NO: 21085 - RNA, 18 nt, Homo sapiens
ccgcggccgccgcccucc

SEQ ID NO: 21086 - RNA, 20 nt, Homo sapiens
cgggagccgggcagcgcugc

SEQ ID NO: 21087 - RNA, 19 nt, Homo sapiens
gccgcccuggccgcggccg

SEQ ID NO: 21088 - RNA, 17 nt, Homo sapiens
gcgccgggggcccgcgg

SEQ ID NO: 21089 - RNA, 20 nt, Homo sapiens
gggcagcgcugcgccggggg

SEQ ID NO: 21090 - RNA, 19 nt, Homo sapiens
uauguacaguacugcagca

SEQ ID NO: 21091 - RNA, 18 nt, Homo sapiens
ccugccugguuucuaucc

SEQ ID NO: 21092 - RNA, 17 nt, Homo sapiens
acucugcccuuauuuua

SEQ ID NO: 21093 - RNA, 18 nt, Homo sapiens
agcagcaguggcagcagc

SEQ ID NO: 21094 - RNA, 22 nt, Homo sapiens
ccuucugucggcacaccugucc

SEQ ID NO: 21095 - RNA, 17 nt, Homo sapiens
ccuuuugcuggguggcg

SEQ ID NO: 21096 - RNA, 22 nt, Homo sapiens
ccuuuugcuggguggcguccua

SEQ ID NO: 21097 - RNA, 21 nt, Homo sapiens
cgcccucuguggaggacuugg

SEQ ID NO: 21098 - RNA, 20 nt, Homo sapiens
cugcugugucuuccuguggu

SEQ ID NO: 21099 - RNA, 19 nt, Homo sapiens
guuugugucagcucuaacu

SEQ ID NO: 21100 - RNA, 21 nt, Homo sapiens
uggaggacuuggucugugggc

SEQ ID NO: 21101 - RNA, 19 nt, Homo sapiens
uuuaucggggauguuuggg

SEQ ID NO: 21102 - RNA, 16 nt, Homo sapiens
aggaggcguggggggg

SEQ ID NO: 21103 - RNA, 21 nt, Homo sapiens
cagcucggugagucccggcag

SEQ ID NO: 21104 - RNA, 14 nt, Homo sapiens
cagggcccugcacc

SEQ ID NO: 21105 - RNA, 16 nt, Homo sapiens
cgccgcgcaccggagc

SEQ ID NO: 21106 - RNA, 18 nt, Homo sapiens
cgucggccgccgcgcacc

SEQ ID NO: 21107 - RNA, 22 nt, Homo sapiens
gagcggcggcgaggggcgggag

SEQ ID NO: 21108 - RNA, 22 nt, Homo sapiens
gagggcccccgggccgcuccgc

SEQ ID NO: 21109 - RNA, 19 nt, Homo sapiens
gccgcuccgcgcgggcgcc

SEQ ID NO: 21110 - RNA, 16 nt, Homo sapiens
gcgccgguggcgcgcc

SEQ ID NO: 21111 - RNA, 18 nt, Homo sapiens
gcgggaggaggggaggag

SEQ ID NO: 21112 - RNA, 20 nt, Homo sapiens
ggaggacagaguuucacucg

SEQ ID NO: 21113 - RNA, 18 nt, Homo sapiens
ggcgaggggcgggagcac

SEQ ID NO: 21114 - RNA, 19 nt, Homo sapiens
ggcgggaggaggggaggag

SEQ ID NO: 21115 - RNA, 18 nt, Homo sapiens
gggaggaggggaggaggc

SEQ ID NO: 21116 - RNA, 18 nt, Homo sapiens
gggcgggagcacgcgcgg

SEQ ID NO: 21117 - RNA, 24 nt, Homo sapiens
ggggaggaggcguggggggggggc

SEQ ID NO: 21118 - RNA, 16 nt, Homo sapiens
ucggccgccgcgcacc

SEQ ID NO: 21119 - RNA, 18 nt, Homo sapiens
ucugaacuugaacaagac

SEQ ID NO: 21120 - RNA, 17 nt, Homo sapiens
ucugucuuuaaggagug

SEQ ID NO: 21121 - RNA, 21 nt, Homo sapiens
acaaagcucugagcccgcccc

SEQ ID NO: 21122 - RNA, 18 nt, Homo sapiens
caaccagaggccugcugc

SEQ ID NO: 21123 - RNA, 16 nt, Homo sapiens
caagugacaaagcucu

SEQ ID NO: 21124 - RNA, 21 nt, Homo sapiens
cuguggagugauccagggaag

SEQ ID NO: 21125 - RNA, 18 nt, Homo sapiens
agaaggggcgcucggggu

SEQ ID NO: 21126 - RNA, 24 nt, Homo sapiens
ccgcuucgccuucuccgcugcugc

SEQ ID NO: 21127 - RNA, 24 nt, Homo sapiens
ccucgcccccgccggccgcuucgc

SEQ ID NO: 21128 - RNA, 18 nt, Homo sapiens
gggaagaaggggcgcucg

SEQ ID NO: 21129 - RNA, 21 nt, Homo sapiens
gggggcaggggaggccaggca

SEQ ID NO: 21130 - RNA, 18 nt, Homo sapiens
gugcgugaacgaggcggc

SEQ ID NO: 21131 - RNA, 23 nt, Homo sapiens
ucgcccccgccggccgcuucgcc

SEQ ID NO: 21132 - RNA, 19 nt, Homo sapiens
ucgccuucuccgcugcugc

SEQ ID NO: 21133 - RNA, 21 nt, Homo sapiens
ucugggaagaaggggcgcucg

SEQ ID NO: 21134 - RNA, 19 nt, Homo sapiens
cuaggagugggcaagguau

SEQ ID NO: 21135 - RNA, 26 nt, Homo sapiens
uacaaaaauugaacugaguuaaaagg

SEQ ID NO: 21136 - RNA, 20 nt, Homo sapiens
uguacaaucacugaugaggu

SEQ ID NO: 21137 - RNA, 18 nt, Homo sapiens
uuuaaaacugcucagucu

SEQ ID NO: 21138 - RNA, 19 nt, Homo sapiens
caccuguggguauguauaa

SEQ ID NO: 21139 - RNA, 19 nt, Homo sapiens
gggcuuguggucgcgaggg

SEQ ID NO: 21140 - RNA, 19 nt, Homo sapiens
uaacccuaaugcucacuuc

SEQ ID NO: 21141 - RNA, 22 nt, Homo sapiens
ucgcagccggggccgcggccgg

SEQ ID NO: 21142 - RNA, 20 nt, Homo sapiens
agagcagguauauugggcug

SEQ ID NO: 21143 - RNA, 19 nt, Homo sapiens
agcagguauauugggcugg

SEQ ID NO: 21144 - RNA, 20 nt, Homo sapiens
auaggauaggaguuuccacc

SEQ ID NO: 21145 - RNA, 16 nt, Homo sapiens
ccacgcggcgggcgga

SEQ ID NO: 21146 - RNA, 19 nt, Homo sapiens
cccugccccgccccugccc

SEQ ID NO: 21147 - RNA, 15 nt, Homo sapiens
ccggccccuccggcu

SEQ ID NO: 21148 - RNA, 17 nt, Homo sapiens
ccggccgcuccgagccc

SEQ ID NO: 21149 - RNA, 17 nt, Homo sapiens
ccggggccgggaacgac

SEQ ID NO: 21150 - RNA, 19 nt, Homo sapiens
ccugcccgcgaccacgcgg

SEQ ID NO: 21151 - RNA, 20 nt, Homo sapiens
cgcccggcucagaccucccg

SEQ ID NO: 21152 - RNA, 17 nt, Homo sapiens
gagaacaugguccugau

SEQ ID NO: 21153 - RNA, 16 nt, Homo sapiens
gcccaccugcccgcga

SEQ ID NO: 21154 - RNA, 20 nt, Homo sapiens
ggccagaggagggugacuuc

SEQ ID NO: 21155 - RNA, 17 nt, Homo sapiens
ggcugcagaccggccug

SEQ ID NO: 21156 - RNA, 16 nt, Homo sapiens
gggcacggggaugggu

SEQ ID NO: 21157 - RNA, 19 nt, Homo sapiens
gggccgggaacgacgaggg

SEQ ID NO: 21158 - RNA, 21 nt, Homo sapiens
ggguggggggccggggccggg

SEQ ID NO: 21159 - RNA, 14 nt, Homo sapiens
guuuggaugucaau

SEQ ID NO: 21160 - RNA, 23 nt, Homo sapiens
uaaaauauccaucuauguggauu

SEQ ID NO: 21161 - RNA, 17 nt, Homo sapiens
uacugcagauggcugga

SEQ ID NO: 21162 - RNA, 18 nt, Homo sapiens
uagaaguccuauaaagau

SEQ ID NO: 21163 - RNA, 20 nt, Homo sapiens
uccaauaauuugccucccuu

SEQ ID NO: 21164 - RNA, 19 nt, Homo sapiens
ugagcuuaguuguucagaa

SEQ ID NO: 21165 - RNA, 19 nt, Homo sapiens
uggggggccggggccggga

SEQ ID NO: 21166 - RNA, 19 nt, Homo sapiens
uguagagaucaaguaaaau

SEQ ID NO: 21167 - RNA, 17 nt, Homo sapiens
ugucuacuaccugcugu

SEQ ID NO: 21168 - RNA, 20 nt, Homo sapiens
uguuacauggacuauaguac

SEQ ID NO: 21169 - RNA, 19 nt, Homo sapiens
uguucagaagugugguuuu

SEQ ID NO: 21170 - RNA, 18 nt, Homo sapiens
uguuggauuucuucagca

SEQ ID NO: 21171 - RNA, 23 nt, Homo sapiens
uuaaaguacagggagcaauaguc

SEQ ID NO: 21172 - RNA, 25 nt, Homo sapiens
uuauauauuuuaguucccagacaua

SEQ ID NO: 21173 - RNA, 17 nt, Homo sapiens
uugauauaaaccaccau

SEQ ID NO: 21174 - RNA, 19 nt, Homo sapiens
aaaggagggauacaacuag

SEQ ID NO: 21175 - RNA, 22 nt, Homo sapiens
agccauuagucagaugucuggg

SEQ ID NO: 21176 - RNA, 16 nt, Homo sapiens
aggggcggaggggcuu

SEQ ID NO: 21177 - RNA, 17 nt, Homo sapiens
ccagaucaaaaauacca

SEQ ID NO: 21178 - RNA, 19 nt, Homo sapiens
gauuacaggagugugccac

SEQ ID NO: 21179 - RNA, 17 nt, Homo sapiens
gccgcggaccugggcgc

SEQ ID NO: 21180 - RNA, 18 nt, Homo sapiens
ggggcuuggcgccgacag

SEQ ID NO: 21181 - RNA, 18 nt, Homo sapiens
uuguacauauuccuucug

SEQ ID NO: 21182 - RNA, 18 nt, Homo sapiens
agcacaccgcaccggcag

SEQ ID NO: 21183 - RNA, 18 nt, Homo sapiens
ccccggccucgccguucc

SEQ ID NO: 21184 - RNA, 16 nt, Homo sapiens
ccgcaccggcagcgcc

SEQ ID NO: 21185 - RNA, 22 nt, Homo sapiens
ccggccucgccguuccuucccc

SEQ ID NO: 21186 - RNA, 23 nt, Homo sapiens
uauacaauauauuuauaguauua

SEQ ID NO: 21187 - RNA, 20 nt, Homo sapiens
uggagaggcuguggaguccc

SEQ ID NO: 21188 - RNA, 19 nt, Homo sapiens
gugggugcggcgcccucgc

SEQ ID NO: 21189 - RNA, 23 nt, Homo sapiens
agguggcuauuugguccccccag

SEQ ID NO: 21190 - RNA, 18 nt, Homo sapiens
ccuuggagagaagagugg

SEQ ID NO: 21191 - RNA, 20 nt, Homo sapiens
ucuacaacaguuuuuuuuuu

SEQ ID NO: 21192 - RNA, 14 nt, Homo sapiens
uuugguccccccag

SEQ ID NO: 21193 - RNA, 21 nt, Homo sapiens
aggggucuggaguggccaccu

SEQ ID NO: 21194 - RNA, 18 nt, Homo sapiens
cccuggccccgcgcgucg

SEQ ID NO: 21195 - RNA, 22 nt, Homo sapiens
cuuuagggguggcucugagggu

SEQ ID NO: 21196 - RNA, 20 nt, Homo sapiens
gcagcccaaagcagggcugc

SEQ ID NO: 21197 - RNA, 22 nt, Homo sapiens
gcagggagggcugagcgggaag

SEQ ID NO: 21198 - RNA, 19 nt, Homo sapiens
gccaccuggccaugcccug

SEQ ID NO: 21199 - RNA, 22 nt, Homo sapiens
gggaaggggcgccugggaggag

SEQ ID NO: 21200 - RNA, 19 nt, Homo sapiens
gggccugugggagccaggg

SEQ ID NO: 21201 - RNA, 19 nt, Homo sapiens
gguccgcuggcucgguggc

SEQ ID NO: 21202 - RNA, 19 nt, Homo sapiens
gguugaagggaggggcagg

SEQ ID NO: 21203 - RNA, 20 nt, Homo sapiens
ugcccugugccaggcugucg

SEQ ID NO: 21204 - RNA, 19 nt, Homo sapiens
cacauuuaaauuauuccau

SEQ ID NO: 21205 - RNA, 19 nt, Homo sapiens
gaaauuagucauggaagga

SEQ ID NO: 21206 - RNA, 25 nt, Homo sapiens
ggggcggugaggugggguugguggg

SEQ ID NO: 21207 - RNA, 20 nt, Homo sapiens
ucuaccacagauaucuuucc

SEQ ID NO: 21208 - RNA, 19 nt, Homo sapiens
ugaggugggguuggugggg

SEQ ID NO: 21209 - RNA, 22 nt, Homo sapiens
agugaaagggaagguagaacac

SEQ ID NO: 21210 - RNA, 19 nt, Homo sapiens
cgcagagcggagcuggagc

SEQ ID NO: 21211 - RNA, 17 nt, Homo sapiens
gcggagguggcagcggc

SEQ ID NO: 21212 - RNA, 22 nt, Homo sapiens
uaaaauauagacuaccaagaaa

SEQ ID NO: 21213 - RNA, 18 nt, Homo sapiens
uauuauacuacaacagcc

SEQ ID NO: 21214 - RNA, 21 nt, Homo sapiens
uguguagcaccaaacuaacau

SEQ ID NO: 21215 - RNA, 19 nt, Homo sapiens
uuuaauauuuauuuauuuu

SEQ ID NO: 21216 - RNA, 21 nt, Homo sapiens
aguagaaagaaaaacagaaag

SEQ ID NO: 21217 - RNA, 18 nt, Homo sapiens
cacuugauguucagguga

SEQ ID NO: 21218 - RNA, 19 nt, Homo sapiens
uacaugacaugcauuuggu

SEQ ID NO: 21219 - RNA, 21 nt, Homo sapiens
uaucacuugauguucagguga

SEQ ID NO: 21220 - RNA, 21 nt, Homo sapiens
ugaauaacuuggauaaaguga

SEQ ID NO: 21221 - RNA, 25 nt, Homo sapiens
aacugcuuuguuuguuuagacacua

SEQ ID NO: 21222 - RNA, 20 nt, Homo sapiens
auugaaauucuuaacaaaau

SEQ ID NO: 21223 - RNA, 22 nt, Homo sapiens
caaagacacugcgacgauuugg

SEQ ID NO: 21224 - RNA, 18 nt, Homo sapiens
cuuuguuuguuuagacac

SEQ ID NO: 21225 - RNA, 18 nt, Homo sapiens
uacguucccugaaauucc

SEQ ID NO: 21226 - RNA, 17 nt, Homo sapiens
uccugcuguagccagaa

SEQ ID NO: 21227 - RNA, 22 nt, Homo sapiens
uuaauggugaaccuauaacagu

SEQ ID NO: 21228 - RNA, 19 nt, Homo sapiens
uuguauaauccauugugaa

SEQ ID NO: 21229 - RNA, 18 nt, Homo sapiens
uuuguauaauccauugug

SEQ ID NO: 21230 - RNA, 18 nt, Homo sapiens
ucccagcaagccccgcgg

SEQ ID NO: 21231 - RNA, 26 nt, Homo sapiens
agagguuuuauuaguugcugguuugu

SEQ ID NO: 21232 - RNA, 18 nt, Homo sapiens
gaaacacuuuuauuucug

SEQ ID NO: 21233 - RNA, 21 nt, Homo sapiens
gcuggagcagaaggcggcccg

SEQ ID NO: 21234 - RNA, 18 nt, Homo sapiens
ggcugccgagagcuggcc

SEQ ID NO: 21235 - RNA, 16 nt, Homo sapiens
uacaggauggauugcu

SEQ ID NO: 21236 - RNA, 18 nt, Homo sapiens
cggcggcgggcgcggacu

SEQ ID NO: 21237 - RNA, 19 nt, Homo sapiens
ugcccuggccucuaccucc

SEQ ID NO: 21238 - RNA, 21 nt, Homo sapiens
agggucguuuaccgucgaacu

SEQ ID NO: 21239 - RNA, 19 nt, Homo sapiens
ucaucuuuacugagggcgu

SEQ ID NO: 21240 - RNA, 17 nt, Homo sapiens
uccuaucugugcaugcc

SEQ ID NO: 21241 - RNA, 21 nt, Homo sapiens
uuuauuauaauuucuccuuuu

SEQ ID NO: 21242 - RNA, 17 nt, Homo sapiens
cacacuuugacaaggag

SEQ ID NO: 21243 - RNA, 21 nt, Homo sapiens
agcgagcuucacgugcucagc

SEQ ID NO: 21244 - RNA, 21 nt, Homo sapiens
gaggcugcuguaucuucaccc

SEQ ID NO: 21245 - RNA, 20 nt, Homo sapiens
gcaggagcccccaggucccg

SEQ ID NO: 21246 - RNA, 17 nt, Homo sapiens
ggggggaguucaggagg

SEQ ID NO: 21247 - RNA, 16 nt, Homo sapiens
gggugggaggggggag

SEQ ID NO: 21248 - RNA, 18 nt, Homo sapiens
augcugcuccuguucuuu

SEQ ID NO: 21249 - RNA, 20 nt, Homo sapiens
gagccugcugcauucacacu

SEQ ID NO: 21250 - RNA, 18 nt, Homo sapiens
gcccuucaaaugaccaua

SEQ ID NO: 21251 - RNA, 16 nt, Homo sapiens
gcugcagcuccuccuc

SEQ ID NO: 21252 - RNA, 20 nt, Homo sapiens
gcugcagcuccuccucaggc

SEQ ID NO: 21253 - RNA, 18 nt, Homo sapiens
ggaaacccaagguccaag

SEQ ID NO: 21254 - RNA, 18 nt, Homo sapiens
ucuccaagccccgguccc

SEQ ID NO: 21255 - RNA, 21 nt, Homo sapiens
accguguucuguacaauacug

SEQ ID NO: 21256 - RNA, 18 nt, Homo sapiens
agagcuucgggccggggc

SEQ ID NO: 21257 - RNA, 20 nt, Homo sapiens
agugggcaaaauacacaugg

SEQ ID NO: 21258 - RNA, 20 nt, Homo sapiens
ccuguggggucucggcgggg

SEQ ID NO: 21259 - RNA, 17 nt, Homo sapiens
cgucguccucuucuccg

SEQ ID NO: 21260 - RNA, 16 nt, Homo sapiens
gcgcggggucgggcgc

SEQ ID NO: 21261 - RNA, 17 nt, Homo sapiens
gcgcggggucgggcgcc

SEQ ID NO: 21262 - RNA, 21 nt, Homo sapiens
gcuucgggccggggcgcgggg

SEQ ID NO: 21263 - RNA, 19 nt, Homo sapiens
ggaggcagcagaaauggag

SEQ ID NO: 21264 - RNA, 21 nt, Homo sapiens
gggccggggcgcggggucggg

SEQ ID NO: 21265 - RNA, 18 nt, Homo sapiens
ugccuccucgcugccuuu

SEQ ID NO: 21266 - RNA, 19 nt, Homo sapiens
uuuacaaauaggaccaaca

SEQ ID NO: 21267 - RNA, 18 nt, Homo sapiens
aacagacaggugagaggc

SEQ ID NO: 21268 - RNA, 19 nt, Homo sapiens
agcugggaggcaauccugg

SEQ ID NO: 21269 - RNA, 24 nt, Homo sapiens
agcugggccaccacacagcccggg

SEQ ID NO: 21270 - RNA, 23 nt, Homo sapiens
aggcagcugggaggcaauccugg

SEQ ID NO: 21271 - RNA, 18 nt, Homo sapiens
aggcucauguucaaagcc

SEQ ID NO: 21272 - RNA, 16 nt, Homo sapiens
cacuggggaccugcag

SEQ ID NO: 21273 - RNA, 20 nt, Homo sapiens
gagcauuagaagcccugcca

SEQ ID NO: 21274 - RNA, 18 nt, Homo sapiens
gccaccacacagcccggg

SEQ ID NO: 21275 - RNA, 22 nt, Homo sapiens
gggaccugcagccccugcccug

SEQ ID NO: 21276 - RNA, 18 nt, Homo sapiens
gguuucuggaaacuuccc

SEQ ID NO: 21277 - RNA, 17 nt, Homo sapiens
ucuaaaaagagaagccc

SEQ ID NO: 21278 - RNA, 25 nt, Homo sapiens
ugaaucugugcucugguauuugugu

SEQ ID NO: 21279 - RNA, 17 nt, Homo sapiens
ugugagaacucucucuc

SEQ ID NO: 21280 - RNA, 18 nt, Homo sapiens
uugaaaagagaauuagaa

SEQ ID NO: 21281 - RNA, 17 nt, Homo sapiens
ccuguucccagucaggc

SEQ ID NO: 21282 - RNA, 24 nt, Homo sapiens
gggguggcugcuggucggcugugg

SEQ ID NO: 21283 - RNA, 24 nt, Homo sapiens
aaggccucgguggucucaccucag

SEQ ID NO: 21284 - RNA, 21 nt, Homo sapiens
accuugucgccgacugucaac

SEQ ID NO: 21285 - RNA, 26 nt, Homo sapiens
caccagguccaugcugggcagcuggg

SEQ ID NO: 21286 - RNA, 17 nt, Homo sapiens
cacuauggcuaacaaau

SEQ ID NO: 21287 - RNA, 18 nt, Homo sapiens
cagggccccaugaagacc

SEQ ID NO: 21288 - RNA, 22 nt, Homo sapiens
ccagacacuuucugacccagcc

SEQ ID NO: 21289 - RNA, 18 nt, Homo sapiens
cugcugugguuggggcuc

SEQ ID NO: 21290 - RNA, 20 nt, Homo sapiens
gcaccccuggccaccagcuc

SEQ ID NO: 21291 - RNA, 17 nt, Homo sapiens
gcauggcauggugacua

SEQ ID NO: 21292 - RNA, 18 nt, Homo sapiens
ggacacaaaggacuuggg

SEQ ID NO: 21293 - RNA, 22 nt, Homo sapiens
gggcuggggugggggcucuggg

SEQ ID NO: 21294 - RNA, 17 nt, Homo sapiens
ggggugggggcucuggg

SEQ ID NO: 21295 - RNA, 23 nt, Homo sapiens
uaacuccccucuguacacagaga

SEQ ID NO: 21296 - RNA, 22 nt, Homo sapiens
ucacacuucacaaagccaacug

SEQ ID NO: 21297 - RNA, 19 nt, Homo sapiens
ugacauggauacaacggcc

SEQ ID NO: 21298 - RNA, 26 nt, Homo sapiens
ugcacaugaauggaaggcugugcugc

SEQ ID NO: 21299 - RNA, 17 nt, Homo sapiens
uggggcucugacagaug

SEQ ID NO: 21300 - RNA, 19 nt, Homo sapiens
acuuccugcucgagacccg

SEQ ID NO: 21301 - RNA, 22 nt, Homo sapiens
cuucugcugggaacgaccuuuc

SEQ ID NO: 21302 - RNA, 23 nt, Homo sapiens
uggcagaccuccaagcuuguugu

SEQ ID NO: 21303 - RNA, 14 nt, Homo sapiens
ugacauacuguguc

SEQ ID NO: 21304 - RNA, 19 nt, Homo sapiens
ugcuucacaaacaucaaca

SEQ ID NO: 21305 - RNA, 22 nt, Homo sapiens
ugucaguuucccauuguuuugc

SEQ ID NO: 21306 - RNA, 21 nt, Homo sapiens
agccaacccgugggggcugcc

SEQ ID NO: 21307 - RNA, 24 nt, Homo sapiens
cuagaaauuuuauccucaauauag

SEQ ID NO: 21308 - RNA, 21 nt, Homo sapiens
gccguugucaccgcacacugg

SEQ ID NO: 21309 - RNA, 18 nt, Homo sapiens
gucaauucagaacauucc

SEQ ID NO: 21310 - RNA, 16 nt, Homo sapiens
uaccaggaaacagaag

SEQ ID NO: 21311 - RNA, 19 nt, Homo sapiens
uauagcaaaugaaacaggc

SEQ ID NO: 21312 - RNA, 17 nt, Homo sapiens
ucgcugcugggacucca

SEQ ID NO: 21313 - RNA, 22 nt, Homo sapiens
ucucucgguucaucuuggggcc

SEQ ID NO: 21314 - RNA, 23 nt, Homo sapiens
uuagaaaauggcagcgcuauucc

SEQ ID NO: 21315 - RNA, 22 nt, Homo sapiens
aaaaaaguccaggaaaggcauu

SEQ ID NO: 21316 - RNA, 19 nt, Homo sapiens
caggaagccaucuaccaua

SEQ ID NO: 21317 - RNA, 20 nt, Homo sapiens
gaauucacauuuugauucca

SEQ ID NO: 21318 - RNA, 23 nt, Homo sapiens
uaaaacaacauuuaauguagauu

SEQ ID NO: 21319 - RNA, 20 nt, Homo sapiens
cagccucagaaggcuggggc

SEQ ID NO: 21320 - RNA, 18 nt, Homo sapiens
gccugauggggccuggaa

SEQ ID NO: 21321 - RNA, 21 nt, Homo sapiens
ggggaggggagggcccucagc

SEQ ID NO: 21322 - RNA, 15 nt, Homo sapiens
guggaggugaguggg

SEQ ID NO: 21323 - RNA, 21 nt, Homo sapiens
uggaagccuggggcaggaggg

SEQ ID NO: 21324 - RNA, 19 nt, Homo sapiens
aaaaaaaacuuaucucuuu

SEQ ID NO: 21325 - RNA, 18 nt, Homo sapiens
aggaugcugcgccugccu

SEQ ID NO: 21326 - RNA, 18 nt, Homo sapiens
aggcggagagaaaaaaaa

SEQ ID NO: 21327 - RNA, 23 nt, Homo sapiens
aggggggcaggggagccaguggg

SEQ ID NO: 21328 - RNA, 19 nt, Homo sapiens
auuuccccacaguucauuu

SEQ ID NO: 21329 - RNA, 20 nt, Homo sapiens
caggagauacugacuaguuc

SEQ ID NO: 21330 - RNA, 17 nt, Homo sapiens
ccagccuuucucaggga

SEQ ID NO: 21331 - RNA, 19 nt, Homo sapiens
ccgcgacaaaauggugccu

SEQ ID NO: 21332 - RNA, 19 nt, Homo sapiens
cuggucccgcccgcccgcc

SEQ ID NO: 21333 - RNA, 18 nt, Homo sapiens
ggaaaaaaaaauggugga

SEQ ID NO: 21334 - RNA, 18 nt, Homo sapiens
ggagaggggggcagggga

SEQ ID NO: 21335 - RNA, 17 nt, Homo sapiens
gggggcaggggagccag

SEQ ID NO: 21336 - RNA, 24 nt, Homo sapiens
ucagaaguucaagucaacuaugga

SEQ ID NO: 21337 - RNA, 19 nt, Homo sapiens
ucccuagccaaauucucag

SEQ ID NO: 21338 - RNA, 18 nt, Homo sapiens
ucccuuucauugaaaaac

SEQ ID NO: 21339 - RNA, 16 nt, Homo sapiens
ugaggaggagacgggg

SEQ ID NO: 21340 - RNA, 19 nt, Homo sapiens
ugcaguggcgagauggcag

SEQ ID NO: 21341 - RNA, 19 nt, Homo sapiens
uggaagaauuacuguuagc

SEQ ID NO: 21342 - RNA, 17 nt, Homo sapiens
uggggagaugcccaaca

SEQ ID NO: 21343 - RNA, 21 nt, Homo sapiens
uuagcuggcagcuuucaauuc

SEQ ID NO: 21344 - RNA, 22 nt, Homo sapiens
caaccgccggucucccagcggc

SEQ ID NO: 21345 - RNA, 18 nt, Homo sapiens
ccccacggcaaccgccgg

SEQ ID NO: 21346 - RNA, 18 nt, Homo sapiens
cccgcgguccgccggcgc

SEQ ID NO: 21347 - RNA, 19 nt, Homo sapiens
ccgcgcaggcgcagggccc

SEQ ID NO: 21348 - RNA, 17 nt, Homo sapiens
gccgccucucgccgggu

SEQ ID NO: 21349 - RNA, 22 nt, Homo sapiens
ggggaagggccuggggcggggg

SEQ ID NO: 21350 - RNA, 21 nt, Homo sapiens
cgugggguggggcggggagcc

SEQ ID NO: 21351 - RNA, 21 nt, Homo sapiens
gaauggauggcccaggcccag

SEQ ID NO: 21352 - RNA, 18 nt, Homo sapiens
gcgcggggcggggcgggc

SEQ ID NO: 21353 - RNA, 19 nt, Homo sapiens
gcgcggggcggggcgggcg

SEQ ID NO: 21354 - RNA, 16 nt, Homo sapiens
gcggggcgggcgcccg

SEQ ID NO: 21355 - RNA, 21 nt, Homo sapiens
gcggggcgggcgcccguggcu

SEQ ID NO: 21356 - RNA, 22 nt, Homo sapiens
guggaacaaaauggaauggaug

SEQ ID NO: 21357 - RNA, 22 nt, Homo sapiens
aguuaccaaugcuucaacaauu

SEQ ID NO: 21358 - RNA, 16 nt, Homo sapiens
auuggucaauccaguu

SEQ ID NO: 21359 - RNA, 18 nt, Homo sapiens
cacaaugcccauuaaucu

SEQ ID NO: 21360 - RNA, 18 nt, Homo sapiens
cauguuaaauagaaugcu

SEQ ID NO: 21361 - RNA, 20 nt, Homo sapiens
ccccaccccaauccccuucc

SEQ ID NO: 21362 - RNA, 18 nt, Homo sapiens
gcugguaaagacagagau

SEQ ID NO: 21363 - RNA, 18 nt, Homo sapiens
uaaaugcucaugagcucu

SEQ ID NO: 21364 - RNA, 16 nt, Homo sapiens
uaaguggcuuuaaugg

SEQ ID NO: 21365 - RNA, 18 nt, Homo sapiens
ucaacauuauaaauauga

SEQ ID NO: 21366 - RNA, 20 nt, Homo sapiens
auacaugggggaaaaaucaa

SEQ ID NO: 21367 - RNA, 24 nt, Homo sapiens
ggguagacuuaggagccgggcgcc

SEQ ID NO: 21368 - RNA, 19 nt, Homo sapiens
agcagcaccuacuaugaca

SEQ ID NO: 21369 - RNA, 22 nt, Homo sapiens
caaggaaaacuugucagcucca

SEQ ID NO: 21370 - RNA, 20 nt, Homo sapiens
caucuaagacacugccuggc

SEQ ID NO: 21371 - RNA, 20 nt, Homo sapiens
ccucagggcuggcagccgga

SEQ ID NO: 21372 - RNA, 18 nt, Homo sapiens
cugccacuggcuggggcu

SEQ ID NO: 21373 - RNA, 16 nt, Homo sapiens
gacagccagcuggggc

SEQ ID NO: 21374 - RNA, 20 nt, Homo sapiens
ggcaacccuagccacacacu

SEQ ID NO: 21375 - RNA, 24 nt, Homo sapiens
uaagacacugccuggcagcucuuc

SEQ ID NO: 21376 - RNA, 14 nt, Homo sapiens
ugaaucaauagcag

SEQ ID NO: 21377 - RNA, 19 nt, Homo sapiens
aaccccuagagaaaucaaa

SEQ ID NO: 21378 - RNA, 24 nt, Homo sapiens
cauuugguaugucacugaaaaccu

SEQ ID NO: 21379 - RNA, 22 nt, Homo sapiens
ccucgccccgccauguccuucc

SEQ ID NO: 21380 - RNA, 19 nt, Homo sapiens
ugguaugaaggccauucug

SEQ ID NO: 21381 - RNA, 23 nt, Homo sapiens
aaguggcagggguuaggagcagg

SEQ ID NO: 21382 - RNA, 17 nt, Homo sapiens
cacaaucuuggugguuu

SEQ ID NO: 21383 - RNA, 18 nt, Homo sapiens
cacccugucagccccugc

SEQ ID NO: 21384 - RNA, 25 nt, Homo sapiens
cagccgcccucccggcaccgcagcg

SEQ ID NO: 21385 - RNA, 19 nt, Homo sapiens
ccugcccagccgcccuccc

SEQ ID NO: 21386 - RNA, 20 nt, Homo sapiens
cucuguuuggggaauguuca

SEQ ID NO: 21387 - RNA, 24 nt, Homo sapiens
cugaucccuagaaagucaccugcc

SEQ ID NO: 21388 - RNA, 16 nt, Homo sapiens
gcccagccgcccuccc

SEQ ID NO: 21389 - RNA, 18 nt, Homo sapiens
gcuggggagggaguuggg

SEQ ID NO: 21390 - RNA, 18 nt, Homo sapiens
ggcaccgcagcggccgcc

SEQ ID NO: 21391 - RNA, 21 nt, Homo sapiens
ggugacauggcagcccagagg

SEQ ID NO: 21392 - RNA, 20 nt, Homo sapiens
ugaacugaagccuggcccag

SEQ ID NO: 21393 - RNA, 18 nt, Homo sapiens
uggcagcaaagggaaggg

SEQ ID NO: 21394 - RNA, 17 nt, Homo sapiens
uggcccugagaugcugg

SEQ ID NO: 21395 - RNA, 19 nt, Homo sapiens
aaaaacaaaagcccacaga

SEQ ID NO: 21396 - RNA, 24 nt, Homo sapiens
gcgcggcgugucaggcugcggccg

SEQ ID NO: 21397 - RNA, 16 nt, Homo sapiens
gcuauuugcagcacau

SEQ ID NO: 21398 - RNA, 15 nt, Homo sapiens
ggggccgcgcggcgg

SEQ ID NO: 21399 - RNA, 22 nt, Homo sapiens
cagcgccaggugcaaugucugg

SEQ ID NO: 21400 - RNA, 16 nt, Homo sapiens
caggugcaaugucugg

SEQ ID NO: 21401 - RNA, 17 nt, Homo sapiens
acgcgggggcggugccg

SEQ ID NO: 21402 - RNA, 21 nt, Homo sapiens
cucggcaggugacagcuaaga

SEQ ID NO: 21403 - RNA, 20 nt, Homo sapiens
gccgucgccaccgcccauga

SEQ ID NO: 21404 - RNA, 19 nt, Homo sapiens
gcugggcacaggccugagg

SEQ ID NO: 21405 - RNA, 22 nt, Homo sapiens
gggcugcccaguuucugcccug

SEQ ID NO: 21406 - RNA, 20 nt, Homo sapiens
gguggaggggugggcugagc

SEQ ID NO: 21407 - RNA, 19 nt, Homo sapiens
accuagcccaagggguugc

SEQ ID NO: 21408 - RNA, 23 nt, Homo sapiens
agggguugcuccuggggccggag

SEQ ID NO: 21409 - RNA, 18 nt, Homo sapiens
cacgccccgcuggcugcc

SEQ ID NO: 21410 - RNA, 19 nt, Homo sapiens
cagguggcagcagccaggg

SEQ ID NO: 21411 - RNA, 20 nt, Homo sapiens
ccagagggacaccugggguc

SEQ ID NO: 21412 - RNA, 21 nt, Homo sapiens
gcuccucgcugugcacacugc

SEQ ID NO: 21413 - RNA, 19 nt, Homo sapiens
gggaggauggcaagggcag

SEQ ID NO: 21414 - RNA, 18 nt, Homo sapiens
ucaagaaggcaacacgga

SEQ ID NO: 21415 - RNA, 17 nt, Homo sapiens
ugggagggcagcccagc

SEQ ID NO: 21416 - RNA, 23 nt, Homo sapiens
uuggaguggcccaccuggagugg

SEQ ID NO: 21417 - RNA, 18 nt, Homo sapiens
cucccaguuacuccggag

SEQ ID NO: 21418 - RNA, 16 nt, Homo sapiens
gaacccaggaggcgga

SEQ ID NO: 21419 - RNA, 18 nt, Homo sapiens
uguaaaguggugacacug

SEQ ID NO: 21420 - RNA, 25 nt, Homo sapiens
gguaggggaaaggggguugcggucc

SEQ ID NO: 21421 - RNA, 18 nt, Homo sapiens
cuccuggggucuucuucc

SEQ ID NO: 21422 - RNA, 19 nt, Homo sapiens
gcuccuggccuccuucucc

SEQ ID NO: 21423 - RNA, 20 nt, Homo sapiens
ggcuccuggccuccuucucc

SEQ ID NO: 21424 - RNA, 18 nt, Homo sapiens
uggagaugucccgagggc

SEQ ID NO: 21425 - RNA, 17 nt, Homo sapiens
aucuucugauaagauuu

SEQ ID NO: 21426 - RNA, 18 nt, Homo sapiens
caaggcagaaauggcccc

SEQ ID NO: 21427 - RNA, 20 nt, Homo sapiens
ccgugccuggggugggccac

SEQ ID NO: 21428 - RNA, 16 nt, Homo sapiens
gagccgugccuggggu

SEQ ID NO: 21429 - RNA, 23 nt, Homo sapiens
ucuaaccaaguuuccuaaauagg

SEQ ID NO: 21430 - RNA, 20 nt, Homo sapiens
ugggccguguccccacagcu

SEQ ID NO: 21431 - RNA, 19 nt, Homo sapiens
uggguguccuuguagugac

SEQ ID NO: 21432 - RNA, 24 nt, Homo sapiens
aucacuuucuuuaguaauaagaca

SEQ ID NO: 21433 - RNA, 18 nt, Homo sapiens
caccgccuguggcccggc

SEQ ID NO: 21434 - RNA, 19 nt, Homo sapiens
ccuucuguucccucucagu

SEQ ID NO: 21435 - RNA, 14 nt, Homo sapiens
cuguucccucucag

SEQ ID NO: 21436 - RNA, 19 nt, Homo sapiens
uacaaaauacaauugcaug

SEQ ID NO: 21437 - RNA, 21 nt, Homo sapiens
agaggagaaggcagucgcugg

SEQ ID NO: 21438 - RNA, 16 nt, Homo sapiens
auuuaugcuuuaagga

SEQ ID NO: 21439 - RNA, 20 nt, Homo sapiens
gccccuggagcugggugcag

SEQ ID NO: 21440 - RNA, 18 nt, Homo sapiens
ggagggggcugccuccuc

SEQ ID NO: 21441 - RNA, 20 nt, Homo sapiens
ggggugaguggggacccaca

SEQ ID NO: 21442 - RNA, 19 nt, Homo sapiens
guuuuguuucaaguuuaga

SEQ ID NO: 21443 - RNA, 19 nt, Homo sapiens
ugguggguggucaauggcu

SEQ ID NO: 21444 - RNA, 21 nt, Homo sapiens
aaggacacagacaguacggga

SEQ ID NO: 21445 - RNA, 17 nt, Homo sapiens
cacuugugucucucucu

SEQ ID NO: 21446 - RNA, 20 nt, Homo sapiens
ggaagaggcagggcgguggg

SEQ ID NO: 21447 - RNA, 18 nt, Homo sapiens
ggccucggggugagguuc

SEQ ID NO: 21448 - RNA, 21 nt, Homo sapiens
ggcggcggcggcaggcggcgg

SEQ ID NO: 21449 - RNA, 21 nt, Homo sapiens
guuuggaugagguccucaaug

SEQ ID NO: 21450 - RNA, 16 nt, Homo sapiens
uaggacuagcugcagg

SEQ ID NO: 21451 - RNA, 21 nt, Homo sapiens
uauuauguacugugcucuaac

SEQ ID NO: 21452 - RNA, 20 nt, Homo sapiens
uccuuuuuaaaacaggucuc

SEQ ID NO: 21453 - RNA, 20 nt, Homo sapiens
uggcacaacagggcuucaca

SEQ ID NO: 21454 - RNA, 22 nt, Homo sapiens
acaugugacuuuauacauuuua

SEQ ID NO: 21455 - RNA, 16 nt, Homo sapiens
caagaagagaagaagu

SEQ ID NO: 21456 - RNA, 22 nt, Homo sapiens
gccaugaugacagccucaaaag

SEQ ID NO: 21457 - RNA, 21 nt, Homo sapiens
ucaaaagcuccucacugccuc

SEQ ID NO: 21458 - RNA, 24 nt, Homo sapiens
uguagucgucaugcuguagagucu

SEQ ID NO: 21459 - RNA, 19 nt, Homo sapiens
ugugaacuguguccuugga

SEQ ID NO: 21460 - RNA, 26 nt, Homo sapiens
ugugacuuuauacauuuuacauuugu

SEQ ID NO: 21461 - RNA, 18 nt, Homo sapiens
aaggccaacacuguccuc

SEQ ID NO: 21462 - RNA, 18 nt, Homo sapiens
ccccggcugccggcgcau

SEQ ID NO: 21463 - RNA, 18 nt, Homo sapiens
cccggagccgcuccccgg

SEQ ID NO: 21464 - RNA, 21 nt, Homo sapiens
gagaagcccugggcagccugg

SEQ ID NO: 21465 - RNA, 19 nt, Homo sapiens
ugagaaaguggcguucucu

SEQ ID NO: 21466 - RNA, 18 nt, Homo sapiens
uguccucuaaguuuccag

SEQ ID NO: 21467 - RNA, 17 nt, Homo sapiens
acugucaccaaaauaca

SEQ ID NO: 21468 - RNA, 17 nt, Homo sapiens
ccuggcugcggccggcg

SEQ ID NO: 21469 - RNA, 20 nt, Homo sapiens
ccuggguguggugacgggcg

SEQ ID NO: 21470 - RNA, 20 nt, Homo sapiens
cgcgggcuccgcgaggccgg

SEQ ID NO: 21471 - RNA, 27 nt, Homo sapiens
gacuucaaacguuaaggccuucgaaaa

SEQ ID NO: 21472 - RNA, 19 nt, Homo sapiens
ggacgcgcaggaagggguc

SEQ ID NO: 21473 - RNA, 18 nt, Homo sapiens
ggccuggggcggggccgg

SEQ ID NO: 21474 - RNA, 19 nt, Homo sapiens
uaaggccaggucuagaauc

SEQ ID NO: 21475 - RNA, 23 nt, Homo sapiens
uacaaaaauuaccuggguguggu

SEQ ID NO: 21476 - RNA, 18 nt, Homo sapiens
ugccacaguucaccagca

SEQ ID NO: 21477 - RNA, 23 nt, Homo sapiens
ugccuguaaucucagcacuuugg

SEQ ID NO: 21478 - RNA, 17 nt, Homo sapiens
uugggaggccgaggcgg

SEQ ID NO: 21479 - RNA, 22 nt, Homo sapiens
acuggcccggggaaaagucacc

SEQ ID NO: 21480 - RNA, 17 nt, Homo sapiens
agggggugcaaagagga

SEQ ID NO: 21481 - RNA, 22 nt, Homo sapiens
auguuuccaggguucaguggag

SEQ ID NO: 21482 - RNA, 22 nt, Homo sapiens
cgggaacgcccgacuggccugg

SEQ ID NO: 21483 - RNA, 18 nt, Homo sapiens
gcccggggaaaagucacc

SEQ ID NO: 21484 - RNA, 17 nt, Homo sapiens
ggauccacagagcaggc

SEQ ID NO: 21485 - RNA, 20 nt, Homo sapiens
uaaguguggggauucaucug

SEQ ID NO: 21486 - RNA, 18 nt, Homo sapiens
uguguccacauuagccac

SEQ ID NO: 21487 - RNA, 19 nt, Homo sapiens
uuguuugggguuuugauuu

SEQ ID NO: 21488 - RNA, 20 nt, Homo sapiens
aacaacauaauagucaggau

SEQ ID NO: 21489 - RNA, 20 nt, Homo sapiens
acaggugugagccaccacgc

SEQ ID NO: 21490 - RNA, 26 nt, Homo sapiens
caacaagccagcaacaaacacaacug

SEQ ID NO: 21491 - RNA, 21 nt, Homo sapiens
caaguguauauggcugguucu

SEQ ID NO: 21492 - RNA, 20 nt, Homo sapiens
cuggcacauacucuuaguac

SEQ ID NO: 21493 - RNA, 22 nt, Homo sapiens
cuggugucuuuugguuagugua

SEQ ID NO: 21494 - RNA, 22 nt, Homo sapiens
gcgccguccgcugcguucggaa

SEQ ID NO: 21495 - RNA, 16 nt, Homo sapiens
gcuaggguccuccgag

SEQ ID NO: 21496 - RNA, 20 nt, Homo sapiens
uaacacacaaauguuaucug

SEQ ID NO: 21497 - RNA, 21 nt, Homo sapiens
uagagauggagucucacuuug

SEQ ID NO: 21498 - RNA, 20 nt, Homo sapiens
uauagaaaauaucaagcauc

SEQ ID NO: 21499 - RNA, 18 nt, Homo sapiens
uauuuugugugugcuuuc

SEQ ID NO: 21500 - RNA, 19 nt, Homo sapiens
uguaaccauuacacagcag

SEQ ID NO: 21501 - RNA, 14 nt, Homo sapiens
uuuccuggcacaua

SEQ ID NO: 21502 - RNA, 22 nt, Homo sapiens
uuuuaauuaucuauuuuuauac

SEQ ID NO: 21503 - RNA, 21 nt, Homo sapiens
agagaccagggggccgggggc

SEQ ID NO: 21504 - RNA, 19 nt, Homo sapiens
agggugggguggcaagggg

SEQ ID NO: 21505 - RNA, 18 nt, Homo sapiens
cagaguggcgcuggccug

SEQ ID NO: 21506 - RNA, 20 nt, Homo sapiens
ccggggcuggccgcgcccgg

SEQ ID NO: 21507 - RNA, 18 nt, Homo sapiens
cuagggcugcguucucua

SEQ ID NO: 21508 - RNA, 17 nt, Homo sapiens
gcccucaggucacacca

SEQ ID NO: 21509 - RNA, 16 nt, Homo sapiens
gccuuuggaggaggag

SEQ ID NO: 21510 - RNA, 16 nt, Homo sapiens
ggcagacagaggaggc

SEQ ID NO: 21511 - RNA, 18 nt, Homo sapiens
ggcaggccucuguccccg

SEQ ID NO: 21512 - RNA, 18 nt, Homo sapiens
gggaaggggcgggagggg

SEQ ID NO: 21513 - RNA, 16 nt, Homo sapiens
gggcggcgcaccaggc

SEQ ID NO: 21514 - RNA, 17 nt, Homo sapiens
ggggccgggggcagccu

SEQ ID NO: 21515 - RNA, 21 nt, Homo sapiens
gugaagggcagacagaggagg

SEQ ID NO: 21516 - RNA, 18 nt, Homo sapiens
ugggcagaagagccagca

SEQ ID NO: 21517 - RNA, 24 nt, Homo sapiens
uggugcuggugaccuuccccgggc

SEQ ID NO: 21518 - RNA, 24 nt, Homo sapiens
uguauguguagcagggugagguau

SEQ ID NO: 21519 - RNA, 20 nt, Homo sapiens
agcacgggagccacggagcg

SEQ ID NO: 21520 - RNA, 18 nt, Homo sapiens
agcgggaggagggaggga

SEQ ID NO: 21521 - RNA, 19 nt, Homo sapiens
agcgggaggagggagggag

SEQ ID NO: 21522 - RNA, 17 nt, Homo sapiens
aggagggagggaggagc

SEQ ID NO: 21523 - RNA, 14 nt, Homo sapiens
agggaccugggcug

SEQ ID NO: 21524 - RNA, 21 nt, Homo sapiens
ccgccggggccgcgggccggg

SEQ ID NO: 21525 - RNA, 21 nt, Homo sapiens
ccuccagcccccgccccuccc

SEQ ID NO: 21526 - RNA, 21 nt, Homo sapiens
gaggagcgagcgcggcguggg

SEQ ID NO: 21527 - RNA, 16 nt, Homo sapiens
gcgggggcgcugcugc

SEQ ID NO: 21528 - RNA, 20 nt, Homo sapiens
gggaggagggagggaggagc

SEQ ID NO: 21529 - RNA, 23 nt, Homo sapiens
gggcugugcugaucccgcgggcc

SEQ ID NO: 21530 - RNA, 22 nt, Homo sapiens
aagcaaaaaacaaaagaaaaca

SEQ ID NO: 21531 - RNA, 19 nt, Homo sapiens
cgcgcggcgggcgcgcccg

SEQ ID NO: 21532 - RNA, 19 nt, Homo sapiens
gcacggccgccgcuggucc

SEQ ID NO: 21533 - RNA, 16 nt, Homo sapiens
gguccugcacgccgcc

SEQ ID NO: 21534 - RNA, 21 nt, Homo sapiens
uacauauauauuuauauauau

SEQ ID NO: 21535 - RNA, 24 nt, Homo sapiens
uauacauauauauuuauauauaua

SEQ ID NO: 21536 - RNA, 24 nt, Homo sapiens
uauauauacauauauauuuauaua

SEQ ID NO: 21537 - RNA, 18 nt, Homo sapiens
uauauauauacauauaua

SEQ ID NO: 21538 - RNA, 19 nt, Homo sapiens
uauauauauacauauauau

SEQ ID NO: 21539 - RNA, 25 nt, Homo sapiens
uauauauuuauauauauaaaauaua

SEQ ID NO: 21540 - RNA, 25 nt, Homo sapiens
uauauuuauauauauaaaauauaua

SEQ ID NO: 21541 - RNA, 16 nt, Homo sapiens
ucccaugccuggcauc

SEQ ID NO: 21542 - RNA, 16 nt, Homo sapiens
ucccgcagaacauucu

SEQ ID NO: 21543 - RNA, 24 nt, Homo sapiens
ugagaagugccaccccaaagaaaa

SEQ ID NO: 21544 - RNA, 19 nt, Homo sapiens
ugggcccagcaggcucaga

SEQ ID NO: 21545 - RNA, 24 nt, Homo sapiens
ugucgguuuccuuugauguccugc

SEQ ID NO: 21546 - RNA, 21 nt, Homo sapiens
ucgaggacgguguucacuagu

SEQ ID NO: 21547 - RNA, 17 nt, Homo sapiens
uuuaguagcgguauuaa

SEQ ID NO: 21548 - RNA, 17 nt, Homo sapiens
cauuucuccuuaguaca

SEQ ID NO: 21549 - RNA, 23 nt, Homo sapiens
ccucagcuuggccucgucucccc

SEQ ID NO: 21550 - RNA, 20 nt, Homo sapiens
ggccugcagagaaauggucc

SEQ ID NO: 21551 - RNA, 18 nt, Homo sapiens
ggugccccucuagugggc

SEQ ID NO: 21552 - RNA, 15 nt, Homo sapiens
uguaguggggcagca

SEQ ID NO: 21553 - RNA, 24 nt, Homo sapiens
aggagaaacaggaaaaaaggugcc

SEQ ID NO: 21554 - RNA, 21 nt, Homo sapiens
ccguggcucggcccuuccucg

SEQ ID NO: 21555 - RNA, 21 nt, Homo sapiens
cucgccucugguuggccgggu

SEQ ID NO: 21556 - RNA, 21 nt, Homo sapiens
gaggaaacgagucagcaaccc

SEQ ID NO: 21557 - RNA, 17 nt, Homo sapiens
gccccacaguccguggc

SEQ ID NO: 21558 - RNA, 18 nt, Homo sapiens
ggaggaaacgagucagca

SEQ ID NO: 21559 - RNA, 15 nt, Homo sapiens
ucccaaccccagcgg

SEQ ID NO: 21560 - RNA, 15 nt, Homo sapiens
uggccgaggcugggc

SEQ ID NO: 21561 - RNA, 22 nt, Homo sapiens
cgggggcggcggggccggggcc

SEQ ID NO: 21562 - RNA, 16 nt, Homo sapiens
cucccggggggagggg

SEQ ID NO: 21563 - RNA, 19 nt, Homo sapiens
gagggaggagagagggcac

SEQ ID NO: 21564 - RNA, 16 nt, Homo sapiens
gccgggggcggcgggg

SEQ ID NO: 21565 - RNA, 21 nt, Homo sapiens
gcgcgagacgcacaaagaggg

SEQ ID NO: 21566 - RNA, 23 nt, Homo sapiens
gggccgggggcggcggggccggg

SEQ ID NO: 21567 - RNA, 18 nt, Homo sapiens
gggcgggccgggggcggc

SEQ ID NO: 21568 - RNA, 18 nt, Homo sapiens
ggggcgggccgggggcgg

SEQ ID NO: 21569 - RNA, 23 nt, Homo sapiens
gggggcgggccgggggcggcggg

SEQ ID NO: 21570 - RNA, 19 nt, Homo sapiens
ggguggcuauggcaccuug

SEQ ID NO: 21571 - RNA, 21 nt, Homo sapiens
cgccgccgccgcugccgcccg

SEQ ID NO: 21572 - RNA, 19 nt, Homo sapiens
gauggauagccacaaagca

SEQ ID NO: 21573 - RNA, 15 nt, Homo sapiens
ccuuucccucagcgg

SEQ ID NO: 21574 - RNA, 17 nt, Homo sapiens
ugccuggggccggcucc

SEQ ID NO: 21575 - RNA, 19 nt, Homo sapiens
agggaggggaaaggggggg

SEQ ID NO: 21576 - RNA, 19 nt, Homo sapiens
cugugucccauaucugcau

SEQ ID NO: 21577 - RNA, 22 nt, Homo sapiens
gcgcugggggcuccgggccggg

SEQ ID NO: 21578 - RNA, 16 nt, Homo sapiens
guguugggggcaguca

SEQ ID NO: 21579 - RNA, 22 nt, Homo sapiens
uccagaaucucccaggaugaua

SEQ ID NO: 21580 - RNA, 23 nt, Homo sapiens
gggaccaggggaagggggaggag

SEQ ID NO: 21581 - RNA, 20 nt, Homo sapiens
gggauccgggacccgggccu

SEQ ID NO: 21582 - RNA, 21 nt, Homo sapiens
uacucuuuuuuaacaaacagc

SEQ ID NO: 21583 - RNA, 19 nt, Homo sapiens
gccuaggugggagggagcc

SEQ ID NO: 21584 - RNA, 17 nt, Homo sapiens
ggccggccuagguggga

SEQ ID NO: 21585 - RNA, 20 nt, Homo sapiens
uccguuuccccgauaguauu

SEQ ID NO: 21586 - RNA, 24 nt, Homo sapiens
caagagcgcaggcgcaagggaccg

SEQ ID NO: 21587 - RNA, 16 nt, Homo sapiens
cauggggugggggcug

SEQ ID NO: 21588 - RNA, 23 nt, Homo sapiens
ccucuccugaaggacagacgguc

SEQ ID NO: 21589 - RNA, 23 nt, Homo sapiens
ggggugggggcugucaggggugg

SEQ ID NO: 21590 - RNA, 16 nt, Homo sapiens
gugggggcugucaggg

SEQ ID NO: 21591 - RNA, 21 nt, Homo sapiens
uggggugggggcugucagggg

SEQ ID NO: 21592 - RNA, 22 nt, Homo sapiens
aaagaugcaaacaguuuuaguc

SEQ ID NO: 21593 - RNA, 20 nt, Homo sapiens
agccggcggggcggccgggg

SEQ ID NO: 21594 - RNA, 19 nt, Homo sapiens
ccgcgcgcguccgggcggc

SEQ ID NO: 21595 - RNA, 19 nt, Homo sapiens
ccuccgggugcgcucggcg

SEQ ID NO: 21596 - RNA, 21 nt, Homo sapiens
cggcggcggcgaggccgggcg

SEQ ID NO: 21597 - RNA, 27 nt, Homo sapiens
cgggcggcgggcgcgccgggcgcggcg

SEQ ID NO: 21598 - RNA, 21 nt, Homo sapiens
gcccgcgcgcguccgggcggc

SEQ ID NO: 21599 - RNA, 15 nt, Homo sapiens
gcgcaggggcggccg

SEQ ID NO: 21600 - RNA, 22 nt, Homo sapiens
gcggcugcgggaggccagggcg

SEQ ID NO: 21601 - RNA, 20 nt, Homo sapiens
ggggcggccggggccgggag

SEQ ID NO: 21602 - RNA, 18 nt, Homo sapiens
uccgcggagccggcgggg

SEQ ID NO: 21603 - RNA, 18 nt, Homo sapiens
aaggggaauuuacacugg

SEQ ID NO: 21604 - RNA, 23 nt, Homo sapiens
accccagcuuccccucauuuccc

SEQ ID NO: 21605 - RNA, 18 nt, Homo sapiens
agacguguccauggcgaa

SEQ ID NO: 21606 - RNA, 15 nt, Homo sapiens
cuggccccccuuugc

SEQ ID NO: 21607 - RNA, 18 nt, Homo sapiens
gcaaucuggaggggcagg

SEQ ID NO: 21608 - RNA, 21 nt, Homo sapiens
ggcgguuccuauuuauauucg

SEQ ID NO: 21609 - RNA, 16 nt, Homo sapiens
uacccuugagcaggcc

SEQ ID NO: 21610 - RNA, 19 nt, Homo sapiens
ucaaaaccguaaaucacgg

SEQ ID NO: 21611 - RNA, 22 nt, Homo sapiens
ugaagggggcagggaaacaugg

SEQ ID NO: 21612 - RNA, 17 nt, Homo sapiens
ugcauuuccccaggggg

SEQ ID NO: 21613 - RNA, 17 nt, Homo sapiens
ugccagcuagugagcug

SEQ ID NO: 21614 - RNA, 17 nt, Homo sapiens
uggagagcugcgccggc

SEQ ID NO: 21615 - RNA, 21 nt, Homo sapiens
uguuguuuccuuccacucuuc

SEQ ID NO: 21616 - RNA, 21 nt, Homo sapiens
gguauagaugggagccaaaca

SEQ ID NO: 21617 - RNA, 19 nt, Homo sapiens
gacuacaggcaugcgccac

SEQ ID NO: 21618 - RNA, 23 nt, Homo sapiens
ucgaacuccugaccucaggugau

SEQ ID NO: 21619 - RNA, 22 nt, Homo sapiens
ugucacucagcccccuccaugu

SEQ ID NO: 21620 - RNA, 18 nt, Homo sapiens
ccucucccccucccccug

SEQ ID NO: 21621 - RNA, 22 nt, Homo sapiens
gagggagggagggagaggcccu

SEQ ID NO: 21622 - RNA, 18 nt, Homo sapiens
ggcuucccccucuccccc

SEQ ID NO: 21623 - RNA, 17 nt, Homo sapiens
ggggagaauugaggagc

SEQ ID NO: 21624 - RNA, 22 nt, Homo sapiens
gucaagaaccaaccuuucaugg

SEQ ID NO: 21625 - RNA, 23 nt, Homo sapiens
ugugagagcagcccagccacacc

SEQ ID NO: 21626 - RNA, 16 nt, Homo sapiens
acacuucgaccuucug

SEQ ID NO: 21627 - RNA, 18 nt, Homo sapiens
cacucuguguucagguga

SEQ ID NO: 21628 - RNA, 19 nt, Homo sapiens
cacuggcuguccaggccug

SEQ ID NO: 21629 - RNA, 20 nt, Homo sapiens
cagcagcagcuguagaagcg

SEQ ID NO: 21630 - RNA, 17 nt, Homo sapiens
cccgcaguggacguucu

SEQ ID NO: 21631 - RNA, 19 nt, Homo sapiens
cucgccguuuucuaucugg

SEQ ID NO: 21632 - RNA, 21 nt, Homo sapiens
gccggcccgcaguggacguuc

SEQ ID NO: 21633 - RNA, 18 nt, Homo sapiens
ggggagcagacuggugcu

SEQ ID NO: 21634 - RNA, 22 nt, Homo sapiens
gguccccucccugcaguaugcc

SEQ ID NO: 21635 - RNA, 21 nt, Homo sapiens
ugaggagagggaagggcacga

SEQ ID NO: 21636 - RNA, 20 nt, Homo sapiens
caauuuugucugcuuaugua

SEQ ID NO: 21637 - RNA, 21 nt, Homo sapiens
caaaagaaaugaaauuaaaga

SEQ ID NO: 21638 - RNA, 18 nt, Homo sapiens
cuuguuuuucccuauucu

SEQ ID NO: 21639 - RNA, 21 nt, Homo sapiens
ggcaaaaauaaagguacgcac

SEQ ID NO: 21640 - RNA, 21 nt, Homo sapiens
ucucucugucucucuggggcc

SEQ ID NO: 21641 - RNA, 20 nt, Homo sapiens
ucucuuaguuuauggauuuc

SEQ ID NO: 21642 - RNA, 16 nt, Homo sapiens
caacaugguggcaugu

SEQ ID NO: 21643 - RNA, 18 nt, Homo sapiens
cacuugccagcacccccc

SEQ ID NO: 21644 - RNA, 20 nt, Homo sapiens
gcuggacagaggcucuucug

SEQ ID NO: 21645 - RNA, 20 nt, Homo sapiens
ggaucaccuuuuucaaagcc

SEQ ID NO: 21646 - RNA, 19 nt, Homo sapiens
ggcuggacagaggcucuuc

SEQ ID NO: 21647 - RNA, 16 nt, Homo sapiens
gggcccaccaggacag

SEQ ID NO: 21648 - RNA, 18 nt, Homo sapiens
uggugagggccacacggc

SEQ ID NO: 21649 - RNA, 18 nt, Homo sapiens
agaaaauaaaaauauuuu

SEQ ID NO: 21650 - RNA, 21 nt, Homo sapiens
agcaagcuuauggaaugacaa

SEQ ID NO: 21651 - RNA, 18 nt, Homo sapiens
uggaguccgugacagguc

SEQ ID NO: 21652 - RNA, 22 nt, Homo sapiens
acaggacuaggcacgucucugg

SEQ ID NO: 21653 - RNA, 22 nt, Homo sapiens
aguagagaccccagucucaguc

SEQ ID NO: 21654 - RNA, 17 nt, Homo sapiens
cgcugaagagggccccc

SEQ ID NO: 21655 - RNA, 16 nt, Homo sapiens
uggugggugggaggcg

SEQ ID NO: 21656 - RNA, 23 nt, Homo sapiens
auguggaccuuccuaucaguguu

SEQ ID NO: 21657 - RNA, 19 nt, Homo sapiens
ccuguagugaggccugguc

SEQ ID NO: 21658 - RNA, 18 nt, Homo sapiens
gagccaacaggacaucaa

SEQ ID NO: 21659 - RNA, 16 nt, Homo sapiens
ggccuguagugaggcc

SEQ ID NO: 21660 - RNA, 23 nt, Homo sapiens
uacugcuggcugguaaaaccgaa

SEQ ID NO: 21661 - RNA, 21 nt, Homo sapiens
uagcaugcauuaaagaccaga

SEQ ID NO: 21662 - RNA, 26 nt, Homo sapiens
ucuaaaaucuguugugugcaaauagu

SEQ ID NO: 21663 - RNA, 17 nt, Homo sapiens
ucuuuuggucaaguuuc

SEQ ID NO: 21664 - RNA, 23 nt, Homo sapiens
ugaauugaugacuccuguuaaag

SEQ ID NO: 21665 - RNA, 18 nt, Homo sapiens
ugguaucgugagcauuac

SEQ ID NO: 21666 - RNA, 22 nt, Homo sapiens
caagcucugugagauuauuuuu

SEQ ID NO: 21667 - RNA, 15 nt, Homo sapiens
gcaagauaaugucug

SEQ ID NO: 21668 - RNA, 24 nt, Homo sapiens
uagcaucuacugugcaaauauauu

SEQ ID NO: 21669 - RNA, 21 nt, Homo sapiens
ucuguauaaucaccaauguua

SEQ ID NO: 21670 - RNA, 17 nt, Homo sapiens
uccagcugcaucggugc

SEQ ID NO: 21671 - RNA, 20 nt, Homo sapiens
uggcagacuguguaaaagcu

SEQ ID NO: 21672 - RNA, 21 nt, Homo sapiens
uuucacuucagucaccuuggc

SEQ ID NO: 21673 - RNA, 18 nt, Homo sapiens
aacaauguaguggaagaa

SEQ ID NO: 21674 - RNA, 18 nt, Homo sapiens
aagaccaauaggucugag

SEQ ID NO: 21675 - RNA, 18 nt, Homo sapiens
agcagcagugguaucugu

SEQ ID NO: 21676 - RNA, 19 nt, Homo sapiens
aggacauggaaaaauucau

SEQ ID NO: 21677 - RNA, 19 nt, Homo sapiens
aggcauuuuagaaauucau

SEQ ID NO: 21678 - RNA, 21 nt, Homo sapiens
agugaagccauagcaugaaaa

SEQ ID NO: 21679 - RNA, 19 nt, Homo sapiens
auccaugccugcuggugga

SEQ ID NO: 21680 - RNA, 17 nt, Homo sapiens
gccugaucauugccaac

SEQ ID NO: 21681 - RNA, 17 nt, Homo sapiens
uuugaugcuuacaaaaa

SEQ ID NO: 21682 - RNA, 19 nt, Homo sapiens
cagaguagccaaaaaaaug

SEQ ID NO: 21683 - RNA, 19 nt, Homo sapiens
cagugcauggcuguuaucg

SEQ ID NO: 21684 - RNA, 19 nt, Homo sapiens
cauccaucauuuuuuaaau

SEQ ID NO: 21685 - RNA, 17 nt, Homo sapiens
ccuguugugcccuacuc

SEQ ID NO: 21686 - RNA, 18 nt, Homo sapiens
gcauggcuguuaucggua

SEQ ID NO: 21687 - RNA, 19 nt, Homo sapiens
ucacugaguuguguaaugu

SEQ ID NO: 21688 - RNA, 20 nt, Homo sapiens
ugaggcccucucuucuuagc

SEQ ID NO: 21689 - RNA, 19 nt, Homo sapiens
ugcacagugcauggcuguu

SEQ ID NO: 21690 - RNA, 18 nt, Homo sapiens
acgcgcagggcccggccg

SEQ ID NO: 21691 - RNA, 19 nt, Homo sapiens
cccuccucccgccuggcuc

SEQ ID NO: 21692 - RNA, 15 nt, Homo sapiens
gcagccuacagucua

SEQ ID NO: 21693 - RNA, 19 nt, Homo sapiens
ggacaccugggagagggga

SEQ ID NO: 21694 - RNA, 18 nt, Homo sapiens
uacagucuacacagcagc

SEQ ID NO: 21695 - RNA, 19 nt, Homo sapiens
ucccuccucccgccuggcu

SEQ ID NO: 21696 - RNA, 20 nt, Homo sapiens
caggaggggcagugacccac

SEQ ID NO: 21697 - RNA, 16 nt, Homo sapiens
gacaaacagcuggagc

SEQ ID NO: 21698 - RNA, 21 nt, Homo sapiens
gccuugacaaacagcuggagc

SEQ ID NO: 21699 - RNA, 18 nt, Homo sapiens
cauuuuguucuccucuuc

SEQ ID NO: 21700 - RNA, 22 nt, Homo sapiens
cggagagacugccgcggcaacc

SEQ ID NO: 21701 - RNA, 22 nt, Homo sapiens
uacguauugacaacauggaugu

SEQ ID NO: 21702 - RNA, 22 nt, Homo sapiens
uuuguucuuuucaaaacauuuu

SEQ ID NO: 21703 - RNA, 19 nt, Homo sapiens
aaagaaagaaaaaaaaaga

SEQ ID NO: 21704 - RNA, 18 nt, Homo sapiens
gcuucuggaugauuuuca

SEQ ID NO: 21705 - RNA, 23 nt, Homo sapiens
uaagcuguggaguucaaguaaau

SEQ ID NO: 21706 - RNA, 18 nt, Homo sapiens
uacaaggugugacagcac

SEQ ID NO: 21707 - RNA, 17 nt, Homo sapiens
ugugauggaauacaagg

SEQ ID NO: 21708 - RNA, 21 nt, Homo sapiens
ugugggcauguuuuuguuugu

SEQ ID NO: 21709 - RNA, 15 nt, Homo sapiens
cagcugggccuaaac

SEQ ID NO: 21710 - RNA, 21 nt, Homo sapiens
caggcugccuggccucccugu

SEQ ID NO: 21711 - RNA, 17 nt, Homo sapiens
gcagcugggccuaaacu

SEQ ID NO: 21712 - RNA, 21 nt, Homo sapiens
aaaguaaccuaaaucugcaca

SEQ ID NO: 21713 - RNA, 16 nt, Homo sapiens
aauugugugucucuga

SEQ ID NO: 21714 - RNA, 24 nt, Homo sapiens
agacacgggauuggaacaguugcu

SEQ ID NO: 21715 - RNA, 19 nt, Homo sapiens
ucuccauacuuacugccug

SEQ ID NO: 21716 - RNA, 22 nt, Homo sapiens
ugccuggugggacagcuugggc

SEQ ID NO: 21717 - RNA, 17 nt, Homo sapiens
uaucagaaaccuuauga

SEQ ID NO: 21718 - RNA, 19 nt, Homo sapiens
ccggguuaaaaagcuauag

SEQ ID NO: 21719 - RNA, 18 nt, Homo sapiens
cggguucucgaaacuguc

SEQ ID NO: 21720 - RNA, 17 nt, Homo sapiens
cuucccggaaaacacga

SEQ ID NO: 21721 - RNA, 18 nt, Homo sapiens
guaguugaaaacaugcag

SEQ ID NO: 21722 - RNA, 24 nt, Homo sapiens
ucccccgguccgcccgccgagcgc

SEQ ID NO: 21723 - RNA, 18 nt, Homo sapiens
ccuuagagagggcaguuu

SEQ ID NO: 21724 - RNA, 19 nt, Homo sapiens
gaggagcaacaucccccca

SEQ ID NO: 21725 - RNA, 18 nt, Homo sapiens
gggagcggcgggaccgga

SEQ ID NO: 21726 - RNA, 17 nt, Homo sapiens
gggagggagcugaggag

SEQ ID NO: 21727 - RNA, 15 nt, Homo sapiens
guccauccuuggugg

SEQ ID NO: 21728 - RNA, 19 nt, Homo sapiens
uaagaacagucucuaagag

SEQ ID NO: 21729 - RNA, 17 nt, Homo sapiens
cgggcacgguccggggc

SEQ ID NO: 21730 - RNA, 18 nt, Homo sapiens
cggggcgcucagagacgc

SEQ ID NO: 21731 - RNA, 18 nt, Homo sapiens
gcgcucggggcgcucaga

SEQ ID NO: 21732 - RNA, 16 nt, Homo sapiens
gcugggggcgccgggg

SEQ ID NO: 21733 - RNA, 23 nt, Homo sapiens
ggcugggggcgccggggcccggg

SEQ ID NO: 21734 - RNA, 21 nt, Homo sapiens
agcgaaggcacuugggggugg

SEQ ID NO: 21735 - RNA, 18 nt, Homo sapiens
gggguggggguggagggg

SEQ ID NO: 21736 - RNA, 21 nt, Homo sapiens
gggguggggguggaggggugg

SEQ ID NO: 21737 - RNA, 16 nt, Homo sapiens
uggccgaggcucaugc

SEQ ID NO: 21738 - RNA, 22 nt, Homo sapiens
uggggguggggguggaggggug

SEQ ID NO: 21739 - RNA, 25 nt, Homo sapiens
uggggguggggguggagggguggcc

SEQ ID NO: 21740 - RNA, 18 nt, Homo sapiens
aacaggugaaagagaggg

SEQ ID NO: 21741 - RNA, 22 nt, Homo sapiens
accacgggaggcagcccagagg

SEQ ID NO: 21742 - RNA, 23 nt, Homo sapiens
aggugaaagagaggggcuggcag

SEQ ID NO: 21743 - RNA, 20 nt, Homo sapiens
gggaaaguccagggcagagg

SEQ ID NO: 21744 - RNA, 16 nt, Homo sapiens
guggcucugccagccc

SEQ ID NO: 21745 - RNA, 15 nt, Homo sapiens
guugucaggcaaagc

SEQ ID NO: 21746 - RNA, 21 nt, Homo sapiens
ugaagcccucugggcacaggc

SEQ ID NO: 21747 - RNA, 19 nt, Homo sapiens
aaaacacccagcacugggc

SEQ ID NO: 21748 - RNA, 20 nt, Homo sapiens
aaaggggucuugggccaagg

SEQ ID NO: 21749 - RNA, 21 nt, Homo sapiens
acuaugucaccagaagucacc

SEQ ID NO: 21750 - RNA, 16 nt, Homo sapiens
agcgaguuuccccaug

SEQ ID NO: 21751 - RNA, 17 nt, Homo sapiens
agcuuaccugguacccu

SEQ ID NO: 21752 - RNA, 19 nt, Homo sapiens
caccacagauggauggaug

SEQ ID NO: 21753 - RNA, 21 nt, Homo sapiens
cagugggccuucuggaaggcc

SEQ ID NO: 21754 - RNA, 18 nt, Homo sapiens
ccccaagcguggggaugg

SEQ ID NO: 21755 - RNA, 19 nt, Homo sapiens
ccggcccagucccuucucc

SEQ ID NO: 21756 - RNA, 27 nt, Homo sapiens
cguggggaugguaggagguggguggcc

SEQ ID NO: 21757 - RNA, 22 nt, Homo sapiens
cuuugaagaucaagaaucacca

SEQ ID NO: 21758 - RNA, 27 nt, Homo sapiens
gagaggggacagauggggaggggcggg

SEQ ID NO: 21759 - RNA, 16 nt, Homo sapiens
gaguugggccuggggu

SEQ ID NO: 21760 - RNA, 15 nt, Homo sapiens
gcuggcugggguccu

SEQ ID NO: 21761 - RNA, 22 nt, Homo sapiens
gcugggguccucuccaucacug

SEQ ID NO: 21762 - RNA, 19 nt, Homo sapiens
ggcaggacagucugugacu

SEQ ID NO: 21763 - RNA, 19 nt, Homo sapiens
gggaggggcgggggcaggc

SEQ ID NO: 21764 - RNA, 20 nt, Homo sapiens
ggggacagauggggaggggc

SEQ ID NO: 21765 - RNA, 22 nt, Homo sapiens
ggggacagauggggaggggcgg

SEQ ID NO: 21766 - RNA, 18 nt, Homo sapiens
ggggauggggggauggug

SEQ ID NO: 21767 - RNA, 21 nt, Homo sapiens
ggggaugguaggaggugggug

SEQ ID NO: 21768 - RNA, 17 nt, Homo sapiens
gucugugggacacgcag

SEQ ID NO: 21769 - RNA, 24 nt, Homo sapiens
uauauuauacaucuuauauauaga

SEQ ID NO: 21770 - RNA, 20 nt, Homo sapiens
ucacacccucaucugugccu

SEQ ID NO: 21771 - RNA, 18 nt, Homo sapiens
ucucacccucucucaucu

SEQ ID NO: 21772 - RNA, 15 nt, Homo sapiens
ugagugaguaagcag

SEQ ID NO: 21773 - RNA, 19 nt, Homo sapiens
uggguguggagagagggga

SEQ ID NO: 21774 - RNA, 22 nt, Homo sapiens
aaaagggggagaggggcccaag

SEQ ID NO: 21775 - RNA, 16 nt, Homo sapiens
agggcccccagauggg

SEQ ID NO: 21776 - RNA, 23 nt, Homo sapiens
aggggagcgaggccuggagcggg

SEQ ID NO: 21777 - RNA, 21 nt, Homo sapiens
cccccacccccuccuaggguc

SEQ ID NO: 21778 - RNA, 19 nt, Homo sapiens
cccuccaccggaccaccac

SEQ ID NO: 21779 - RNA, 21 nt, Homo sapiens
gcggacgcggcaagccagggc

SEQ ID NO: 21780 - RNA, 21 nt, Homo sapiens
uagaaaaaaagggggagaggg

SEQ ID NO: 21781 - RNA, 21 nt, Homo sapiens
aauagucuugauauauuuagu

SEQ ID NO: 21782 - RNA, 20 nt, Homo sapiens
cacaguucccacacaggauu

SEQ ID NO: 21783 - RNA, 17 nt, Homo sapiens
cuuugcccgaauaccag

SEQ ID NO: 21784 - RNA, 17 nt, Homo sapiens
gcaucccauaaaucugg

SEQ ID NO: 21785 - RNA, 22 nt, Homo sapiens
gcuugcucauguccucuuugcc

SEQ ID NO: 21786 - RNA, 16 nt, Homo sapiens
gguuaccucucugagg

SEQ ID NO: 21787 - RNA, 23 nt, Homo sapiens
ucugacagacauuucugacuaga

SEQ ID NO: 21788 - RNA, 18 nt, Homo sapiens
ugggcuaucauguucugu

SEQ ID NO: 21789 - RNA, 18 nt, Homo sapiens
aagccauccaaguaaaaa

SEQ ID NO: 21790 - RNA, 20 nt, Homo sapiens
aagcaaaaggagagagaaaa

SEQ ID NO: 21791 - RNA, 23 nt, Homo sapiens
ccucggccucccaaacugcuggg

SEQ ID NO: 21792 - RNA, 19 nt, Homo sapiens
ggagagagaaaauggucaa

SEQ ID NO: 21793 - RNA, 17 nt, Homo sapiens
ggcgugaucacuggagc

SEQ ID NO: 21794 - RNA, 20 nt, Homo sapiens
ucaaguuauccaugaauuaa

SEQ ID NO: 21795 - RNA, 18 nt, Homo sapiens
caguauagucacgagauc

SEQ ID NO: 21796 - RNA, 19 nt, Homo sapiens
gggaugagucugggggugg

SEQ ID NO: 21797 - RNA, 19 nt, Homo sapiens
ucauguuccuguuauugca

SEQ ID NO: 21798 - RNA, 18 nt, Homo sapiens
uuucuagggggugguaaa

SEQ ID NO: 21799 - RNA, 17 nt, Homo sapiens
aaagacccuucucugua

SEQ ID NO: 21800 - RNA, 18 nt, Homo sapiens
aaccuccucaugaagcag

SEQ ID NO: 21801 - RNA, 18 nt, Homo sapiens
acccuucucuguaucaaa

SEQ ID NO: 21802 - RNA, 20 nt, Homo sapiens
cagucacaaaaugauauuag

SEQ ID NO: 21803 - RNA, 21 nt, Homo sapiens
cgcucggccgccgccgccucc

SEQ ID NO: 21804 - RNA, 18 nt, Homo sapiens
uaaccuuaaccucgcuuu

SEQ ID NO: 21805 - RNA, 18 nt, Homo sapiens
uaagauugaaaacuagcu

SEQ ID NO: 21806 - RNA, 18 nt, Homo sapiens
cagcagcggcggcggccc

SEQ ID NO: 21807 - RNA, 15 nt, Homo sapiens
cccccgcccgcggcc

SEQ ID NO: 21808 - RNA, 18 nt, Homo sapiens
cccggagccacagccccc

SEQ ID NO: 21809 - RNA, 18 nt, Homo sapiens
ccgccacagccaccgccu

SEQ ID NO: 21810 - RNA, 21 nt, Homo sapiens
ccgcgcggccgcuuccucccg

SEQ ID NO: 21811 - RNA, 16 nt, Homo sapiens
cgccacagccaccgcc

SEQ ID NO: 21812 - RNA, 16 nt, Homo sapiens
cgccgccaccaccgcc

SEQ ID NO: 21813 - RNA, 17 nt, Homo sapiens
cggcggcggcccggagc

SEQ ID NO: 21814 - RNA, 19 nt, Homo sapiens
agaaacacaacaauaagag

SEQ ID NO: 21815 - RNA, 16 nt, Homo sapiens
cacaaugagcugcagg

SEQ ID NO: 21816 - RNA, 19 nt, Homo sapiens
cagcguguguuuggggcag

SEQ ID NO: 21817 - RNA, 17 nt, Homo sapiens
cagcucuggaaacuugu

SEQ ID NO: 21818 - RNA, 16 nt, Homo sapiens
cccuucccacuccacu

SEQ ID NO: 21819 - RNA, 17 nt, Homo sapiens
gauccuuagacucacca

SEQ ID NO: 21820 - RNA, 20 nt, Homo sapiens
uaccauugggauucacaguu

SEQ ID NO: 21821 - RNA, 17 nt, Homo sapiens
uagaaugucuaaucccu

SEQ ID NO: 21822 - RNA, 16 nt, Homo sapiens
uagcgaggcaauuaau

SEQ ID NO: 21823 - RNA, 16 nt, Homo sapiens
uagcucgugcgccuau

SEQ ID NO: 21824 - RNA, 15 nt, Homo sapiens
ucagugaaucauucc

SEQ ID NO: 21825 - RNA, 15 nt, Homo sapiens
uccugggguagcgag

SEQ ID NO: 21826 - RNA, 17 nt, Homo sapiens
uugggaggccgaggcgg

SEQ ID NO: 21827 - RNA, 24 nt, Homo sapiens
aaggauugacccaagcaaaauaaa

SEQ ID NO: 21828 - RNA, 23 nt, Homo sapiens
aagugcuuguaagucccacauuu

SEQ ID NO: 21829 - RNA, 16 nt, Homo sapiens
agggcugggucugguu

SEQ ID NO: 21830 - RNA, 15 nt, Homo sapiens
gcuggagggugaggc

SEQ ID NO: 21831 - RNA, 18 nt, Homo sapiens
gcuggagggugaggcacg

SEQ ID NO: 21832 - RNA, 22 nt, Homo sapiens
ggcggcucgcggcggcggcggc

SEQ ID NO: 21833 - RNA, 18 nt, Homo sapiens
guaggcugcugcgcugac

SEQ ID NO: 21834 - RNA, 20 nt, Homo sapiens
uaagucccacauuugaaaca

SEQ ID NO: 21835 - RNA, 22 nt, Homo sapiens
uuugguauacuuuuuuccaucg

SEQ ID NO: 21836 - RNA, 16 nt, Homo sapiens
agagucagguauggaa

SEQ ID NO: 21837 - RNA, 18 nt, Homo sapiens
agggguuugggauucaga

SEQ ID NO: 21838 - RNA, 20 nt, Homo sapiens
ucacuuuguaggauuaggca

SEQ ID NO: 21839 - RNA, 16 nt, Homo sapiens
aacaaugucagacuag

SEQ ID NO: 21840 - RNA, 20 nt, Homo sapiens
uacaauguggucauaagaaa

SEQ ID NO: 21841 - RNA, 16 nt, Homo sapiens
uacuccugugcacuga

SEQ ID NO: 21842 - RNA, 20 nt, Homo sapiens
uaggugcccccuggaacggc

SEQ ID NO: 21843 - RNA, 16 nt, Homo sapiens
uccaaggcugucgcgc

SEQ ID NO: 21844 - RNA, 19 nt, Homo sapiens
ugccaacaaugucagacua

SEQ ID NO: 21845 - RNA, 19 nt, Homo sapiens
aauuaagcugaaaauuaua

SEQ ID NO: 21846 - RNA, 21 nt, Homo sapiens
cccacaugggccccggcgcgg

SEQ ID NO: 21847 - RNA, 18 nt, Homo sapiens
ccgauccggaagagcucg

SEQ ID NO: 21848 - RNA, 18 nt, Homo sapiens
ccugaaagagguaugugg

SEQ ID NO: 21849 - RNA, 18 nt, Homo sapiens
cgcuucucuccuccuccg

SEQ ID NO: 21850 - RNA, 20 nt, Homo sapiens
cuguaugguuaaguuucaua

SEQ ID NO: 21851 - RNA, 23 nt, Homo sapiens
gaggguccuugcaaugccuguuc

SEQ ID NO: 21852 - RNA, 24 nt, Homo sapiens
ggaguuacgacagggaugggucaa

SEQ ID NO: 21853 - RNA, 19 nt, Homo sapiens
ucuguaugguuaaguuuca

SEQ ID NO: 21854 - RNA, 22 nt, Homo sapiens
uggugugaagugugggauuccu

SEQ ID NO: 21855 - RNA, 15 nt, Homo sapiens
uuucaugaaucugcu

SEQ ID NO: 21856 - RNA, 20 nt, Homo sapiens
aaggaucagauuuucuauuu

SEQ ID NO: 21857 - RNA, 18 nt, Homo sapiens
caggacccucugguuaca

SEQ ID NO: 21858 - RNA, 22 nt, Homo sapiens
cagggucccggcaggcgcugcc

SEQ ID NO: 21859 - RNA, 19 nt, Homo sapiens
ccagcgccguuucucuguc

SEQ ID NO: 21860 - RNA, 21 nt, Homo sapiens
cccggcuccaaaugccgcggc

SEQ ID NO: 21861 - RNA, 18 nt, Homo sapiens
cccugaucuuguggcuuu

SEQ ID NO: 21862 - RNA, 19 nt, Homo sapiens
ccuuguccaaggucucugu

SEQ ID NO: 21863 - RNA, 20 nt, Homo sapiens
gccgcggcgaggguccgggu

SEQ ID NO: 21864 - RNA, 18 nt, Homo sapiens
gcgcggcggcgccgccgc

SEQ ID NO: 21865 - RNA, 17 nt, Homo sapiens
guggugggcuucuuggu

SEQ ID NO: 21866 - RNA, 24 nt, Homo sapiens
uccacagugaagcaggcaagaacc

SEQ ID NO: 21867 - RNA, 18 nt, Homo sapiens
uccccaguuaugauggga

SEQ ID NO: 21868 - RNA, 19 nt, Homo sapiens
uccccaucgcuauagcccc

SEQ ID NO: 21869 - RNA, 14 nt, Homo sapiens
ugugugugcacuga

SEQ ID NO: 21870 - RNA, 25 nt, Homo sapiens
uuccaagugguugguuuaugacugc

SEQ ID NO: 21871 - RNA, 19 nt, Homo sapiens
acagaacugaagacacgga

SEQ ID NO: 21872 - RNA, 20 nt, Homo sapiens
auguaccaaggccuaccaau

SEQ ID NO: 21873 - RNA, 23 nt, Homo sapiens
cggcggagcaccuuuggcgggga

SEQ ID NO: 21874 - RNA, 18 nt, Homo sapiens
cuucuaacccuuugcagc

SEQ ID NO: 21875 - RNA, 19 nt, Homo sapiens
guaugugugugcagggagg

SEQ ID NO: 21876 - RNA, 24 nt, Homo sapiens
ugcuggugcccucgcuuacccgag

SEQ ID NO: 21877 - RNA, 19 nt, Homo sapiens
uguaccaaggccuaccaau

SEQ ID NO: 21878 - RNA, 16 nt, Homo sapiens
uuccaaagcgcugggu

SEQ ID NO: 21879 - RNA, 18 nt, Homo sapiens
acucuuccccuccccauc

SEQ ID NO: 21880 - RNA, 21 nt, Homo sapiens
caccaccuguuaucuguuuac

SEQ ID NO: 21881 - RNA, 20 nt, Homo sapiens
caccuguuaucuguuuacuc

SEQ ID NO: 21882 - RNA, 15 nt, Homo sapiens
cagugcacgcccccc

SEQ ID NO: 21883 - RNA, 23 nt, Homo sapiens
ccaagacaucuguggguccuacc

SEQ ID NO: 21884 - RNA, 18 nt, Homo sapiens
cgcgcugucgccgccgca

SEQ ID NO: 21885 - RNA, 21 nt, Homo sapiens
cuaccucucagcccaccuccc

SEQ ID NO: 21886 - RNA, 14 nt, Homo sapiens
cuguccuccaucgg

SEQ ID NO: 21887 - RNA, 16 nt, Homo sapiens
gagcguggccuggggu

SEQ ID NO: 21888 - RNA, 15 nt, Homo sapiens
gcaagcauggaggca

SEQ ID NO: 21889 - RNA, 22 nt, Homo sapiens
gcagagggggaggggagggaag

SEQ ID NO: 21890 - RNA, 18 nt, Homo sapiens
gccgucgcgguucauccc

SEQ ID NO: 21891 - RNA, 21 nt, Homo sapiens
gggaagggagguuugggugcc

SEQ ID NO: 21892 - RNA, 22 nt, Homo sapiens
ggggcccgcgcagccggcaccu

SEQ ID NO: 21893 - RNA, 19 nt, Homo sapiens
guccgggaggcucgcgggg

SEQ ID NO: 21894 - RNA, 20 nt, Homo sapiens
uagguucccacaugggccaa

SEQ ID NO: 21895 - RNA, 16 nt, Homo sapiens
ucgcgggggcagggcu

SEQ ID NO: 21896 - RNA, 18 nt, Homo sapiens
ugcacgccccccuccccc

SEQ ID NO: 21897 - RNA, 18 nt, Homo sapiens
cgggcgcgggagggcgcg

SEQ ID NO: 21898 - RNA, 20 nt, Homo sapiens
cgggcugcggcucggcggcg

SEQ ID NO: 21899 - RNA, 21 nt, Homo sapiens
cuccugcugaggguggcucag

SEQ ID NO: 21900 - RNA, 17 nt, Homo sapiens
gcgcggcgggcugcggc

SEQ ID NO: 21901 - RNA, 18 nt, Homo sapiens
ugccgggggcgcgcggcg

SEQ ID NO: 21902 - RNA, 21 nt, Homo sapiens
ugcggcucggcggcgguggcg

SEQ ID NO: 21903 - RNA, 16 nt, Homo sapiens
uggccccgcccggccc

SEQ ID NO: 21904 - RNA, 20 nt, Homo sapiens
aacuacuaggguuaggggug

SEQ ID NO: 21905 - RNA, 19 nt, Homo sapiens
aggcgugauucuguuucca

SEQ ID NO: 21906 - RNA, 14 nt, Homo sapiens
gagcacagggaagu

SEQ ID NO: 21907 - RNA, 20 nt, Homo sapiens
gcgguguuccguggcagcaa

SEQ ID NO: 21908 - RNA, 21 nt, Homo sapiens
uccaucaaaguucuccuccac

SEQ ID NO: 21909 - RNA, 20 nt, Homo sapiens
aaauuucccauauuaucuaa

SEQ ID NO: 21910 - RNA, 18 nt, Homo sapiens
ucuaaaugcuaaacaaaa

SEQ ID NO: 21911 - RNA, 19 nt, Homo sapiens
aaaacagaccccuuucucu

SEQ ID NO: 21912 - RNA, 22 nt, Homo sapiens
acaagcagcucaaaucuagccc

SEQ ID NO: 21913 - RNA, 15 nt, Homo sapiens
ccaaugagaccaacg

SEQ ID NO: 21914 - RNA, 19 nt, Homo sapiens
cuuuuuuuccgaucccgcg

SEQ ID NO: 21915 - RNA, 22 nt, Homo sapiens
ucacauaguacuuguuuucugu

SEQ ID NO: 21916 - RNA, 15 nt, Homo sapiens
ucuuucccgcucugc

SEQ ID NO: 21917 - RNA, 20 nt, Homo sapiens
ccggaccgaguccccucccc

SEQ ID NO: 21918 - RNA, 18 nt, Homo sapiens
ccgucggucuccggcccc

SEQ ID NO: 21919 - RNA, 19 nt, Homo sapiens
gcagcguggguccugagcc

SEQ ID NO: 21920 - RNA, 20 nt, Homo sapiens
uccccucugcccuggggcuc

SEQ ID NO: 21921 - RNA, 18 nt, Homo sapiens
uccggccccggaccgagu

SEQ ID NO: 21922 - RNA, 18 nt, Homo sapiens
ccgcgcucucggccugcc

SEQ ID NO: 21923 - RNA, 18 nt, Homo sapiens
gcgccaggcccgggcgcc

SEQ ID NO: 21924 - RNA, 21 nt, Homo sapiens
augaaaaaaauuggaaguauu

SEQ ID NO: 21925 - RNA, 21 nt, Homo sapiens
ucuaauuugauuugaaggccu

SEQ ID NO: 21926 - RNA, 17 nt, Homo sapiens
caccccucccacccccc

SEQ ID NO: 21927 - RNA, 22 nt, Homo sapiens
cucccuuucuuaagcaaguauu

SEQ ID NO: 21928 - RNA, 18 nt, Homo sapiens
cuuuuucauuuucugccc

SEQ ID NO: 21929 - RNA, 19 nt, Homo sapiens
gaggaaacaaguuggcucg

SEQ ID NO: 21930 - RNA, 15 nt, Homo sapiens
gaggccgccgccauc

SEQ ID NO: 21931 - RNA, 17 nt, Homo sapiens
ggaggaaacaaguuggc

SEQ ID NO: 21932 - RNA, 18 nt, Homo sapiens
uaacuuucuuucuggcac

SEQ ID NO: 21933 - RNA, 21 nt, Homo sapiens
ucaugcaaaugcaucaaggaa

SEQ ID NO: 21934 - RNA, 18 nt, Homo sapiens
ugccuauaaacuuaucaa

SEQ ID NO: 21935 - RNA, 18 nt, Homo sapiens
agcugguaauguaggcac

SEQ ID NO: 21936 - RNA, 19 nt, Homo sapiens
caggugggggugugagcag

SEQ ID NO: 21937 - RNA, 21 nt, Homo sapiens
ccaccgccugggccucggcca

SEQ ID NO: 21938 - RNA, 23 nt, Homo sapiens
cucccuauuugagugcuccuugg

SEQ ID NO: 21939 - RNA, 18 nt, Homo sapiens
gaaggccaagaggcucca

SEQ ID NO: 21940 - RNA, 16 nt, Homo sapiens
gaguucgagaccagcc

SEQ ID NO: 21941 - RNA, 21 nt, Homo sapiens
guguacuugaugguaauuaug

SEQ ID NO: 21942 - RNA, 24 nt, Homo sapiens
uaaaacguaagagcaagcucaaaa

SEQ ID NO: 21943 - RNA, 15 nt, Homo sapiens
ugcuauagcuuaccg

SEQ ID NO: 21944 - RNA, 20 nt, Homo sapiens
ugcuguguagacccuccccc

SEQ ID NO: 21945 - RNA, 20 nt, Homo sapiens
uggaaaacaagggcggggga

SEQ ID NO: 21946 - RNA, 18 nt, Homo sapiens
uggcauuuuccagaauuc

SEQ ID NO: 21947 - RNA, 18 nt, Homo sapiens
ugggguaggagaugggga

SEQ ID NO: 21948 - RNA, 19 nt, Homo sapiens
uguuuuauggaaaacaagg

SEQ ID NO: 21949 - RNA, 28 nt, Homo sapiens
uugguuccuguuuuuuuuaaggccgacc

SEQ ID NO: 21950 - RNA, 19 nt, Homo sapiens
acggggugcaguggaagug

SEQ ID NO: 21951 - RNA, 20 nt, Homo sapiens
agucauuucccccauuggau

SEQ ID NO: 21952 - RNA, 17 nt, Homo sapiens
ccaaaaauacauggaug

SEQ ID NO: 21953 - RNA, 16 nt, Homo sapiens
ccagccccauguggcc

SEQ ID NO: 21954 - RNA, 17 nt, Homo sapiens
gagacggggugcagugg

SEQ ID NO: 21955 - RNA, 18 nt, Homo sapiens
gcuugaccacgccauccc

SEQ ID NO: 21956 - RNA, 15 nt, Homo sapiens
ggagagaaaacauaa

SEQ ID NO: 21957 - RNA, 20 nt, Homo sapiens
ggauuaccagugcccagagg

SEQ ID NO: 21958 - RNA, 27 nt, Homo sapiens
ggcagacagaggugggcggccgccugc

SEQ ID NO: 21959 - RNA, 22 nt, Homo sapiens
uagcugggcaccucacuguucc

SEQ ID NO: 21960 - RNA, 22 nt, Homo sapiens
ucaaaccuuuccucucucuucu

SEQ ID NO: 21961 - RNA, 14 nt, Homo sapiens
ugcccucgaggagc

SEQ ID NO: 21962 - RNA, 18 nt, Homo sapiens
ugccuuggaagcacuuug

SEQ ID NO: 21963 - RNA, 18 nt, Homo sapiens
ugcugugggccaggccuu

SEQ ID NO: 21964 - RNA, 17 nt, Homo sapiens
ugggagggagcaggggc

SEQ ID NO: 21965 - RNA, 18 nt, Homo sapiens
aaagagucuucauuuugc

SEQ ID NO: 21966 - RNA, 17 nt, Homo sapiens
aagaaaaagaaaagaag

SEQ ID NO: 21967 - RNA, 16 nt, Homo sapiens
acauucuggcauuugc

SEQ ID NO: 21968 - RNA, 21 nt, Homo sapiens
accuagugggagaggcagagc

SEQ ID NO: 21969 - RNA, 20 nt, Homo sapiens
agcacaugggguguaugugu

SEQ ID NO: 21970 - RNA, 19 nt, Homo sapiens
ccauagccauucauaaaaa

SEQ ID NO: 21971 - RNA, 19 nt, Homo sapiens
gaagauaaaugcaaauagg

SEQ ID NO: 21972 - RNA, 22 nt, Homo sapiens
gauaucaaauagcaacuggcac

SEQ ID NO: 21973 - RNA, 19 nt, Homo sapiens
gcuacacacuugcuugugc

SEQ ID NO: 21974 - RNA, 19 nt, Homo sapiens
uaagcugcacaauugagua

SEQ ID NO: 21975 - RNA, 18 nt, Homo sapiens
ucaacagaaguugcacaa

SEQ ID NO: 21976 - RNA, 24 nt, Homo sapiens
ucagcauauuaagcugcacaauug

SEQ ID NO: 21977 - RNA, 19 nt, Homo sapiens
ucauggauaugauacccgu

SEQ ID NO: 21978 - RNA, 24 nt, Homo sapiens
uccaaguuuaguauuagccucuug

SEQ ID NO: 21979 - RNA, 19 nt, Homo sapiens
ugcaauggcugcuuagcaa

SEQ ID NO: 21980 - RNA, 18 nt, Homo sapiens
uggcuguggacaagguug

SEQ ID NO: 21981 - RNA, 20 nt, Homo sapiens
acagugacacaaauguugug

SEQ ID NO: 21982 - RNA, 18 nt, Homo sapiens
cuaaugauacaugcuaca

SEQ ID NO: 21983 - RNA, 17 nt, Homo sapiens
uccucgguccacaccgc

SEQ ID NO: 21984 - RNA, 20 nt, Homo sapiens
agcggcacugcucugggcgg

SEQ ID NO: 21985 - RNA, 18 nt, Homo sapiens
cacuucugcaaggugggg

SEQ ID NO: 21986 - RNA, 17 nt, Homo sapiens
ggaggcggcaggaggga

SEQ ID NO: 21987 - RNA, 20 nt, Homo sapiens
gugaguuuaaagugagagua

SEQ ID NO: 21988 - RNA, 15 nt, Homo sapiens
ucucagucugagccc

SEQ ID NO: 21989 - RNA, 25 nt, Homo sapiens
ugauauucuaccuccugugugcuug

SEQ ID NO: 21990 - RNA, 18 nt, Homo sapiens
uucgcauuuauauguucu

SEQ ID NO: 21991 - RNA, 17 nt, Homo sapiens
guuuuucucaugucgag

SEQ ID NO: 21992 - RNA, 18 nt, Homo sapiens
ucucucaaacuuaaaauc

SEQ ID NO: 21993 - RNA, 23 nt, Homo sapiens
uguuuuucucaugucgaguuuau

SEQ ID NO: 21994 - RNA, 18 nt, Homo sapiens
gaccgagcugcucgcucg

SEQ ID NO: 21995 - RNA, 17 nt, Homo sapiens
ggcgcgcuccccacagc

SEQ ID NO: 21996 - RNA, 22 nt, Homo sapiens
agaggaggagagagggaggaga

SEQ ID NO: 21997 - RNA, 16 nt, Homo sapiens
cagccgccgccgcgcc

SEQ ID NO: 21998 - RNA, 21 nt, Homo sapiens
cgcucgaggcgagcgagcucu

SEQ ID NO: 21999 - RNA, 18 nt, Homo sapiens
cuccagccgccgccgcgc

SEQ ID NO: 22000 - RNA, 18 nt, Homo sapiens
gugcgugcgccggcaccg

SEQ ID NO: 22001 - RNA, 23 nt, Homo sapiens
ugcgcgcgcgcgcgugaaggggg

SEQ ID NO: 22002 - RNA, 21 nt, Homo sapiens
ugugcgcgcgugugugugugu

SEQ ID NO: 22003 - RNA, 15 nt, Homo sapiens
cacccaaaaagagaa

SEQ ID NO: 22004 - RNA, 15 nt, Homo sapiens
ccucagggacacagg

SEQ ID NO: 22005 - RNA, 20 nt, Homo sapiens
gguuuaucuugccugauaca

SEQ ID NO: 22006 - RNA, 17 nt, Homo sapiens
ucucuagcauccaauuu

SEQ ID NO: 22007 - RNA, 22 nt, Homo sapiens
uguaucugccaucuucuuuucc

SEQ ID NO: 22008 - RNA, 24 nt, Homo sapiens
uuugcauauaguuucuguguuuua

SEQ ID NO: 22009 - RNA, 19 nt, Homo sapiens
agccuuuaauugacuuugg

SEQ ID NO: 22010 - RNA, 20 nt, Homo sapiens
aguaguuugcauaauauuuu

SEQ ID NO: 22011 - RNA, 19 nt, Homo sapiens
cauguauauaucuaauaau

SEQ ID NO: 22012 - RNA, 16 nt, Homo sapiens
gaacauagcauaugau

SEQ ID NO: 22013 - RNA, 15 nt, Homo sapiens
gagagagagagagag

SEQ ID NO: 22014 - RNA, 19 nt, Homo sapiens
gaggugggaaacagacacc

SEQ ID NO: 22015 - RNA, 17 nt, Homo sapiens
ggccaggaguucgagac

SEQ ID NO: 22016 - RNA, 20 nt, Homo sapiens
guggaucacaaagucaggag

SEQ ID NO: 22017 - RNA, 22 nt, Homo sapiens
uauuaaauauaaauugucuaaa

SEQ ID NO: 22018 - RNA, 21 nt, Homo sapiens
ucagaacacagaaaauuauca

SEQ ID NO: 22019 - RNA, 18 nt, Homo sapiens
ugaaagccuuuaauugac

SEQ ID NO: 22020 - RNA, 20 nt, Homo sapiens
ugauggaaaaagauauacca

SEQ ID NO: 22021 - RNA, 23 nt, Homo sapiens
ugccuguaaucccagcacuuugg

SEQ ID NO: 22022 - RNA, 23 nt, Homo sapiens
uggcauggugguaggcaccugug

SEQ ID NO: 22023 - RNA, 17 nt, Homo sapiens
uugggaggccgaggcgg

SEQ ID NO: 22024 - RNA, 17 nt, Homo sapiens
uugggaggucgaggcgg

SEQ ID NO: 22025 - RNA, 22 nt, Homo sapiens
uuuagggaaaauaccucuacau

SEQ ID NO: 22026 - RNA, 19 nt, Homo sapiens
uuuugcaucuaucauccac

SEQ ID NO: 22027 - RNA, 14 nt, Homo sapiens
aacaggcccacugc

SEQ ID NO: 22028 - RNA, 18 nt, Homo sapiens
auuucuaaaauugggcaa

SEQ ID NO: 22029 - RNA, 18 nt, Homo sapiens
caccacaccaggcaaacc

SEQ ID NO: 22030 - RNA, 20 nt, Homo sapiens
cacuuuuaguacagacgggg

SEQ ID NO: 22031 - RNA, 19 nt, Homo sapiens
cccaccuggggccuggauc

SEQ ID NO: 22032 - RNA, 18 nt, Homo sapiens
cggcggcggcggcggcgg

SEQ ID NO: 22033 - RNA, 19 nt, Homo sapiens
cggcggcggcgggggcggc

SEQ ID NO: 22034 - RNA, 18 nt, Homo sapiens
cgggcggcggcggcggcg

SEQ ID NO: 22035 - RNA, 19 nt, Homo sapiens
cuuccagccuggauuaguc

SEQ ID NO: 22036 - RNA, 16 nt, Homo sapiens
gagagaggagagaaag

SEQ ID NO: 22037 - RNA, 17 nt, Homo sapiens
gaguuugggccgaaucc

SEQ ID NO: 22038 - RNA, 21 nt, Homo sapiens
gggaagggggagaagaaggca

SEQ ID NO: 22039 - RNA, 16 nt, Homo sapiens
gugcccaccuggggcc

SEQ ID NO: 22040 - RNA, 19 nt, Homo sapiens
guucuuauucaaacaggca

SEQ ID NO: 22041 - RNA, 21 nt, Homo sapiens
uacagaauucagauuagcuuu

SEQ ID NO: 22042 - RNA, 21 nt, Homo sapiens
ucagaagugccacaauacagc

SEQ ID NO: 22043 - RNA, 20 nt, Homo sapiens
ucccugcccacugcacugag

SEQ ID NO: 22044 - RNA, 20 nt, Homo sapiens
ugauccagucaaaucuugag

SEQ ID NO: 22045 - RNA, 18 nt, Homo sapiens
ugggaaaagauggugaca

SEQ ID NO: 22046 - RNA, 20 nt, Homo sapiens
uucacuuuucaaccucacug

SEQ ID NO: 22047 - RNA, 18 nt, Homo sapiens
uucucuugcuuuccacuu

SEQ ID NO: 22048 - RNA, 18 nt, Homo sapiens
gccggcggguggggggcc

SEQ ID NO: 22049 - RNA, 19 nt, Homo sapiens
gcgcggagcggguggcugc

SEQ ID NO: 22050 - RNA, 18 nt, Homo sapiens
gggcuccagguucucgag

SEQ ID NO: 22051 - RNA, 20 nt, Homo sapiens
ggggagcgggcggcgcggag

SEQ ID NO: 22052 - RNA, 19 nt, Homo sapiens
ggggcuuguccggaaaggc

SEQ ID NO: 22053 - RNA, 21 nt, Homo sapiens
agccgcagccuggggcaguga

SEQ ID NO: 22054 - RNA, 24 nt, Homo sapiens
agcggcuggcgggagcuggcggcc

SEQ ID NO: 22055 - RNA, 18 nt, Homo sapiens
agggugugcccgggaugg

SEQ ID NO: 22056 - RNA, 21 nt, Homo sapiens
ccucugggcugugagucugug

SEQ ID NO: 22057 - RNA, 18 nt, Homo sapiens
cuccaagaaaagaaaaac

SEQ ID NO: 22058 - RNA, 17 nt, Homo sapiens
gccggccaggaggccac

SEQ ID NO: 22059 - RNA, 20 nt, Homo sapiens
ggaagacagggugugcccgg

SEQ ID NO: 22060 - RNA, 17 nt, Homo sapiens
ggccggccaggaggcca

SEQ ID NO: 22061 - RNA, 22 nt, Homo sapiens
gggcagggucuggccccugcug

SEQ ID NO: 22062 - RNA, 22 nt, Homo sapiens
gggcuggggagcggcuggcggg

SEQ ID NO: 22063 - RNA, 19 nt, Homo sapiens
ggggagcggcuggcgggag

SEQ ID NO: 22064 - RNA, 18 nt, Homo sapiens
ggggcaggggugggaaga

SEQ ID NO: 22065 - RNA, 19 nt, Homo sapiens
ugaaaaguggacgcugggc

SEQ ID NO: 22066 - RNA, 21 nt, Homo sapiens
uuuuuuuuucagugcuugacu

SEQ ID NO: 22067 - RNA, 19 nt, Homo sapiens
ugacguuuucuggggaguc

SEQ ID NO: 22068 - RNA, 18 nt, Homo sapiens
gaagagagggagaaagag

SEQ ID NO: 22069 - RNA, 20 nt, Homo sapiens
uuuauaaggaaucugaagag

SEQ ID NO: 22070 - RNA, 19 nt, Homo sapiens
acgcuccgacgggugacgc

SEQ ID NO: 22071 - RNA, 19 nt, Homo sapiens
gcucuggccuccguucccc

SEQ ID NO: 22072 - RNA, 16 nt, Homo sapiens
uccaguaguguggguc

SEQ ID NO: 22073 - RNA, 18 nt, Homo sapiens
ugucccacccccuuuccc

SEQ ID NO: 22074 - RNA, 14 nt, Homo sapiens
cggcgcgcgcuagg

SEQ ID NO: 22075 - RNA, 25 nt, Homo sapiens
cggcgcgcgcuaggccgcggugggc

SEQ ID NO: 22076 - RNA, 16 nt, Homo sapiens
cugccaccauccuguu

SEQ ID NO: 22077 - RNA, 16 nt, Homo sapiens
ucucucggcggcgccc

SEQ ID NO: 22078 - RNA, 20 nt, Homo sapiens
ccucaagaucaccugcugug

SEQ ID NO: 22079 - RNA, 20 nt, Homo sapiens
ccucccugacuuuccaggcu

SEQ ID NO: 22080 - RNA, 20 nt, Homo sapiens
ccuuccaucuuucccuuucu

SEQ ID NO: 22081 - RNA, 16 nt, Homo sapiens
ggcagcaccucccaug

SEQ ID NO: 22082 - RNA, 18 nt, Homo sapiens
ggucugagcccacagccc

SEQ ID NO: 22083 - RNA, 20 nt, Homo sapiens
ggugccugaaaugaggucug

SEQ ID NO: 22084 - RNA, 17 nt, Homo sapiens
gucaugguuaagggcag

SEQ ID NO: 22085 - RNA, 19 nt, Homo sapiens
ugcugggaaacaaaggaga

SEQ ID NO: 22086 - RNA, 21 nt, Homo sapiens
aaaaccaaaacugucuauaaa

SEQ ID NO: 22087 - RNA, 21 nt, Homo sapiens
ggguaagaacuggacguauuu

SEQ ID NO: 22088 - RNA, 19 nt, Homo sapiens
ucauacuuaagcuauucag

SEQ ID NO: 22089 - RNA, 24 nt, Homo sapiens
agacacgggauuggaacaguugcu

SEQ ID NO: 22090 - RNA, 22 nt, Homo sapiens
ugccuggugggacagcuugggc

SEQ ID NO: 22091 - RNA, 20 nt, Homo sapiens
cccgagcgggggccugagcc

SEQ ID NO: 22092 - RNA, 19 nt, Homo sapiens
cccugcuccaggccccucc

SEQ ID NO: 22093 - RNA, 24 nt, Homo sapiens
ccggcaggugcgcgcccgagccgg

SEQ ID NO: 22094 - RNA, 19 nt, Homo sapiens
gcguggccgccggccuccu

SEQ ID NO: 22095 - RNA, 17 nt, Homo sapiens
uacauuuccaguauagc

SEQ ID NO: 22096 - RNA, 19 nt, Homo sapiens
uucauguuuaauucaguuu

SEQ ID NO: 22097 - RNA, 19 nt, Homo sapiens
caaguacccagggacacaa

SEQ ID NO: 22098 - RNA, 18 nt, Homo sapiens
gagggaauugggagcugg

SEQ ID NO: 22099 - RNA, 18 nt, Homo sapiens
gcucgugggaggggacac

SEQ ID NO: 22100 - RNA, 20 nt, Homo sapiens
uaaaaaaaaaaaaaaaaaag

SEQ ID NO: 22101 - RNA, 19 nt, Homo sapiens
uccuuuuccugugcgcucg

SEQ ID NO: 22102 - RNA, 21 nt, Homo sapiens
ucgugggaggggacaccugga

SEQ ID NO: 22103 - RNA, 18 nt, Homo sapiens
gacugagccuaugugguu

SEQ ID NO: 22104 - RNA, 18 nt, Homo sapiens
ggaauauacaaccauuua

SEQ ID NO: 22105 - RNA, 15 nt, Homo sapiens
accgggucugccacc

SEQ ID NO: 22106 - RNA, 22 nt, Homo sapiens
cucccgccgcuuggagcuccca

SEQ ID NO: 22107 - RNA, 16 nt, Homo sapiens
cugccucucccgccgc

SEQ ID NO: 22108 - RNA, 19 nt, Homo sapiens
uaggacuauaaaacuacgg

SEQ ID NO: 22109 - RNA, 18 nt, Homo sapiens
ugagggcuauaaagcuug

SEQ ID NO: 22110 - RNA, 18 nt, Homo sapiens
gcuuuugauucuuucaac

SEQ ID NO: 22111 - RNA, 25 nt, Homo sapiens
ugaugguaguaggauagaguuggug

SEQ ID NO: 22112 - RNA, 22 nt, Homo sapiens
aggcgugagccacugugcuggg

SEQ ID NO: 22113 - RNA, 16 nt, Homo sapiens
agggggaguggggagg

SEQ ID NO: 22114 - RNA, 18 nt, Homo sapiens
agggggaguggggaggcg

SEQ ID NO: 22115 - RNA, 21 nt, Homo sapiens
agggggaguggggaggcggcc

SEQ ID NO: 22116 - RNA, 19 nt, Homo sapiens
ccugcagcuucgaacuccu

SEQ ID NO: 22117 - RNA, 21 nt, Homo sapiens
cuguuacagcggaacagauuu

SEQ ID NO: 22118 - RNA, 23 nt, Homo sapiens
ggcgucugggggugggggccucc

SEQ ID NO: 22119 - RNA, 15 nt, Homo sapiens
uccaccuuccauccg

SEQ ID NO: 22120 - RNA, 16 nt, Homo sapiens
ucccagcucugccugg

SEQ ID NO: 22121 - RNA, 19 nt, Homo sapiens
aagaggguugcuuuuuucu

SEQ ID NO: 22122 - RNA, 18 nt, Homo sapiens
cccauacaaacugagggu

SEQ ID NO: 22123 - RNA, 17 nt, Homo sapiens
ccucaaggucacugaaa

SEQ ID NO: 22124 - RNA, 20 nt, Homo sapiens
uauacaggcugugacagaau

SEQ ID NO: 22125 - RNA, 16 nt, Homo sapiens
ucugaaaaaccagccc

SEQ ID NO: 22126 - RNA, 22 nt, Homo sapiens
ugaaagaggguugcuuuuuucu

SEQ ID NO: 22127 - RNA, 21 nt, Homo sapiens
ugagggugagaagagaaagag

SEQ ID NO: 22128 - RNA, 17 nt, Homo sapiens
aaggaugauucuguuca

SEQ ID NO: 22129 - RNA, 21 nt, Homo sapiens
aauuuccauuccagaauaucu

SEQ ID NO: 22130 - RNA, 18 nt, Homo sapiens
caagggggaaaaucccca

SEQ ID NO: 22131 - RNA, 20 nt, Homo sapiens
cuuuaaacuucaaaagacug

SEQ ID NO: 22132 - RNA, 19 nt, Homo sapiens
gcuguacuggcuauucuuu

SEQ ID NO: 22133 - RNA, 21 nt, Homo sapiens
gugucugauacuguaagccuu

SEQ ID NO: 22134 - RNA, 18 nt, Homo sapiens
uccgguggggcggcgggg

SEQ ID NO: 22135 - RNA, 19 nt, Homo sapiens
ucuguauaaaacuacucug

SEQ ID NO: 22136 - RNA, 23 nt, Homo sapiens
cgcgaccacccgcugcgcaugcg

SEQ ID NO: 22137 - RNA, 23 nt, Homo sapiens
aggcgguguaggcagccuucauu

SEQ ID NO: 22138 - RNA, 18 nt, Homo sapiens
ccccagcuaggaauccgg

SEQ ID NO: 22139 - RNA, 16 nt, Homo sapiens
cgugcgcgaccggagc

SEQ ID NO: 22140 - RNA, 20 nt, Homo sapiens
cugucauugccaggugucac

SEQ ID NO: 22141 - RNA, 18 nt, Homo sapiens
gagcagucgucgcucgca

SEQ ID NO: 22142 - RNA, 18 nt, Homo sapiens
ggccuccuugcgguuucc

SEQ ID NO: 22143 - RNA, 19 nt, Homo sapiens
uggcggucucugugcucgg

SEQ ID NO: 22144 - RNA, 22 nt, Homo sapiens
acaagaugccaagugcugaggg

SEQ ID NO: 22145 - RNA, 25 nt, Homo sapiens
ucccagcucacucauuucugggucu

SEQ ID NO: 22146 - RNA, 24 nt, Homo sapiens
aauauuuuguuugaauuucucucu

SEQ ID NO: 22147 - RNA, 22 nt, Homo sapiens
aggagaaggggaggggggaggc

SEQ ID NO: 22148 - RNA, 21 nt, Homo sapiens
aggggaggggggaggcugggc

SEQ ID NO: 22149 - RNA, 17 nt, Homo sapiens
ccggggacgcaggaaac

SEQ ID NO: 22150 - RNA, 21 nt, Homo sapiens
gagaaggggaggggggaggcu

SEQ ID NO: 22151 - RNA, 20 nt, Homo sapiens
gaggaggagaaggggagggg

SEQ ID NO: 22152 - RNA, 17 nt, Homo sapiens
ggaggggggaggcuggg

SEQ ID NO: 22153 - RNA, 22 nt, Homo sapiens
ggucuccuccugucacuggggc

SEQ ID NO: 22154 - RNA, 22 nt, Homo sapiens
uaugcauaauggggaaaccugc

SEQ ID NO: 22155 - RNA, 16 nt, Homo sapiens
uggaaucauggugcuc

SEQ ID NO: 22156 - RNA, 19 nt, Homo sapiens
acggcggcccugccacagc

SEQ ID NO: 22157 - RNA, 21 nt, Homo sapiens
agccggagggggagccgcggg

SEQ ID NO: 22158 - RNA, 18 nt, Homo sapiens
cagcagucugagugcggg

SEQ ID NO: 22159 - RNA, 18 nt, Homo sapiens
ccguccgccgccgccgcc

SEQ ID NO: 22160 - RNA, 15 nt, Homo sapiens
gaggagccggagggg

SEQ ID NO: 22161 - RNA, 22 nt, Homo sapiens
gaggaggagccggagggggagc

SEQ ID NO: 22162 - RNA, 18 nt, Homo sapiens
ggaggggugcagguugga

SEQ ID NO: 22163 - RNA, 19 nt, Homo sapiens
gggagccgcggggggcggg

SEQ ID NO: 22164 - RNA, 20 nt, Homo sapiens
gggaggagggauagcagggg

SEQ ID NO: 22165 - RNA, 20 nt, Homo sapiens
gggccgggccgcuccccguc

SEQ ID NO: 22166 - RNA, 19 nt, Homo sapiens
ggggagccgcggggggcgg

SEQ ID NO: 22167 - RNA, 26 nt, Homo sapiens
ggggguguucagagagagauuggggc

SEQ ID NO: 22168 - RNA, 18 nt, Homo sapiens
ggguacaggaugggagga

SEQ ID NO: 22169 - RNA, 17 nt, Homo sapiens
ugccaccccccuccccc

SEQ ID NO: 22170 - RNA, 19 nt, Homo sapiens
aggauugcuugagccugag

SEQ ID NO: 22171 - RNA, 21 nt, Homo sapiens
cgggcuguggcuggcugcccc

SEQ ID NO: 22172 - RNA, 20 nt, Homo sapiens
gggaggauugcuugagccug

SEQ ID NO: 22173 - RNA, 18 nt, Homo sapiens
ucugaggucuccccuuua

SEQ ID NO: 22174 - RNA, 20 nt, Homo sapiens
ugagacccucgggcuguggc

SEQ ID NO: 22175 - RNA, 20 nt, Homo sapiens
ccccaucuccacucccuucc

SEQ ID NO: 22176 - RNA, 24 nt, Homo sapiens
ccucccagucccuccacucugccg

SEQ ID NO: 22177 - RNA, 16 nt, Homo sapiens
cuguuccccucacugc

SEQ ID NO: 22178 - RNA, 18 nt, Homo sapiens
ggaagcagggaggcugga

SEQ ID NO: 22179 - RNA, 22 nt, Homo sapiens
uucuaaggaucuggauccauca

SEQ ID NO: 22180 - RNA, 15 nt, Homo sapiens
uuccagaccagggug

SEQ ID NO: 22181 - RNA, 19 nt, Homo sapiens
gaacccgggaggcggaggc

SEQ ID NO: 22182 - RNA, 18 nt, Homo sapiens
gcucccgguccuccaccc

SEQ ID NO: 22183 - RNA, 17 nt, Homo sapiens
ggccaggaguucgagac

SEQ ID NO: 22184 - RNA, 23 nt, Homo sapiens
uacaaaaauuagcuggguauggu

SEQ ID NO: 22185 - RNA, 23 nt, Homo sapiens
ugccugucaucccagcacuuugg

SEQ ID NO: 22186 - RNA, 18 nt, Homo sapiens
uuucuggggucagucuga

SEQ ID NO: 22187 - RNA, 15 nt, Homo sapiens
gaaaauagcuuuuuc

SEQ ID NO: 22188 - RNA, 17 nt, Homo sapiens
gcagagcggguccugcc

SEQ ID NO: 22189 - RNA, 17 nt, Homo sapiens
uaauggcuauaaaggga

SEQ ID NO: 22190 - RNA, 14 nt, Homo sapiens
caccggaauggacg

SEQ ID NO: 22191 - RNA, 22 nt, Homo sapiens
ccgacccggguccccggcgccc

SEQ ID NO: 22192 - RNA, 22 nt, Homo sapiens
ccuccaccggaauggacggcug

SEQ ID NO: 22193 - RNA, 19 nt, Homo sapiens
ccucggccgccuccagacc

SEQ ID NO: 22194 - RNA, 17 nt, Homo sapiens
cugccgcggacccgccu

SEQ ID NO: 22195 - RNA, 20 nt, Homo sapiens
gagugguucuggcucugcgg

SEQ ID NO: 22196 - RNA, 16 nt, Homo sapiens
ggccgcguccuguccu

SEQ ID NO: 22197 - RNA, 18 nt, Homo sapiens
ucgcggagcagccagccu

SEQ ID NO: 22198 - RNA, 22 nt, Homo sapiens
ugcccuggucugccgcggaccc

SEQ ID NO: 22199 - RNA, 19 nt, Homo sapiens
uggucugccgcggacccgc

SEQ ID NO: 22200 - RNA, 19 nt, Homo sapiens
guucucccuuaccagugac

SEQ ID NO: 22201 - RNA, 22 nt, Homo sapiens
uacuauucccuaauauauaugg

SEQ ID NO: 22202 - RNA, 17 nt, Homo sapiens
ucacuuacccuaaagca

SEQ ID NO: 22203 - RNA, 18 nt, Homo sapiens
ucuuuuguuuaaggagua

SEQ ID NO: 22204 - RNA, 17 nt, Homo sapiens
acaaguguacagugacu

SEQ ID NO: 22205 - RNA, 18 nt, Homo sapiens
agcaguaccagguagcag

SEQ ID NO: 22206 - RNA, 21 nt, Homo sapiens
gagggaccggagaacacuggc

SEQ ID NO: 22207 - RNA, 14 nt, Homo sapiens
ggaucgcagcucuc

SEQ ID NO: 22208 - RNA, 16 nt, Homo sapiens
ggugucuuccucaccc

SEQ ID NO: 22209 - RNA, 19 nt, Homo sapiens
ccugaaaagagaggauuua

SEQ ID NO: 22210 - RNA, 21 nt, Homo sapiens
gcugcaaccaucuuuaaccug

SEQ ID NO: 22211 - RNA, 21 nt, Homo sapiens
uaguaguaaaacagguuuaaa

SEQ ID NO: 22212 - RNA, 19 nt, Homo sapiens
aaauguauguaacuuguau

SEQ ID NO: 22213 - RNA, 21 nt, Homo sapiens
accccuucuuuuuucuuugua

SEQ ID NO: 22214 - RNA, 16 nt, Homo sapiens
caguaagaaucauaaa

SEQ ID NO: 22215 - RNA, 15 nt, Homo sapiens
cgggauagcuuugca

SEQ ID NO: 22216 - RNA, 22 nt, Homo sapiens
gcuggaacuuucccuccuuucc

SEQ ID NO: 22217 - RNA, 17 nt, Homo sapiens
ggagagggguuggggga

SEQ ID NO: 22218 - RNA, 18 nt, Homo sapiens
gucgcuaccaagucuacu

SEQ ID NO: 22219 - RNA, 22 nt, Homo sapiens
uauucuaauaauguauuuucua

SEQ ID NO: 22220 - RNA, 16 nt, Homo sapiens
uggcagugguaugucc

SEQ ID NO: 22221 - RNA, 18 nt, Homo sapiens
uguccucuccucccuuuc

SEQ ID NO: 22222 - RNA, 14 nt, Homo sapiens
uuaagugugguaug

SEQ ID NO: 22223 - RNA, 21 nt, Homo sapiens
acguucgccacacaguccggg

SEQ ID NO: 22224 - RNA, 25 nt, Homo sapiens
cccaguaguaguagaggcgggcggc

SEQ ID NO: 22225 - RNA, 16 nt, Homo sapiens
aucggggccucgaggc

SEQ ID NO: 22226 - RNA, 18 nt, Homo sapiens
ccgccgccgaaccccgcc

SEQ ID NO: 22227 - RNA, 18 nt, Homo sapiens
gaguccaacuuuuaguga

SEQ ID NO: 22228 - RNA, 21 nt, Homo sapiens
uauacagacaucauuguguug

SEQ ID NO: 22229 - RNA, 16 nt, Homo sapiens
ucacagagcaauaugc

SEQ ID NO: 22230 - RNA, 18 nt, Homo sapiens
acccagaaccauaagucc

SEQ ID NO: 22231 - RNA, 19 nt, Homo sapiens
acgggccuacagcuugagg

SEQ ID NO: 22232 - RNA, 26 nt, Homo sapiens
caaacauauccuggaggcccgaaggg

SEQ ID NO: 22233 - RNA, 16 nt, Homo sapiens
caccacacccaccccc

SEQ ID NO: 22234 - RNA, 28 nt, Homo sapiens
cacgagacgggugggaugagugggcaua

SEQ ID NO: 22235 - RNA, 15 nt, Homo sapiens
cagggagaggccuug

SEQ ID NO: 22236 - RNA, 22 nt, Homo sapiens
ccagaggagggcagugccaugu

SEQ ID NO: 22237 - RNA, 22 nt, Homo sapiens
cccuggagcugagcccgguggg

SEQ ID NO: 22238 - RNA, 25 nt, Homo sapiens
ccgugugugugcagggagcggaggc

SEQ ID NO: 22239 - RNA, 19 nt, Homo sapiens
ccuggagucugggcggggc

SEQ ID NO: 22240 - RNA, 19 nt, Homo sapiens
cuccgcaccacagucacgg

SEQ ID NO: 22241 - RNA, 20 nt, Homo sapiens
gcagcagugggcacaggccc

SEQ ID NO: 22242 - RNA, 17 nt, Homo sapiens
gcccagcaaaccugguc

SEQ ID NO: 22243 - RNA, 22 nt, Homo sapiens
gcccggugguguggggcuccca

SEQ ID NO: 22244 - RNA, 16 nt, Homo sapiens
ucacggaaauuccugu

SEQ ID NO: 22245 - RNA, 19 nt, Homo sapiens
uccagaaggaauaguccug

SEQ ID NO: 22246 - RNA, 16 nt, Homo sapiens
ucccagggggaauggc

SEQ ID NO: 22247 - RNA, 19 nt, Homo sapiens
uccuguccgugugugugca

SEQ ID NO: 22248 - RNA, 17 nt, Homo sapiens
uggaggcccgaaggggc

SEQ ID NO: 22249 - RNA, 17 nt, Homo sapiens
uugggaggccgaggcgg

SEQ ID NO: 22250 - RNA, 17 nt, Homo sapiens
uugggaggccgaggugg

SEQ ID NO: 22251 - RNA, 19 nt, Homo sapiens
uuguucugcacauccuggc

SEQ ID NO: 22252 - RNA, 19 nt, Homo sapiens
ccaaugucuucucacaauu

SEQ ID NO: 22253 - RNA, 21 nt, Homo sapiens
gaucagaagagucucuguguc

SEQ ID NO: 22254 - RNA, 20 nt, Homo sapiens
cuccgguguacauugcuugc

SEQ ID NO: 22255 - RNA, 17 nt, Homo sapiens
gguaugaaggggauuug

SEQ ID NO: 22256 - RNA, 18 nt, Homo sapiens
ucacugaggcuccggugu

SEQ ID NO: 22257 - RNA, 21 nt, Homo sapiens
ucgggccaaagugucagcaga

SEQ ID NO: 22258 - RNA, 21 nt, Homo sapiens
aauggcuguuacauugauucc

SEQ ID NO: 22259 - RNA, 20 nt, Homo sapiens
aguacaauucugcugcuuga

SEQ ID NO: 22260 - RNA, 20 nt, Homo sapiens
caaaaauugccaaacugauu

SEQ ID NO: 22261 - RNA, 15 nt, Homo sapiens
ccaguucuucgucag

SEQ ID NO: 22262 - RNA, 20 nt, Homo sapiens
cccagagcaaugguguggau

SEQ ID NO: 22263 - RNA, 18 nt, Homo sapiens
cuuuuguaucguccaugu

SEQ ID NO: 22264 - RNA, 19 nt, Homo sapiens
uagaugccaucauucuuga

SEQ ID NO: 22265 - RNA, 20 nt, Homo sapiens
uagcuguguuuuuucuugcc

SEQ ID NO: 22266 - RNA, 16 nt, Homo sapiens
ugucacaguuagcaau

SEQ ID NO: 22267 - RNA, 19 nt, Homo sapiens
agcaagaagauucugcaaa

SEQ ID NO: 22268 - RNA, 22 nt, Homo sapiens
ccgcgagcuucgccuugacccc

SEQ ID NO: 22269 - RNA, 18 nt, Homo sapiens
cugucgccccccgcgagc

SEQ ID NO: 22270 - RNA, 22 nt, Homo sapiens
uagagauuucuagacuaagaca

SEQ ID NO: 22271 - RNA, 21 nt, Homo sapiens
ucgccccccgcgagcuucgcc

SEQ ID NO: 22272 - RNA, 19 nt, Homo sapiens
ucuagacuaagacaaaauc

SEQ ID NO: 22273 - RNA, 14 nt, Homo sapiens
ucucccggggggcc

SEQ ID NO: 22274 - RNA, 20 nt, Homo sapiens
cgcccaccagccuguccgcu

SEQ ID NO: 22275 - RNA, 14 nt, Homo sapiens
gcccaggccccucc

SEQ ID NO: 22276 - RNA, 22 nt, Homo sapiens
gccucucgcucgcccaccagcc

SEQ ID NO: 22277 - RNA, 18 nt, Homo sapiens
uugcauagauacagagug

SEQ ID NO: 22278 - RNA, 19 nt, Homo sapiens
aagaauauauucuauggau

SEQ ID NO: 22279 - RNA, 18 nt, Homo sapiens
agaucgggaagaaaaagg

SEQ ID NO: 22280 - RNA, 18 nt, Homo sapiens
cacauaugaacuggggaa

SEQ ID NO: 22281 - RNA, 21 nt, Homo sapiens
cacgccaguucccggcgcccc

SEQ ID NO: 22282 - RNA, 19 nt, Homo sapiens
caggggugggggggguggg

SEQ ID NO: 22283 - RNA, 24 nt, Homo sapiens
gaacaaaauuaacaaaaaaaagca

SEQ ID NO: 22284 - RNA, 25 nt, Homo sapiens
gagggggagagggagggcacauucu

SEQ ID NO: 22285 - RNA, 18 nt, Homo sapiens
gaggugcugggggaaagg

SEQ ID NO: 22286 - RNA, 19 nt, Homo sapiens
gaggugcugggggaaaggg

SEQ ID NO: 22287 - RNA, 14 nt, Homo sapiens
ggcugcugguuccg

SEQ ID NO: 22288 - RNA, 19 nt, Homo sapiens
ggggggggugggggggcgg

SEQ ID NO: 22289 - RNA, 16 nt, Homo sapiens
gggggugggggggcgg

SEQ ID NO: 22290 - RNA, 18 nt, Homo sapiens
gggguggggggggugggg

SEQ ID NO: 22291 - RNA, 22 nt, Homo sapiens
gguggggggggugggggggcgg

SEQ ID NO: 22292 - RNA, 19 nt, Homo sapiens
guggaaugucuugagaugg

SEQ ID NO: 22293 - RNA, 21 nt, Homo sapiens
guuacaaaaaaugucguugaa

SEQ ID NO: 22294 - RNA, 17 nt, Homo sapiens
uauugaugugcagugac

SEQ ID NO: 22295 - RNA, 19 nt, Homo sapiens
uuugcucuccaauuucuga

SEQ ID NO: 22296 - RNA, 15 nt, Homo sapiens
aagggcccagggacc

SEQ ID NO: 22297 - RNA, 19 nt, Homo sapiens
acaggacugguguagacag

SEQ ID NO: 22298 - RNA, 20 nt, Homo sapiens
acgcugggguccccguggag

SEQ ID NO: 22299 - RNA, 20 nt, Homo sapiens
agugacugucuucacccugg

SEQ ID NO: 22300 - RNA, 19 nt, Homo sapiens
ccgaccggcgggcgccccc

SEQ ID NO: 22301 - RNA, 16 nt, Homo sapiens
cgcucggcggaggaug

SEQ ID NO: 22302 - RNA, 18 nt, Homo sapiens
gcccgaccggcgggcgcc

SEQ ID NO: 22303 - RNA, 20 nt, Homo sapiens
gcuuccugugccaggcccgg

SEQ ID NO: 22304 - RNA, 20 nt, Homo sapiens
gggcuggggaagacgcuggg

SEQ ID NO: 22305 - RNA, 23 nt, Homo sapiens
ucuagcugcuuccugugccaggc

SEQ ID NO: 22306 - RNA, 15 nt, Homo sapiens
ugggagaacagcggc

SEQ ID NO: 22307 - RNA, 20 nt, Homo sapiens
accaguauaggauauucuag

SEQ ID NO: 22308 - RNA, 15 nt, Homo sapiens
auuuaggucauauuc

SEQ ID NO: 22309 - RNA, 14 nt, Homo sapiens
caguauagaaacaa

SEQ ID NO: 22310 - RNA, 21 nt, Homo sapiens
cauuuguugaauuuuaguuuu

SEQ ID NO: 22311 - RNA, 26 nt, Homo sapiens
cgcgggcgcugccgggcgcuguccua

SEQ ID NO: 22312 - RNA, 21 nt, Homo sapiens
gggcgcgggcgcugccgggcg

SEQ ID NO: 22313 - RNA, 19 nt, Homo sapiens
uacauagaaagaaaaucca

SEQ ID NO: 22314 - RNA, 22 nt, Homo sapiens
ugugggacaguucuaugguugu

SEQ ID NO: 22315 - RNA, 19 nt, Homo sapiens
aacgagugcacggcguguc

SEQ ID NO: 22316 - RNA, 23 nt, Homo sapiens
acaaaaaccacacggucucuaug

SEQ ID NO: 22317 - RNA, 19 nt, Homo sapiens
cucuauggaaauguggaga

SEQ ID NO: 22318 - RNA, 20 nt, Homo sapiens
gggagggaagggacgaggga

SEQ ID NO: 22319 - RNA, 16 nt, Homo sapiens
aaacaccccuauguag

SEQ ID NO: 22320 - RNA, 19 nt, Homo sapiens
acacuuuuguuuaagggaa

SEQ ID NO: 22321 - RNA, 17 nt, Homo sapiens
caccaggacagcggaag

SEQ ID NO: 22322 - RNA, 17 nt, Homo sapiens
caugugguggccaaaac

SEQ ID NO: 22323 - RNA, 20 nt, Homo sapiens
ccaauuuuccucuuccaagg

SEQ ID NO: 22324 - RNA, 20 nt, Homo sapiens
ccagccucauuccuccuucc

SEQ ID NO: 22325 - RNA, 24 nt, Homo sapiens
ccgcccaggcugcuccugccuccg

SEQ ID NO: 22326 - RNA, 18 nt, Homo sapiens
ccuguccuccccuccggc

SEQ ID NO: 22327 - RNA, 20 nt, Homo sapiens
gccagaaggauuaguucagu

SEQ ID NO: 22328 - RNA, 21 nt, Homo sapiens
gccgcggucgccggcucugcc

SEQ ID NO: 22329 - RNA, 23 nt, Homo sapiens
uacaaaggcaaacuuucgcaugu

SEQ ID NO: 22330 - RNA, 18 nt, Homo sapiens
uaccguuuaauuugcuuc

SEQ ID NO: 22331 - RNA, 18 nt, Homo sapiens
uaggauauaacaaacuau

SEQ ID NO: 22332 - RNA, 17 nt, Homo sapiens
uggaaaaugaaaaaggc

SEQ ID NO: 22333 - RNA, 22 nt, Homo sapiens
uggauggauuuuacauuacuuu

SEQ ID NO: 22334 - RNA, 18 nt, Homo sapiens
gcaggaaggggccucuuc

SEQ ID NO: 22335 - RNA, 16 nt, Homo sapiens
gccggagugcacccgc

SEQ ID NO: 22336 - RNA, 22 nt, Homo sapiens
gccggagugcacccgcgacccg

SEQ ID NO: 22337 - RNA, 20 nt, Homo sapiens
gucgggcccggugaccucag

SEQ ID NO: 22338 - RNA, 20 nt, Homo sapiens
uagggaggugacccgcaugg

SEQ ID NO: 22339 - RNA, 21 nt, Homo sapiens
cccuguuucuguucuugcucc

SEQ ID NO: 22340 - RNA, 19 nt, Homo sapiens
uccacaagguugcaagaac

SEQ ID NO: 22341 - RNA, 27 nt, Homo sapiens
uccaucagggaaaggucagaucauauu

SEQ ID NO: 22342 - RNA, 20 nt, Homo sapiens
ucuguucuugcuccucuuca

SEQ ID NO: 22343 - RNA, 21 nt, Homo sapiens
ugcugucacucugcugcagac

SEQ ID NO: 22344 - RNA, 21 nt, Homo sapiens
uucuguucuugcuccucuuca

SEQ ID NO: 22345 - RNA, 16 nt, Homo sapiens
cggcgcucucgcaaag

SEQ ID NO: 22346 - RNA, 21 nt, Homo sapiens
gcccuuggcucacccggcugc

SEQ ID NO: 22347 - RNA, 15 nt, Homo sapiens
gccuucgcuggguga

SEQ ID NO: 22348 - RNA, 18 nt, Homo sapiens
ggaaagagagggaagggg

SEQ ID NO: 22349 - RNA, 18 nt, Homo sapiens
uccugggacccccacccc

SEQ ID NO: 22350 - RNA, 21 nt, Homo sapiens
ucucacaaaacacaguaaucc

SEQ ID NO: 22351 - RNA, 20 nt, Homo sapiens
ugaaaacccggaggggagga

SEQ ID NO: 22352 - RNA, 17 nt, Homo sapiens
ugcagcgguggcagcaa

SEQ ID NO: 22353 - RNA, 18 nt, Homo sapiens
aacacugagaggagguac

SEQ ID NO: 22354 - RNA, 21 nt, Homo sapiens
cagucuccagucccgggcgcc

SEQ ID NO: 22355 - RNA, 19 nt, Homo sapiens
cauauauauauauacauau

SEQ ID NO: 22356 - RNA, 24 nt, Homo sapiens
cccuugguucugcaguccaaacag

SEQ ID NO: 22357 - RNA, 16 nt, Homo sapiens
gccggggcggcggcgg

SEQ ID NO: 22358 - RNA, 18 nt, Homo sapiens
ggcgccugggagcucccc

SEQ ID NO: 22359 - RNA, 17 nt, Homo sapiens
ggcugugggugcaggaa

SEQ ID NO: 22360 - RNA, 20 nt, Homo sapiens
guuuauaaaucauacagugg

SEQ ID NO: 22361 - RNA, 22 nt, Homo sapiens
uaaaaaaagaaaaaaacaaaca

SEQ ID NO: 22362 - RNA, 18 nt, Homo sapiens
uaaacugcaaugaccauc

SEQ ID NO: 22363 - RNA, 20 nt, Homo sapiens
uaauauauauguauauacau

SEQ ID NO: 22364 - RNA, 21 nt, Homo sapiens
uaauauauauguauauacaua

SEQ ID NO: 22365 - RNA, 26 nt, Homo sapiens
uauauacauagugcauauauauauau

SEQ ID NO: 22366 - RNA, 28 nt, Homo sapiens
uauauacauagugcauauauauauauau

SEQ ID NO: 22367 - RNA, 20 nt, Homo sapiens
uauauauacauaugauauau

SEQ ID NO: 22368 - RNA, 23 nt, Homo sapiens
uauauauauauacauaugauaua

SEQ ID NO: 22369 - RNA, 28 nt, Homo sapiens
uauguauauacauagugcauauauauau

SEQ ID NO: 22370 - RNA, 19 nt, Homo sapiens
agggcuucuggacgccgcc

SEQ ID NO: 22371 - RNA, 25 nt, Homo sapiens
uagcauuaauagcuuacguuacuau

SEQ ID NO: 22372 - RNA, 17 nt, Homo sapiens
uggcuucaagacucugu

SEQ ID NO: 22373 - RNA, 18 nt, Homo sapiens
accccccgccaccaccac

SEQ ID NO: 22374 - RNA, 18 nt, Homo sapiens
acgcccgcucccggcucg

SEQ ID NO: 22375 - RNA, 23 nt, Homo sapiens
aggaggaggaggaggagaggaau

SEQ ID NO: 22376 - RNA, 16 nt, Homo sapiens
aggcacuuacaguggu

SEQ ID NO: 22377 - RNA, 18 nt, Homo sapiens
caacaccccagcgccccc

SEQ ID NO: 22378 - RNA, 18 nt, Homo sapiens
ccucgcccgccgccgacc

SEQ ID NO: 22379 - RNA, 24 nt, Homo sapiens
ccugcgccgcgggugcgugaggcc

SEQ ID NO: 22380 - RNA, 18 nt, Homo sapiens
ccuggggauguaggcgcc

SEQ ID NO: 22381 - RNA, 16 nt, Homo sapiens
cugguccccccucugc

SEQ ID NO: 22382 - RNA, 19 nt, Homo sapiens
gaggaggaggaggagagga

SEQ ID NO: 22383 - RNA, 17 nt, Homo sapiens
gccccuuugcgcagugc

SEQ ID NO: 22384 - RNA, 18 nt, Homo sapiens
gcgccggcggcccccggc

SEQ ID NO: 22385 - RNA, 19 nt, Homo sapiens
gcucccgcccgcccgggcc

SEQ ID NO: 22386 - RNA, 23 nt, Homo sapiens
ggcugugugguuaauauggccgg

SEQ ID NO: 22387 - RNA, 21 nt, Homo sapiens
uagaauacagagugcaggcac

SEQ ID NO: 22388 - RNA, 19 nt, Homo sapiens
ugcgcagugcgguguccag

SEQ ID NO: 22389 - RNA, 23 nt, Homo sapiens
uggcagccgaggcugggccaggc

SEQ ID NO: 22390 - RNA, 16 nt, Homo sapiens
cugcaauucuuucaug

SEQ ID NO: 22391 - RNA, 19 nt, Homo sapiens
acagacccagccaccgauc

SEQ ID NO: 22392 - RNA, 18 nt, Homo sapiens
gaggagguggggcgcgcg

SEQ ID NO: 22393 - RNA, 21 nt, Homo sapiens
aagggaaguccugcaaaguuu

SEQ ID NO: 22394 - RNA, 21 nt, Homo sapiens
uucucuugggcuuacuuccga

SEQ ID NO: 22395 - RNA, 18 nt, Homo sapiens
uugcuuuauguuguucuc

SEQ ID NO: 22396 - RNA, 21 nt, Homo sapiens
ccccaaguuugguaccaaaca

SEQ ID NO: 22397 - RNA, 17 nt, Homo sapiens
gcagcaggcagugcugc

SEQ ID NO: 22398 - RNA, 15 nt, Homo sapiens
gccccaucucucccc

SEQ ID NO: 22399 - RNA, 18 nt, Homo sapiens
gccccgccccaucucucc

SEQ ID NO: 22400 - RNA, 16 nt, Homo sapiens
gcccgggacccauggc

SEQ ID NO: 22401 - RNA, 17 nt, Homo sapiens
gccugguggggaagggg

SEQ ID NO: 22402 - RNA, 21 nt, Homo sapiens
gcucccggcuucuccgcuucc

SEQ ID NO: 22403 - RNA, 22 nt, Homo sapiens
ucucuggggggacaaagggaga

SEQ ID NO: 22404 - RNA, 16 nt, Homo sapiens
uggagaggccaaaggc

SEQ ID NO: 22405 - RNA, 19 nt, Homo sapiens
aaggaccccaggggcaggc

SEQ ID NO: 22406 - RNA, 23 nt, Homo sapiens
aggcagccccaagccauccugcc

SEQ ID NO: 22407 - RNA, 20 nt, Homo sapiens
aggggugguacaggggcugg

SEQ ID NO: 22408 - RNA, 18 nt, Homo sapiens
aguggcugcacacccugg

SEQ ID NO: 22409 - RNA, 24 nt, Homo sapiens
ggggaggagagggacaccuggcgg

SEQ ID NO: 22410 - RNA, 17 nt, Homo sapiens
agacuuuggagugagca

SEQ ID NO: 22411 - RNA, 24 nt, Homo sapiens
agaggaggaggcgcaggggagaau

SEQ ID NO: 22412 - RNA, 23 nt, Homo sapiens
aggaggcgcaggggagaauggag

SEQ ID NO: 22413 - RNA, 22 nt, Homo sapiens
gagggggacauggaaaaaacac

SEQ ID NO: 22414 - RNA, 20 nt, Homo sapiens
gaguauaucaggucaaacca

SEQ ID NO: 22415 - RNA, 20 nt, Homo sapiens
gcucccuccccagggccugg

SEQ ID NO: 22416 - RNA, 20 nt, Homo sapiens
ggcaggaggcagacagggag

SEQ ID NO: 22417 - RNA, 17 nt, Homo sapiens
ggcucccuccccagggc

SEQ ID NO: 22418 - RNA, 19 nt, Homo sapiens
uaacguggcaacuguacag

SEQ ID NO: 22419 - RNA, 16 nt, Homo sapiens
gcgcaaaaaacgcccu

SEQ ID NO: 22420 - RNA, 18 nt, Homo sapiens
uaaaaauaaauaucaaca

SEQ ID NO: 22421 - RNA, 19 nt, Homo sapiens
aaggcacugggaggaggaa

SEQ ID NO: 22422 - RNA, 23 nt, Homo sapiens
accugguccagugucacugugaa

SEQ ID NO: 22423 - RNA, 20 nt, Homo sapiens
agcuggcacugcaggugugg

SEQ ID NO: 22424 - RNA, 19 nt, Homo sapiens
aggaaggagagaccaaggc

SEQ ID NO: 22425 - RNA, 21 nt, Homo sapiens
aggaggcaggcgggguguugg

SEQ ID NO: 22426 - RNA, 17 nt, Homo sapiens
cagccacccucuguccc

SEQ ID NO: 22427 - RNA, 17 nt, Homo sapiens
cgcggcccugcagcgcc

SEQ ID NO: 22428 - RNA, 22 nt, Homo sapiens
cggccccccuuccucgagggcc

SEQ ID NO: 22429 - RNA, 21 nt, Homo sapiens
gaugcggacccaccgggcucu

SEQ ID NO: 22430 - RNA, 21 nt, Homo sapiens
gauggcagcagccucacggag

SEQ ID NO: 22431 - RNA, 15 nt, Homo sapiens
guggcuggaagaugg

SEQ ID NO: 22432 - RNA, 23 nt, Homo sapiens
ucacggaguaugcuggccccacu

SEQ ID NO: 22433 - RNA, 17 nt, Homo sapiens
ucucgcggcccugcagc

SEQ ID NO: 22434 - RNA, 22 nt, Homo sapiens
ugcaaggcaugugaaaugcagc

SEQ ID NO: 22435 - RNA, 17 nt, Homo sapiens
acaacauggugucuaga

SEQ ID NO: 22436 - RNA, 21 nt, Homo sapiens
agucaaacuuucucaccaugg

SEQ ID NO: 22437 - RNA, 18 nt, Homo sapiens
caacauggugucuagaca

SEQ ID NO: 22438 - RNA, 19 nt, Homo sapiens
ucgcgcggcuucggccaag

SEQ ID NO: 22439 - RNA, 17 nt, Homo sapiens
ucugugcaucugcucag

SEQ ID NO: 22440 - RNA, 20 nt, Homo sapiens
ccuugugcccacuugcuuug

SEQ ID NO: 22441 - RNA, 17 nt, Homo sapiens
cgcccucccgcccgcgg

SEQ ID NO: 22442 - RNA, 18 nt, Homo sapiens
cucccgcccgcggcuccg

SEQ ID NO: 22443 - RNA, 20 nt, Homo sapiens
ggggaagaaacgugagggac

SEQ ID NO: 22444 - RNA, 18 nt, Homo sapiens
ugcccugagcucggggcc

SEQ ID NO: 22445 - RNA, 16 nt, Homo sapiens
uggguggcaagguggc

SEQ ID NO: 22446 - RNA, 18 nt, Homo sapiens
agccuucgcgaaacuggg

SEQ ID NO: 22447 - RNA, 22 nt, Homo sapiens
agggaccacugauaagacaugg

SEQ ID NO: 22448 - RNA, 17 nt, Homo sapiens
caacaugguaauagaag

SEQ ID NO: 22449 - RNA, 21 nt, Homo sapiens
cagcaaaugauuucaccucuu

SEQ ID NO: 22450 - RNA, 20 nt, Homo sapiens
gugggauucccuccuucuua

SEQ ID NO: 22451 - RNA, 22 nt, Homo sapiens
uuuuuuuuuuuuuauuuucaua

SEQ ID NO: 22452 - RNA, 16 nt, Homo sapiens
aagggccuagcaggaa

SEQ ID NO: 22453 - RNA, 16 nt, Homo sapiens
aauucugaaugguuag

SEQ ID NO: 22454 - RNA, 16 nt, Homo sapiens
caaacucauggugcaa

SEQ ID NO: 22455 - RNA, 18 nt, Homo sapiens
cuagucaccauuuccacc

SEQ ID NO: 22456 - RNA, 19 nt, Homo sapiens
gcauuuuauaaaaacgaga

SEQ ID NO: 22457 - RNA, 20 nt, Homo sapiens
gcuggggccgugugucuauu

SEQ ID NO: 22458 - RNA, 19 nt, Homo sapiens
uaguacuugaaacuaaagu

SEQ ID NO: 22459 - RNA, 18 nt, Homo sapiens
ucuuggguguggcuuuuu

SEQ ID NO: 22460 - RNA, 15 nt, Homo sapiens
uggggccgugugucu

SEQ ID NO: 22461 - RNA, 26 nt, Homo sapiens
uuggguguggcuuuuuugcggagccc

SEQ ID NO: 22462 - RNA, 24 nt, Homo sapiens
aggcagucaggucugaggcagccu

SEQ ID NO: 22463 - RNA, 23 nt, Homo sapiens
caacagcagcaggucaucuuugu

SEQ ID NO: 22464 - RNA, 24 nt, Homo sapiens
ccgucccggcugccgggcgucucc

SEQ ID NO: 22465 - RNA, 22 nt, Homo sapiens
cguccccgaccgucccggcugc

SEQ ID NO: 22466 - RNA, 18 nt, Homo sapiens
gaacgguggccuggaaac

SEQ ID NO: 22467 - RNA, 20 nt, Homo sapiens
gggucucuccucgaccccca

SEQ ID NO: 22468 - RNA, 19 nt, Homo sapiens
gucuuugguuggccagagc

SEQ ID NO: 22469 - RNA, 19 nt, Homo sapiens
uaagcucuuuaaaguagua

SEQ ID NO: 22470 - RNA, 18 nt, Homo sapiens
ucgaagaaauuuucccag

SEQ ID NO: 22471 - RNA, 18 nt, Homo sapiens
ucuucuauuguugaugau

SEQ ID NO: 22472 - RNA, 19 nt, Homo sapiens
uugaagaucucacucaaca

SEQ ID NO: 22473 - RNA, 18 nt, Homo sapiens
uauaauauuucuacauaa

SEQ ID NO: 22474 - RNA, 20 nt, Homo sapiens
ugacauuugacaauuuuuug

SEQ ID NO: 22475 - RNA, 19 nt, Homo sapiens
ccgcagcagcccucagccc

SEQ ID NO: 22476 - RNA, 23 nt, Homo sapiens
gcccgggccgaggggcccgaccg

SEQ ID NO: 22477 - RNA, 24 nt, Homo sapiens
guccgcugcugcccccuucugcuc

SEQ ID NO: 22478 - RNA, 17 nt, Homo sapiens
uauauaauaaugauaua

SEQ ID NO: 22479 - RNA, 15 nt, Homo sapiens
ugggcccucgggggc

SEQ ID NO: 22480 - RNA, 20 nt, Homo sapiens
uguuaacagacaauguuuaa

SEQ ID NO: 22481 - RNA, 20 nt, Homo sapiens
aagcggugagauggagaugg

SEQ ID NO: 22482 - RNA, 23 nt, Homo sapiens
aaguuuacugucaaaaagaggga

SEQ ID NO: 22483 - RNA, 17 nt, Homo sapiens
cccaagggaggggugca

SEQ ID NO: 22484 - RNA, 21 nt, Homo sapiens
gcaaaaaaauauccugguggu

SEQ ID NO: 22485 - RNA, 18 nt, Homo sapiens
uguuguugguggugguug

SEQ ID NO: 22486 - RNA, 21 nt, Homo sapiens
uucccuuuuuuauuccacaca

SEQ ID NO: 22487 - RNA, 18 nt, Homo sapiens
ccccuggcggccgcuccg

SEQ ID NO: 22488 - RNA, 15 nt, Homo sapiens
aggaaccaaacugau

SEQ ID NO: 22489 - RNA, 23 nt, Homo sapiens
aggagcagugggggggggguggg

SEQ ID NO: 22490 - RNA, 26 nt, Homo sapiens
aggagcaguggggggggggugggggg

SEQ ID NO: 22491 - RNA, 19 nt, Homo sapiens
aggaggggcggggcggggc

SEQ ID NO: 22492 - RNA, 21 nt, Homo sapiens
aggcggugacaagagcccggg

SEQ ID NO: 22493 - RNA, 17 nt, Homo sapiens
agggcuuggggggagau

SEQ ID NO: 22494 - RNA, 19 nt, Homo sapiens
aggggcggggacacggggg

SEQ ID NO: 22495 - RNA, 22 nt, Homo sapiens
aguggggggggggugggggggg

SEQ ID NO: 22496 - RNA, 20 nt, Homo sapiens
auccagcaacagugugugug

SEQ ID NO: 22497 - RNA, 16 nt, Homo sapiens
cacagcuaaugggacu

SEQ ID NO: 22498 - RNA, 18 nt, Homo sapiens
caggcaggggguggggua

SEQ ID NO: 22499 - RNA, 18 nt, Homo sapiens
ccuccagaagauucuaag

SEQ ID NO: 22500 - RNA, 18 nt, Homo sapiens
cggggguggggggcggug

SEQ ID NO: 22501 - RNA, 15 nt, Homo sapiens
cguggcggggcuggg

SEQ ID NO: 22502 - RNA, 17 nt, Homo sapiens
cucuuucuaagagagca

SEQ ID NO: 22503 - RNA, 19 nt, Homo sapiens
gagagaccgacgggauugg

SEQ ID NO: 22504 - RNA, 19 nt, Homo sapiens
gaggaggggcggggcgggg

SEQ ID NO: 22505 - RNA, 16 nt, Homo sapiens
ggacggggggcggggc

SEQ ID NO: 22506 - RNA, 15 nt, Homo sapiens
ggacggggucggggg

SEQ ID NO: 22507 - RNA, 19 nt, Homo sapiens
ggaggaggggcggggcggg

SEQ ID NO: 22508 - RNA, 21 nt, Homo sapiens
gggaaggggcgggggggaccg

SEQ ID NO: 22509 - RNA, 19 nt, Homo sapiens
gggaggaggggcggggcgg

SEQ ID NO: 22510 - RNA, 23 nt, Homo sapiens
gggaggggcggggacgcaggggc

SEQ ID NO: 22511 - RNA, 25 nt, Homo sapiens
gggaggggcggggacgcaggggcgg

SEQ ID NO: 22512 - RNA, 26 nt, Homo sapiens
gggaggggcggggacgcaggggcggg

SEQ ID NO: 22513 - RNA, 18 nt, Homo sapiens
ggggcggggcgggagggg

SEQ ID NO: 22514 - RNA, 18 nt, Homo sapiens
ggggcggugaggcggagg

SEQ ID NO: 22515 - RNA, 16 nt, Homo sapiens
ggggggaaggggcggg

SEQ ID NO: 22516 - RNA, 18 nt, Homo sapiens
ggggggcggggcgggagg

SEQ ID NO: 22517 - RNA, 23 nt, Homo sapiens
ggggggcggggcgggaggggcgg

SEQ ID NO: 22518 - RNA, 24 nt, Homo sapiens
ggggggcggggcgggaggggcggg

SEQ ID NO: 22519 - RNA, 15 nt, Homo sapiens
ggggggcggugaggc

SEQ ID NO: 22520 - RNA, 18 nt, Homo sapiens
gggggggggugggggggg

SEQ ID NO: 22521 - RNA, 21 nt, Homo sapiens
gggggggguggggggggaggg

SEQ ID NO: 22522 - RNA, 22 nt, Homo sapiens
gggguggggggcggugaggcgg

SEQ ID NO: 22523 - RNA, 17 nt, Homo sapiens
gggguggggggggaggg

SEQ ID NO: 22524 - RNA, 17 nt, Homo sapiens
ggguggggucugcaagg

SEQ ID NO: 22525 - RNA, 18 nt, Homo sapiens
gguggggucugcaagggg

SEQ ID NO: 22526 - RNA, 17 nt, Homo sapiens
cagcgucagacggggga

SEQ ID NO: 22527 - RNA, 15 nt, Homo sapiens
cggcccccucugcgg

SEQ ID NO: 22528 - RNA, 18 nt, Homo sapiens
cgggggagggggaggaga

SEQ ID NO: 22529 - RNA, 18 nt, Homo sapiens
gcccccucugcggcuugg

SEQ ID NO: 22530 - RNA, 19 nt, Homo sapiens
ggagggggaggagacgaag

SEQ ID NO: 22531 - RNA, 18 nt, Homo sapiens
cagcucuugggccggcag

SEQ ID NO: 22532 - RNA, 19 nt, Homo sapiens
cccucccuuccucuggccc

SEQ ID NO: 22533 - RNA, 17 nt, Homo sapiens
cuuuuucuugcagugcg

SEQ ID NO: 22534 - RNA, 17 nt, Homo sapiens
gcucuugggccggcagc

SEQ ID NO: 22535 - RNA, 15 nt, Homo sapiens
ucugccgaccccacc

SEQ ID NO: 22536 - RNA, 23 nt, Homo sapiens
cccccaccuuccuccagaagguc

SEQ ID NO: 22537 - RNA, 18 nt, Homo sapiens
gaugucccccgcccagca

SEQ ID NO: 22538 - RNA, 22 nt, Homo sapiens
gccugggugcuggagucaggag

SEQ ID NO: 22539 - RNA, 23 nt, Homo sapiens
ggggaagggugguggauccgggg

SEQ ID NO: 22540 - RNA, 20 nt, Homo sapiens
gguucugagagcaaagaggg

SEQ ID NO: 22541 - RNA, 19 nt, Homo sapiens
ucugggccuuugcacuggc

SEQ ID NO: 22542 - RNA, 19 nt, Homo sapiens
ugaagagucagugggggaa

SEQ ID NO: 22543 - RNA, 16 nt, Homo sapiens
gccgcgggcagguccc

SEQ ID NO: 22544 - RNA, 18 nt, Homo sapiens
gccucuccgucccuggac

SEQ ID NO: 22545 - RNA, 23 nt, Homo sapiens
ugggggcugcguguccuaaggag

SEQ ID NO: 22546 - RNA, 22 nt, Homo sapiens
acucuucuugggcugcaggggu

SEQ ID NO: 22547 - RNA, 21 nt, Homo sapiens
cuuugugugugugcaugcgug

SEQ ID NO: 22548 - RNA, 15 nt, Homo sapiens
gcccggcgaagccug

SEQ ID NO: 22549 - RNA, 17 nt, Homo sapiens
gggacucuucuugggcu

SEQ ID NO: 22550 - RNA, 19 nt, Homo sapiens
ugcgugugugcgugugugu

SEQ ID NO: 22551 - RNA, 23 nt, Homo sapiens
ugugugcauguuugugugcgugu

SEQ ID NO: 22552 - RNA, 19 nt, Homo sapiens
ugugugcgugugugcgugu

SEQ ID NO: 22553 - RNA, 18 nt, Homo sapiens
ugugugcguguguguaug

SEQ ID NO: 22554 - RNA, 19 nt, Homo sapiens
ugugugugugcaugcgugu

SEQ ID NO: 22555 - RNA, 26 nt, Homo sapiens
gcuuuuuuuuuccuucuuuaaaucag

SEQ ID NO: 22556 - RNA, 24 nt, Homo sapiens
ucuuuaaaucaguagucuaacaag

SEQ ID NO: 22557 - RNA, 18 nt, Homo sapiens
acacacucacucucugua

SEQ ID NO: 22558 - RNA, 16 nt, Homo sapiens
acuugcagguacggca

SEQ ID NO: 22559 - RNA, 19 nt, Homo sapiens
ccucccucucucuccuguc

SEQ ID NO: 22560 - RNA, 21 nt, Homo sapiens
ccuguuucucuccuguuucuc

SEQ ID NO: 22561 - RNA, 16 nt, Homo sapiens
cucccucccucucucc

SEQ ID NO: 22562 - RNA, 21 nt, Homo sapiens
cugcagccucugguguguggu

SEQ ID NO: 22563 - RNA, 18 nt, Homo sapiens
gcuucggguggggggagg

SEQ ID NO: 22564 - RNA, 20 nt, Homo sapiens
aaagugacgcuugaaaugcu

SEQ ID NO: 22565 - RNA, 19 nt, Homo sapiens
acaaauuuccuuaauaaau

SEQ ID NO: 22566 - RNA, 20 nt, Homo sapiens
accccaaggcaggggcagca

SEQ ID NO: 22567 - RNA, 20 nt, Homo sapiens
acgcuugaaaugcuguguuc

SEQ ID NO: 22568 - RNA, 18 nt, Homo sapiens
acggaggaagggaaagaa

SEQ ID NO: 22569 - RNA, 23 nt, Homo sapiens
acuccgagggaaaagggggagca

SEQ ID NO: 22570 - RNA, 18 nt, Homo sapiens
agcagcuuccgccaucca

SEQ ID NO: 22571 - RNA, 22 nt, Homo sapiens
agccucaggccccacuggcagc

SEQ ID NO: 22572 - RNA, 21 nt, Homo sapiens
agcuguagacggggcacugau

SEQ ID NO: 22573 - RNA, 18 nt, Homo sapiens
aggcagaaauggaagggg

SEQ ID NO: 22574 - RNA, 20 nt, Homo sapiens
auggagccccuguugggcca

SEQ ID NO: 22575 - RNA, 16 nt, Homo sapiens
caagacaacacacacu

SEQ ID NO: 22576 - RNA, 18 nt, Homo sapiens
caaguucugcaagccuuu

SEQ ID NO: 22577 - RNA, 19 nt, Homo sapiens
caccgggcagguccuccag

SEQ ID NO: 22578 - RNA, 16 nt, Homo sapiens
cagggccccugccugc

SEQ ID NO: 22579 - RNA, 19 nt, Homo sapiens
cagucaccaucccccuccc

SEQ ID NO: 22580 - RNA, 20 nt, Homo sapiens
ccacuaugggggcaggagcc

SEQ ID NO: 22581 - RNA, 20 nt, Homo sapiens
ccacugaaagggccuauggc

SEQ ID NO: 22582 - RNA, 17 nt, Homo sapiens
cccagccccauucuccc

SEQ ID NO: 22583 - RNA, 21 nt, Homo sapiens
cccggagcgggagcugggggu

SEQ ID NO: 22584 - RNA, 18 nt, Homo sapiens
cgggagcuggggguugug

SEQ ID NO: 22585 - RNA, 20 nt, Homo sapiens
cguggauaaguguccuuugg

SEQ ID NO: 22586 - RNA, 16 nt, Homo sapiens
cguuggaggacguccc

SEQ ID NO: 22587 - RNA, 18 nt, Homo sapiens
gaccagaugacgcccagg

SEQ ID NO: 22588 - RNA, 22 nt, Homo sapiens
gagcuggccccggaugugggcc

SEQ ID NO: 22589 - RNA, 16 nt, Homo sapiens
gagggggcagacaccc

SEQ ID NO: 22590 - RNA, 16 nt, Homo sapiens
gcaggagccaaaccuc

SEQ ID NO: 22591 - RNA, 19 nt, Homo sapiens
gcggcaacggccuccucgc

SEQ ID NO: 22592 - RNA, 21 nt, Homo sapiens
gcggcggcggcggcggcggcc

SEQ ID NO: 22593 - RNA, 20 nt, Homo sapiens
gcgggaggggaggugccugg

SEQ ID NO: 22594 - RNA, 22 nt, Homo sapiens
gcucuggaaaaggagcuguggu

SEQ ID NO: 22595 - RNA, 18 nt, Homo sapiens
ggaaagguuugggcggga

SEQ ID NO: 22596 - RNA, 15 nt, Homo sapiens
ggaaaugccuuuugc

SEQ ID NO: 22597 - RNA, 15 nt, Homo sapiens
ggaaggggaagggga

SEQ ID NO: 22598 - RNA, 21 nt, Homo sapiens
ggagguggggggagcuggggg

SEQ ID NO: 22599 - RNA, 20 nt, Homo sapiens
ggagugggggaggugggggg

SEQ ID NO: 22600 - RNA, 15 nt, Homo sapiens
ggcaggcagggggcc

SEQ ID NO: 22601 - RNA, 21 nt, Homo sapiens
ggcucacccugaccaggucac

SEQ ID NO: 22602 - RNA, 19 nt, Homo sapiens
gggaaggggacugggggag

SEQ ID NO: 22603 - RNA, 23 nt, Homo sapiens
gggccgggagggguagaccuggg

SEQ ID NO: 22604 - RNA, 19 nt, Homo sapiens
ggggacacagaguucuggc

SEQ ID NO: 22605 - RNA, 16 nt, Homo sapiens
ggggagguggggggag

SEQ ID NO: 22606 - RNA, 22 nt, Homo sapiens
gggggagguggggggagcuggg

SEQ ID NO: 22607 - RNA, 17 nt, Homo sapiens
ggggggagcugggggag

SEQ ID NO: 22608 - RNA, 14 nt, Homo sapiens
guuuuucuuuugga

SEQ ID NO: 22609 - RNA, 18 nt, Homo sapiens
uacaguguccagauacac

SEQ ID NO: 22610 - RNA, 20 nt, Homo sapiens
ucacaccugcuuccuucugc

SEQ ID NO: 22611 - RNA, 20 nt, Homo sapiens
uccaggcuggagccagcucc

SEQ ID NO: 22612 - RNA, 19 nt, Homo sapiens
ucggagcuucgugggaacc

SEQ ID NO: 22613 - RNA, 18 nt, Homo sapiens
ucggcgcggcggcggcgg

SEQ ID NO: 22614 - RNA, 19 nt, Homo sapiens
ucguuuuuuuuucuuuuuu

SEQ ID NO: 22615 - RNA, 18 nt, Homo sapiens
ugaucugggcagggguca

SEQ ID NO: 22616 - RNA, 23 nt, Homo sapiens
ugcagugacuuggaaaguggcaa

SEQ ID NO: 22617 - RNA, 16 nt, Homo sapiens
ugccgacuacguuccg

SEQ ID NO: 22618 - RNA, 14 nt, Homo sapiens
ugccuggaagagaa

SEQ ID NO: 22619 - RNA, 24 nt, Homo sapiens
uggcuaguuuggcacugauggauu

SEQ ID NO: 22620 - RNA, 21 nt, Homo sapiens
ugggagugggggagguggggg

SEQ ID NO: 22621 - RNA, 19 nt, Homo sapiens
uggugcugggccuuccagg

SEQ ID NO: 22622 - RNA, 19 nt, Homo sapiens
ugguguggggccagacuug

SEQ ID NO: 22623 - RNA, 22 nt, Homo sapiens
ugugucugguuauuacccucuu

SEQ ID NO: 22624 - RNA, 19 nt, Homo sapiens
uguuuugaagugggaacau

SEQ ID NO: 22625 - RNA, 21 nt, Homo sapiens
uuggauuggggcugguguggg

SEQ ID NO: 22626 - RNA, 17 nt, Homo sapiens
agcacacgguauacagu

SEQ ID NO: 22627 - RNA, 21 nt, Homo sapiens
ccagaacagaauaccaguuug

SEQ ID NO: 22628 - RNA, 19 nt, Homo sapiens
ccucccuuuccuccagaac

SEQ ID NO: 22629 - RNA, 19 nt, Homo sapiens
acauucagauggggcugga

SEQ ID NO: 22630 - RNA, 19 nt, Homo sapiens
aggaggcugcggggagggg

SEQ ID NO: 22631 - RNA, 23 nt, Homo sapiens
aggcugcggggagggggcucggg

SEQ ID NO: 22632 - RNA, 16 nt, Homo sapiens
cagcccacccuguggc

SEQ ID NO: 22633 - RNA, 19 nt, Homo sapiens
cagcguggccagccaggcc

SEQ ID NO: 22634 - RNA, 22 nt, Homo sapiens
ccccacccccccgacaucccuc

SEQ ID NO: 22635 - RNA, 18 nt, Homo sapiens
cccucuccucuugcuccc

SEQ ID NO: 22636 - RNA, 20 nt, Homo sapiens
ccugaggucagaguucagag

SEQ ID NO: 22637 - RNA, 20 nt, Homo sapiens
cuggcuguucugccuuuggg

SEQ ID NO: 22638 - RNA, 18 nt, Homo sapiens
ggagggagggaggcgguc

SEQ ID NO: 22639 - RNA, 21 nt, Homo sapiens
ggcccccugcuuggcuuggcc

SEQ ID NO: 22640 - RNA, 18 nt, Homo sapiens
gggagggaggcggucagg

SEQ ID NO: 22641 - RNA, 19 nt, Homo sapiens
gggcaggagggagggaggc

SEQ ID NO: 22642 - RNA, 24 nt, Homo sapiens
gggccucagccccagcugccugag

SEQ ID NO: 22643 - RNA, 16 nt, Homo sapiens
gggcuccgcggccggg

SEQ ID NO: 22644 - RNA, 19 nt, Homo sapiens
uccacagcccacccugugg

SEQ ID NO: 22645 - RNA, 17 nt, Homo sapiens
ugggggagcgagagggc

SEQ ID NO: 22646 - RNA, 20 nt, Homo sapiens
aagcgggggucuugggcauc

SEQ ID NO: 22647 - RNA, 18 nt, Homo sapiens
agccgucgcuauggaagc

SEQ ID NO: 22648 - RNA, 22 nt, Homo sapiens
aggcccauuccugaguucugga

SEQ ID NO: 22649 - RNA, 18 nt, Homo sapiens
caggcugcagcaccuggc

SEQ ID NO: 22650 - RNA, 20 nt, Homo sapiens
ucgcuauggaagcggggguc

SEQ ID NO: 22651 - RNA, 16 nt, Homo sapiens
acccuuggcacguaca

SEQ ID NO: 22652 - RNA, 24 nt, Homo sapiens
caccuggucugugccuggagcucc

SEQ ID NO: 22653 - RNA, 18 nt, Homo sapiens
cagcaggccagcuuaccc

SEQ ID NO: 22654 - RNA, 21 nt, Homo sapiens
cuacuuaguacauucauacau

SEQ ID NO: 22655 - RNA, 18 nt, Homo sapiens
gcaagaguccacucguac

SEQ ID NO: 22656 - RNA, 15 nt, Homo sapiens
ggagcuccucugccc

SEQ ID NO: 22657 - RNA, 23 nt, Homo sapiens
gugagggcgagacggcggcgacu

SEQ ID NO: 22658 - RNA, 17 nt, Homo sapiens
uacucgccgcucgccgc

SEQ ID NO: 22659 - RNA, 20 nt, Homo sapiens
uauacaguauaugauccugu

SEQ ID NO: 22660 - RNA, 21 nt, Homo sapiens
uuauauauacaguauaugauc

SEQ ID NO: 22661 - RNA, 21 nt, Homo sapiens
aaacuccuuagaauuauguca

SEQ ID NO: 22662 - RNA, 19 nt, Homo sapiens
aagacacugcaaaggagga

SEQ ID NO: 22663 - RNA, 19 nt, Homo sapiens
gcgcggcggcggggcuacc

SEQ ID NO: 22664 - RNA, 16 nt, Homo sapiens
gcgggagcgaaggcag

SEQ ID NO: 22665 - RNA, 22 nt, Homo sapiens
ggcggcggggcuaccuguacgg

SEQ ID NO: 22666 - RNA, 21 nt, Homo sapiens
uccacugucaccggugcggga

SEQ ID NO: 22667 - RNA, 20 nt, Homo sapiens
cacuugugcuauuuuaucac

SEQ ID NO: 22668 - RNA, 19 nt, Homo sapiens
uucaaaucuucccauggcc

SEQ ID NO: 22669 - RNA, 18 nt, Homo sapiens
aagugauaccugagcucu

SEQ ID NO: 22670 - RNA, 21 nt, Homo sapiens
uguuuuaauaguggaacugug

SEQ ID NO: 22671 - RNA, 17 nt, Homo sapiens
guguccucacugccaga

SEQ ID NO: 22672 - RNA, 23 nt, Homo sapiens
uccauuucacugauuuuuuauua

SEQ ID NO: 22673 - RNA, 18 nt, Homo sapiens
uccccggccgcgcggaga

SEQ ID NO: 22674 - RNA, 23 nt, Homo sapiens
uuugagauguggaaccaggucuu

SEQ ID NO: 22675 - RNA, 17 nt, Homo sapiens
aaaaauccagaaaccag

SEQ ID NO: 22676 - RNA, 26 nt, Homo sapiens
aaccagaucucuguccuggcuccauc

SEQ ID NO: 22677 - RNA, 18 nt, Homo sapiens
acguggcagaggccacag

SEQ ID NO: 22678 - RNA, 21 nt, Homo sapiens
cuuugguaugcugcugcccug

SEQ ID NO: 22679 - RNA, 16 nt, Homo sapiens
gagggaggaaaggaag

SEQ ID NO: 22680 - RNA, 22 nt, Homo sapiens
gcagggagcacguggcagaggc

SEQ ID NO: 22681 - RNA, 16 nt, Homo sapiens
gcuucugucugcucug

SEQ ID NO: 22682 - RNA, 19 nt, Homo sapiens
ucuuucugccuuucaacgg

SEQ ID NO: 22683 - RNA, 19 nt, Homo sapiens
uaaugccuccccuuuagag

SEQ ID NO: 22684 - RNA, 19 nt, Homo sapiens
uccugcgugggggaugggg

SEQ ID NO: 22685 - RNA, 18 nt, Homo sapiens
aaacguugugugcaaguu

SEQ ID NO: 22686 - RNA, 14 nt, Homo sapiens
acaaagauucguuc

SEQ ID NO: 22687 - RNA, 19 nt, Homo sapiens
auagaauauauauuuacuu

SEQ ID NO: 22688 - RNA, 18 nt, Homo sapiens
auauuuacuuuuuaaacu

SEQ ID NO: 22689 - RNA, 17 nt, Homo sapiens
ccuuuucuucuuucaca

SEQ ID NO: 22690 - RNA, 19 nt, Homo sapiens
cgguguccuccguucucga

SEQ ID NO: 22691 - RNA, 21 nt, Homo sapiens
cuugccugauuucuuagauuc

SEQ ID NO: 22692 - RNA, 24 nt, Homo sapiens
gaaaaaugaauauagagacaugaa

SEQ ID NO: 22693 - RNA, 22 nt, Homo sapiens
gacaaugacaguaaucuaggac

SEQ ID NO: 22694 - RNA, 20 nt, Homo sapiens
uggggggaggggggaaccca

SEQ ID NO: 22695 - RNA, 21 nt, Homo sapiens
uggggggaggggggaacccaa

SEQ ID NO: 22696 - RNA, 17 nt, Homo sapiens
cccggccgccucguccc

SEQ ID NO: 22697 - RNA, 19 nt, Homo sapiens
cggcggcggcgguggcggc

SEQ ID NO: 22698 - RNA, 18 nt, Homo sapiens
cgucccggccgcuggcgc

SEQ ID NO: 22699 - RNA, 17 nt, Homo sapiens
cucccggccgccucguc

SEQ ID NO: 22700 - RNA, 20 nt, Homo sapiens
gcucccggccgccucguccc

SEQ ID NO: 22701 - RNA, 18 nt, Homo sapiens
ggcggcggcggcggcggc

SEQ ID NO: 22702 - RNA, 21 nt, Homo sapiens
ucgccuccgccuggccgccuc

SEQ ID NO: 22703 - RNA, 18 nt, Homo sapiens
uggcugcagccucgccug

SEQ ID NO: 22704 - RNA, 17 nt, Homo sapiens
uguccgggucgcaccag

SEQ ID NO: 22705 - RNA, 16 nt, Homo sapiens
uccccaguugucuuuc

SEQ ID NO: 22706 - RNA, 18 nt, Homo sapiens
uccuuagguuuaguguug

SEQ ID NO: 22707 - RNA, 24 nt, Homo sapiens
acagaagucuuuaagguguuucgg

SEQ ID NO: 22708 - RNA, 19 nt, Homo sapiens
ccucucuuaucuaucaaaa

SEQ ID NO: 22709 - RNA, 20 nt, Homo sapiens
ucuggcuuuugucucaaaaa

SEQ ID NO: 22710 - RNA, 18 nt, Homo sapiens
uucuucuuaauuccuugu

SEQ ID NO: 22711 - RNA, 20 nt, Homo sapiens
uuuauguucuucuuaauucc

SEQ ID NO: 22712 - RNA, 20 nt, Homo sapiens
gagaaccacucgggggguca

SEQ ID NO: 22713 - RNA, 18 nt, Homo sapiens
ucuuuauuaauugugcau

SEQ ID NO: 22714 - RNA, 22 nt, Homo sapiens
ugaauggguggggcagggagcc

SEQ ID NO: 22715 - RNA, 23 nt, Homo sapiens
cugcuacuggggcugcucucggc

SEQ ID NO: 22716 - RNA, 19 nt, Homo sapiens
gcucggggcacgcgcugcc

SEQ ID NO: 22717 - RNA, 17 nt, Homo sapiens
ggaggaaaggggugcaa

SEQ ID NO: 22718 - RNA, 17 nt, Homo sapiens
ggaggcggagagcucgg

SEQ ID NO: 22719 - RNA, 19 nt, Homo sapiens
ggcuggcgggcggggggag

SEQ ID NO: 22720 - RNA, 16 nt, Homo sapiens
ggguagggggaggugu

SEQ ID NO: 22721 - RNA, 17 nt, Homo sapiens
cacaaugacauaacagg

SEQ ID NO: 22722 - RNA, 16 nt, Homo sapiens
acagcagguucccaaa

SEQ ID NO: 22723 - RNA, 14 nt, Homo sapiens
aggaccaaugugcu

SEQ ID NO: 22724 - RNA, 15 nt, Homo sapiens
aguuuuggaagaccu

SEQ ID NO: 22725 - RNA, 18 nt, Homo sapiens
caccgggcagguccugag

SEQ ID NO: 22726 - RNA, 19 nt, Homo sapiens
cagagcuggcaccugagcc

SEQ ID NO: 22727 - RNA, 20 nt, Homo sapiens
gaggagaacagucuuugcug

SEQ ID NO: 22728 - RNA, 18 nt, Homo sapiens
gaggcugaggcaagaaga

SEQ ID NO: 22729 - RNA, 19 nt, Homo sapiens
gaguucgagaccagcccag

SEQ ID NO: 22730 - RNA, 19 nt, Homo sapiens
gggcccagggcugggagga

SEQ ID NO: 22731 - RNA, 18 nt, Homo sapiens
uacaguagagaaagauga

SEQ ID NO: 22732 - RNA, 19 nt, Homo sapiens
uaccucagcacucucacag

SEQ ID NO: 22733 - RNA, 14 nt, Homo sapiens
ucagagagaaagau

SEQ ID NO: 22734 - RNA, 25 nt, Homo sapiens
ucagucuagggaggauacacagggu

SEQ ID NO: 22735 - RNA, 16 nt, Homo sapiens
ucgggaggagaacagu

SEQ ID NO: 22736 - RNA, 23 nt, Homo sapiens
ugccuguaaucccagcacuuugg

SEQ ID NO: 22737 - RNA, 17 nt, Homo sapiens
ugcugggaacaggcgug

SEQ ID NO: 22738 - RNA, 20 nt, Homo sapiens
uuaaaaaaauagaaaauauu

SEQ ID NO: 22739 - RNA, 17 nt, Homo sapiens
uugggaggcucaggcgg

SEQ ID NO: 22740 - RNA, 19 nt, Homo sapiens
aggcgaccacaggggccgc

SEQ ID NO: 22741 - RNA, 18 nt, Homo sapiens
aggggaaguuggagucug

SEQ ID NO: 22742 - RNA, 15 nt, Homo sapiens
cccgccgccgcagcc

SEQ ID NO: 22743 - RNA, 22 nt, Homo sapiens
ccuuacaagggccacucgucac

SEQ ID NO: 22744 - RNA, 18 nt, Homo sapiens
cgcagacgggcccagggg

SEQ ID NO: 22745 - RNA, 16 nt, Homo sapiens
cggcccccuugugggg

SEQ ID NO: 22746 - RNA, 18 nt, Homo sapiens
cgggaccccgggggaccu

SEQ ID NO: 22747 - RNA, 19 nt, Homo sapiens
cguggcucccgccgccgca

SEQ ID NO: 22748 - RNA, 19 nt, Homo sapiens
gccccacuggccccauugg

SEQ ID NO: 22749 - RNA, 16 nt, Homo sapiens
ggaccugcggugggca

SEQ ID NO: 22750 - RNA, 21 nt, Homo sapiens
gggcugggaggguccgcuggg

SEQ ID NO: 22751 - RNA, 17 nt, Homo sapiens
uccugcccugaccccag

SEQ ID NO: 22752 - RNA, 19 nt, Homo sapiens
uggcucccgccgccgcagc

SEQ ID NO: 22753 - RNA, 19 nt, Homo sapiens
ugggcagggcagaggguca

SEQ ID NO: 22754 - RNA, 19 nt, Homo sapiens
uucaaauuauuccaugacc

SEQ ID NO: 22755 - RNA, 20 nt, Homo sapiens
aguccgcgcacguuuauuuc

SEQ ID NO: 22756 - RNA, 17 nt, Homo sapiens
cccccugcucccgggcc

SEQ ID NO: 22757 - RNA, 22 nt, Homo sapiens
ggcaggcaggggccaggggccg

SEQ ID NO: 22758 - RNA, 19 nt, Homo sapiens
ucccaguagcggcggcugc

SEQ ID NO: 22759 - RNA, 24 nt, Homo sapiens
aggggcggcggagggggcgguggg

SEQ ID NO: 22760 - RNA, 20 nt, Homo sapiens
uaagguacauuuuucuucua

SEQ ID NO: 22761 - RNA, 21 nt, Homo sapiens
ugaccugcgaaucaugcaccu

SEQ ID NO: 22762 - RNA, 17 nt, Homo sapiens
ugggaaaugucaagggc

SEQ ID NO: 22763 - RNA, 14 nt, Homo sapiens
aguuuuggagacac

SEQ ID NO: 22764 - RNA, 20 nt, Homo sapiens
augcucuuagaaguacuggu

SEQ ID NO: 22765 - RNA, 19 nt, Homo sapiens
auggugcugguugugcgcc

SEQ ID NO: 22766 - RNA, 22 nt, Homo sapiens
cagcuucagaacuccuggaaaa

SEQ ID NO: 22767 - RNA, 16 nt, Homo sapiens
cccugagcuucagccu

SEQ ID NO: 22768 - RNA, 18 nt, Homo sapiens
cccugagcuucagccugg

SEQ ID NO: 22769 - RNA, 23 nt, Homo sapiens
uccugagauuagccaccuccccc

SEQ ID NO: 22770 - RNA, 15 nt, Homo sapiens
ucuugaacuucccag

SEQ ID NO: 22771 - RNA, 18 nt, Homo sapiens
uggugcugguugugcgcc

SEQ ID NO: 22772 - RNA, 20 nt, Homo sapiens
ugguggauauuugugcaaaa

SEQ ID NO: 22773 - RNA, 21 nt, Homo sapiens
uaugaugaccuuuuuccaaug

SEQ ID NO: 22774 - RNA, 28 nt, Homo sapiens
ucugcuuuuacuuuguguacagaccucu

SEQ ID NO: 22775 - RNA, 26 nt, Homo sapiens
aagcuugucugcucuuaaugcauucc

SEQ ID NO: 22776 - RNA, 22 nt, Homo sapiens
acaggguuuugccauauuggcc

SEQ ID NO: 22777 - RNA, 18 nt, Homo sapiens
agccaccgcgcccagccc

SEQ ID NO: 22778 - RNA, 15 nt, Homo sapiens
caucuuggccuccca

SEQ ID NO: 22779 - RNA, 18 nt, Homo sapiens
cauguccaugaaaauuuu

SEQ ID NO: 22780 - RNA, 23 nt, Homo sapiens
gcauuccaaacuccuaguuccac

SEQ ID NO: 22781 - RNA, 18 nt, Homo sapiens
ugaguagcugagauuaua

SEQ ID NO: 22782 - RNA, 18 nt, Homo sapiens
aagauauagaugcagcau

SEQ ID NO: 22783 - RNA, 18 nt, Homo sapiens
agugaagaccugaggugc

SEQ ID NO: 22784 - RNA, 20 nt, Homo sapiens
gugaagaccugaggucuggc

SEQ ID NO: 22785 - RNA, 18 nt, Homo sapiens
ugggcuacaugugugcac

SEQ ID NO: 22786 - RNA, 18 nt, Homo sapiens
ugggguggcgaggguagc

SEQ ID NO: 22787 - RNA, 17 nt, Homo sapiens
cggcggcgggcgcggcc

SEQ ID NO: 22788 - RNA, 17 nt, Homo sapiens
cgggccgggcggcggcg

SEQ ID NO: 22789 - RNA, 19 nt, Homo sapiens
gcucgggugggccagggcu

SEQ ID NO: 22790 - RNA, 18 nt, Homo sapiens
ggcggcggcgggcgcggc

SEQ ID NO: 22791 - RNA, 22 nt, Homo sapiens
agacuggggagggggccuuggg

SEQ ID NO: 22792 - RNA, 21 nt, Homo sapiens
agggugggggcuucgguggcc

SEQ ID NO: 22793 - RNA, 18 nt, Homo sapiens
cugucgccucccaguccu

SEQ ID NO: 22794 - RNA, 19 nt, Homo sapiens
gaggacaggaagcuggacu

SEQ ID NO: 22795 - RNA, 16 nt, Homo sapiens
gcgccgcgccgcgcgc

SEQ ID NO: 22796 - RNA, 23 nt, Homo sapiens
gcgccgcgcgccgaccacuuccg

SEQ ID NO: 22797 - RNA, 19 nt, Homo sapiens
gggccacuccaauggagga

SEQ ID NO: 22798 - RNA, 27 nt, Homo sapiens
gggggacagcugucuggccucgcugag

SEQ ID NO: 22799 - RNA, 21 nt, Homo sapiens
uaaauaaacaugaauauauau

SEQ ID NO: 22800 - RNA, 14 nt, Homo sapiens
uggggugggggugg

SEQ ID NO: 22801 - RNA, 22 nt, Homo sapiens
caacacagaaaccccagaaucg

SEQ ID NO: 22802 - RNA, 18 nt, Homo sapiens
cuugcucauggccaugcc

SEQ ID NO: 22803 - RNA, 21 nt, Homo sapiens
gugagagguucuccuauuugg

SEQ ID NO: 22804 - RNA, 21 nt, Homo sapiens
ugaaggccauucaucuuuaga

SEQ ID NO: 22805 - RNA, 18 nt, Homo sapiens
ccgcccggucucagcucc

SEQ ID NO: 22806 - RNA, 17 nt, Homo sapiens
ccggucucagcuccggc

SEQ ID NO: 22807 - RNA, 17 nt, Homo sapiens
uggguggagcacaggcc

SEQ ID NO: 22808 - RNA, 16 nt, Homo sapiens
uuugguacaaccaaca

SEQ ID NO: 22809 - RNA, 19 nt, Homo sapiens
agccagccgcagcaucugc

SEQ ID NO: 22810 - RNA, 21 nt, Homo sapiens
aggguucaugggaaaggaaaa

SEQ ID NO: 22811 - RNA, 21 nt, Homo sapiens
cagcaggccauagggagaggc

SEQ ID NO: 22812 - RNA, 19 nt, Homo sapiens
ggaaaggaaaagggugagg

SEQ ID NO: 22813 - RNA, 17 nt, Homo sapiens
gggaccacccuccaggg

SEQ ID NO: 22814 - RNA, 22 nt, Homo sapiens
ugcccaggagggcagggagcag

SEQ ID NO: 22815 - RNA, 15 nt, Homo sapiens
aaaugcuacaaccau

SEQ ID NO: 22816 - RNA, 20 nt, Homo sapiens
acacuguguucagcaggguu

SEQ ID NO: 22817 - RNA, 24 nt, Homo sapiens
agaaaacguucagggaagagaaag

SEQ ID NO: 22818 - RNA, 19 nt, Homo sapiens
agaauuccugugcugaagg

SEQ ID NO: 22819 - RNA, 16 nt, Homo sapiens
agugaaggggcacaac

SEQ ID NO: 22820 - RNA, 18 nt, Homo sapiens
aucacuuuccagggggcu

SEQ ID NO: 22821 - RNA, 18 nt, Homo sapiens
auccuccacucaggcccc

SEQ ID NO: 22822 - RNA, 20 nt, Homo sapiens
cacagaaaaggcauccucug

SEQ ID NO: 22823 - RNA, 18 nt, Homo sapiens
ccuuaaauccuucccuuu

SEQ ID NO: 22824 - RNA, 20 nt, Homo sapiens
cucaaaagacaaggaugccu

SEQ ID NO: 22825 - RNA, 18 nt, Homo sapiens
cucuugaucagaucugag

SEQ ID NO: 22826 - RNA, 20 nt, Homo sapiens
cugugccucaugagagaggg

SEQ ID NO: 22827 - RNA, 19 nt, Homo sapiens
cuucagaguuuuuuccaaa

SEQ ID NO: 22828 - RNA, 17 nt, Homo sapiens
gaagagagagaggauaa

SEQ ID NO: 22829 - RNA, 16 nt, Homo sapiens
gagcggaguucggggu

SEQ ID NO: 22830 - RNA, 20 nt, Homo sapiens
gagggagagagaggcuuucu

SEQ ID NO: 22831 - RNA, 16 nt, Homo sapiens
ggguucuugcccuugc

SEQ ID NO: 22832 - RNA, 20 nt, Homo sapiens
uaggaagaagugaaaguugu

SEQ ID NO: 22833 - RNA, 18 nt, Homo sapiens
ucggggucgccggaggac

SEQ ID NO: 22834 - RNA, 20 nt, Homo sapiens
ucugcagagggagugagggc

SEQ ID NO: 22835 - RNA, 20 nt, Homo sapiens
ugagugaaggggcacaacac

SEQ ID NO: 22836 - RNA, 24 nt, Homo sapiens
ugccugggaggcaauaagggaaag

SEQ ID NO: 22837 - RNA, 18 nt, Homo sapiens
ugcguuguuuauguauuc

SEQ ID NO: 22838 - RNA, 18 nt, Homo sapiens
uguuuauguauucucaaa

SEQ ID NO: 22839 - RNA, 21 nt, Homo sapiens
uuuccauuccaucuagcaaaa

SEQ ID NO: 22840 - RNA, 17 nt, Homo sapiens
uuucuuggagaaccaua

SEQ ID NO: 22841 - RNA, 17 nt, Homo sapiens
aaagugaaaguugguag

SEQ ID NO: 22842 - RNA, 20 nt, Homo sapiens
aacacugaucaguuuuuagu

SEQ ID NO: 22843 - RNA, 23 nt, Homo sapiens
agagaaagacaaagcaaaauaaa

SEQ ID NO: 22844 - RNA, 22 nt, Homo sapiens
caagcaaauuacagaguaggug

SEQ ID NO: 22845 - RNA, 19 nt, Homo sapiens
cucuguaaaggaaguuuuu

SEQ ID NO: 22846 - RNA, 20 nt, Homo sapiens
cugaucauuucuuacauacu

SEQ ID NO: 22847 - RNA, 21 nt, Homo sapiens
gauguguucuuugugcaaaaa

SEQ ID NO: 22848 - RNA, 22 nt, Homo sapiens
uacuuuuucuuugccauugacu

SEQ ID NO: 22849 - RNA, 21 nt, Homo sapiens
ucaacauuaugaguuuuauga

SEQ ID NO: 22850 - RNA, 21 nt, Homo sapiens
ucucuuggugacuaacucuuc

SEQ ID NO: 22851 - RNA, 21 nt, Homo sapiens
uguguuuuucauuuauaggcc

SEQ ID NO: 22852 - RNA, 22 nt, Homo sapiens
uuaggaaaaguaugucuguguc

SEQ ID NO: 22853 - RNA, 17 nt, Homo sapiens
uucuaaucaaagagaau

SEQ ID NO: 22854 - RNA, 18 nt, Homo sapiens
uucuaaugacuugccaga

SEQ ID NO: 22855 - RNA, 24 nt, Homo sapiens
uugggaucguuuuaaauuuucuug

SEQ ID NO: 22856 - RNA, 21 nt, Homo sapiens
accuuuccacuuuucaaaagc

SEQ ID NO: 22857 - RNA, 19 nt, Homo sapiens
aggcaaaagcgaagaagac

SEQ ID NO: 22858 - RNA, 17 nt, Homo sapiens
cgaggcaaaagcgaaga

SEQ ID NO: 22859 - RNA, 16 nt, Homo sapiens
uagaagcaugaauggc

SEQ ID NO: 22860 - RNA, 16 nt, Homo sapiens
aggcggagggcuggac

SEQ ID NO: 22861 - RNA, 17 nt, Homo sapiens
ccagccauccaauuuca

SEQ ID NO: 22862 - RNA, 18 nt, Homo sapiens
ccugcucgggcugcgggc

SEQ ID NO: 22863 - RNA, 18 nt, Homo sapiens
cggcgucccgggccccga

SEQ ID NO: 22864 - RNA, 19 nt, Homo sapiens
gccggggcgcuggcuccgc

SEQ ID NO: 22865 - RNA, 17 nt, Homo sapiens
gcgcgcgcggacgugac

SEQ ID NO: 22866 - RNA, 18 nt, Homo sapiens
guggaucuauaguucuag

SEQ ID NO: 22867 - RNA, 22 nt, Homo sapiens
uccagcuggcagcgcagggggc

SEQ ID NO: 22868 - RNA, 21 nt, Homo sapiens
uccugcucgggcugcgggccg

SEQ ID NO: 22869 - RNA, 17 nt, Homo sapiens
uggcuccgcccggcucc

SEQ ID NO: 22870 - RNA, 22 nt, Homo sapiens
uaaggaaaauaaacauuuugcc

SEQ ID NO: 22871 - RNA, 17 nt, Homo sapiens
ucucuaacaaucugugg

SEQ ID NO: 22872 - RNA, 22 nt, Homo sapiens
aggugugagccacugagcccgg

SEQ ID NO: 22873 - RNA, 17 nt, Homo sapiens
ccgcaagucggcggcgg

SEQ ID NO: 22874 - RNA, 22 nt, Homo sapiens
gauuacaggugugagccacuga

SEQ ID NO: 22875 - RNA, 16 nt, Homo sapiens
gcaguccauugacagu

SEQ ID NO: 22876 - RNA, 19 nt, Homo sapiens
gccgggcucgguggcgccg

SEQ ID NO: 22877 - RNA, 20 nt, Homo sapiens
gccgggcucgguggcgccgc

SEQ ID NO: 22878 - RNA, 23 nt, Homo sapiens
ggagaggcgggcacaucccuucc

SEQ ID NO: 22879 - RNA, 16 nt, Homo sapiens
gugcuacucuuggugu

SEQ ID NO: 22880 - RNA, 16 nt, Homo sapiens
uaacaagguagacaca

SEQ ID NO: 22881 - RNA, 18 nt, Homo sapiens
uagugugaagaaaauuga

SEQ ID NO: 22882 - RNA, 19 nt, Homo sapiens
ugaaaggauuucuguuuac

SEQ ID NO: 22883 - RNA, 21 nt, Homo sapiens
ugacaggauuuuuccauguug

SEQ ID NO: 22884 - RNA, 21 nt, Homo sapiens
ugcauuuaaugccuauucaau

SEQ ID NO: 22885 - RNA, 26 nt, Homo sapiens
uggaagcucauuuuuuaaacacugcu

SEQ ID NO: 22886 - RNA, 23 nt, Homo sapiens
uugaagaaaggguuaaauaaaaa

SEQ ID NO: 22887 - RNA, 20 nt, Homo sapiens
cagccgcccgccgcuguccc

SEQ ID NO: 22888 - RNA, 22 nt, Homo sapiens
caggcaagcagggcuggcaggu

SEQ ID NO: 22889 - RNA, 17 nt, Homo sapiens
cagggucccacaagacc

SEQ ID NO: 22890 - RNA, 19 nt, Homo sapiens
cccgccgcacccgccgucc

SEQ ID NO: 22891 - RNA, 19 nt, Homo sapiens
cccgccgucccagccgccc

SEQ ID NO: 22892 - RNA, 18 nt, Homo sapiens
ccgcccgccgcugucccc

SEQ ID NO: 22893 - RNA, 18 nt, Homo sapiens
ccgccgcuguccccgccc

SEQ ID NO: 22894 - RNA, 18 nt, Homo sapiens
cgcuguccccgccccucg

SEQ ID NO: 22895 - RNA, 24 nt, Homo sapiens
cucagcugucuccauucggcucag

SEQ ID NO: 22896 - RNA, 17 nt, Homo sapiens
gacugagccagaucuuc

SEQ ID NO: 22897 - RNA, 19 nt, Homo sapiens
gccgucccagccgcccgcc

SEQ ID NO: 22898 - RNA, 16 nt, Homo sapiens
gcucagcugucuccau

SEQ ID NO: 22899 - RNA, 24 nt, Homo sapiens
aaaaagaaaaaagaaaauagcauu

SEQ ID NO: 22900 - RNA, 21 nt, Homo sapiens
gcagugagcugagaucgugcc

SEQ ID NO: 22901 - RNA, 18 nt, Homo sapiens
ucagggcaucugcgggcc

SEQ ID NO: 22902 - RNA, 20 nt, Homo sapiens
uguguacguguggcuuaaau

SEQ ID NO: 22903 - RNA, 18 nt, Homo sapiens
cuccuaccaccuucuucc

SEQ ID NO: 22904 - RNA, 20 nt, Homo sapiens
gcaagugcucuguuucacac

SEQ ID NO: 22905 - RNA, 15 nt, Homo sapiens
gcagcacaccaacag

SEQ ID NO: 22906 - RNA, 22 nt, Homo sapiens
gggccuguugugggguggggga

SEQ ID NO: 22907 - RNA, 21 nt, Homo sapiens
aagggcacuguuuaaaguagg

SEQ ID NO: 22908 - RNA, 18 nt, Homo sapiens
acacaccagcaugaaugc

SEQ ID NO: 22909 - RNA, 18 nt, Homo sapiens
caggguccuugcugcugc

SEQ ID NO: 22910 - RNA, 18 nt, Homo sapiens
gcacagugucaggccacc

SEQ ID NO: 22911 - RNA, 18 nt, Homo sapiens
gcccuggccucucaacuc

SEQ ID NO: 22912 - RNA, 19 nt, Homo sapiens
gcucagcuuggggacagcc

SEQ ID NO: 22913 - RNA, 21 nt, Homo sapiens
gcuggggcagguggaugcugc

SEQ ID NO: 22914 - RNA, 20 nt, Homo sapiens
ggaccuggggcgagagaagg

SEQ ID NO: 22915 - RNA, 18 nt, Homo sapiens
guccuugcugcugcucga

SEQ ID NO: 22916 - RNA, 23 nt, Homo sapiens
uggaggcugagaaaggaccuggg

SEQ ID NO: 22917 - RNA, 17 nt, Homo sapiens
cacccagaaagaaagaa

SEQ ID NO: 22918 - RNA, 21 nt, Homo sapiens
cggcgauccgcgugcgcggcg

SEQ ID NO: 22919 - RNA, 19 nt, Homo sapiens
cgggcgcucggggacugug

SEQ ID NO: 22920 - RNA, 19 nt, Homo sapiens
gcgcucggggacugugcgc

SEQ ID NO: 22921 - RNA, 17 nt, Homo sapiens
gcggggagcgcgcuggc

SEQ ID NO: 22922 - RNA, 18 nt, Homo sapiens
ugcucuucuccuccucgu

SEQ ID NO: 22923 - RNA, 26 nt, Homo sapiens
uggacuugucgccuccucuuuguaga

SEQ ID NO: 22924 - RNA, 20 nt, Homo sapiens
aaagggcaacaguauuggau

SEQ ID NO: 22925 - RNA, 20 nt, Homo sapiens
ucagcagguguucccguugc

SEQ ID NO: 22926 - RNA, 17 nt, Homo sapiens
uggcuuugggcaguggc

SEQ ID NO: 22927 - RNA, 21 nt, Homo sapiens
ccggggggagccaaggaggac

SEQ ID NO: 22928 - RNA, 25 nt, Homo sapiens
ugagaacuugcagguuaaaaacgca

SEQ ID NO: 22929 - RNA, 21 nt, Homo sapiens
caaggagaguucugccugcug

SEQ ID NO: 22930 - RNA, 22 nt, Homo sapiens
gggaguaggucacccugcccug

SEQ ID NO: 22931 - RNA, 28 nt, Homo sapiens
cgccgcccucagugugucgccgagaucg

SEQ ID NO: 22932 - RNA, 19 nt, Homo sapiens
gccacccacgccuugccca

SEQ ID NO: 22933 - RNA, 20 nt, Homo sapiens
aagcaggaaaauguuuuccu

SEQ ID NO: 22934 - RNA, 17 nt, Homo sapiens
caccgacagugcagcgu

SEQ ID NO: 22935 - RNA, 15 nt, Homo sapiens
gcccuggagcgcggc

SEQ ID NO: 22936 - RNA, 19 nt, Homo sapiens
gcugaugacuggagguggg

SEQ ID NO: 22937 - RNA, 22 nt, Homo sapiens
gcugggugggugggugggugcg

SEQ ID NO: 22938 - RNA, 19 nt, Homo sapiens
uaucuuaauuucugcuuuc

SEQ ID NO: 22939 - RNA, 20 nt, Homo sapiens
ucccccaccuccugccuguc

SEQ ID NO: 22940 - RNA, 21 nt, Homo sapiens
uucaugaauuuccauuuuuag

SEQ ID NO: 22941 - RNA, 18 nt, Homo sapiens
acacagccggacgacacg

SEQ ID NO: 22942 - RNA, 23 nt, Homo sapiens
agcaaaacagcuucuuaaaaaaa

SEQ ID NO: 22943 - RNA, 18 nt, Homo sapiens
cagcagccgcucgcgcag

SEQ ID NO: 22944 - RNA, 16 nt, Homo sapiens
cagccgccgccgcucc

SEQ ID NO: 22945 - RNA, 14 nt, Homo sapiens
caggcccagcgcgc

SEQ ID NO: 22946 - RNA, 19 nt, Homo sapiens
ccgccgccgccgcuggccc

SEQ ID NO: 22947 - RNA, 17 nt, Homo sapiens
ccguggacguucguggc

SEQ ID NO: 22948 - RNA, 23 nt, Homo sapiens
ccuccgcucccggcuccgcuccc

SEQ ID NO: 22949 - RNA, 20 nt, Homo sapiens
ccucggccacgcucccguuc

SEQ ID NO: 22950 - RNA, 22 nt, Homo sapiens
ccugucuuugcugugggaccuc

SEQ ID NO: 22951 - RNA, 19 nt, Homo sapiens
ccuugggggcaccggccgg

SEQ ID NO: 22952 - RNA, 17 nt, Homo sapiens
cggcuccgcucccuccg

SEQ ID NO: 22953 - RNA, 21 nt, Homo sapiens
cgggcucgugcugcgccggcg

SEQ ID NO: 22954 - RNA, 16 nt, Homo sapiens
gcccggcuccucuccc

SEQ ID NO: 22955 - RNA, 19 nt, Homo sapiens
gcgcuccuucuccuccucc

SEQ ID NO: 22956 - RNA, 18 nt, Homo sapiens
gcucccggcuccgcuccc

SEQ ID NO: 22957 - RNA, 20 nt, Homo sapiens
gcucccgguugcacuugucc

SEQ ID NO: 22958 - RNA, 17 nt, Homo sapiens
gcuggcccgccuggccc

SEQ ID NO: 22959 - RNA, 18 nt, Homo sapiens
ggcuguugguuguuguca

SEQ ID NO: 22960 - RNA, 22 nt, Homo sapiens
gggccgcgcucuccuugggggc

SEQ ID NO: 22961 - RNA, 18 nt, Homo sapiens
gugguccgggcucgugcg

SEQ ID NO: 22962 - RNA, 16 nt, Homo sapiens
ugcuucuuguggggcc

SEQ ID NO: 22963 - RNA, 17 nt, Homo sapiens
ggguggcaggggccccg

SEQ ID NO: 22964 - RNA, 18 nt, Homo sapiens
acagaguuuugcucuguu

SEQ ID NO: 22965 - RNA, 17 nt, Homo sapiens
agcucaggcuggcugcc

SEQ ID NO: 22966 - RNA, 19 nt, Homo sapiens
aggaggcagauggggucgg

SEQ ID NO: 22967 - RNA, 17 nt, Homo sapiens
auguguguggucugaga

SEQ ID NO: 22968 - RNA, 20 nt, Homo sapiens
caagucugaacagcaggguu

SEQ ID NO: 22969 - RNA, 22 nt, Homo sapiens
cacauguugcaucucuuuuuag

SEQ ID NO: 22970 - RNA, 23 nt, Homo sapiens
cagaguuuugcucuguugcccag

SEQ ID NO: 22971 - RNA, 18 nt, Homo sapiens
ccucauucucucucagau

SEQ ID NO: 22972 - RNA, 20 nt, Homo sapiens
ccuuguuucuaguucaguuc

SEQ ID NO: 22973 - RNA, 16 nt, Homo sapiens
gccaucuggcccgugc

SEQ ID NO: 22974 - RNA, 19 nt, Homo sapiens
gccugggagacaagagaga

SEQ ID NO: 22975 - RNA, 26 nt, Homo sapiens
uacauuauuggcuuucuuuugugagc

SEQ ID NO: 22976 - RNA, 16 nt, Homo sapiens
uacccuuugcaagcag

SEQ ID NO: 22977 - RNA, 17 nt, Homo sapiens
ucacagcaaccacagcc

SEQ ID NO: 22978 - RNA, 20 nt, Homo sapiens
ucuagaacuacccagaauga

SEQ ID NO: 22979 - RNA, 24 nt, Homo sapiens
ugcaaacugagcuucaguguggaa

SEQ ID NO: 22980 - RNA, 23 nt, Homo sapiens
ugccuguaauccuggcacuuugg

SEQ ID NO: 22981 - RNA, 21 nt, Homo sapiens
uggugcugagcagccaucagg

SEQ ID NO: 22982 - RNA, 19 nt, Homo sapiens
uguggagggggaggagggg

SEQ ID NO: 22983 - RNA, 17 nt, Homo sapiens
uguggcucagcaggugc

SEQ ID NO: 22984 - RNA, 23 nt, Homo sapiens
uguggcucagcaggugccaaaug

SEQ ID NO: 22985 - RNA, 17 nt, Homo sapiens
uugggaggccaaggugg

SEQ ID NO: 22986 - RNA, 23 nt, Homo sapiens
aggcauuuggaagauuuuaaaaa

SEQ ID NO: 22987 - RNA, 21 nt, Homo sapiens
aguggcggcaggcccugcgcc

SEQ ID NO: 22988 - RNA, 17 nt, Homo sapiens
aguggguacccccuuug

SEQ ID NO: 22989 - RNA, 20 nt, Homo sapiens
cagaagaccagggccccaug

SEQ ID NO: 22990 - RNA, 17 nt, Homo sapiens
gggcagagaaggcagcu

SEQ ID NO: 22991 - RNA, 20 nt, Homo sapiens
gggccugucacccugaggga

SEQ ID NO: 22992 - RNA, 21 nt, Homo sapiens
gucauucucugccucugagga

SEQ ID NO: 22993 - RNA, 22 nt, Homo sapiens
uccuagagaaggcagggaaugg

SEQ ID NO: 22994 - RNA, 21 nt, Homo sapiens
ugaugugaaagauggauaugg

SEQ ID NO: 22995 - RNA, 16 nt, Homo sapiens
ugccuugggaggucug

SEQ ID NO: 22996 - RNA, 15 nt, Homo sapiens
uggcucacugaaggg

SEQ ID NO: 22997 - RNA, 18 nt, Homo sapiens
guagugcuugguucuagc

SEQ ID NO: 22998 - RNA, 18 nt, Homo sapiens
uaaacauuuuauuuggca

SEQ ID NO: 22999 - RNA, 21 nt, Homo sapiens
uaagaacaggucacauaggag

SEQ ID NO: 23000 - RNA, 18 nt, Homo sapiens
aggggucuggcuucucca

SEQ ID NO: 23001 - RNA, 18 nt, Homo sapiens
cccagaaagggcagccgg

SEQ ID NO: 23002 - RNA, 21 nt, Homo sapiens
ccgggcguggugguaggugcc

SEQ ID NO: 23003 - RNA, 15 nt, Homo sapiens
ccuccacacccuagc

SEQ ID NO: 23004 - RNA, 20 nt, Homo sapiens
ccucccugccuucccccucc

SEQ ID NO: 23005 - RNA, 23 nt, Homo sapiens
cuccugccaaggucagaggcaaa

SEQ ID NO: 23006 - RNA, 19 nt, Homo sapiens
gaggccgaggcaggucgau

SEQ ID NO: 23007 - RNA, 17 nt, Homo sapiens
gagucuuagcaugaggc

SEQ ID NO: 23008 - RNA, 18 nt, Homo sapiens
gcaccaaguccuccacac

SEQ ID NO: 23009 - RNA, 17 nt, Homo sapiens
uugggaggccaaggcgg

SEQ ID NO: 23010 - RNA, 21 nt, Homo sapiens
cagagucccugcaaaauggcc

SEQ ID NO: 23011 - RNA, 21 nt, Homo sapiens
ccuguugccucuagcaucauu

SEQ ID NO: 23012 - RNA, 20 nt, Homo sapiens
cuuuagaacuuucaauuuua

SEQ ID NO: 23013 - RNA, 19 nt, Homo sapiens
gagauaauuuuguugaauc

SEQ ID NO: 23014 - RNA, 16 nt, Homo sapiens
uaccuacuggguaugu

SEQ ID NO: 23015 - RNA, 17 nt, Homo sapiens
gccuguagucccagcug

SEQ ID NO: 23016 - RNA, 19 nt, Homo sapiens
gcugagggugauggugugu

SEQ ID NO: 23017 - RNA, 18 nt, Homo sapiens
uagcugagggugauggug

SEQ ID NO: 23018 - RNA, 17 nt, Homo sapiens
aagaagagagagggaau

SEQ ID NO: 23019 - RNA, 18 nt, Homo sapiens
accuguaucaucuuuucu

SEQ ID NO: 23020 - RNA, 18 nt, Homo sapiens
cacuugggagaugguccc

SEQ ID NO: 23021 - RNA, 23 nt, Homo sapiens
ccgccccuagcuccgcccggccg

SEQ ID NO: 23022 - RNA, 18 nt, Homo sapiens
cucugguguucuuuuaua

SEQ ID NO: 23023 - RNA, 21 nt, Homo sapiens
ggaucccuccugucuggggcc

SEQ ID NO: 23024 - RNA, 21 nt, Homo sapiens
uacaguuuacuguuucauggu

SEQ ID NO: 23025 - RNA, 21 nt, Homo sapiens
uaugccacugucuuaucuuuu

SEQ ID NO: 23026 - RNA, 16 nt, Homo sapiens
uccgccacgcggcgug

SEQ ID NO: 23027 - RNA, 23 nt, Homo sapiens
uccgucaguccguccguccgcca

SEQ ID NO: 23028 - RNA, 18 nt, Homo sapiens
ugaaggagggggagagga

SEQ ID NO: 23029 - RNA, 24 nt, Homo sapiens
uggacugcaagaagagagagggaa

SEQ ID NO: 23030 - RNA, 21 nt, Homo sapiens
uggggugggggcggcuauggg

SEQ ID NO: 23031 - RNA, 18 nt, Homo sapiens
uugcuuuguuuguuuugc

SEQ ID NO: 23032 - RNA, 19 nt, Homo sapiens
uuggaaauucuuccagaga

SEQ ID NO: 23033 - RNA, 21 nt, Homo sapiens
caaaaaaagaaaaagaaaagc

SEQ ID NO: 23034 - RNA, 16 nt, Homo sapiens
cagcaggcucccuccu

SEQ ID NO: 23035 - RNA, 20 nt, Homo sapiens
ccugcuccuccgaguccggc

SEQ ID NO: 23036 - RNA, 18 nt, Homo sapiens
cugaucaucucaccuacu

SEQ ID NO: 23037 - RNA, 20 nt, Homo sapiens
ggcgaacugauuuucauggg

SEQ ID NO: 23038 - RNA, 19 nt, Homo sapiens
gucacucacuagguuacgu

SEQ ID NO: 23039 - RNA, 23 nt, Homo sapiens
uaaguuuacuaacggaacucugg

SEQ ID NO: 23040 - RNA, 15 nt, Homo sapiens
uugcaccagcugaag

SEQ ID NO: 23041 - RNA, 19 nt, Homo sapiens
gacacagagaaacaguauc

SEQ ID NO: 23042 - RNA, 19 nt, Homo sapiens
ugggauauuucaagcuguu

SEQ ID NO: 23043 - RNA, 17 nt, Homo sapiens
ugggccacacacgagaa

SEQ ID NO: 23044 - RNA, 19 nt, Homo sapiens
uguagcaucccugcuguug

SEQ ID NO: 23045 - RNA, 23 nt, Homo sapiens
cccuuaagauguuaauuauagaa

SEQ ID NO: 23046 - RNA, 24 nt, Homo sapiens
uaucaagaguagugugacuuuugc

SEQ ID NO: 23047 - RNA, 23 nt, Homo sapiens
uugugguggggugggggcauggg

SEQ ID NO: 23048 - RNA, 18 nt, Homo sapiens
cccaagucuagaaaaaga

SEQ ID NO: 23049 - RNA, 18 nt, Homo sapiens
uguaacauguacaaagua

SEQ ID NO: 23050 - RNA, 18 nt, Homo sapiens
agcuuuucucauaugcug

SEQ ID NO: 23051 - RNA, 16 nt, Homo sapiens
caauccugacccgagu

SEQ ID NO: 23052 - RNA, 16 nt, Homo sapiens
gaacucgguggcagag

SEQ ID NO: 23053 - RNA, 21 nt, Homo sapiens
gaucugggcucaccgcaaccu

SEQ ID NO: 23054 - RNA, 20 nt, Homo sapiens
ugugaaauuuuggccccaaa

SEQ ID NO: 23055 - RNA, 16 nt, Homo sapiens
caaaacaauauuuguu

SEQ ID NO: 23056 - RNA, 20 nt, Homo sapiens
caaugaaaaauagcaggguu

SEQ ID NO: 23057 - RNA, 18 nt, Homo sapiens
uagagucaaugaaaaaua

SEQ ID NO: 23058 - RNA, 21 nt, Homo sapiens
gggugggugaggcaggguggg

SEQ ID NO: 23059 - RNA, 22 nt, Homo sapiens
ugcuggaucauaaaauauuuuu

SEQ ID NO: 23060 - RNA, 17 nt, Homo sapiens
agaaacucucuucaaag

SEQ ID NO: 23061 - RNA, 21 nt, Homo sapiens
cuuuuauguguagccugacac

SEQ ID NO: 23062 - RNA, 19 nt, Homo sapiens
uauguguagccugacacgu

SEQ ID NO: 23063 - RNA, 18 nt, Homo sapiens
gggauuacaggcgccgcc

SEQ ID NO: 23064 - RNA, 23 nt, Homo sapiens
ucgaacuccugaccucaagugau

SEQ ID NO: 23065 - RNA, 20 nt, Homo sapiens
aaacaccccuuucaaaaggg

SEQ ID NO: 23066 - RNA, 23 nt, Homo sapiens
aaacaccccuuucaaaaggggcu

SEQ ID NO: 23067 - RNA, 16 nt, Homo sapiens
cccaggaaguuggggg

SEQ ID NO: 23068 - RNA, 15 nt, Homo sapiens
gggggguggggagag

SEQ ID NO: 23069 - RNA, 16 nt, Homo sapiens
gggggguggggagagg

SEQ ID NO: 23070 - RNA, 16 nt, Homo sapiens
gggguggggggugggg

SEQ ID NO: 23071 - RNA, 17 nt, Homo sapiens
ugggggguggggggugg

SEQ ID NO: 23072 - RNA, 19 nt, Homo sapiens
uuggggggugggggguggg

SEQ ID NO: 23073 - RNA, 22 nt, Homo sapiens
aagcaggaaagacaccgagauu

SEQ ID NO: 23074 - RNA, 20 nt, Homo sapiens
aaggaaaaugcucugccaau

SEQ ID NO: 23075 - RNA, 19 nt, Homo sapiens
uacaguaugugaagaaguu

SEQ ID NO: 23076 - RNA, 15 nt, Homo sapiens
ucacacacagggcug

SEQ ID NO: 23077 - RNA, 18 nt, Homo sapiens
ucccaagaguggucacag

SEQ ID NO: 23078 - RNA, 19 nt, Homo sapiens
uggccacagagcccagcaa

SEQ ID NO: 23079 - RNA, 17 nt, Homo sapiens
uguaaauguguacagca

SEQ ID NO: 23080 - RNA, 21 nt, Homo sapiens
gcucagcuuguuaauucuaau

SEQ ID NO: 23081 - RNA, 15 nt, Homo sapiens
uucuguaaugacugc

SEQ ID NO: 23082 - RNA, 18 nt, Homo sapiens
aaagaggucuucagcaca

SEQ ID NO: 23083 - RNA, 23 nt, Homo sapiens
acagugugagaaugugucaagaa

SEQ ID NO: 23084 - RNA, 18 nt, Homo sapiens
agugcaaccguugugaca

SEQ ID NO: 23085 - RNA, 22 nt, Homo sapiens
agugcaugugggauccacggca

SEQ ID NO: 23086 - RNA, 18 nt, Homo sapiens
cagcaccacagaacugca

SEQ ID NO: 23087 - RNA, 15 nt, Homo sapiens
cagcaggccaagcuc

SEQ ID NO: 23088 - RNA, 18 nt, Homo sapiens
cccaggauggugguuuca

SEQ ID NO: 23089 - RNA, 17 nt, Homo sapiens
ccccagggaccgguguu

SEQ ID NO: 23090 - RNA, 20 nt, Homo sapiens
ccggggcggcugggaggccg

SEQ ID NO: 23091 - RNA, 20 nt, Homo sapiens
ccuggaagagugggccccca

SEQ ID NO: 23092 - RNA, 22 nt, Homo sapiens
cugcgcugcugaggaggggccg

SEQ ID NO: 23093 - RNA, 19 nt, Homo sapiens
gcagaaggcgggcuguggu

SEQ ID NO: 23094 - RNA, 14 nt, Homo sapiens
gccggaccgggccg

SEQ ID NO: 23095 - RNA, 21 nt, Homo sapiens
gccugcugcucuggaaccugg

SEQ ID NO: 23096 - RNA, 19 nt, Homo sapiens
ggagccacaguggcagcgg

SEQ ID NO: 23097 - RNA, 15 nt, Homo sapiens
ggaguccauccccga

SEQ ID NO: 23098 - RNA, 21 nt, Homo sapiens
ggcccccuccugagggcggcc

SEQ ID NO: 23099 - RNA, 19 nt, Homo sapiens
ggggcauucuggauggugg

SEQ ID NO: 23100 - RNA, 20 nt, Homo sapiens
uggcagaaggcgggcugugg

SEQ ID NO: 23101 - RNA, 19 nt, Homo sapiens
ugggauggaaaaaaugggu

SEQ ID NO: 23102 - RNA, 16 nt, Homo sapiens
ugggcccccagugacc

SEQ ID NO: 23103 - RNA, 21 nt, Homo sapiens
cgcggcggggccgcgcgucag

SEQ ID NO: 23104 - RNA, 19 nt, Homo sapiens
uucauuuaugagcugcuac

SEQ ID NO: 23105 - RNA, 18 nt, Homo sapiens
uuuaauggaguagaacua

SEQ ID NO: 23106 - RNA, 21 nt, Homo sapiens
gagauguuugauagaagcuga

SEQ ID NO: 23107 - RNA, 20 nt, Homo sapiens
uugcauagauuuaaaaugaa

SEQ ID NO: 23108 - RNA, 16 nt, Homo sapiens
cuuugcccucuuccag

SEQ ID NO: 23109 - RNA, 18 nt, Homo sapiens
gugagcuccgacaccggc

SEQ ID NO: 23110 - RNA, 19 nt, Homo sapiens
cgagcccggcugccgccga

SEQ ID NO: 23111 - RNA, 20 nt, Homo sapiens
gagcuuuauuuaauaugaag

SEQ ID NO: 23112 - RNA, 21 nt, Homo sapiens
uagucugcuuuauugugcauc

SEQ ID NO: 23113 - RNA, 16 nt, Homo sapiens
gcgcggugguggcggc

SEQ ID NO: 23114 - RNA, 17 nt, Homo sapiens
gcggcgggaggcggcgg

SEQ ID NO: 23115 - RNA, 18 nt, Homo sapiens
ggaggcggcggcgcagga

SEQ ID NO: 23116 - RNA, 20 nt, Homo sapiens
ggaggcggcggcgcaggaga

SEQ ID NO: 23117 - RNA, 18 nt, Homo sapiens
guggcuacagaauggugg

SEQ ID NO: 23118 - RNA, 22 nt, Homo sapiens
uccaaagauaauuuucucuucu

SEQ ID NO: 23119 - RNA, 19 nt, Homo sapiens
ugggccugacgagggcggc

SEQ ID NO: 23120 - RNA, 18 nt, Homo sapiens
uugaaaggcauuucaacu

SEQ ID NO: 23121 - RNA, 24 nt, Homo sapiens
cagccuggcccaguuucuccugcc

SEQ ID NO: 23122 - RNA, 25 nt, Homo sapiens
ccagggggguacucgacacaacgug

SEQ ID NO: 23123 - RNA, 15 nt, Homo sapiens
gaggaaacaggcgga

SEQ ID NO: 23124 - RNA, 21 nt, Homo sapiens
uccagcagcagcaccuggucg

SEQ ID NO: 23125 - RNA, 16 nt, Homo sapiens
ggaggaaggugcggga

SEQ ID NO: 23126 - RNA, 21 nt, Homo sapiens
ggugggagcggggcuggcggg

SEQ ID NO: 23127 - RNA, 18 nt, Homo sapiens
acguggauuuguaaaauu

SEQ ID NO: 23128 - RNA, 24 nt, Homo sapiens
agcugaccccaagccgaagggucc

SEQ ID NO: 23129 - RNA, 20 nt, Homo sapiens
gagaaaacaaacuucacagg

SEQ ID NO: 23130 - RNA, 20 nt, Homo sapiens
gcagaugcugcugggaccag

SEQ ID NO: 23131 - RNA, 17 nt, Homo sapiens
ggcggcggcggcggcgg

SEQ ID NO: 23132 - RNA, 20 nt, Homo sapiens
ggggagucuaagauguguuu

SEQ ID NO: 23133 - RNA, 20 nt, Homo sapiens
uuuugguaauuaucuuccaa

SEQ ID NO: 23134 - RNA, 17 nt, Homo sapiens
acccaggcuggcucggc

SEQ ID NO: 23135 - RNA, 15 nt, Homo sapiens
agaacugugacacag

SEQ ID NO: 23136 - RNA, 18 nt, Homo sapiens
aggaggcguggaggggcc

SEQ ID NO: 23137 - RNA, 15 nt, Homo sapiens
ccagagagaugacag

SEQ ID NO: 23138 - RNA, 23 nt, Homo sapiens
cguggaggggcccagggauggcc

SEQ ID NO: 23139 - RNA, 19 nt, Homo sapiens
ggaaagguuaagcgucgaa

SEQ ID NO: 23140 - RNA, 18 nt, Homo sapiens
ggccaggaggcguggagg

SEQ ID NO: 23141 - RNA, 18 nt, Homo sapiens
ucccccaucccugguccc

SEQ ID NO: 23142 - RNA, 17 nt, Homo sapiens
ugcagcggcagcggcag

SEQ ID NO: 23143 - RNA, 18 nt, Homo sapiens
ugugccugccacccccag

SEQ ID NO: 23144 - RNA, 19 nt, Homo sapiens
uuuccaucugggcucgaga

SEQ ID NO: 23145 - RNA, 23 nt, Homo sapiens
aaagugcaugauuagggcaaguc

SEQ ID NO: 23146 - RNA, 20 nt, Homo sapiens
aacagaagagcaagcagaaa

SEQ ID NO: 23147 - RNA, 15 nt, Homo sapiens
acacuucgucuaacu

SEQ ID NO: 23148 - RNA, 19 nt, Homo sapiens
acuaugauucucagaaucc

SEQ ID NO: 23149 - RNA, 17 nt, Homo sapiens
ccccagcaaauguuuua

SEQ ID NO: 23150 - RNA, 20 nt, Homo sapiens
cgaacaaaaccggcucuagc

SEQ ID NO: 23151 - RNA, 24 nt, Homo sapiens
uaacauacuucaugcaguauaaca

SEQ ID NO: 23152 - RNA, 19 nt, Homo sapiens
ucucuuccacuguuguguu

SEQ ID NO: 23153 - RNA, 18 nt, Homo sapiens
ucugcagcguuucucuuc

SEQ ID NO: 23154 - RNA, 18 nt, Homo sapiens
ugaaaaugaggagagagc

SEQ ID NO: 23155 - RNA, 21 nt, Homo sapiens
ugcuauuauagcccaguuuga

SEQ ID NO: 23156 - RNA, 18 nt, Homo sapiens
uugauacauuuuagccau

SEQ ID NO: 23157 - RNA, 15 nt, Homo sapiens
ccugugcgcagccag

SEQ ID NO: 23158 - RNA, 20 nt, Homo sapiens
guaugguauguacucaaggc

SEQ ID NO: 23159 - RNA, 18 nt, Homo sapiens
ugcccucagucaugaggg

SEQ ID NO: 23160 - RNA, 23 nt, Homo sapiens
ugcgcagccaguuagcagccgca

SEQ ID NO: 23161 - RNA, 15 nt, Homo sapiens
agagggugaauucca

SEQ ID NO: 23162 - RNA, 23 nt, Homo sapiens
aggcugcugggacuaucugggaa

SEQ ID NO: 23163 - RNA, 19 nt, Homo sapiens
ugcgcccucacguccccug

SEQ ID NO: 23164 - RNA, 23 nt, Homo sapiens
uggaauuuuggaauuggaaaggg

SEQ ID NO: 23165 - RNA, 16 nt, Homo sapiens
aggggugggagcccca

SEQ ID NO: 23166 - RNA, 16 nt, Homo sapiens
cagcaagccugguccu

SEQ ID NO: 23167 - RNA, 18 nt, Homo sapiens
ccagggcaggcggcggcc

SEQ ID NO: 23168 - RNA, 19 nt, Homo sapiens
cgcuggagccgggaagcgg

SEQ ID NO: 23169 - RNA, 18 nt, Homo sapiens
cggcccguguccgggggg

SEQ ID NO: 23170 - RNA, 17 nt, Homo sapiens
gcuucuggagcggcggc

SEQ ID NO: 23171 - RNA, 17 nt, Homo sapiens
ggagccccauccugguu

SEQ ID NO: 23172 - RNA, 20 nt, Homo sapiens
ggagcuggggagaggggugg

SEQ ID NO: 23173 - RNA, 16 nt, Homo sapiens
gggagaggggugggag

SEQ ID NO: 23174 - RNA, 18 nt, Homo sapiens
uccgggcaggggguccgc

SEQ ID NO: 23175 - RNA, 16 nt, Homo sapiens
ugccacuaaagaaggg

SEQ ID NO: 23176 - RNA, 15 nt, Homo sapiens
uggcaggcugaaggg

SEQ ID NO: 23177 - RNA, 16 nt, Homo sapiens
ugggagggggugcggc

SEQ ID NO: 23178 - RNA, 18 nt, Homo sapiens
uggggcgcuggagccggg

SEQ ID NO: 23179 - RNA, 17 nt, Homo sapiens
ugggugccccagggggc

SEQ ID NO: 23180 - RNA, 21 nt, Homo sapiens
cgggguccggguggaggucgg

SEQ ID NO: 23181 - RNA, 16 nt, Homo sapiens
gccgggccaggccggg

SEQ ID NO: 23182 - RNA, 18 nt, Homo sapiens
gcgggggccgggccaggc

SEQ ID NO: 23183 - RNA, 20 nt, Homo sapiens
gggcgggggcgggggccggg

SEQ ID NO: 23184 - RNA, 19 nt, Homo sapiens
ccagggcacgcguccuagg

SEQ ID NO: 23185 - RNA, 22 nt, Homo sapiens
cgccugcauccacccgcccgcu

SEQ ID NO: 23186 - RNA, 16 nt, Homo sapiens
cggcgcgccgcaggaa

SEQ ID NO: 23187 - RNA, 17 nt, Homo sapiens
ggggcuucuggcacggc

SEQ ID NO: 23188 - RNA, 21 nt, Homo sapiens
acauauaaaaucaucagucug

SEQ ID NO: 23189 - RNA, 18 nt, Homo sapiens
aggaggcgcgcggggcug

SEQ ID NO: 23190 - RNA, 18 nt, Homo sapiens
cccccaggaaagaagcag

SEQ ID NO: 23191 - RNA, 19 nt, Homo sapiens
cccugccucccccacugcg

SEQ ID NO: 23192 - RNA, 18 nt, Homo sapiens
cgggacccggugggcaag

SEQ ID NO: 23193 - RNA, 22 nt, Homo sapiens
cuaagaccuccccaccuccccc

SEQ ID NO: 23194 - RNA, 15 nt, Homo sapiens
gagagcgggugcccu

SEQ ID NO: 23195 - RNA, 16 nt, Homo sapiens
gcagacagcgcggcgg

SEQ ID NO: 23196 - RNA, 19 nt, Homo sapiens
gcagacagcgcggcggccg

SEQ ID NO: 23197 - RNA, 17 nt, Homo sapiens
ggcaaggguggggggcg

SEQ ID NO: 23198 - RNA, 21 nt, Homo sapiens
uccggcgggacccggugggca

SEQ ID NO: 23199 - RNA, 19 nt, Homo sapiens
ucguggggagggggcaagg

SEQ ID NO: 23200 - RNA, 16 nt, Homo sapiens
ugggcgaguguggugg

SEQ ID NO: 23201 - RNA, 19 nt, Homo sapiens
aggccggugaccccccaug

SEQ ID NO: 23202 - RNA, 17 nt, Homo sapiens
uuagagaaacguugugu

SEQ ID NO: 23203 - RNA, 17 nt, Homo sapiens
ugggagguggagacggc

SEQ ID NO: 23204 - RNA, 17 nt, Homo sapiens
agauggggggggggggg

SEQ ID NO: 23205 - RNA, 17 nt, Homo sapiens
ccgaagauggggggggg

SEQ ID NO: 23206 - RNA, 17 nt, Homo sapiens
gcucugggaggggacau

SEQ ID NO: 23207 - RNA, 17 nt, Homo sapiens
cacuugugcgaguuuau

SEQ ID NO: 23208 - RNA, 17 nt, Homo sapiens
caggguuucuaaccggc

SEQ ID NO: 23209 - RNA, 16 nt, Homo sapiens
cauucuuggggauggg

SEQ ID NO: 23210 - RNA, 20 nt, Homo sapiens
ccugcuuccucucuccuucc

SEQ ID NO: 23211 - RNA, 20 nt, Homo sapiens
gaaauuaaaaauaaauggcc

SEQ ID NO: 23212 - RNA, 18 nt, Homo sapiens
gcgaaggggcacccacgc

SEQ ID NO: 23213 - RNA, 18 nt, Homo sapiens
gcggaggugggcgaaggg

SEQ ID NO: 23214 - RNA, 19 nt, Homo sapiens
ggcgaaggggcacccacgc

SEQ ID NO: 23215 - RNA, 15 nt, Homo sapiens
gucgaggugacgggg

SEQ ID NO: 23216 - RNA, 20 nt, Homo sapiens
ucucucucaaaacugcaggg

SEQ ID NO: 23217 - RNA, 17 nt, Homo sapiens
ucucuuccccugcgugg

SEQ ID NO: 23218 - RNA, 21 nt, Homo sapiens
ucuggcuuauguuuaauuguu

SEQ ID NO: 23219 - RNA, 19 nt, Homo sapiens
ugacgggggcggagguggg

SEQ ID NO: 23220 - RNA, 21 nt, Homo sapiens
ugacugacuucuugcuggugu

SEQ ID NO: 23221 - RNA, 17 nt, Homo sapiens
ugcugucuauagucauu

SEQ ID NO: 23222 - RNA, 24 nt, Homo sapiens
ugugaaauuuuagauaacagaaaa

SEQ ID NO: 23223 - RNA, 17 nt, Homo sapiens
uguggaaaaaugaaaua

SEQ ID NO: 23224 - RNA, 16 nt, Homo sapiens
ggaggggagggcagga

SEQ ID NO: 23225 - RNA, 18 nt, Homo sapiens
agaugaggggcauggaga

SEQ ID NO: 23226 - RNA, 21 nt, Homo sapiens
aggggaagcaggggguggggg

SEQ ID NO: 23227 - RNA, 23 nt, Homo sapiens
caaaugagcaguccccacccagc

SEQ ID NO: 23228 - RNA, 20 nt, Homo sapiens
caacggcaaagggcaugcuc

SEQ ID NO: 23229 - RNA, 17 nt, Homo sapiens
ccccaucccuccuuccc

SEQ ID NO: 23230 - RNA, 18 nt, Homo sapiens
ccgccgcgcguccgcgcc

SEQ ID NO: 23231 - RNA, 18 nt, Homo sapiens
ccucgaccccuccugggc

SEQ ID NO: 23232 - RNA, 22 nt, Homo sapiens
cgggaggugcuggcggaccagg

SEQ ID NO: 23233 - RNA, 22 nt, Homo sapiens
cucaaagcugggcaggucccag

SEQ ID NO: 23234 - RNA, 17 nt, Homo sapiens
gaagcaggggguggggg

SEQ ID NO: 23235 - RNA, 19 nt, Homo sapiens
gaggcugcuguagcugccg

SEQ ID NO: 23236 - RNA, 19 nt, Homo sapiens
ggggggugggguggggagg

SEQ ID NO: 23237 - RNA, 29 nt, Homo sapiens
ggggguggggggugggguggggagguggc

SEQ ID NO: 23238 - RNA, 18 nt, Homo sapiens
gggguggggagguggugg

SEQ ID NO: 23239 - RNA, 19 nt, Homo sapiens
gggguggggaggugguggg

SEQ ID NO: 23240 - RNA, 17 nt, Homo sapiens
ggggugggggguggggg

SEQ ID NO: 23241 - RNA, 21 nt, Homo sapiens
ggggugggggguggggugggg

SEQ ID NO: 23242 - RNA, 17 nt, Homo sapiens
ggggugggguggggagg

SEQ ID NO: 23243 - RNA, 18 nt, Homo sapiens
gggugggggguggggugg

SEQ ID NO: 23244 - RNA, 20 nt, Homo sapiens
gguggggagguggugggggg

SEQ ID NO: 23245 - RNA, 16 nt, Homo sapiens
ucacagggcugguugc

SEQ ID NO: 23246 - RNA, 20 nt, Homo sapiens
ucacugcccgcagcgcgcgc

SEQ ID NO: 23247 - RNA, 15 nt, Homo sapiens
ucuugucccucccag

SEQ ID NO: 23248 - RNA, 16 nt, Homo sapiens
cagagggggcguuggc

SEQ ID NO: 23249 - RNA, 19 nt, Homo sapiens
cccagccccggggccuccc

SEQ ID NO: 23250 - RNA, 18 nt, Homo sapiens
cccgccgccccuccgccc

SEQ ID NO: 23251 - RNA, 17 nt, Homo sapiens
ccuccccgcccuccucc

SEQ ID NO: 23252 - RNA, 17 nt, Homo sapiens
gaaguggggagagggga

SEQ ID NO: 23253 - RNA, 22 nt, Homo sapiens
ggacagagggggcguuggcuuc

SEQ ID NO: 23254 - RNA, 21 nt, Homo sapiens
ggaggagaggggacaggagga

SEQ ID NO: 23255 - RNA, 20 nt, Homo sapiens
uggcaauggguggggcccag

SEQ ID NO: 23256 - RNA, 23 nt, Homo sapiens
uggccucugaaguggggagaggg

SEQ ID NO: 23257 - RNA, 20 nt, Homo sapiens
ugggaggagaggggacagga

SEQ ID NO: 23258 - RNA, 16 nt, Homo sapiens
ugguaggaggcgaggc

SEQ ID NO: 23259 - RNA, 20 nt, Homo sapiens
aggaguggagggaggguggg

SEQ ID NO: 23260 - RNA, 17 nt, Homo sapiens
cagagaggaaaagagag

SEQ ID NO: 23261 - RNA, 19 nt, Homo sapiens
cccccccguuuucuuuguc

SEQ ID NO: 23262 - RNA, 23 nt, Homo sapiens
gagaaagugugugauagucauag

SEQ ID NO: 23263 - RNA, 20 nt, Homo sapiens
gaggagagagguagaggagg

SEQ ID NO: 23264 - RNA, 19 nt, Homo sapiens
gaugggagggagcacgucu

SEQ ID NO: 23265 - RNA, 20 nt, Homo sapiens
ggauuuugauuucuuguguu

SEQ ID NO: 23266 - RNA, 18 nt, Homo sapiens
ggcugggccagcuggggc

SEQ ID NO: 23267 - RNA, 16 nt, Homo sapiens
gucuucuuucggagag

SEQ ID NO: 23268 - RNA, 15 nt, Homo sapiens
ucuuuguccauuucu

SEQ ID NO: 23269 - RNA, 18 nt, Homo sapiens
ugaaaagucacagggggc

SEQ ID NO: 23270 - RNA, 20 nt, Homo sapiens
ugagaggaguggagggaggg

SEQ ID NO: 23271 - RNA, 17 nt, Homo sapiens
ugagggguggcugggca

SEQ ID NO: 23272 - RNA, 18 nt, Homo sapiens
ugcuuuuuuaaaaaaacu

SEQ ID NO: 23273 - RNA, 16 nt, Homo sapiens
uggcugggcaggagca

SEQ ID NO: 23274 - RNA, 18 nt, Homo sapiens
uguaguuuuuuuguuuuu

SEQ ID NO: 23275 - RNA, 18 nt, Homo sapiens
uuggaguuggggcgaugg

SEQ ID NO: 23276 - RNA, 17 nt, Homo sapiens
uuucagggaggccugcu

SEQ ID NO: 23277 - RNA, 19 nt, Homo sapiens
aagcagggcgugaaggagg

SEQ ID NO: 23278 - RNA, 19 nt, Homo sapiens
agggcaagacuucacugug

SEQ ID NO: 23279 - RNA, 23 nt, Homo sapiens
gcaaaacaggcagggcugaugac

SEQ ID NO: 23280 - RNA, 21 nt, Homo sapiens
uggguaaaacagcuuaaauuu

SEQ ID NO: 23281 - RNA, 17 nt, Homo sapiens
acguugacaucccugcg

SEQ ID NO: 23282 - RNA, 18 nt, Homo sapiens
ccaguggcuuuccuggca

SEQ ID NO: 23283 - RNA, 23 nt, Homo sapiens
ccugcccccccgcugcuucucgc

SEQ ID NO: 23284 - RNA, 23 nt, Homo sapiens
ccuucgugugugugugugugugu

SEQ ID NO: 23285 - RNA, 19 nt, Homo sapiens
gguaauuuuggcuuuuucg

SEQ ID NO: 23286 - RNA, 20 nt, Homo sapiens
ugacaauuccaguggcuuuc

SEQ ID NO: 23287 - RNA, 23 nt, Homo sapiens
ugccuggugccacaagcuugggu

SEQ ID NO: 23288 - RNA, 24 nt, Homo sapiens
ugccuggugccacaagcuuggguc

SEQ ID NO: 23289 - RNA, 18 nt, Homo sapiens
ugugugugugugugugug

SEQ ID NO: 23290 - RNA, 21 nt, Homo sapiens
aaaguaucucaacaauucuca

SEQ ID NO: 23291 - RNA, 16 nt, Homo sapiens
aguaguccuagcuccu

SEQ ID NO: 23292 - RNA, 15 nt, Homo sapiens
ccgguccagucggcc

SEQ ID NO: 23293 - RNA, 17 nt, Homo sapiens
ccuugggccaccagcag

SEQ ID NO: 23294 - RNA, 22 nt, Homo sapiens
gaggcugcugggucucuucggu

SEQ ID NO: 23295 - RNA, 17 nt, Homo sapiens
uccaaguggagucauac

SEQ ID NO: 23296 - RNA, 16 nt, Homo sapiens
uccucagcuugagccc

SEQ ID NO: 23297 - RNA, 18 nt, Homo sapiens
ugaugagugagcuggaug

SEQ ID NO: 23298 - RNA, 18 nt, Homo sapiens
uggggagaucaaugaaga

SEQ ID NO: 23299 - RNA, 14 nt, Homo sapiens
uguccagguugucc

SEQ ID NO: 23300 - RNA, 20 nt, Homo sapiens
acauucaugggucacaggag

SEQ ID NO: 23301 - RNA, 14 nt, Homo sapiens
caccccgccgcccc

SEQ ID NO: 23302 - RNA, 14 nt, Homo sapiens
cagccaccgccucc

SEQ ID NO: 23303 - RNA, 19 nt, Homo sapiens
gguuuacacaguuuuaucc

SEQ ID NO: 23304 - RNA, 16 nt, Homo sapiens
aaggaagacccuuucc

SEQ ID NO: 23305 - RNA, 18 nt, Homo sapiens
cccgccugcuccggggcc

SEQ ID NO: 23306 - RNA, 22 nt, Homo sapiens
ccgcugugugcauuccaaaugu

SEQ ID NO: 23307 - RNA, 18 nt, Homo sapiens
gcuacucuuugcacaaua

SEQ ID NO: 23308 - RNA, 18 nt, Homo sapiens
ggcgguaggggcggcggc

SEQ ID NO: 23309 - RNA, 20 nt, Homo sapiens
caggugcagggcugcaaggu

SEQ ID NO: 23310 - RNA, 22 nt, Homo sapiens
cugauccucuucuuccccuuuu

SEQ ID NO: 23311 - RNA, 18 nt, Homo sapiens
ggcaggcaggugcagggc

SEQ ID NO: 23312 - RNA, 16 nt, Homo sapiens
guucuccccgugucgc

SEQ ID NO: 23313 - RNA, 17 nt, Homo sapiens
uccgcagggaucgggac

SEQ ID NO: 23314 - RNA, 22 nt, Homo sapiens
uccucuuccucuucucucuucu

SEQ ID NO: 23315 - RNA, 20 nt, Homo sapiens
uccuugggcugauccucuuc

SEQ ID NO: 23316 - RNA, 20 nt, Homo sapiens
caguagguugaguuggccug

SEQ ID NO: 23317 - RNA, 18 nt, Homo sapiens
uguaaggagagaagagcu

SEQ ID NO: 23318 - RNA, 18 nt, Homo sapiens
ugugcaagaaucaaaaua

SEQ ID NO: 23319 - RNA, 24 nt, Homo sapiens
aauauauauauauauauauauaua

SEQ ID NO: 23320 - RNA, 20 nt, Homo sapiens
auauauauauauauauauau

SEQ ID NO: 23321 - RNA, 21 nt, Homo sapiens
auauauauauauauauauaua

SEQ ID NO: 23322 - RNA, 22 nt, Homo sapiens
auauauauauauauauauauau

SEQ ID NO: 23323 - RNA, 24 nt, Homo sapiens
auauauauauauauauauauauau

SEQ ID NO: 23324 - RNA, 23 nt, Homo sapiens
auauauauauauauauauauauu

SEQ ID NO: 23325 - RNA, 22 nt, Homo sapiens
auauauauauauauauguauau

SEQ ID NO: 23326 - RNA, 22 nt, Homo sapiens
auauauauauauauguauauau

SEQ ID NO: 23327 - RNA, 14 nt, Homo sapiens
cagcacaauuccac

SEQ ID NO: 23328 - RNA, 21 nt, Homo sapiens
ccugaagcuuugaaauguguu

SEQ ID NO: 23329 - RNA, 20 nt, Homo sapiens
ggacccaagguggaaagaca

SEQ ID NO: 23330 - RNA, 25 nt, Homo sapiens
uaaaauauauauauauauauauaua

SEQ ID NO: 23331 - RNA, 21 nt, Homo sapiens
uaagccauugucuucaagaca

SEQ ID NO: 23332 - RNA, 19 nt, Homo sapiens
uauauauauauauauauau

SEQ ID NO: 23333 - RNA, 21 nt, Homo sapiens
uauauauauauauauauauau

SEQ ID NO: 23334 - RNA, 22 nt, Homo sapiens
uauauauauauauauauauaua

SEQ ID NO: 23335 - RNA, 23 nt, Homo sapiens
uauauauauauauauauauauau

SEQ ID NO: 23336 - RNA, 24 nt, Human papillomavirus type 25
uauauauauauauauauauauaua

SEQ ID NO: 23337 - RNA, 24 nt, Homo sapiens
uauauauauauauauauauguaua

SEQ ID NO: 23338 - RNA, 22 nt, Homo sapiens
uauauauauauauauauguaua

SEQ ID NO: 23339 - RNA, 24 nt, Homo sapiens
uauauauauauauauauguauaua

SEQ ID NO: 23340 - RNA, 22 nt, Homo sapiens
uauauauauauauauguauaua

SEQ ID NO: 23341 - RNA, 23 nt, Homo sapiens
uauauauauauauauguauauau

SEQ ID NO: 23342 - RNA, 21 nt, Homo sapiens
uauauauauauauguauauau

SEQ ID NO: 23343 - RNA, 19 nt, Homo sapiens
uauauauauauguauauau

SEQ ID NO: 23344 - RNA, 19 nt, Homo sapiens
aacugcuucaggaucuucc

SEQ ID NO: 23345 - RNA, 26 nt, Homo sapiens
uaacugagugguccugaugggugacc

SEQ ID NO: 23346 - RNA, 20 nt, Homo sapiens
aucgcggcucgugcccgugg

SEQ ID NO: 23347 - RNA, 20 nt, Homo sapiens
gcggagagggcucuagcccc

SEQ ID NO: 23348 - RNA, 16 nt, Homo sapiens
ucccaccccuuggcuc

SEQ ID NO: 23349 - RNA, 16 nt, Homo sapiens
ugccacuuuuagcaau

SEQ ID NO: 23350 - RNA, 17 nt, Homo sapiens
aggcccaggggaucccg

SEQ ID NO: 23351 - RNA, 21 nt, Homo sapiens
caccugagagugcagaaaaca

SEQ ID NO: 23352 - RNA, 15 nt, Homo sapiens
caggacacgccugcc

SEQ ID NO: 23353 - RNA, 19 nt, Homo sapiens
caguggugggggccugcag

SEQ ID NO: 23354 - RNA, 17 nt, Homo sapiens
gacaauuuucuccuuuu

SEQ ID NO: 23355 - RNA, 18 nt, Homo sapiens
ggccugcaaagcccaccc

SEQ ID NO: 23356 - RNA, 18 nt, Homo sapiens
gggagggugggacugggc

SEQ ID NO: 23357 - RNA, 19 nt, Homo sapiens
ucucuugucugggggcccc

SEQ ID NO: 23358 - RNA, 18 nt, Homo sapiens
ucuugucugggggcccca

SEQ ID NO: 23359 - RNA, 18 nt, Homo sapiens
ugauaacaaggccaaagg

SEQ ID NO: 23360 - RNA, 21 nt, Homo sapiens
ugcugggcuccggauccugca

SEQ ID NO: 23361 - RNA, 17 nt, Homo sapiens
uuucuugguucuuuugu

SEQ ID NO: 23362 - RNA, 22 nt, Homo sapiens
auauacguauauauauauauau

SEQ ID NO: 23363 - RNA, 22 nt, Homo sapiens
auauauacguauauauauauau

SEQ ID NO: 23364 - RNA, 22 nt, Homo sapiens
auauauauauauauauauauau

SEQ ID NO: 23365 - RNA, 16 nt, Homo sapiens
ccccuguuuuauuaaa

SEQ ID NO: 23366 - RNA, 19 nt, Homo sapiens
cgcuaggggugggcggcgg

SEQ ID NO: 23367 - RNA, 20 nt, Homo sapiens
cgggggcgggggccgccggg

SEQ ID NO: 23368 - RNA, 18 nt, Homo sapiens
cuauauagauauauagau

SEQ ID NO: 23369 - RNA, 17 nt, Homo sapiens
gccccugcggggagggg

SEQ ID NO: 23370 - RNA, 18 nt, Homo sapiens
gggccgcgggggagccgg

SEQ ID NO: 23371 - RNA, 23 nt, Homo sapiens
gggcgcuaggggugggcggcggg

SEQ ID NO: 23372 - RNA, 22 nt, Homo sapiens
ggggagggggcccggccgcacu

SEQ ID NO: 23373 - RNA, 17 nt, Homo sapiens
ggugggcggcgggggcg

SEQ ID NO: 23374 - RNA, 15 nt, Homo sapiens
guggcagggggcggg

SEQ ID NO: 23375 - RNA, 22 nt, Homo sapiens
uacguauauauauauauauaua

SEQ ID NO: 23376 - RNA, 25 nt, Homo sapiens
uacguauauauauauauauauauau

SEQ ID NO: 23377 - RNA, 22 nt, Homo sapiens
uauacguauauauauauauaua

SEQ ID NO: 23378 - RNA, 26 nt, Homo sapiens
uauacguauauauauauauauauaua

SEQ ID NO: 23379 - RNA, 22 nt, Homo sapiens
uauauacguauauauauauaua

SEQ ID NO: 23380 - RNA, 25 nt, Homo sapiens
uauauacguauauauauauauauau

SEQ ID NO: 23381 - RNA, 22 nt, Homo sapiens
uauauauacguauauauauaua

SEQ ID NO: 23382 - RNA, 22 nt, Homo sapiens
uauauauauacguauauauaua

SEQ ID NO: 23383 - RNA, 20 nt, Homo sapiens
uauauauauauauauauaua

SEQ ID NO: 23384 - RNA, 22 nt, Homo sapiens
uauauauauauauauauauaua

SEQ ID NO: 23385 - RNA, 23 nt, Homo sapiens
uauauauauauauauauauauau

SEQ ID NO: 23386 - RNA, 24 nt, Human papillomavirus type 25
uauauauauauauauauauauaua

SEQ ID NO: 23387 - RNA, 18 nt, Homo sapiens
uccuggccccuguguggc

SEQ ID NO: 23388 - RNA, 16 nt, Homo sapiens
uucuguuuuucugaug

SEQ ID NO: 23389 - RNA, 30 nt, Homo sapiens
cagggcuucuucuuugcccugcacucggug

SEQ ID NO: 23390 - RNA, 24 nt, Homo sapiens
caggucuucagccuggggccccca

SEQ ID NO: 23391 - RNA, 17 nt, Homo sapiens
cuugccucugcuucaga

SEQ ID NO: 23392 - RNA, 15 nt, Homo sapiens
gagagggaaggucug

SEQ ID NO: 23393 - RNA, 21 nt, Homo sapiens
gcccccacguggccuugagga

SEQ ID NO: 23394 - RNA, 17 nt, Homo sapiens
ugcccugguccagcaau

SEQ ID NO: 23395 - RNA, 22 nt, Homo sapiens
acaguugggccuggaugaacuc

SEQ ID NO: 23396 - RNA, 20 nt, Homo sapiens
cccaaaaugugcccgaggug

SEQ ID NO: 23397 - RNA, 23 nt, Homo sapiens
gcguaaggaggggguuugggggc

SEQ ID NO: 23398 - RNA, 16 nt, Homo sapiens
uccggcgcagcgcggc

SEQ ID NO: 23399 - RNA, 19 nt, Homo sapiens
ugcuccuugcucacaguug

SEQ ID NO: 23400 - RNA, 22 nt, Homo sapiens
ugcuggggccaugaaggccuuc

SEQ ID NO: 23401 - RNA, 27 nt, Homo sapiens
uggaugggguggauauuagcauagcug

SEQ ID NO: 23402 - RNA, 15 nt, Homo sapiens
uguggcuugguccug

SEQ ID NO: 23403 - RNA, 18 nt, Homo sapiens
ugugggucuaagagcuaa

SEQ ID NO: 23404 - RNA, 22 nt, Homo sapiens
acagaaaacagagaaguugugg

SEQ ID NO: 23405 - RNA, 22 nt, Homo sapiens
acagagaaguuguggaagcugu

SEQ ID NO: 23406 - RNA, 17 nt, Homo sapiens
caccuagaagccgcccc

SEQ ID NO: 23407 - RNA, 24 nt, Homo sapiens
ccacugggggacugacagaaaaca

SEQ ID NO: 23408 - RNA, 18 nt, Homo sapiens
ccccagaagggguggugg

SEQ ID NO: 23409 - RNA, 19 nt, Homo sapiens
gaagcuguguguuuucugu

SEQ ID NO: 23410 - RNA, 19 nt, Homo sapiens
gaggaaacaggcaggaccc

SEQ ID NO: 23411 - RNA, 20 nt, Homo sapiens
gggaggugggggagaugucc

SEQ ID NO: 23412 - RNA, 18 nt, Homo sapiens
gggagguuggcagacaaa

SEQ ID NO: 23413 - RNA, 21 nt, Homo sapiens
gggagguuggcagacaaagga

SEQ ID NO: 23414 - RNA, 19 nt, Homo sapiens
gguggugguggcgguggcg

SEQ ID NO: 23415 - RNA, 17 nt, Homo sapiens
guggcggcggcagcacc

SEQ ID NO: 23416 - RNA, 19 nt, Homo sapiens
uccuggaccccugaguaug

SEQ ID NO: 23417 - RNA, 15 nt, Homo sapiens
ugggagggagggaac

SEQ ID NO: 23418 - RNA, 24 nt, Homo sapiens
aggcgucugcagacggucuguggc

SEQ ID NO: 23419 - RNA, 20 nt, Homo sapiens
ccucuuuuuuuuuccccucu

SEQ ID NO: 23420 - RNA, 19 nt, Homo sapiens
gcccccgacuuuccaugcu

SEQ ID NO: 23421 - RNA, 22 nt, Homo sapiens
uucccccuuuuuuucuuucucu

SEQ ID NO: 23422 - RNA, 23 nt, Homo sapiens
uuucuaggaggacccgggcgaaa

SEQ ID NO: 23423 - RNA, 17 nt, Homo sapiens
cacagggccgaccugag

SEQ ID NO: 23424 - RNA, 19 nt, Homo sapiens
cagcgguguccuggagcug

SEQ ID NO: 23425 - RNA, 17 nt, Homo sapiens
ccaaggccgagaggcca

SEQ ID NO: 23426 - RNA, 18 nt, Homo sapiens
cugugcgucccaauccag

SEQ ID NO: 23427 - RNA, 17 nt, Homo sapiens
uccgggggggggcuggg

SEQ ID NO: 23428 - RNA, 22 nt, Homo sapiens
ucuguuuaaaacacaguaaucc

SEQ ID NO: 23429 - RNA, 22 nt, Homo sapiens
ugaugagaaaaugcaccucagg

SEQ ID NO: 23430 - RNA, 18 nt, Homo sapiens
uuggggaagaacacacac

SEQ ID NO: 23431 - RNA, 22 nt, Homo sapiens
aucauccuuuuacuucuacccc

SEQ ID NO: 23432 - RNA, 25 nt, Homo sapiens
cccccaccucccuuugaccguuugg

SEQ ID NO: 23433 - RNA, 15 nt, Homo sapiens
ccccguccuugcucc

SEQ ID NO: 23434 - RNA, 20 nt, Homo sapiens
gcuccgggccgggaccuggg

SEQ ID NO: 23435 - RNA, 18 nt, Homo sapiens
gggaccugggaccuggga

SEQ ID NO: 23436 - RNA, 18 nt, Homo sapiens
ucuggggugcagagcagg

SEQ ID NO: 23437 - RNA, 17 nt, Homo sapiens
uucuacccccaccuccc

SEQ ID NO: 23438 - RNA, 18 nt, Homo sapiens
caacaauccucaacuucu

SEQ ID NO: 23439 - RNA, 23 nt, Homo sapiens
ccagaauuauugucugucugcag

SEQ ID NO: 23440 - RNA, 16 nt, Homo sapiens
cuacgccuuccacagc

SEQ ID NO: 23441 - RNA, 18 nt, Homo sapiens
uacacaccaaaacugcac

SEQ ID NO: 23442 - RNA, 22 nt, Homo sapiens
uacaugauauacuuaaggaagc

SEQ ID NO: 23443 - RNA, 18 nt, Homo sapiens
uauaaauguuuccacuac

SEQ ID NO: 23444 - RNA, 21 nt, Homo sapiens
uuagugcagcauucuauauag

SEQ ID NO: 23445 - RNA, 15 nt, Homo sapiens
uuccucuguguugcu

SEQ ID NO: 23446 - RNA, 18 nt, Homo sapiens
uuuauccauucuagugac

SEQ ID NO: 23447 - RNA, 20 nt, Homo sapiens
uuugcagcauuauuuuaucc

SEQ ID NO: 23448 - RNA, 20 nt, Homo sapiens
cccuugaggucugucugcag

SEQ ID NO: 23449 - RNA, 19 nt, Homo sapiens
cugaggagagaagccagag

SEQ ID NO: 23450 - RNA, 25 nt, Homo sapiens
gcgcccccaccgcgcucuucccucc

SEQ ID NO: 23451 - RNA, 20 nt, Homo sapiens
gcgcggggggcacgggcugc

SEQ ID NO: 23452 - RNA, 16 nt, Homo sapiens
aacauugugguuccuc

SEQ ID NO: 23453 - RNA, 18 nt, Homo sapiens
aacugaacaaauuuccuu

SEQ ID NO: 23454 - RNA, 22 nt, Homo sapiens
ccauggaauucaagccaauccu

SEQ ID NO: 23455 - RNA, 15 nt, Homo sapiens
gaccuaucccuaagc

SEQ ID NO: 23456 - RNA, 21 nt, Homo sapiens
gccauucuuacuugcuaggac

SEQ ID NO: 23457 - RNA, 17 nt, Homo sapiens
guuauaacuuuaaugga

SEQ ID NO: 23458 - RNA, 19 nt, Homo sapiens
uggauucccucauugggcc

SEQ ID NO: 23459 - RNA, 24 nt, Homo sapiens
uuaguuaauuugcugguugcuucc

SEQ ID NO: 23460 - RNA, 22 nt, Homo sapiens
cucaaauucccgcugccuuucu

SEQ ID NO: 23461 - RNA, 14 nt, Homo sapiens
gcccgccgcgcgcc

SEQ ID NO: 23462 - RNA, 21 nt, Homo sapiens
gcggcgaagugagcgcgcucg

SEQ ID NO: 23463 - RNA, 19 nt, Homo sapiens
acauuuucaauccugccuu

SEQ ID NO: 23464 - RNA, 23 nt, Homo sapiens
acgguggcugcucggcgcccgcg

SEQ ID NO: 23465 - RNA, 20 nt, Homo sapiens
agcagcuggucaggaugggc

SEQ ID NO: 23466 - RNA, 16 nt, Homo sapiens
cagccagaaccauccc

SEQ ID NO: 23467 - RNA, 16 nt, Homo sapiens
cauuugcuguuccugg

SEQ ID NO: 23468 - RNA, 20 nt, Homo sapiens
gcgagggcgagggcgccggc

SEQ ID NO: 23469 - RNA, 17 nt, Homo sapiens
gcuccuuugagaaucuc

SEQ ID NO: 23470 - RNA, 18 nt, Homo sapiens
gcugcucggugcgcgccg

SEQ ID NO: 23471 - RNA, 16 nt, Homo sapiens
ggaggcagccugguca

SEQ ID NO: 23472 - RNA, 20 nt, Homo sapiens
ucgcuccuuugagaaucuca

SEQ ID NO: 23473 - RNA, 25 nt, Homo sapiens
ugaaaaaugaaauaaaaccucagau

SEQ ID NO: 23474 - RNA, 17 nt, Homo sapiens
ugagaacaauuauaaga

SEQ ID NO: 23475 - RNA, 18 nt, Homo sapiens
uuccuggguccucggagc

SEQ ID NO: 23476 - RNA, 14 nt, Homo sapiens
ccugcucuucccgg

SEQ ID NO: 23477 - RNA, 17 nt, Homo sapiens
cuugauacugaauagcc

SEQ ID NO: 23478 - RNA, 24 nt, Homo sapiens
uaugaauggaguuugguacuaucu

SEQ ID NO: 23479 - RNA, 22 nt, Homo sapiens
ugcgaaucuacuaggggucuua

SEQ ID NO: 23480 - RNA, 21 nt, Homo sapiens
uuucuugggcaggaguaugau

SEQ ID NO: 23481 - RNA, 21 nt, Homo sapiens
uuuguagaaacagguucccau

SEQ ID NO: 23482 - RNA, 19 nt, Homo sapiens
aaaaaaaaaaaaaaaacau

SEQ ID NO: 23483 - RNA, 17 nt, Homo sapiens
ucacaaccaugaacauu

SEQ ID NO: 23484 - RNA, 18 nt, Homo sapiens
caucaccaggcacccccc

SEQ ID NO: 23485 - RNA, 22 nt, Homo sapiens
ggaguucucgguggggaggugg

SEQ ID NO: 23486 - RNA, 18 nt, Homo sapiens
uccggaguaaugagacua

SEQ ID NO: 23487 - RNA, 21 nt, Homo sapiens
ucgucucggcuguggggcccc

SEQ ID NO: 23488 - RNA, 18 nt, Homo sapiens
acauguucauguaucuga

SEQ ID NO: 23489 - RNA, 17 nt, Homo sapiens
ccggggccucgccgggc

SEQ ID NO: 23490 - RNA, 20 nt, Homo sapiens
uauaaaaacugugucauggu

SEQ ID NO: 23491 - RNA, 16 nt, Homo sapiens
ucacaaauauacagac

SEQ ID NO: 23492 - RNA, 19 nt, Homo sapiens
agcucuucgggagucuaga

SEQ ID NO: 23493 - RNA, 18 nt, Homo sapiens
uaaaguagcguguccaug

SEQ ID NO: 23494 - RNA, 18 nt, Homo sapiens
ugcucuucagugauggcc

SEQ ID NO: 23495 - RNA, 22 nt, Homo sapiens
acaaggucugagcacuuuuggg

SEQ ID NO: 23496 - RNA, 23 nt, Homo sapiens
agagaggguugaugcccggacag

SEQ ID NO: 23497 - RNA, 17 nt, Homo sapiens
agggguccagccaagac

SEQ ID NO: 23498 - RNA, 24 nt, Homo sapiens
gauaggagagaagugagggaggua

SEQ ID NO: 23499 - RNA, 18 nt, Homo sapiens
accggugggugccgaacg

SEQ ID NO: 23500 - RNA, 22 nt, Homo sapiens
cgcaguuggacgcaggcucggg

SEQ ID NO: 23501 - RNA, 18 nt, Homo sapiens
cggcgcgcgggcggcgcg

SEQ ID NO: 23502 - RNA, 19 nt, Homo sapiens
cggcggcggcgcgggagcg

SEQ ID NO: 23503 - RNA, 15 nt, Homo sapiens
cggcggcggcggcgc

SEQ ID NO: 23504 - RNA, 23 nt, Homo sapiens
cgggagcgggacagcggcgcgcg

SEQ ID NO: 23505 - RNA, 20 nt, Homo sapiens
gcacugagcgcuccggcagc

SEQ ID NO: 23506 - RNA, 17 nt, Homo sapiens
gcggcgcgcgggcggcg

SEQ ID NO: 23507 - RNA, 20 nt, Homo sapiens
gcgggcggcgcggcgaccgg

SEQ ID NO: 23508 - RNA, 18 nt, Homo sapiens
ggcgcgggggggcggcgg

SEQ ID NO: 23509 - RNA, 17 nt, Homo sapiens
ggcggcgcggcgaccgg

SEQ ID NO: 23510 - RNA, 20 nt, Homo sapiens
ggcggcggcgcgggagcggg

SEQ ID NO: 23511 - RNA, 22 nt, Homo sapiens
ggggcggcgggcggcagcggcg

SEQ ID NO: 23512 - RNA, 17 nt, Homo sapiens
gggggggcggcgggcgg

SEQ ID NO: 23513 - RNA, 23 nt, Homo sapiens
uccggcagcagcgcagugccgcg

SEQ ID NO: 23514 - RNA, 14 nt, Homo sapiens
ugggaggggggggc

SEQ ID NO: 23515 - RNA, 18 nt, Homo sapiens
aaauaaaaauauaaauau

SEQ ID NO: 23516 - RNA, 20 nt, Homo sapiens
gccggcugccuccccuuccc

SEQ ID NO: 23517 - RNA, 19 nt, Homo sapiens
ggcacuugugggugccggc

SEQ ID NO: 23518 - RNA, 18 nt, Homo sapiens
gggcgaggggccgagggg

SEQ ID NO: 23519 - RNA, 21 nt, Homo sapiens
gggcgaggggccgaggggcgg

SEQ ID NO: 23520 - RNA, 20 nt, Homo sapiens
ugaaaauauccagcaccagg

SEQ ID NO: 23521 - RNA, 21 nt, Homo sapiens
aaacaguggcuuauucugguu

SEQ ID NO: 23522 - RNA, 18 nt, Homo sapiens
aagggguuuuguuuuugu

SEQ ID NO: 23523 - RNA, 18 nt, Homo sapiens
aaugaccuacagaguaaa

SEQ ID NO: 23524 - RNA, 21 nt, Homo sapiens
aauugcuuuuuuauacaguau

SEQ ID NO: 23525 - RNA, 23 nt, Homo sapiens
aggagguggugcggggacccgag

SEQ ID NO: 23526 - RNA, 18 nt, Homo sapiens
gggaaggcagcaggaggu

SEQ ID NO: 23527 - RNA, 24 nt, Homo sapiens
uauacaguauagauaaccuagagg

SEQ ID NO: 23528 - RNA, 18 nt, Homo sapiens
uggcuguaccuuuguugu

SEQ ID NO: 23529 - RNA, 18 nt, Homo sapiens
ugggagaaauaccuaugu

SEQ ID NO: 23530 - RNA, 19 nt, Homo sapiens
augaaucagcuguuccuuc

SEQ ID NO: 23531 - RNA, 20 nt, Homo sapiens
caccaaauaaaucacagacg

SEQ ID NO: 23532 - RNA, 24 nt, Homo sapiens
ccggggcuccagaggccacgcccg

SEQ ID NO: 23533 - RNA, 18 nt, Homo sapiens
guuccuucgggaggagaa

SEQ ID NO: 23534 - RNA, 16 nt, Homo sapiens
agugcuuuuacucaug

SEQ ID NO: 23535 - RNA, 21 nt, Homo sapiens
uaugucagcucauguaugaau

SEQ ID NO: 23536 - RNA, 22 nt, Homo sapiens
aguggagugaggcccgcggcgg

SEQ ID NO: 23537 - RNA, 19 nt, Homo sapiens
cagcucgacagguugcccc

SEQ ID NO: 23538 - RNA, 17 nt, Homo sapiens
cagcuuggcgccgcggc

SEQ ID NO: 23539 - RNA, 21 nt, Homo sapiens
ggggcccgcgaccccaggcgc

SEQ ID NO: 23540 - RNA, 20 nt, Homo sapiens
uuugcuacccuguuuacaaa

SEQ ID NO: 23541 - RNA, 18 nt, Homo sapiens
aggaaaaugccccugaag

SEQ ID NO: 23542 - RNA, 18 nt, Homo sapiens
cacuuauuuacaaaacaa

SEQ ID NO: 23543 - RNA, 17 nt, Homo sapiens
guuuggaugguuaaaug

SEQ ID NO: 23544 - RNA, 25 nt, Homo sapiens
auucugauuuuaaaaauauuuuuau

SEQ ID NO: 23545 - RNA, 17 nt, Homo sapiens
cuccgucucgggccguc

SEQ ID NO: 23546 - RNA, 20 nt, Homo sapiens
gccggaucggcgucggggcg

SEQ ID NO: 23547 - RNA, 15 nt, Homo sapiens
guccgcgcugggaua

SEQ ID NO: 23548 - RNA, 19 nt, Homo sapiens
aaaugauuccuccaagauu

SEQ ID NO: 23549 - RNA, 16 nt, Homo sapiens
acuugguagccgguga

SEQ ID NO: 23550 - RNA, 20 nt, Homo sapiens
agggagcagagugguggcaa

SEQ ID NO: 23551 - RNA, 18 nt, Homo sapiens
ccagaagaucuaaaaaca

SEQ ID NO: 23552 - RNA, 18 nt, Homo sapiens
cggcugcacuuugaaaag

SEQ ID NO: 23553 - RNA, 22 nt, Homo sapiens
cugguccccauuugacuuugcc

SEQ ID NO: 23554 - RNA, 16 nt, Homo sapiens
gcgucccgcgggcgcc

SEQ ID NO: 23555 - RNA, 18 nt, Homo sapiens
ggaguggaggcaagcagg

SEQ ID NO: 23556 - RNA, 18 nt, Homo sapiens
uaacauggugccugguac

SEQ ID NO: 23557 - RNA, 19 nt, Homo sapiens
uccccucucauuaccaacu

SEQ ID NO: 23558 - RNA, 16 nt, Homo sapiens
ucccgcgggcgcccgg

SEQ ID NO: 23559 - RNA, 19 nt, Homo sapiens
ugccugguacuugguagcc

SEQ ID NO: 23560 - RNA, 19 nt, Homo sapiens
ugcugucuucucagaauuc

SEQ ID NO: 23561 - RNA, 18 nt, Homo sapiens
aaaaaaagaaaaaaaaaa

SEQ ID NO: 23562 - RNA, 24 nt, Homo sapiens
aauguaggcugaaauuuauaucau

SEQ ID NO: 23563 - RNA, 16 nt, Homo sapiens
cccgcccccuccuucc

SEQ ID NO: 23564 - RNA, 14 nt, Homo sapiens
ccgagcagagcccu

SEQ ID NO: 23565 - RNA, 21 nt, Homo sapiens
ccggacagcugugcugcucug

SEQ ID NO: 23566 - RNA, 19 nt, Homo sapiens
gcgcggggcugguccccgc

SEQ ID NO: 23567 - RNA, 21 nt, Homo sapiens
ggcaaaaaagcuuggcaucaa

SEQ ID NO: 23568 - RNA, 17 nt, Homo sapiens
guucagguccgacccaa

SEQ ID NO: 23569 - RNA, 19 nt, Homo sapiens
uggcgagggcgggaggcgg

SEQ ID NO: 23570 - RNA, 22 nt, Homo sapiens
aaggccaggaggccaccugagc

SEQ ID NO: 23571 - RNA, 19 nt, Homo sapiens
aggggccccaagccuugcc

SEQ ID NO: 23572 - RNA, 22 nt, Homo sapiens
ggagacaggccagggaggcacc

SEQ ID NO: 23573 - RNA, 19 nt, Homo sapiens
ucccucugccucuagcugg

SEQ ID NO: 23574 - RNA, 20 nt, Homo sapiens
uguuggccacgaaagacagg

SEQ ID NO: 23575 - RNA, 15 nt, Homo sapiens
uuuugggcugcaccc

SEQ ID NO: 23576 - RNA, 19 nt, Homo sapiens
agagggaggagaagccaag

SEQ ID NO: 23577 - RNA, 15 nt, Homo sapiens
aggcauuuguaaagc

SEQ ID NO: 23578 - RNA, 16 nt, Homo sapiens
agucgggggguggugu

SEQ ID NO: 23579 - RNA, 22 nt, Homo sapiens
caggaagauuccguagaugaag

SEQ ID NO: 23580 - RNA, 21 nt, Homo sapiens
ccuucuuucccucuacccugu

SEQ ID NO: 23581 - RNA, 15 nt, Homo sapiens
cuccugaccucguac

SEQ ID NO: 23582 - RNA, 20 nt, Homo sapiens
gagagaggacaacagcuucu

SEQ ID NO: 23583 - RNA, 24 nt, Homo sapiens
ggaaagguugcaacaucaccaagg

SEQ ID NO: 23584 - RNA, 20 nt, Homo sapiens
gggagaaagggaagggaugg

SEQ ID NO: 23585 - RNA, 18 nt, Homo sapiens
aaaaaaaaaaaaaaaagc

SEQ ID NO: 23586 - RNA, 21 nt, Homo sapiens
aggggaggugcgugauggucg

SEQ ID NO: 23587 - RNA, 17 nt, Homo sapiens
cccagacucauccagaa

SEQ ID NO: 23588 - RNA, 20 nt, Homo sapiens
gcaauuuuauuacagcagca

SEQ ID NO: 23589 - RNA, 24 nt, Homo sapiens
gcggaggggaggugcgugaugguc

SEQ ID NO: 23590 - RNA, 17 nt, Homo sapiens
gugguuacauguaaacu

SEQ ID NO: 23591 - RNA, 17 nt, Homo sapiens
ugagucaggagagaaag

SEQ ID NO: 23592 - RNA, 18 nt, Homo sapiens
ugucccagacucauccag

SEQ ID NO: 23593 - RNA, 19 nt, Homo sapiens
uuggacuguaucauaauua

SEQ ID NO: 23594 - RNA, 16 nt, Homo sapiens
gagcaggcuguagggu

SEQ ID NO: 23595 - RNA, 23 nt, Homo sapiens
aggcagcuccuggccgcuggccc

SEQ ID NO: 23596 - RNA, 26 nt, Homo sapiens
cagccccgcagcccuggccuguagug

SEQ ID NO: 23597 - RNA, 18 nt, Homo sapiens
cccgccgccagcgcugcc

SEQ ID NO: 23598 - RNA, 23 nt, Homo sapiens
cggcggcggcggcggcggcgcgg

SEQ ID NO: 23599 - RNA, 19 nt, Homo sapiens
cuccugcuccuccucuucc

SEQ ID NO: 23600 - RNA, 17 nt, Homo sapiens
ggcccgaggccuguggc

SEQ ID NO: 23601 - RNA, 21 nt, Homo sapiens
ggcccggggaagggggcuggg

SEQ ID NO: 23602 - RNA, 22 nt, Homo sapiens
gggccgcgggacgggggcuggg

SEQ ID NO: 23603 - RNA, 18 nt, Homo sapiens
ggguugggggcggcuggg

SEQ ID NO: 23604 - RNA, 26 nt, Homo sapiens
guggcggugggacucugcggcggggg

SEQ ID NO: 23605 - RNA, 19 nt, Homo sapiens
uggccuguagugugggcau

SEQ ID NO: 23606 - RNA, 24 nt, Homo sapiens
aaguuuguauauuauggcacaugu

SEQ ID NO: 23607 - RNA, 18 nt, Homo sapiens
cauguguuacagggauaa

SEQ ID NO: 23608 - RNA, 16 nt, Homo sapiens
ccgugggucggcgggg

SEQ ID NO: 23609 - RNA, 17 nt, Homo sapiens
cggcgcgcggcgggggc

SEQ ID NO: 23610 - RNA, 21 nt, Homo sapiens
uauuauggcacauguguuaca

SEQ ID NO: 23611 - RNA, 19 nt, Homo sapiens
uguacaggcuucaaaugua

SEQ ID NO: 23612 - RNA, 17 nt, Homo sapiens
acagcauucuuguagca

SEQ ID NO: 23613 - RNA, 18 nt, Homo sapiens
uaagugcuaaacaacaaa

SEQ ID NO: 23614 - RNA, 17 nt, Homo sapiens
uacagaggugcaaucca

SEQ ID NO: 23615 - RNA, 18 nt, Homo sapiens
uauaacacaugggaagug

SEQ ID NO: 23616 - RNA, 18 nt, Homo sapiens
ugcauauaucagaaaaau

SEQ ID NO: 23617 - RNA, 19 nt, Homo sapiens
uguuauguauaacacaugg

SEQ ID NO: 23618 - RNA, 23 nt, Homo sapiens
cccuuugucaguucuuccuuuuu

SEQ ID NO: 23619 - RNA, 17 nt, Homo sapiens
cuucugggucauuugca

SEQ ID NO: 23620 - RNA, 21 nt, Homo sapiens
gcgugggguuacagcaggaga

SEQ ID NO: 23621 - RNA, 25 nt, Homo sapiens
gcucuggggguugcaggcuugugcg

SEQ ID NO: 23622 - RNA, 15 nt, Homo sapiens
ugagcugagcucccg

SEQ ID NO: 23623 - RNA, 18 nt, Homo sapiens
uggccugugucucuucaa

SEQ ID NO: 23624 - RNA, 19 nt, Homo sapiens
uaacgcuuggcgucggagu

SEQ ID NO: 23625 - RNA, 23 nt, Homo sapiens
uuguauuuuguuuuagacucuuu

SEQ ID NO: 23626 - RNA, 22 nt, Homo sapiens
aauuauuuugcuguuagagcca

SEQ ID NO: 23627 - RNA, 20 nt, Homo sapiens
cugaguuuuguaaaugcuag

SEQ ID NO: 23628 - RNA, 22 nt, Homo sapiens
ugcuugauuuuaauaacuacuu

SEQ ID NO: 23629 - RNA, 21 nt, Homo sapiens
uguuauagagauuuaggcaua

SEQ ID NO: 23630 - RNA, 18 nt, Homo sapiens
aaggagaagggucugggc

SEQ ID NO: 23631 - RNA, 16 nt, Homo sapiens
agccggccggcggggc

SEQ ID NO: 23632 - RNA, 17 nt, Homo sapiens
cagcgccuggggugcug

SEQ ID NO: 23633 - RNA, 20 nt, Homo sapiens
ccucggaaaacagaccugag

SEQ ID NO: 23634 - RNA, 22 nt, Homo sapiens
ucuugagucacauuuuuuuuuu

SEQ ID NO: 23635 - RNA, 15 nt, Homo sapiens
ggccccgccccaccc

SEQ ID NO: 23636 - RNA, 16 nt, Homo sapiens
ggccccgccccacccg

SEQ ID NO: 23637 - RNA, 18 nt, Homo sapiens
gggaaggcagcucaggag

SEQ ID NO: 23638 - RNA, 18 nt, Homo sapiens
agcagaggagaaaacugg

SEQ ID NO: 23639 - RNA, 18 nt, Homo sapiens
cacuggauggguggaggg

SEQ ID NO: 23640 - RNA, 17 nt, Homo sapiens
ggagaggggucaggagg

SEQ ID NO: 23641 - RNA, 21 nt, Homo sapiens
gggcggcgggcagccugaagg

SEQ ID NO: 23642 - RNA, 22 nt, Homo sapiens
gggcuguuuucuaucugaggga

SEQ ID NO: 23643 - RNA, 18 nt, Homo sapiens
aaggaagaaaaugcaauu

SEQ ID NO: 23644 - RNA, 21 nt, Homo sapiens
acagugaagccugccaccagg

SEQ ID NO: 23645 - RNA, 19 nt, Homo sapiens
acugaggagcagagaaaug

SEQ ID NO: 23646 - RNA, 19 nt, Homo sapiens
aggcaggcguuuggagagg

SEQ ID NO: 23647 - RNA, 16 nt, Homo sapiens
caaaacucuuucugua

SEQ ID NO: 23648 - RNA, 14 nt, Homo sapiens
cacguggcuguguc

SEQ ID NO: 23649 - RNA, 18 nt, Homo sapiens
ccccgcggggcgcccggc

SEQ ID NO: 23650 - RNA, 21 nt, Homo sapiens
cccgggcgcgcgcgccgcggc

SEQ ID NO: 23651 - RNA, 19 nt, Homo sapiens
ccgcgcagucggagcaccc

SEQ ID NO: 23652 - RNA, 17 nt, Homo sapiens
ccgcggccccgccgcgc

SEQ ID NO: 23653 - RNA, 18 nt, Homo sapiens
cgcggggcgcccggcugc

SEQ ID NO: 23654 - RNA, 19 nt, Homo sapiens
cucgcucuggguccccagg

SEQ ID NO: 23655 - RNA, 17 nt, Homo sapiens
cuugaaaaggguuuacc

SEQ ID NO: 23656 - RNA, 17 nt, Homo sapiens
gaaaguuuacaauuagg

SEQ ID NO: 23657 - RNA, 20 nt, Homo sapiens
gcaccgcuuggacuccacac

SEQ ID NO: 23658 - RNA, 18 nt, Homo sapiens
gccagcuugcccgccccc

SEQ ID NO: 23659 - RNA, 17 nt, Homo sapiens
gcccccaggagcgcggc

SEQ ID NO: 23660 - RNA, 17 nt, Homo sapiens
gcgcgaggccagcgagc

SEQ ID NO: 23661 - RNA, 20 nt, Homo sapiens
ggcaauaucauggccagcac

SEQ ID NO: 23662 - RNA, 17 nt, Homo sapiens
ggccagcgagcuggggc

SEQ ID NO: 23663 - RNA, 16 nt, Homo sapiens
ggccuugaccgcagcc

SEQ ID NO: 23664 - RNA, 17 nt, Homo sapiens
ggggcggaggggaccaa

SEQ ID NO: 23665 - RNA, 20 nt, Homo sapiens
guuccuuagggaacacuuca

SEQ ID NO: 23666 - RNA, 19 nt, Homo sapiens
uaccacagugacaccuuuu

SEQ ID NO: 23667 - RNA, 18 nt, Homo sapiens
ucagaaauuuccuucugc

SEQ ID NO: 23668 - RNA, 16 nt, Homo sapiens
ucagagucaagcuuuu

SEQ ID NO: 23669 - RNA, 22 nt, Homo sapiens
ucuacaguggguaucacguggc

SEQ ID NO: 23670 - RNA, 19 nt, Homo sapiens
ucuguagcacugucugcug

SEQ ID NO: 23671 - RNA, 18 nt, Homo sapiens
ugccggucacugggcugc

SEQ ID NO: 23672 - RNA, 18 nt, Homo sapiens
aagaggggagagauggaa

SEQ ID NO: 23673 - RNA, 22 nt, Homo sapiens
cagggccccugcaggacaggcc

SEQ ID NO: 23674 - RNA, 21 nt, Homo sapiens
ccgcccggccccgcugagggc

SEQ ID NO: 23675 - RNA, 22 nt, Homo sapiens
cgcggggcagagcaccagcugc

SEQ ID NO: 23676 - RNA, 18 nt, Homo sapiens
gcauucugcccacccagc

SEQ ID NO: 23677 - RNA, 14 nt, Homo sapiens
ucagggacccugga

SEQ ID NO: 23678 - RNA, 18 nt, Homo sapiens
uccuccccaaugguuuuc

SEQ ID NO: 23679 - RNA, 19 nt, Homo sapiens
ugggguggggacggccgga

SEQ ID NO: 23680 - RNA, 21 nt, Homo sapiens
uuccauaaacagugcagcuaa

SEQ ID NO: 23681 - RNA, 19 nt, Homo sapiens
agggcacagacacaacaau

SEQ ID NO: 23682 - RNA, 15 nt, Homo sapiens
cccacagcgucuuuc

SEQ ID NO: 23683 - RNA, 19 nt, Homo sapiens
uauaauggugauccaucau

SEQ ID NO: 23684 - RNA, 15 nt, Homo sapiens
ugcugcucuggcuuu

SEQ ID NO: 23685 - RNA, 18 nt, Homo sapiens
acccaguggccgcagcag

SEQ ID NO: 23686 - RNA, 19 nt, Homo sapiens
aggaggaauacuuaagguc

SEQ ID NO: 23687 - RNA, 18 nt, Homo sapiens
auauaugugugugugugu

SEQ ID NO: 23688 - RNA, 14 nt, Homo sapiens
gcaacagucucccu

SEQ ID NO: 23689 - RNA, 15 nt, Homo sapiens
gcagcgccauugucu

SEQ ID NO: 23690 - RNA, 26 nt, Homo sapiens
gccgcagcaguagccaccgccucugu

SEQ ID NO: 23691 - RNA, 18 nt, Homo sapiens
gcuugucugucaggccag

SEQ ID NO: 23692 - RNA, 24 nt, Homo sapiens
gugaagaaugaaggauggaggagg

SEQ ID NO: 23693 - RNA, 19 nt, Homo sapiens
uauauauguacauacacau

SEQ ID NO: 23694 - RNA, 17 nt, Homo sapiens
uguguguguguguauau

SEQ ID NO: 23695 - RNA, 16 nt, Homo sapiens
ggccccggccccgagc

SEQ ID NO: 23696 - RNA, 22 nt, Homo sapiens
gguccuguggagacagcgaggg

SEQ ID NO: 23697 - RNA, 20 nt, Homo sapiens
agcccucgucggaggcugag

SEQ ID NO: 23698 - RNA, 20 nt, Homo sapiens
ccccacccuuccccugaagu

SEQ ID NO: 23699 - RNA, 26 nt, Homo sapiens
cccgcccacucccccucccccucccg

SEQ ID NO: 23700 - RNA, 18 nt, Homo sapiens
gcccacucccccuccccc

SEQ ID NO: 23701 - RNA, 17 nt, Homo sapiens
gcugagcaaagccugcc

SEQ ID NO: 23702 - RNA, 24 nt, Homo sapiens
acaagacuccccaccacuugugaa

SEQ ID NO: 23703 - RNA, 19 nt, Homo sapiens
augaugcuggugugaauaa

SEQ ID NO: 23704 - RNA, 18 nt, Homo sapiens
ccgccgcgccgcuuccgc

SEQ ID NO: 23705 - RNA, 19 nt, Homo sapiens
uauucuauagcugccaggu

SEQ ID NO: 23706 - RNA, 16 nt, Homo sapiens
uguuuccucagcagag

SEQ ID NO: 23707 - RNA, 15 nt, Homo sapiens
agcgccacgccgccc

SEQ ID NO: 23708 - RNA, 18 nt, Homo sapiens
agcggcggcggcggcggc

SEQ ID NO: 23709 - RNA, 23 nt, Homo sapiens
ccgcacaguggaucccuggaggc

SEQ ID NO: 23710 - RNA, 24 nt, Homo sapiens
cgggcgcaggcggcucccagcgcg

SEQ ID NO: 23711 - RNA, 20 nt, Homo sapiens
gccccgacugccacgggccg

SEQ ID NO: 23712 - RNA, 19 nt, Homo sapiens
gcgucggcgcgucgcagcc

SEQ ID NO: 23713 - RNA, 21 nt, Homo sapiens
gcugugccgcgagccuccgcc

SEQ ID NO: 23714 - RNA, 19 nt, Homo sapiens
ggcggcccgagagcugcgc

SEQ ID NO: 23715 - RNA, 21 nt, Homo sapiens
ucccagcgcggcgaggcugcg

SEQ ID NO: 23716 - RNA, 24 nt, Homo sapiens
acgcagcaacagugagcauggugc

SEQ ID NO: 23717 - RNA, 19 nt, Homo sapiens
gcagcggcggcgacagcga

SEQ ID NO: 23718 - RNA, 19 nt, Homo sapiens
gcgcgaggcgggcagccgc

SEQ ID NO: 23719 - RNA, 17 nt, Homo sapiens
ucugaccaaagagcauu

SEQ ID NO: 23720 - RNA, 17 nt, Homo sapiens
uguacugugugagggaa

SEQ ID NO: 23721 - RNA, 17 nt, Homo sapiens
uagaggaacuaaggugu

SEQ ID NO: 23722 - RNA, 24 nt, Homo sapiens
uuccuugaguuuccaaaauccuuu

SEQ ID NO: 23723 - RNA, 16 nt, Homo sapiens
aagcccaguccccaug

SEQ ID NO: 23724 - RNA, 21 nt, Homo sapiens
agggugucagggucacaggaa

SEQ ID NO: 23725 - RNA, 19 nt, Homo sapiens
caugugcagaaggagggug

SEQ ID NO: 23726 - RNA, 18 nt, Homo sapiens
gcccccuguucuccaugg

SEQ ID NO: 23727 - RNA, 16 nt, Homo sapiens
ucucaaggccaagccc

SEQ ID NO: 23728 - RNA, 20 nt, Homo sapiens
cgccuggggaucccgcggcc

SEQ ID NO: 23729 - RNA, 16 nt, Homo sapiens
gcgaccccgcugcgcc

SEQ ID NO: 23730 - RNA, 19 nt, Homo sapiens
gcgccgcgccgcagcuucg

SEQ ID NO: 23731 - RNA, 18 nt, Homo sapiens
cagccuguccuggggguc

SEQ ID NO: 23732 - RNA, 18 nt, Homo sapiens
ccuguccugggggucccg

SEQ ID NO: 23733 - RNA, 18 nt, Homo sapiens
ucauugguuuauuggcgc

SEQ ID NO: 23734 - RNA, 23 nt, Homo sapiens
gccgcggccagccugcccuucug

SEQ ID NO: 23735 - RNA, 19 nt, Homo sapiens
ugcaccuaagcccuccccc

SEQ ID NO: 23736 - RNA, 22 nt, Homo sapiens
uggaaacaguguugacuguaaa

SEQ ID NO: 23737 - RNA, 19 nt, Homo sapiens
cacagcuuccacuauggca

SEQ ID NO: 23738 - RNA, 17 nt, Homo sapiens
caccagaagauagaaaa

SEQ ID NO: 23739 - RNA, 18 nt, Homo sapiens
gcccccugguuucuucgg

SEQ ID NO: 23740 - RNA, 18 nt, Homo sapiens
gcuccugacccucucucc

SEQ ID NO: 23741 - RNA, 20 nt, Homo sapiens
uaucaacuuguuugagauuc

SEQ ID NO: 23742 - RNA, 20 nt, Homo sapiens
ugacugguaguaguugguga

SEQ ID NO: 23743 - RNA, 15 nt, Homo sapiens
ugagagaugguucca

SEQ ID NO: 23744 - RNA, 19 nt, Homo sapiens
uguaucacuuugauguguc

SEQ ID NO: 23745 - RNA, 17 nt, Homo sapiens
uguggcgaaccagccag

SEQ ID NO: 23746 - RNA, 17 nt, Homo sapiens
aaguaguguuguugauc

SEQ ID NO: 23747 - RNA, 18 nt, Homo sapiens
agcagagcacugcguugc

SEQ ID NO: 23748 - RNA, 18 nt, Homo sapiens
agccauucuaaucugagc

SEQ ID NO: 23749 - RNA, 22 nt, Homo sapiens
aggcaugcgccacugugcccgg

SEQ ID NO: 23750 - RNA, 21 nt, Homo sapiens
cacgagauagguaacaaggau

SEQ ID NO: 23751 - RNA, 18 nt, Homo sapiens
cagaaggucugugccccu

SEQ ID NO: 23752 - RNA, 21 nt, Homo sapiens
cccggcugggcagagaaucuu

SEQ ID NO: 23753 - RNA, 19 nt, Homo sapiens
gauuacaggcaugcgccac

SEQ ID NO: 23754 - RNA, 21 nt, Homo sapiens
gccaugauuuuguugcugucc

SEQ ID NO: 23755 - RNA, 20 nt, Homo sapiens
gcguguuuuuccuuuacagc

SEQ ID NO: 23756 - RNA, 18 nt, Homo sapiens
gggggucaaauagucagc

SEQ ID NO: 23757 - RNA, 18 nt, Homo sapiens
guagaaaguggaacgauc

SEQ ID NO: 23758 - RNA, 18 nt, Homo sapiens
gugauccuaccaccucag

SEQ ID NO: 23759 - RNA, 16 nt, Homo sapiens
ucacucagcagcuccg

SEQ ID NO: 23760 - RNA, 18 nt, Homo sapiens
ucuucccugaugggagca

SEQ ID NO: 23761 - RNA, 21 nt, Homo sapiens
ugguaauugggaacauaugag

SEQ ID NO: 23762 - RNA, 19 nt, Homo sapiens
uguugaguggcccugcccc

SEQ ID NO: 23763 - RNA, 20 nt, Homo sapiens
uguuuaagugcuuucuuaac

SEQ ID NO: 23764 - RNA, 19 nt, Homo sapiens
uuugcuagagucacaccug

SEQ ID NO: 23765 - RNA, 18 nt, Homo sapiens
aggcgggggugggggggg

SEQ ID NO: 23766 - RNA, 23 nt, Homo sapiens
caucaaguauuuacuauuuuugc

SEQ ID NO: 23767 - RNA, 23 nt, Homo sapiens
gauguuggugcuccucaagaaga

SEQ ID NO: 23768 - RNA, 14 nt, Homo sapiens
ggcggggguggggg

SEQ ID NO: 23769 - RNA, 17 nt, Homo sapiens
ggggggggugaaggggg

SEQ ID NO: 23770 - RNA, 23 nt, Homo sapiens
uaaaguagcauguuucuuccaug

SEQ ID NO: 23771 - RNA, 17 nt, Homo sapiens
uaggugucaaauucacu

SEQ ID NO: 23772 - RNA, 22 nt, Homo sapiens
uuccccuuuuuaaauuuacaca

SEQ ID NO: 23773 - RNA, 19 nt, Homo sapiens
uuuguauugguccuaaaaa

SEQ ID NO: 23774 - RNA, 18 nt, Homo sapiens
cuccgucgccuccacagc

SEQ ID NO: 23775 - RNA, 20 nt, Homo sapiens
agagugaggagaacacgaga

SEQ ID NO: 23776 - RNA, 17 nt, Homo sapiens
agggaggccagucucca

SEQ ID NO: 23777 - RNA, 19 nt, Homo sapiens
cacccauggccacuucaug

SEQ ID NO: 23778 - RNA, 20 nt, Homo sapiens
cagccucucccaaaaggcau

SEQ ID NO: 23779 - RNA, 23 nt, Homo sapiens
uauguacaacuuugauacaguuu

SEQ ID NO: 23780 - RNA, 21 nt, Homo sapiens
aauggccugaguuaaguguau

SEQ ID NO: 23781 - RNA, 22 nt, Homo sapiens
agguucgcucugggaagccuug

SEQ ID NO: 23782 - RNA, 22 nt, Homo sapiens
agguucgcucuggaaagccuug

SEQ ID NO: 23783 - RNA, 19 nt, Homo sapiens
ucuaaugaacauaucgguu

SEQ ID NO: 23784 - RNA, 16 nt, Homo sapiens
aauggcuguauugggc

SEQ ID NO: 23785 - RNA, 18 nt, Homo sapiens
acugcuaaugaaaagcag

SEQ ID NO: 23786 - RNA, 20 nt, Homo sapiens
agaaagauaaggggaaauag

SEQ ID NO: 23787 - RNA, 21 nt, Homo sapiens
agccgagcauggugguaacaa

SEQ ID NO: 23788 - RNA, 19 nt, Homo sapiens
uccuacaccagaugcacau

SEQ ID NO: 23789 - RNA, 17 nt, Homo sapiens
ugacacaaaccauugcc

SEQ ID NO: 23790 - RNA, 16 nt, Homo sapiens
ugguaacaagccugug

SEQ ID NO: 23791 - RNA, 18 nt, Homo sapiens
ugugauccacccgccuug

SEQ ID NO: 23792 - RNA, 16 nt, Homo sapiens
uucaacuccacucuga

SEQ ID NO: 23793 - RNA, 18 nt, Homo sapiens
aaggggagggggggacgg

SEQ ID NO: 23794 - RNA, 22 nt, Homo sapiens
acacaaccaacguuuguucccc

SEQ ID NO: 23795 - RNA, 20 nt, Homo sapiens
agcccccuugcggcgcggug

SEQ ID NO: 23796 - RNA, 19 nt, Homo sapiens
aggggagggggggacgguc

SEQ ID NO: 23797 - RNA, 19 nt, Homo sapiens
cccgccgcgccggcccggg

SEQ ID NO: 23798 - RNA, 23 nt, Homo sapiens
cccgggggggaguggccgcggcc

SEQ ID NO: 23799 - RNA, 16 nt, Homo sapiens
cccguccgcucggccc

SEQ ID NO: 23800 - RNA, 22 nt, Homo sapiens
ccgcggccucccggggggcccg

SEQ ID NO: 23801 - RNA, 16 nt, Homo sapiens
ccgcucggcccugcgc

SEQ ID NO: 23802 - RNA, 19 nt, Homo sapiens
gaguggccgcggccucccg

SEQ ID NO: 23803 - RNA, 20 nt, Homo sapiens
gccucccccgccgcgccggc

SEQ ID NO: 23804 - RNA, 22 nt, Homo sapiens
gcgcccgccccggccgcggccg

SEQ ID NO: 23805 - RNA, 17 nt, Homo sapiens
gcgggggggucaugcgc

SEQ ID NO: 23806 - RNA, 19 nt, Homo sapiens
ggaaagaggcagcgcgagg

SEQ ID NO: 23807 - RNA, 17 nt, Homo sapiens
gggcacacucggggagg

SEQ ID NO: 23808 - RNA, 16 nt, Homo sapiens
ggggagggggggacgg

SEQ ID NO: 23809 - RNA, 17 nt, Homo sapiens
ggggcggccgcgcgggg

SEQ ID NO: 23810 - RNA, 18 nt, Homo sapiens
uggcguaacgagacuuua

SEQ ID NO: 23811 - RNA, 21 nt, Homo sapiens
cagcagcagcaaaaggcagcg

SEQ ID NO: 23812 - RNA, 22 nt, Homo sapiens
gcgugcagguccagccgucucg

SEQ ID NO: 23813 - RNA, 19 nt, Homo sapiens
gggaggauuaggaauagga

SEQ ID NO: 23814 - RNA, 22 nt, Homo sapiens
ugcggcggucgccgcagcagca

SEQ ID NO: 23815 - RNA, 20 nt, Homo sapiens
ugggaggauuaggaauagga

SEQ ID NO: 23816 - RNA, 18 nt, Homo sapiens
aaaaaaguuugcagucuu

SEQ ID NO: 23817 - RNA, 18 nt, Homo sapiens
aggggagugggaaggcgc

SEQ ID NO: 23818 - RNA, 22 nt, Homo sapiens
caguuuccaaaauauucaguuu

SEQ ID NO: 23819 - RNA, 18 nt, Homo sapiens
uaugaucauugauggcaa

SEQ ID NO: 23820 - RNA, 15 nt, Homo sapiens
ugcuaggagcaaggc

SEQ ID NO: 23821 - RNA, 26 nt, Homo sapiens
aggcagggcggcgcgcggcguccgcu

SEQ ID NO: 23822 - RNA, 24 nt, Homo sapiens
cccugcccgcgccccccgcgcccg

SEQ ID NO: 23823 - RNA, 18 nt, Homo sapiens
ccggcccgggcugcaggc

SEQ ID NO: 23824 - RNA, 17 nt, Homo sapiens
ccgggcuggggcgcuuc

SEQ ID NO: 23825 - RNA, 27 nt, Homo sapiens
ccgggcuggggcgcuucugggggaucc

SEQ ID NO: 23826 - RNA, 20 nt, Homo sapiens
ccuugcgcucgccuccuugc

SEQ ID NO: 23827 - RNA, 17 nt, Homo sapiens
cggcguccgcucggggc

SEQ ID NO: 23828 - RNA, 15 nt, Homo sapiens
cgguggcggcggugg

SEQ ID NO: 23829 - RNA, 22 nt, Homo sapiens
cuucaugcuucucgccuccucu

SEQ ID NO: 23830 - RNA, 18 nt, Homo sapiens
gcccgcccucccuccccc

SEQ ID NO: 23831 - RNA, 24 nt, Homo sapiens
gcgcggcgucccgccuucgcgcug

SEQ ID NO: 23832 - RNA, 18 nt, Homo sapiens
gcggcggugguggcugcg

SEQ ID NO: 23833 - RNA, 20 nt, Homo sapiens
gcgguggcggcggugguggc

SEQ ID NO: 23834 - RNA, 16 nt, Homo sapiens
gcucccucgcucgccc

SEQ ID NO: 23835 - RNA, 17 nt, Homo sapiens
ggagagggaggggggag

SEQ ID NO: 23836 - RNA, 21 nt, Homo sapiens
gggcgucuguccgggcggcgc

SEQ ID NO: 23837 - RNA, 19 nt, Homo sapiens
gggggagggggagccaagc

SEQ ID NO: 23838 - RNA, 22 nt, Homo sapiens
uaauguacagcucucacacaaa

SEQ ID NO: 23839 - RNA, 18 nt, Homo sapiens
ucacgccaaugugcuccc

SEQ ID NO: 23840 - RNA, 22 nt, Homo sapiens
ugcaggagaggggccagcgggc

SEQ ID NO: 23841 - RNA, 17 nt, Homo sapiens
uggaaggcgcggcgggc

SEQ ID NO: 23842 - RNA, 16 nt, Homo sapiens
cuugccuccucaccga

SEQ ID NO: 23843 - RNA, 19 nt, Homo sapiens
gacccacuggcagaucuuc

SEQ ID NO: 23844 - RNA, 20 nt, Homo sapiens
agacccugagcccgcuuccc

SEQ ID NO: 23845 - RNA, 15 nt, Homo sapiens
ccucacacccaacau

SEQ ID NO: 23846 - RNA, 19 nt, Homo sapiens
cgaaccuugccuccucaca

SEQ ID NO: 23847 - RNA, 18 nt, Homo sapiens
ugcucucuucaaacacag

SEQ ID NO: 23848 - RNA, 18 nt, Homo sapiens
aggagcugggcgauggag

SEQ ID NO: 23849 - RNA, 20 nt, Homo sapiens
gcagcugcuggauggggccc

SEQ ID NO: 23850 - RNA, 18 nt, Homo sapiens
gggcuccuguccuccugg

SEQ ID NO: 23851 - RNA, 18 nt, Homo sapiens
ugcucucuucaaacacag

SEQ ID NO: 23852 - RNA, 20 nt, Homo sapiens
ucagaaccuugccuccucac

SEQ ID NO: 23853 - RNA, 16 nt, Homo sapiens
uuugaacaauuccaac

SEQ ID NO: 23854 - RNA, 25 nt, Homo sapiens
accccagccccagccccucagcucc

SEQ ID NO: 23855 - RNA, 20 nt, Homo sapiens
agggcacucccgguucccag

SEQ ID NO: 23856 - RNA, 22 nt, Homo sapiens
cagacaauugcuacugucaggu

SEQ ID NO: 23857 - RNA, 21 nt, Homo sapiens
ccccagccccucagcuccucc

SEQ ID NO: 23858 - RNA, 22 nt, Homo sapiens
gcucucucuugaacccggggcc

SEQ ID NO: 23859 - RNA, 20 nt, Homo sapiens
gggggugggagcggcagggg

SEQ ID NO: 23860 - RNA, 18 nt, Homo sapiens
gggguuacagccaguuug

SEQ ID NO: 23861 - RNA, 19 nt, Homo sapiens
caaaagcugugguuucaac

SEQ ID NO: 23862 - RNA, 21 nt, Homo sapiens
ccccgaaaagaauuucugggc

SEQ ID NO: 23863 - RNA, 18 nt, Homo sapiens
gcgcaguauuuuuccaaa

SEQ ID NO: 23864 - RNA, 26 nt, Homo sapiens
ugaaauacgagcugcuucuuggguag

SEQ ID NO: 23865 - RNA, 21 nt, Homo sapiens
ugaugaaauacgagcugcuuc

SEQ ID NO: 23866 - RNA, 23 nt, Homo sapiens
aggacacgaaggagugggggcca

SEQ ID NO: 23867 - RNA, 19 nt, Homo sapiens
cuggugacaccccccuggc

SEQ ID NO: 23868 - RNA, 20 nt, Homo sapiens
gaggaccaugugacggcugu

SEQ ID NO: 23869 - RNA, 16 nt, Homo sapiens
ggaggacacgaaggag

SEQ ID NO: 23870 - RNA, 20 nt, Homo sapiens
guggagcuuuguguugcagu

SEQ ID NO: 23871 - RNA, 16 nt, Homo sapiens
uagaaagaacguccga

SEQ ID NO: 23872 - RNA, 16 nt, Homo sapiens
ucccgaucacccaggu

SEQ ID NO: 23873 - RNA, 22 nt, Homo sapiens
ucugaauauacaacgugugggu

SEQ ID NO: 23874 - RNA, 16 nt, Homo sapiens
ucuuggccauguccag

SEQ ID NO: 23875 - RNA, 17 nt, Homo sapiens
ugccuugugucuuggcc

SEQ ID NO: 23876 - RNA, 18 nt, Homo sapiens
ugggaccucgcuuccgug

SEQ ID NO: 23877 - RNA, 14 nt, Homo sapiens
ugucagcuggcccu

SEQ ID NO: 23878 - RNA, 20 nt, Homo sapiens
acucuaggugcugggggaaa

SEQ ID NO: 23879 - RNA, 19 nt, Homo sapiens
cagcgagaucaaaggaacu

SEQ ID NO: 23880 - RNA, 24 nt, Homo sapiens
cugccuguggagaaaggguccugg

SEQ ID NO: 23881 - RNA, 21 nt, Homo sapiens
gcagugagccgagaucgugcc

SEQ ID NO: 23882 - RNA, 17 nt, Homo sapiens
ugcacagcuaguaaaug

SEQ ID NO: 23883 - RNA, 23 nt, Homo sapiens
ugccuguaauccuaacacuuugg

SEQ ID NO: 23884 - RNA, 17 nt, Homo sapiens
uugggaggccaaggugg

SEQ ID NO: 23885 - RNA, 23 nt, Homo sapiens
agauggcagaaagcuggagcuga

SEQ ID NO: 23886 - RNA, 16 nt, Homo sapiens
agggaaagaggcagca

SEQ ID NO: 23887 - RNA, 19 nt, Homo sapiens
cgcuccagccgcccgccac

SEQ ID NO: 23888 - RNA, 18 nt, Homo sapiens
cuuguccccuggggcucc

SEQ ID NO: 23889 - RNA, 16 nt, Homo sapiens
gaccggcuccccgccg

SEQ ID NO: 23890 - RNA, 20 nt, Homo sapiens
uauuauuggcauuuuaaagu

SEQ ID NO: 23891 - RNA, 18 nt, Homo sapiens
ucggcuucuucucccccu

SEQ ID NO: 23892 - RNA, 19 nt, Homo sapiens
ugccugguugggauggagc

SEQ ID NO: 23893 - RNA, 20 nt, Homo sapiens
acauauauauauacauauau

SEQ ID NO: 23894 - RNA, 24 nt, Homo sapiens
agagagagcuggguuucaaaguuu

SEQ ID NO: 23895 - RNA, 21 nt, Homo sapiens
agcugcagaguccagcugggg

SEQ ID NO: 23896 - RNA, 18 nt, Homo sapiens
agggagaucaaaaagaaa

SEQ ID NO: 23897 - RNA, 22 nt, Homo sapiens
auauauacauacauauauauau

SEQ ID NO: 23898 - RNA, 23 nt, Homo sapiens
caagucucugagcuuguuuucac

SEQ ID NO: 23899 - RNA, 21 nt, Homo sapiens
caccgagcgcgcgacccgccc

SEQ ID NO: 23900 - RNA, 19 nt, Homo sapiens
gaccagccuggccaaugug

SEQ ID NO: 23901 - RNA, 21 nt, Homo sapiens
gagguaaugguccacguugau

SEQ ID NO: 23902 - RNA, 17 nt, Homo sapiens
gcgugguggcaggcgcc

SEQ ID NO: 23903 - RNA, 21 nt, Homo sapiens
gcucacgcagcuugccaccug

SEQ ID NO: 23904 - RNA, 20 nt, Homo sapiens
gcuugcucacgcagcuugcc

SEQ ID NO: 23905 - RNA, 20 nt, Homo sapiens
uaauauauacauauauacau

SEQ ID NO: 23906 - RNA, 24 nt, Homo sapiens
uacauauauacauacauauauaua

SEQ ID NO: 23907 - RNA, 21 nt, Homo sapiens
uacauauauauauacauauau

SEQ ID NO: 23908 - RNA, 22 nt, Homo sapiens
uacauauauauauacauauaua

SEQ ID NO: 23909 - RNA, 24 nt, Homo sapiens
uauauauacauauauacauauaua

SEQ ID NO: 23910 - RNA, 18 nt, Homo sapiens
uauauauauacauauaua

SEQ ID NO: 23911 - RNA, 21 nt, Homo sapiens
uauauauauacauauauguaa

SEQ ID NO: 23912 - RNA, 21 nt, Homo sapiens
ugagucacagcauugagagug

SEQ ID NO: 23913 - RNA, 20 nt, Homo sapiens
ugcgggaaagggugcuguag

SEQ ID NO: 23914 - RNA, 18 nt, Homo sapiens
uugcuugcucacgcagcu

SEQ ID NO: 23915 - RNA, 22 nt, Homo sapiens
cagcacuaaauauauacauuuu

SEQ ID NO: 23916 - RNA, 21 nt, Homo sapiens
uauaaguaucaaauuuaguua

SEQ ID NO: 23917 - RNA, 18 nt, Homo sapiens
uauacaggcaguguaaga

SEQ ID NO: 23918 - RNA, 20 nt, Homo sapiens
uggaaacuuggaacacacaa

SEQ ID NO: 23919 - RNA, 21 nt, Homo sapiens
aacuaggguauaacuucacug

SEQ ID NO: 23920 - RNA, 21 nt, Homo sapiens
ggaauggggcauaagaguccu

SEQ ID NO: 23921 - RNA, 18 nt, Homo sapiens
ggaggagagaacaagaag

SEQ ID NO: 23922 - RNA, 22 nt, Homo sapiens
ggggcauaagaguccuggcccc

SEQ ID NO: 23923 - RNA, 20 nt, Homo sapiens
ugcagagaggcugcggguug

SEQ ID NO: 23924 - RNA, 22 nt, Homo sapiens
agggagcacccugagcuugcau

SEQ ID NO: 23925 - RNA, 17 nt, Homo sapiens
aacuucaaaauguagaa

SEQ ID NO: 23926 - RNA, 19 nt, Homo sapiens
ccacccaaagccaugaaaa

SEQ ID NO: 23927 - RNA, 17 nt, Homo sapiens
gagagaagccccccaaa

SEQ ID NO: 23928 - RNA, 19 nt, Homo sapiens
ugccagacucaugagcuac

SEQ ID NO: 23929 - RNA, 19 nt, Homo sapiens
uguggcauaaaaauauuuu

SEQ ID NO: 23930 - RNA, 21 nt, Homo sapiens
aaccaaaaaguuuuaaaaaaa

SEQ ID NO: 23931 - RNA, 23 nt, Homo sapiens
auauauuauuagcugaccauacu

SEQ ID NO: 23932 - RNA, 20 nt, Homo sapiens
cccuagcucgcuccggaucc

SEQ ID NO: 23933 - RNA, 19 nt, Homo sapiens
uaccuuguuaaaacaaaaa

SEQ ID NO: 23934 - RNA, 17 nt, Homo sapiens
uccuguuuauacaacug

SEQ ID NO: 23935 - RNA, 18 nt, Homo sapiens
uucaagacucuuuuacag

SEQ ID NO: 23936 - RNA, 25 nt, Homo sapiens
uuccagacuuagucaugcuggagga

SEQ ID NO: 23937 - RNA, 16 nt, Homo sapiens
aacaagcugugauggu

SEQ ID NO: 23938 - RNA, 18 nt, Homo sapiens
aagcucaucucuauuuuc

SEQ ID NO: 23939 - RNA, 18 nt, Homo sapiens
caugcugaaaauaacagu

SEQ ID NO: 23940 - RNA, 20 nt, Homo sapiens
ccaucuuaagguuuaauauu

SEQ ID NO: 23941 - RNA, 19 nt, Homo sapiens
gaagaaagagcagaagaua

SEQ ID NO: 23942 - RNA, 16 nt, Homo sapiens
uacuuugcauccuucc

SEQ ID NO: 23943 - RNA, 18 nt, Homo sapiens
ugacaccacaucaaaagc

SEQ ID NO: 23944 - RNA, 18 nt, Homo sapiens
uuugaagaaucagaaacc

SEQ ID NO: 23945 - RNA, 19 nt, Homo sapiens
caguggcuggcucgguucc

SEQ ID NO: 23946 - RNA, 21 nt, Homo sapiens
cugugcccccaggcucugcca

SEQ ID NO: 23947 - RNA, 18 nt, Homo sapiens
gcaggggagguggcaggc

SEQ ID NO: 23948 - RNA, 19 nt, Homo sapiens
gggcauuguccuggugggc

SEQ ID NO: 23949 - RNA, 18 nt, Homo sapiens
ggggaaggagggggaucc

SEQ ID NO: 23950 - RNA, 17 nt, Homo sapiens
ggggagagggggaagga

SEQ ID NO: 23951 - RNA, 18 nt, Homo sapiens
ggggggaagguggguggg

SEQ ID NO: 23952 - RNA, 17 nt, Homo sapiens
ugggcacagugccuggc

SEQ ID NO: 23953 - RNA, 21 nt, Homo sapiens
agagcuacuacagccggagcc

SEQ ID NO: 23954 - RNA, 18 nt, Homo sapiens
agcgauggagagucagga

SEQ ID NO: 23955 - RNA, 18 nt, Homo sapiens
agcggcggcggcggcggc

SEQ ID NO: 23956 - RNA, 21 nt, Homo sapiens
aggccuguggguggcuccgga

SEQ ID NO: 23957 - RNA, 19 nt, Homo sapiens
caaguggcucugaccuugg

SEQ ID NO: 23958 - RNA, 26 nt, Homo sapiens
caccugaucuacaagacaaauacuuu

SEQ ID NO: 23959 - RNA, 23 nt, Homo sapiens
cccagagccucuccggguucucc

SEQ ID NO: 23960 - RNA, 22 nt, Homo sapiens
cccagucuuucccuuccccauc

SEQ ID NO: 23961 - RNA, 16 nt, Homo sapiens
ccccagccccuccccc

SEQ ID NO: 23962 - RNA, 20 nt, Homo sapiens
ccccagucuuucccuucccc

SEQ ID NO: 23963 - RNA, 19 nt, Homo sapiens
cccuggccuuccuuuuccc

SEQ ID NO: 23964 - RNA, 22 nt, Homo sapiens
ccggggcucccgagucgcgcug

SEQ ID NO: 23965 - RNA, 24 nt, Homo sapiens
ccucccugccgcugcagcagagcc

SEQ ID NO: 23966 - RNA, 18 nt, Homo sapiens
ccuuuacugaaauggagc

SEQ ID NO: 23967 - RNA, 20 nt, Homo sapiens
cgcgcugcggcggcucuucc

SEQ ID NO: 23968 - RNA, 22 nt, Homo sapiens
cgcuuuccaggcccucuuuucc

SEQ ID NO: 23969 - RNA, 21 nt, Homo sapiens
cggcggcggcggcggcugcgu

SEQ ID NO: 23970 - RNA, 14 nt, Homo sapiens
cucccacgggacca

SEQ ID NO: 23971 - RNA, 20 nt, Homo sapiens
cucuuugcccucucuugccu

SEQ ID NO: 23972 - RNA, 20 nt, Homo sapiens
cugccgcugcagcagagccg

SEQ ID NO: 23973 - RNA, 16 nt, Homo sapiens
cuuugcuggggagggg

SEQ ID NO: 23974 - RNA, 17 nt, Homo sapiens
gagcagguggcugcggu

SEQ ID NO: 23975 - RNA, 26 nt, Homo sapiens
gcacuaguggguuauuuuacaagagg

SEQ ID NO: 23976 - RNA, 20 nt, Homo sapiens
gccuguggguggcuccggag

SEQ ID NO: 23977 - RNA, 16 nt, Homo sapiens
gcggcggcucuuccuc

SEQ ID NO: 23978 - RNA, 21 nt, Homo sapiens
gcggcugcguccugggcggcg

SEQ ID NO: 23979 - RNA, 17 nt, Homo sapiens
ggcuuccuagucaucau

SEQ ID NO: 23980 - RNA, 22 nt, Homo sapiens
gggcaagaaggaagcaaacacc

SEQ ID NO: 23981 - RNA, 18 nt, Homo sapiens
gguguccugguggcaaga

SEQ ID NO: 23982 - RNA, 17 nt, Homo sapiens
ucagagcuacuacagcc

SEQ ID NO: 23983 - RNA, 23 nt, Homo sapiens
uccuguuuucccccaaacaggca

SEQ ID NO: 23984 - RNA, 17 nt, Homo sapiens
ucggcaaucucacugca

SEQ ID NO: 23985 - RNA, 21 nt, Homo sapiens
uggaaauggaagcccaaagaa

SEQ ID NO: 23986 - RNA, 23 nt, Homo sapiens
uggcuggugaagugugacccagg

SEQ ID NO: 23987 - RNA, 20 nt, Homo sapiens
caguagaaaaguauggaugc

SEQ ID NO: 23988 - RNA, 22 nt, Homo sapiens
gcccuuuguguauacuuuucac

SEQ ID NO: 23989 - RNA, 25 nt, Homo sapiens
gcccuuuguguauacuuuucacaca

SEQ ID NO: 23990 - RNA, 23 nt, Homo sapiens
ucaaccuguuacuugauccuuca

SEQ ID NO: 23991 - RNA, 19 nt, Homo sapiens
ucaucaaggauagcuagag

SEQ ID NO: 23992 - RNA, 18 nt, Homo sapiens
ucuccacaaggauacgua

SEQ ID NO: 23993 - RNA, 20 nt, Homo sapiens
ugaaauauuuacaguagaaa

SEQ ID NO: 23994 - RNA, 20 nt, Homo sapiens
ugugaguuguguacacugac

SEQ ID NO: 23995 - RNA, 18 nt, Homo sapiens
ccccguggcgccccggag

SEQ ID NO: 23996 - RNA, 19 nt, Homo sapiens
ccuucgcggcggcggagcc

SEQ ID NO: 23997 - RNA, 16 nt, Homo sapiens
cggacgccgccugccu

SEQ ID NO: 23998 - RNA, 20 nt, Homo sapiens
aaaaagaaaaaaaaagacau

SEQ ID NO: 23999 - RNA, 20 nt, Homo sapiens
uccaucauaaaaaauauggu

SEQ ID NO: 24000 - RNA, 18 nt, Homo sapiens
uggaagccaauucaguag

SEQ ID NO: 24001 - RNA, 18 nt, Homo sapiens
uuagcaaaauauucacgu

SEQ ID NO: 24002 - RNA, 17 nt, Homo sapiens
agaccagguaggcaggc

SEQ ID NO: 24003 - RNA, 19 nt, Homo sapiens
cauucauucagaagauaua

SEQ ID NO: 24004 - RNA, 20 nt, Homo sapiens
ccugagcugggucccagcuc

SEQ ID NO: 24005 - RNA, 20 nt, Homo sapiens
cugccugagagaggagaggg

SEQ ID NO: 24006 - RNA, 18 nt, Homo sapiens
gaugccuucugggaugag

SEQ ID NO: 24007 - RNA, 18 nt, Homo sapiens
uaacaugguggguuggag

SEQ ID NO: 24008 - RNA, 25 nt, Homo sapiens
uaacaugguggguuggaguuaggau

SEQ ID NO: 24009 - RNA, 19 nt, Homo sapiens
uccacugcccugagcuggg

SEQ ID NO: 24010 - RNA, 17 nt, Homo sapiens
ucccauucuaccuuguu

SEQ ID NO: 24011 - RNA, 27 nt, Homo sapiens
ucggugaagagcuucugcuucaccgug

SEQ ID NO: 24012 - RNA, 16 nt, Homo sapiens
ugccugagagaggaga

SEQ ID NO: 24013 - RNA, 20 nt, Homo sapiens
uugagcaaguuggggccgaa

SEQ ID NO: 24014 - RNA, 20 nt, Homo sapiens
agaaaauucagggagaggaa

SEQ ID NO: 24015 - RNA, 19 nt, Homo sapiens
aggaggagggcuaggaggc

SEQ ID NO: 24016 - RNA, 19 nt, Homo sapiens
aggaggcggaggggaagga

SEQ ID NO: 24017 - RNA, 19 nt, Homo sapiens
aggagugggggaggagggg

SEQ ID NO: 24018 - RNA, 20 nt, Homo sapiens
cccucuuguccucguggugg

SEQ ID NO: 24019 - RNA, 23 nt, Homo sapiens
gaggaagggcguaagggacaccc

SEQ ID NO: 24020 - RNA, 18 nt, Homo sapiens
gaggaggagaaggaaagg

SEQ ID NO: 24021 - RNA, 20 nt, Homo sapiens
gaggaggagaaggaagagga

SEQ ID NO: 24022 - RNA, 20 nt, Homo sapiens
gaggaggggaaggagaggga

SEQ ID NO: 24023 - RNA, 19 nt, Homo sapiens
gcggaggggaaggaguggg

SEQ ID NO: 24024 - RNA, 16 nt, Homo sapiens
ggaaaggaggggggag

SEQ ID NO: 24025 - RNA, 16 nt, Homo sapiens
ggaggggggagcagga

SEQ ID NO: 24026 - RNA, 21 nt, Homo sapiens
gggaaggagagggaggagggc

SEQ ID NO: 24027 - RNA, 23 nt, Homo sapiens
guccucgugguggugauugaucu

SEQ ID NO: 24028 - RNA, 18 nt, Homo sapiens
aaaaaaaaaaaaaggaca

SEQ ID NO: 24029 - RNA, 18 nt, Homo sapiens
agacguaugaaaggaaaa

SEQ ID NO: 24030 - RNA, 19 nt, Homo sapiens
caccauguguguccugcca

SEQ ID NO: 24031 - RNA, 16 nt, Homo sapiens
cagccccacaucugcc

SEQ ID NO: 24032 - RNA, 22 nt, Homo sapiens
ccccagcccuucuccugguucc

SEQ ID NO: 24033 - RNA, 24 nt, Homo sapiens
ccccagcccuucuccugguuccuc

SEQ ID NO: 24034 - RNA, 18 nt, Homo sapiens
cuccugguuccucuuccg

SEQ ID NO: 24035 - RNA, 15 nt, Homo sapiens
gcauggcagugggua

SEQ ID NO: 24036 - RNA, 18 nt, Homo sapiens
ggggaggagaacagggcc

SEQ ID NO: 24037 - RNA, 21 nt, Homo sapiens
gggugccgacuuggggaggag

SEQ ID NO: 24038 - RNA, 19 nt, Homo sapiens
ugcagggagaggcgugcgg

SEQ ID NO: 24039 - RNA, 18 nt, Homo sapiens
ugcuuggccuccuucccc

SEQ ID NO: 24040 - RNA, 19 nt, Homo sapiens
agcgaaacuucauccaugc

SEQ ID NO: 24041 - RNA, 23 nt, Homo sapiens
cacccguagaugggaaggaggga

SEQ ID NO: 24042 - RNA, 21 nt, Homo sapiens
cagagagcacuggcagagcug

SEQ ID NO: 24043 - RNA, 15 nt, Homo sapiens
cagcggggaccucag

SEQ ID NO: 24044 - RNA, 20 nt, Homo sapiens
cccuguaccgcaucguggcc

SEQ ID NO: 24045 - RNA, 24 nt, Homo sapiens
gagggucccaggcugggccuucuc

SEQ ID NO: 24046 - RNA, 18 nt, Homo sapiens
ggacuaggccuaagaccc

SEQ ID NO: 24047 - RNA, 18 nt, Homo sapiens
ucaggcucugcaaggcac

SEQ ID NO: 24048 - RNA, 23 nt, Homo sapiens
uccaugcucuggcaggacaggaa

SEQ ID NO: 24049 - RNA, 18 nt, Homo sapiens
aaaaagaugagaaccacu

SEQ ID NO: 24050 - RNA, 20 nt, Homo sapiens
uaagcugcaaaaaaagauga

SEQ ID NO: 24051 - RNA, 14 nt, Homo sapiens
aaagcaugggaacc

SEQ ID NO: 24052 - RNA, 20 nt, Homo sapiens
ugaaugacaggccgggagug

SEQ ID NO: 24053 - RNA, 20 nt, Homo sapiens
aggagcccuugggucagauu

SEQ ID NO: 24054 - RNA, 14 nt, Homo sapiens
cagcaggccuagcu

SEQ ID NO: 24055 - RNA, 18 nt, Homo sapiens
cccaggcuggggcagcuc

SEQ ID NO: 24056 - RNA, 19 nt, Homo sapiens
gcccuggcaggcccaccug

SEQ ID NO: 24057 - RNA, 18 nt, Homo sapiens
ugagggcagggccuccuc

SEQ ID NO: 24058 - RNA, 20 nt, Homo sapiens
acaauauacaaggugugcag

SEQ ID NO: 24059 - RNA, 18 nt, Homo sapiens
ccugcugacguagaugcu

SEQ ID NO: 24060 - RNA, 15 nt, Homo sapiens
cuuugcacagaucca

SEQ ID NO: 24061 - RNA, 21 nt, Homo sapiens
gcggcggcggcggcagcggcg

SEQ ID NO: 24062 - RNA, 20 nt, Homo sapiens
gggggaggggagcggagagc

SEQ ID NO: 24063 - RNA, 23 nt, Homo sapiens
ugcuacacgggacaccuuugccc

SEQ ID NO: 24064 - RNA, 19 nt, Homo sapiens
uguagaaaacaggauuguc

SEQ ID NO: 24065 - RNA, 19 nt, Homo sapiens
ugugaaauuuuugccaaaa

SEQ ID NO: 24066 - RNA, 20 nt, Homo sapiens
uuugccaaaaauaaucguau

SEQ ID NO: 24067 - RNA, 16 nt, Homo sapiens
ccgucgcagccccggg

SEQ ID NO: 24068 - RNA, 20 nt, Homo sapiens
ccugccuccugaggcaguuu

SEQ ID NO: 24069 - RNA, 22 nt, Homo sapiens
gggccugugaggugccugggga

SEQ ID NO: 24070 - RNA, 21 nt, Homo sapiens
gggcgguggcgcaggcugcag

SEQ ID NO: 24071 - RNA, 21 nt, Homo sapiens
ucccggcuggccuggcgcggg

SEQ ID NO: 24072 - RNA, 17 nt, Homo sapiens
gccuguggagcgacagc

SEQ ID NO: 24073 - RNA, 21 nt, Homo sapiens
ggacccaagaggaaaucgggg

SEQ ID NO: 24074 - RNA, 18 nt, Homo sapiens
ggcacaucccgggagcac

SEQ ID NO: 24075 - RNA, 19 nt, Homo sapiens
accaagucaucgauaaaaa

SEQ ID NO: 24076 - RNA, 18 nt, Homo sapiens
accaggcugggacccagc

SEQ ID NO: 24077 - RNA, 20 nt, Homo sapiens
cagggggcagugcaacaagg

SEQ ID NO: 24078 - RNA, 22 nt, Homo sapiens
cgacggugggacgggacgcggc

SEQ ID NO: 24079 - RNA, 17 nt, Homo sapiens
cgcggggagugugacug

SEQ ID NO: 24080 - RNA, 20 nt, Homo sapiens
cguaugaaccgcggggagug

SEQ ID NO: 24081 - RNA, 16 nt, Homo sapiens
gaccccauggcggagg

SEQ ID NO: 24082 - RNA, 24 nt, Homo sapiens
gacgcggcgguggcggcaguggcg

SEQ ID NO: 24083 - RNA, 17 nt, Homo sapiens
gcggcggacagcauggc

SEQ ID NO: 24084 - RNA, 19 nt, Homo sapiens
ggacgggacgcggcggugg

SEQ ID NO: 24085 - RNA, 22 nt, Homo sapiens
ggauaggggacaccacaaacaa

SEQ ID NO: 24086 - RNA, 19 nt, Homo sapiens
uacaguggaaggaaauacu

SEQ ID NO: 24087 - RNA, 17 nt, Homo sapiens
ugacaccaucaggagcc

SEQ ID NO: 24088 - RNA, 25 nt, Homo sapiens
aggauuguuggccacagaugucuuc

SEQ ID NO: 24089 - RNA, 19 nt, Homo sapiens
cacugaugggcagugcugc

SEQ ID NO: 24090 - RNA, 17 nt, Homo sapiens
caucagucuacgugugu

SEQ ID NO: 24091 - RNA, 20 nt, Homo sapiens
ccagccugggagacagagca

SEQ ID NO: 24092 - RNA, 18 nt, Homo sapiens
cucguuguuguuucgauu

SEQ ID NO: 24093 - RNA, 23 nt, Homo sapiens
cugacauuuuuauaauagccauu

SEQ ID NO: 24094 - RNA, 19 nt, Homo sapiens
ggguauauacccaguaaug

SEQ ID NO: 24095 - RNA, 19 nt, Homo sapiens
uccccuagaguuuaaaacu

SEQ ID NO: 24096 - RNA, 19 nt, Homo sapiens
ugugaauuuuugcuucugu

SEQ ID NO: 24097 - RNA, 17 nt, Homo sapiens
uugggaggccgaggugg

SEQ ID NO: 24098 - RNA, 20 nt, Homo sapiens
agaggugggugaggaggagc

SEQ ID NO: 24099 - RNA, 18 nt, Homo sapiens
aggaggagccgccugccu

SEQ ID NO: 24100 - RNA, 18 nt, Homo sapiens
cacuacuagagacaaggc

SEQ ID NO: 24101 - RNA, 19 nt, Homo sapiens
caggguccugcagguggcc

SEQ ID NO: 24102 - RNA, 19 nt, Homo sapiens
ccaacggcaguccggcucc

SEQ ID NO: 24103 - RNA, 16 nt, Homo sapiens
ccagcccugcgcugcc

SEQ ID NO: 24104 - RNA, 16 nt, Homo sapiens
cugaguggugggggag

SEQ ID NO: 24105 - RNA, 20 nt, Homo sapiens
ggccaggauacaccgggacc

SEQ ID NO: 24106 - RNA, 19 nt, Homo sapiens
gucugaggccccagcccag

SEQ ID NO: 24107 - RNA, 17 nt, Homo sapiens
guggaggcacugagugg

SEQ ID NO: 24108 - RNA, 15 nt, Homo sapiens
gugggggguggaggg

SEQ ID NO: 24109 - RNA, 15 nt, Homo sapiens
ugcagccagaugugu

SEQ ID NO: 24110 - RNA, 15 nt, Homo sapiens
ugccgagguggggcc

SEQ ID NO: 24111 - RNA, 18 nt, Homo sapiens
ugggcuggccaccaggau

SEQ ID NO: 24112 - RNA, 21 nt, Homo sapiens
uggggcuuggggaugacccgc

SEQ ID NO: 24113 - RNA, 27 nt, Homo sapiens
aaccacuaaugcugcuauucaaaucug

SEQ ID NO: 24114 - RNA, 20 nt, Homo sapiens
aagcaggagccucacugucc

SEQ ID NO: 24115 - RNA, 19 nt, Homo sapiens
acuuggggaaaaaaaagug

SEQ ID NO: 24116 - RNA, 18 nt, Homo sapiens
cacuguccuucauuacca

SEQ ID NO: 24117 - RNA, 16 nt, Homo sapiens
cauauacgccauggca

SEQ ID NO: 24118 - RNA, 18 nt, Homo sapiens
cgugguggugggcaccug

SEQ ID NO: 24119 - RNA, 18 nt, Homo sapiens
cugaucuggucauauuuu

SEQ ID NO: 24120 - RNA, 16 nt, Homo sapiens
ggaaaaaaaagugguu

SEQ ID NO: 24121 - RNA, 23 nt, Homo sapiens
uggacaguaguuucaauuauaua

SEQ ID NO: 24122 - RNA, 19 nt, Homo sapiens
uuagaguuuaauacuuggg

SEQ ID NO: 24123 - RNA, 17 nt, Homo sapiens
uuccugauuagauuuag

SEQ ID NO: 24124 - RNA, 17 nt, Homo sapiens
uugggaggccgaggcgg

SEQ ID NO: 24125 - RNA, 20 nt, Homo sapiens
ccagcccuugccaugagcag

SEQ ID NO: 24126 - RNA, 20 nt, Homo sapiens
ccauccacagaaggccucuc

SEQ ID NO: 24127 - RNA, 22 nt, Homo sapiens
cccaucugauguguuaaccccu

SEQ ID NO: 24128 - RNA, 16 nt, Homo sapiens
cucuugcaggguucug

SEQ ID NO: 24129 - RNA, 22 nt, Homo sapiens
ucuccauccacagaaggccucu

SEQ ID NO: 24130 - RNA, 15 nt, Homo sapiens
ugaaagguucccaga

SEQ ID NO: 24131 - RNA, 20 nt, Homo sapiens
aaguagauuaacauuaagga

SEQ ID NO: 24132 - RNA, 16 nt, Homo sapiens
acgagagacauggaug

SEQ ID NO: 24133 - RNA, 18 nt, Homo sapiens
cuuauacugggugaaaug

SEQ ID NO: 24134 - RNA, 18 nt, Homo sapiens
gcuuauacugggugaaau

SEQ ID NO: 24135 - RNA, 19 nt, Homo sapiens
aaacaguaacucauaaucu

SEQ ID NO: 24136 - RNA, 17 nt, Homo sapiens
uacagaaagacaaaauu

SEQ ID NO: 24137 - RNA, 25 nt, Homo sapiens
uuggagguacagguaugcugugcuu

SEQ ID NO: 24138 - RNA, 20 nt, Homo sapiens
ggaaggggaggagacauugg

SEQ ID NO: 24139 - RNA, 18 nt, Homo sapiens
ggggaaggggaggagaca

SEQ ID NO: 24140 - RNA, 18 nt, Homo sapiens
ucugcgggguacacggcu

SEQ ID NO: 24141 - RNA, 18 nt, Homo sapiens
accaggagauuaaagaag

SEQ ID NO: 24142 - RNA, 18 nt, Homo sapiens
caagucaguagaugcaga

SEQ ID NO: 24143 - RNA, 18 nt, Homo sapiens
gaacguggggauuggucc

SEQ ID NO: 24144 - RNA, 18 nt, Homo sapiens
gcagaaugaaaaaucaag

SEQ ID NO: 24145 - RNA, 16 nt, Homo sapiens
gacuaugugguccccu

SEQ ID NO: 24146 - RNA, 16 nt, Homo sapiens
aacuguugauuuccuu

SEQ ID NO: 24147 - RNA, 19 nt, Homo sapiens
acaacauaguuuaacuuuu

SEQ ID NO: 24148 - RNA, 16 nt, Homo sapiens
caggguuguuuagugu

SEQ ID NO: 24149 - RNA, 17 nt, Homo sapiens
cuggauaaaagagacac

SEQ ID NO: 24150 - RNA, 23 nt, Homo sapiens
ucaaaauauuucuacauaagaua

SEQ ID NO: 24151 - RNA, 23 nt, Homo sapiens
agguggcugggcucagccugagc

SEQ ID NO: 24152 - RNA, 26 nt, Homo sapiens
caggggcagggcgggcacuugcaggu

SEQ ID NO: 24153 - RNA, 16 nt, Homo sapiens
ccagaagccccgcaga

SEQ ID NO: 24154 - RNA, 18 nt, Homo sapiens
ccccacccuccccuaccc

SEQ ID NO: 24155 - RNA, 24 nt, Homo sapiens
cggagcgcggcgcggaggaggcgg

SEQ ID NO: 24156 - RNA, 20 nt, Homo sapiens
gcaggagccacagcgcccga

SEQ ID NO: 24157 - RNA, 19 nt, Homo sapiens
gcgcggaggaggcggcggc

SEQ ID NO: 24158 - RNA, 27 nt, Homo sapiens
gcggagcgcggcgcggaggaggcggcg

SEQ ID NO: 24159 - RNA, 23 nt, Homo sapiens
gggcacuugcagguggcacaggc

SEQ ID NO: 24160 - RNA, 21 nt, Homo sapiens
ggguuggggcaggggcagggc

SEQ ID NO: 24161 - RNA, 21 nt, Homo sapiens
gugacaggaccaagauggggc

SEQ ID NO: 24162 - RNA, 19 nt, Homo sapiens
ugccacaggccagcaugcc

SEQ ID NO: 24163 - RNA, 17 nt, Homo sapiens
ugccccuccucaagcag

SEQ ID NO: 24164 - RNA, 17 nt, Homo sapiens
acaaaauaucaaacugu

SEQ ID NO: 24165 - RNA, 16 nt, Homo sapiens
ccuggcacugccuggg

SEQ ID NO: 24166 - RNA, 23 nt, Homo sapiens
cugggaaccuugacuccuggcac

SEQ ID NO: 24167 - RNA, 19 nt, Homo sapiens
ucugggaaccuugacuccu

SEQ ID NO: 24168 - RNA, 23 nt, Homo sapiens
uguuuuuacaaaauaucaaacug

SEQ ID NO: 24169 - RNA, 18 nt, Homo sapiens
aaugugauagcccaggaa

SEQ ID NO: 24170 - RNA, 20 nt, Homo sapiens
cauaaccaagauaccuuuuc

SEQ ID NO: 24171 - RNA, 18 nt, Homo sapiens
ccgccgcgcgcacgcgug

SEQ ID NO: 24172 - RNA, 17 nt, Homo sapiens
cgggccccgcgcggccu

SEQ ID NO: 24173 - RNA, 17 nt, Homo sapiens
gacugcgcccggcgcug

SEQ ID NO: 24174 - RNA, 19 nt, Homo sapiens
gaggaggggcgggggcugg

SEQ ID NO: 24175 - RNA, 19 nt, Homo sapiens
gcagcgcagcgcgggcgcc

SEQ ID NO: 24176 - RNA, 18 nt, Homo sapiens
gcgcggcggggccucccg

SEQ ID NO: 24177 - RNA, 17 nt, Homo sapiens
ggggcgcggcggggccu

SEQ ID NO: 24178 - RNA, 17 nt, Homo sapiens
uacagggagaagaugaa

SEQ ID NO: 24179 - RNA, 17 nt, Homo sapiens
uccuggggucagcaguu

SEQ ID NO: 24180 - RNA, 19 nt, Homo sapiens
ucucuggcguccgguccag

SEQ ID NO: 24181 - RNA, 18 nt, Homo sapiens
ucugcccucgguucgcca

SEQ ID NO: 24182 - RNA, 20 nt, Homo sapiens
uguauggaccaauacucuac

SEQ ID NO: 24183 - RNA, 18 nt, Homo sapiens
aggagccacagugaggcc

SEQ ID NO: 24184 - RNA, 17 nt, Homo sapiens
gaggaggcagcauccac

SEQ ID NO: 24185 - RNA, 16 nt, Homo sapiens
gcagugucuguugccc

SEQ ID NO: 24186 - RNA, 21 nt, Homo sapiens
ggcucugggggaaaaacggcu

SEQ ID NO: 24187 - RNA, 23 nt, Homo sapiens
uccuagguaagcaggagagcggg

SEQ ID NO: 24188 - RNA, 19 nt, Homo sapiens
uuuccauugcacuuguuac

SEQ ID NO: 24189 - RNA, 21 nt, Homo sapiens
aacagggauugagguggggga

SEQ ID NO: 24190 - RNA, 19 nt, Homo sapiens
agaccaagaggaaggagga

SEQ ID NO: 24191 - RNA, 17 nt, Homo sapiens
ccagaagguauggaagc

SEQ ID NO: 24192 - RNA, 17 nt, Homo sapiens
ccaguccucuccuuccc

SEQ ID NO: 24193 - RNA, 14 nt, Homo sapiens
aaagcaugaaggaa

SEQ ID NO: 24194 - RNA, 17 nt, Homo sapiens
agggguuuguuccccca

SEQ ID NO: 24195 - RNA, 16 nt, Homo sapiens
caguagacaagccagc

SEQ ID NO: 24196 - RNA, 26 nt, Homo sapiens
ccagcgcuugacaguugcgggaggau

SEQ ID NO: 24197 - RNA, 31 nt, Homo sapiens
ccggccggcccauggcgucgcgcgcccccgc

SEQ ID NO: 24198 - RNA, 19 nt, Homo sapiens
cgccggggaaacuuugcag

SEQ ID NO: 24199 - RNA, 24 nt, Homo sapiens
cguccucucccgcccgccggcucc

SEQ ID NO: 24200 - RNA, 19 nt, Homo sapiens
cgucgcgcgcccccgggcc

SEQ ID NO: 24201 - RNA, 28 nt, Homo sapiens
cucccgcccgccggcuccucgcucgcgg

SEQ ID NO: 24202 - RNA, 17 nt, Homo sapiens
gagguugcagugagcca

SEQ ID NO: 24203 - RNA, 21 nt, Homo sapiens
gcccugggcgcguccucuccc

SEQ ID NO: 24204 - RNA, 19 nt, Homo sapiens
gcuggagggagggaacuua

SEQ ID NO: 24205 - RNA, 20 nt, Homo sapiens
ggcggaggcgguggcccggg

SEQ ID NO: 24206 - RNA, 17 nt, Homo sapiens
gggcgcgguggcucgcg

SEQ ID NO: 24207 - RNA, 21 nt, Homo sapiens
ucugggcuuccugaugauccc

SEQ ID NO: 24208 - RNA, 15 nt, Homo sapiens
ugcucuaccuggugu

SEQ ID NO: 24209 - RNA, 18 nt, Homo sapiens
uggcaccagauucccagc

SEQ ID NO: 24210 - RNA, 19 nt, Homo sapiens
uggugggaugugcugugcc

SEQ ID NO: 24211 - RNA, 21 nt, Homo sapiens
ugguguggacacagcagaccu

SEQ ID NO: 24212 - RNA, 17 nt, Homo sapiens
uugggaggccaaggcgg

SEQ ID NO: 24213 - RNA, 22 nt, Homo sapiens
accaaagaacagauguccuucc

SEQ ID NO: 24214 - RNA, 17 nt, Homo sapiens
gcccgccucggccuccc

SEQ ID NO: 24215 - RNA, 20 nt, Homo sapiens
ugcuuguuucguuuugagag

SEQ ID NO: 24216 - RNA, 25 nt, Homo sapiens
uugucugauguacagagcagauuuc

SEQ ID NO: 24217 - RNA, 16 nt, Homo sapiens
accuccucccgggccc

SEQ ID NO: 24218 - RNA, 22 nt, Homo sapiens
aggggcgcggcgcgccgcccgg

SEQ ID NO: 24219 - RNA, 15 nt, Homo sapiens
cccuccucccucccc

SEQ ID NO: 24220 - RNA, 21 nt, Homo sapiens
ccgcccggcuccaggcgcccc

SEQ ID NO: 24221 - RNA, 20 nt, Homo sapiens
ccgcccguggggacgcgucc

SEQ ID NO: 24222 - RNA, 18 nt, Homo sapiens
gccccggcccguccggcc

SEQ ID NO: 24223 - RNA, 24 nt, Homo sapiens
gccccggcccguccggcccguccc

SEQ ID NO: 24224 - RNA, 17 nt, Homo sapiens
gcccggcuccaggcgcc

SEQ ID NO: 24225 - RNA, 16 nt, Homo sapiens
gccggggucggaccgg

SEQ ID NO: 24226 - RNA, 18 nt, Homo sapiens
gcuguccgucugucucgc

SEQ ID NO: 24227 - RNA, 19 nt, Homo sapiens
ggccggagaggcucugcgg

SEQ ID NO: 24228 - RNA, 24 nt, Homo sapiens
ggccgggggcaggagcgcggcgcc

SEQ ID NO: 24229 - RNA, 18 nt, Homo sapiens
ggcgcggcgcgccgcccg

SEQ ID NO: 24230 - RNA, 17 nt, Homo sapiens
ggcguccucuucccuga

SEQ ID NO: 24231 - RNA, 23 nt, Homo sapiens
ggcuccagguccgcccgccgguc

SEQ ID NO: 24232 - RNA, 22 nt, Homo sapiens
ugagaccagagauggggagaga

SEQ ID NO: 24233 - RNA, 20 nt, Homo sapiens
uuuguuuuucuggugugugu

SEQ ID NO: 24234 - RNA, 22 nt, Homo sapiens
ggagaaaauagagaucacugug

SEQ ID NO: 24235 - RNA, 19 nt, Homo sapiens
cacauagcuugguggcucg

SEQ ID NO: 24236 - RNA, 18 nt, Homo sapiens
cagugggcauucuuggca

SEQ ID NO: 24237 - RNA, 17 nt, Homo sapiens
ccuugccgcuuccccag

SEQ ID NO: 24238 - RNA, 19 nt, Homo sapiens
cugaagaagcccaguucug

SEQ ID NO: 24239 - RNA, 15 nt, Homo sapiens
gcagcgguggcagca

SEQ ID NO: 24240 - RNA, 15 nt, Homo sapiens
gcgguggcagcagca

SEQ ID NO: 24241 - RNA, 18 nt, Homo sapiens
gcugugacccaugcagca

SEQ ID NO: 24242 - RNA, 14 nt, Homo sapiens
ucugggcuccugac

SEQ ID NO: 24243 - RNA, 19 nt, Homo sapiens
ucuuccugggcugcucuug

SEQ ID NO: 24244 - RNA, 22 nt, Homo sapiens
ugauuacaagccgacuuuucca

SEQ ID NO: 24245 - RNA, 18 nt, Homo sapiens
agaaggcaggauuuuugg

SEQ ID NO: 24246 - RNA, 14 nt, Homo sapiens
aucucuucccuuac

SEQ ID NO: 24247 - RNA, 19 nt, Homo sapiens
auuucuccuaacacuaagu

SEQ ID NO: 24248 - RNA, 23 nt, Homo sapiens
cacaauauaagugugagcucuug

SEQ ID NO: 24249 - RNA, 19 nt, Homo sapiens
cagccgccgcugcaacucc

SEQ ID NO: 24250 - RNA, 22 nt, Homo sapiens
ccagagcuggggucggggcccc

SEQ ID NO: 24251 - RNA, 19 nt, Homo sapiens
cggcgcugcugcccgccac

SEQ ID NO: 24252 - RNA, 15 nt, Homo sapiens
gccaugaccuuugua

SEQ ID NO: 24253 - RNA, 18 nt, Homo sapiens
gcugcaacuccuucuccu

SEQ ID NO: 24254 - RNA, 18 nt, Homo sapiens
gggccgcggcgcugcugc

SEQ ID NO: 24255 - RNA, 19 nt, Homo sapiens
aguggaagaguggagaaca

SEQ ID NO: 24256 - RNA, 21 nt, Homo sapiens
uacuaucuugcucccauuagu

SEQ ID NO: 24257 - RNA, 22 nt, Homo sapiens
uagggacuggcauuuacuuacu

SEQ ID NO: 24258 - RNA, 21 nt, Homo sapiens
ugaauugaauccuacugaaug

SEQ ID NO: 24259 - RNA, 25 nt, Homo sapiens
ccccaccucucuggcgaccguuugg

SEQ ID NO: 24260 - RNA, 19 nt, Homo sapiens
gagcuguuuauuggucgcg

SEQ ID NO: 24261 - RNA, 18 nt, Homo sapiens
ggaaggggcuggggcugg

SEQ ID NO: 24262 - RNA, 16 nt, Homo sapiens
ggaggaggggguggga

SEQ ID NO: 24263 - RNA, 17 nt, Homo sapiens
ggcagagccaggcuggc

SEQ ID NO: 24264 - RNA, 18 nt, Homo sapiens
ggccuuaggacacagccc

SEQ ID NO: 24265 - RNA, 16 nt, Homo sapiens
gggccgggggcggggg

SEQ ID NO: 24266 - RNA, 24 nt, Homo sapiens
gggcuggggcuggggagugggcug

SEQ ID NO: 24267 - RNA, 17 nt, Homo sapiens
ggggucccggcgagagc

SEQ ID NO: 24268 - RNA, 22 nt, Homo sapiens
caauggaugugucaccgggaaa

SEQ ID NO: 24269 - RNA, 19 nt, Homo sapiens
cagaacugucacagcuuua

SEQ ID NO: 24270 - RNA, 21 nt, Homo sapiens
cuagugauugaagagaugaaa

SEQ ID NO: 24271 - RNA, 20 nt, Homo sapiens
gcuguugauucuuugccucu

SEQ ID NO: 24272 - RNA, 19 nt, Homo sapiens
ucaaagcaggauguuagcc

SEQ ID NO: 24273 - RNA, 22 nt, Homo sapiens
uggcuuagugaaugaggaugug

SEQ ID NO: 24274 - RNA, 17 nt, Homo sapiens
aagagacgacgggagag

SEQ ID NO: 24275 - RNA, 16 nt, Homo sapiens
agagggggcagacacc

SEQ ID NO: 24276 - RNA, 19 nt, Homo sapiens
aggggugacggcugcccug

SEQ ID NO: 24277 - RNA, 18 nt, Homo sapiens
caggagauucagcaacgc

SEQ ID NO: 24278 - RNA, 22 nt, Homo sapiens
ccccaaacuuucauuacaaguc

SEQ ID NO: 24279 - RNA, 19 nt, Homo sapiens
cccgggcggcccugcccgg

SEQ ID NO: 24280 - RNA, 20 nt, Homo sapiens
gaagucuuccuacggguagc

SEQ ID NO: 24281 - RNA, 18 nt, Homo sapiens
ucaagucugcggcccggc

SEQ ID NO: 24282 - RNA, 19 nt, Homo sapiens
uccucugggcccgggcggc

SEQ ID NO: 24283 - RNA, 20 nt, Homo sapiens
uggggagccagcguccgugg

SEQ ID NO: 24284 - RNA, 24 nt, Homo sapiens
cagccccuccggucuggcaggaag

SEQ ID NO: 24285 - RNA, 18 nt, Homo sapiens
ggagagggcaccgagagc

SEQ ID NO: 24286 - RNA, 20 nt, Homo sapiens
ucccccacaacuggggugcc

SEQ ID NO: 24287 - RNA, 20 nt, Homo sapiens
aaaauuuaaguaaaauauuu

SEQ ID NO: 24288 - RNA, 17 nt, Homo sapiens
aguguggugaauuaagu

SEQ ID NO: 24289 - RNA, 19 nt, Homo sapiens
caccuuuaacacuaugaca

SEQ ID NO: 24290 - RNA, 15 nt, Homo sapiens
cccucccuccuuccc

SEQ ID NO: 24291 - RNA, 20 nt, Homo sapiens
ucaugccacgggucagcggc

SEQ ID NO: 24292 - RNA, 17 nt, Homo sapiens
ugcauauaaacucucua

SEQ ID NO: 24293 - RNA, 19 nt, Homo sapiens
ugugaagaaauuacugaaa

SEQ ID NO: 24294 - RNA, 19 nt, Homo sapiens
uuaaguaaaauauuuguuu

SEQ ID NO: 24295 - RNA, 18 nt, Homo sapiens
uucugaaucagaaaaggu

SEQ ID NO: 24296 - RNA, 19 nt, Homo sapiens
caggcacgccagaggccga

SEQ ID NO: 24297 - RNA, 18 nt, Homo sapiens
agagggauuugggaaccc

SEQ ID NO: 24298 - RNA, 19 nt, Homo sapiens
cuucugcacauucuuguga

SEQ ID NO: 24299 - RNA, 24 nt, Homo sapiens
gagcuaaauugccauagguacauu

SEQ ID NO: 24300 - RNA, 17 nt, Homo sapiens
uagcggaccuacuaaaa

SEQ ID NO: 24301 - RNA, 17 nt, Homo sapiens
uugggaggcugaggcgg

SEQ ID NO: 24302 - RNA, 19 nt, Homo sapiens
acacaaggcuuggauucaa

SEQ ID NO: 24303 - RNA, 18 nt, Homo sapiens
agagagacugaaagucau

SEQ ID NO: 24304 - RNA, 18 nt, Homo sapiens
cacauaggggcagacaca

SEQ ID NO: 24305 - RNA, 20 nt, Homo sapiens
cacguggcucugcagcacuc

SEQ ID NO: 24306 - RNA, 18 nt, Homo sapiens
ccaguucaucugucucca

SEQ ID NO: 24307 - RNA, 21 nt, Homo sapiens
ccugccgagcucuggagcccu

SEQ ID NO: 24308 - RNA, 21 nt, Homo sapiens
ccugggcugaggccugggccc

SEQ ID NO: 24309 - RNA, 18 nt, Homo sapiens
cucgggcuauguggggcc

SEQ ID NO: 24310 - RNA, 20 nt, Homo sapiens
gaagauuuguugaucugaca

SEQ ID NO: 24311 - RNA, 22 nt, Homo sapiens
gcagcccgggaagggggucacc

SEQ ID NO: 24312 - RNA, 20 nt, Homo sapiens
gccggggcaggacucaccgc

SEQ ID NO: 24313 - RNA, 19 nt, Homo sapiens
gcuccaauucucucuuccg

SEQ ID NO: 24314 - RNA, 21 nt, Homo sapiens
gcuggagccgccguggcccac

SEQ ID NO: 24315 - RNA, 22 nt, Homo sapiens
guggcauuuucacuuucucgca

SEQ ID NO: 24316 - RNA, 18 nt, Homo sapiens
guggggcugggcagggac

SEQ ID NO: 24317 - RNA, 24 nt, Homo sapiens
ucacauaggggcagacacaaggcu

SEQ ID NO: 24318 - RNA, 16 nt, Homo sapiens
ucuuccgguccuaagc

SEQ ID NO: 24319 - RNA, 20 nt, Homo sapiens
ugccugggagagaggagaga

SEQ ID NO: 24320 - RNA, 16 nt, Homo sapiens
uggagaaguggggcug

SEQ ID NO: 24321 - RNA, 20 nt, Homo sapiens
ugggugaggcuuuuuaccug

SEQ ID NO: 24322 - RNA, 19 nt, Homo sapiens
ugugaugugauagcugaga

SEQ ID NO: 24323 - RNA, 22 nt, Homo sapiens
gcgcgcgggcuuuggucggucc

SEQ ID NO: 24324 - RNA, 18 nt, Homo sapiens
uugugccaagguggccau

SEQ ID NO: 24325 - RNA, 21 nt, Homo sapiens
aagaggucuucucuccauugc

SEQ ID NO: 24326 - RNA, 19 nt, Homo sapiens
aucugcaugcacauuucug

SEQ ID NO: 24327 - RNA, 20 nt, Homo sapiens
cacgcgacuucugcguggcu

SEQ ID NO: 24328 - RNA, 28 nt, Homo sapiens
uagcugcuguucacugcuggcggguccg

SEQ ID NO: 24329 - RNA, 19 nt, Homo sapiens
aaguagaagggggagggga

SEQ ID NO: 24330 - RNA, 20 nt, Homo sapiens
ccauuggcugugcgcggaga

SEQ ID NO: 24331 - RNA, 22 nt, Homo sapiens
cccuggccccaccggggggccc

SEQ ID NO: 24332 - RNA, 21 nt, Homo sapiens
ccucucuggcuucugcuuccc

SEQ ID NO: 24333 - RNA, 17 nt, Homo sapiens
cuccuggcugcgcggag

SEQ ID NO: 24334 - RNA, 17 nt, Homo sapiens
cucgcugcgcucggcuc

SEQ ID NO: 24335 - RNA, 19 nt, Homo sapiens
cugugacccucugucuggu

SEQ ID NO: 24336 - RNA, 21 nt, Homo sapiens
cuguugugugugguguagugu

SEQ ID NO: 24337 - RNA, 19 nt, Homo sapiens
gagggagagagggggcgcc

SEQ ID NO: 24338 - RNA, 19 nt, Homo sapiens
gccagaagccgaggacaga

SEQ ID NO: 24339 - RNA, 19 nt, Homo sapiens
gcucgcucgcuguugacuc

SEQ ID NO: 24340 - RNA, 19 nt, Homo sapiens
gcuuccccgcuccggcugc

SEQ ID NO: 24341 - RNA, 21 nt, Homo sapiens
ggccaggaggguggggaggag

SEQ ID NO: 24342 - RNA, 24 nt, Homo sapiens
ggcuuuugaggcuuuuauuuauuu

SEQ ID NO: 24343 - RNA, 19 nt, Homo sapiens
ggggaggggagggagagag

SEQ ID NO: 24344 - RNA, 17 nt, Homo sapiens
ggggagggggagaggaa

SEQ ID NO: 24345 - RNA, 19 nt, Homo sapiens
gggggcccgggcggcggcg

SEQ ID NO: 24346 - RNA, 21 nt, Homo sapiens
ucaagaaguaaaauccuacag

SEQ ID NO: 24347 - RNA, 20 nt, Homo sapiens
ucucccauagaugcccaugu

SEQ ID NO: 24348 - RNA, 17 nt, Homo sapiens
ugcccuucuuuaaaaca

SEQ ID NO: 24349 - RNA, 18 nt, Homo sapiens
ugugacccucugucuggu

SEQ ID NO: 24350 - RNA, 17 nt, Homo sapiens
uguggcucuggggugac

SEQ ID NO: 24351 - RNA, 22 nt, Homo sapiens
uucccggccuguuggagcccuc

SEQ ID NO: 24352 - RNA, 21 nt, Homo sapiens
uugacucugggacaucaauca

SEQ ID NO: 24353 - RNA, 21 nt, Homo sapiens
uuggggucugcugccagggug

SEQ ID NO: 24354 - RNA, 17 nt, Homo sapiens
gagcaagugcugagggu

SEQ ID NO: 24355 - RNA, 20 nt, Homo sapiens
ggaggagggguggccugagc

SEQ ID NO: 24356 - RNA, 16 nt, Homo sapiens
uaggaggagggguggc

SEQ ID NO: 24357 - RNA, 19 nt, Homo sapiens
aaagaaccauccugaauaa

SEQ ID NO: 24358 - RNA, 18 nt, Homo sapiens
aacuccuuccauuuguca

SEQ ID NO: 24359 - RNA, 19 nt, Homo sapiens
accuauguuuacuaacaau

SEQ ID NO: 24360 - RNA, 17 nt, Homo sapiens
gguuuaaagaaccaucc

SEQ ID NO: 24361 - RNA, 20 nt, Homo sapiens
aggggcuggguggagguggg

SEQ ID NO: 24362 - RNA, 21 nt, Homo sapiens
gccacccagcucuaucugggg

SEQ ID NO: 24363 - RNA, 21 nt, Homo sapiens
gccaggggcuggguggaggug

SEQ ID NO: 24364 - RNA, 18 nt, Homo sapiens
ggcaccagcccacaagcc

SEQ ID NO: 24365 - RNA, 20 nt, Homo sapiens
ggcccgcgccgcucucucgc

SEQ ID NO: 24366 - RNA, 19 nt, Homo sapiens
ggcuggggcguggcccggg

SEQ ID NO: 24367 - RNA, 16 nt, Homo sapiens
gggcaguucugggccc

SEQ ID NO: 24368 - RNA, 16 nt, Homo sapiens
guggaggugggugggg

SEQ ID NO: 24369 - RNA, 19 nt, Homo sapiens
ucucucgcucgcucgcucc

SEQ ID NO: 24370 - RNA, 21 nt, Homo sapiens
ucugggcccacccagccacug

SEQ ID NO: 24371 - RNA, 20 nt, Homo sapiens
uguggggcaccagcccacaa

SEQ ID NO: 24372 - RNA, 20 nt, Homo sapiens
ccaaaggaggccaugaguug

SEQ ID NO: 24373 - RNA, 19 nt, Homo sapiens
ccagugaaaaugaaguacu

SEQ ID NO: 24374 - RNA, 16 nt, Homo sapiens
cuuauacugguacugc

SEQ ID NO: 24375 - RNA, 22 nt, Homo sapiens
gugcccauuuaguuugucugga

SEQ ID NO: 24376 - RNA, 18 nt, Homo sapiens
uacauuugugucuuugua

SEQ ID NO: 24377 - RNA, 19 nt, Homo sapiens
ggcaugguucucuucucug

SEQ ID NO: 24378 - RNA, 19 nt, Homo sapiens
aagaaaaaaaaaaaaaagc

SEQ ID NO: 24379 - RNA, 17 nt, Homo sapiens
cccccgccccccucccc

SEQ ID NO: 24380 - RNA, 18 nt, Homo sapiens
cccgccccccuccccuuu

SEQ ID NO: 24381 - RNA, 21 nt, Homo sapiens
cccgcuccgggaaccgcggcc

SEQ ID NO: 24382 - RNA, 21 nt, Homo sapiens
ccgcccgcgcccccgcccccg

SEQ ID NO: 24383 - RNA, 20 nt, Homo sapiens
ccgcgcccccgcccccgccc

SEQ ID NO: 24384 - RNA, 24 nt, Homo sapiens
ccuuuuagaggcagcaaaagggaa

SEQ ID NO: 24385 - RNA, 17 nt, Homo sapiens
gccucuucccgagcggc

SEQ ID NO: 24386 - RNA, 22 nt, Homo sapiens
gccucuucccgagcggcagcgg

SEQ ID NO: 24387 - RNA, 21 nt, Homo sapiens
gcucggccgcccgcgcccccg

SEQ ID NO: 24388 - RNA, 24 nt, Homo sapiens
uaaauuacuaggaguauauuuaca

SEQ ID NO: 24389 - RNA, 18 nt, Homo sapiens
ucggccgcccgcgccccc

SEQ ID NO: 24390 - RNA, 19 nt, Homo sapiens
cagcacaaucaaaucagua

SEQ ID NO: 24391 - RNA, 19 nt, Homo sapiens
uacacaagacuuuaaagca

SEQ ID NO: 24392 - RNA, 19 nt, Homo sapiens
uacuuuauguaucuauugu

SEQ ID NO: 24393 - RNA, 18 nt, Homo sapiens
uugaaacuaaagagaaau

SEQ ID NO: 24394 - RNA, 18 nt, Homo sapiens
acacgguuuauuuugucc

SEQ ID NO: 24395 - RNA, 18 nt, Homo sapiens
aguaauuuccugacccag

SEQ ID NO: 24396 - RNA, 15 nt, Homo sapiens
gcccgcgcccccccg

SEQ ID NO: 24397 - RNA, 19 nt, Homo sapiens
uaaaccuuuguuacugaau

SEQ ID NO: 24398 - RNA, 17 nt, Homo sapiens
uaauaugcuaaugaagu

SEQ ID NO: 24399 - RNA, 18 nt, Homo sapiens
uacugaauuguuauaugg

SEQ ID NO: 24400 - RNA, 18 nt, Homo sapiens
caacagcuguggucucaa

SEQ ID NO: 24401 - RNA, 18 nt, Homo sapiens
ugugucaacucaucuugg

SEQ ID NO: 24402 - RNA, 16 nt, Homo sapiens
agagugcguauucggu

SEQ ID NO: 24403 - RNA, 17 nt, Homo sapiens
aggccauguguguuuuu

SEQ ID NO: 24404 - RNA, 16 nt, Homo sapiens
cgcggggcggacuccg

SEQ ID NO: 24405 - RNA, 18 nt, Homo sapiens
gcgcagagucagugccgc

SEQ ID NO: 24406 - RNA, 17 nt, Homo sapiens
gucgucgaagagcgagc

SEQ ID NO: 24407 - RNA, 23 nt, Homo sapiens
uacacagaagaacggcaugggag

SEQ ID NO: 24408 - RNA, 21 nt, Homo sapiens
uauauauauuuauauauauau

SEQ ID NO: 24409 - RNA, 22 nt, Homo sapiens
uauauauauuuauauauauaua

SEQ ID NO: 24410 - RNA, 20 nt, Homo sapiens
uauauuuauauauauauaaa

SEQ ID NO: 24411 - RNA, 24 nt, Homo sapiens
uauauuuauauauauuuauauaua

SEQ ID NO: 24412 - RNA, 24 nt, Homo sapiens
uauuuauauauauuuauauauaua

SEQ ID NO: 24413 - RNA, 15 nt, Homo sapiens
uguggggcugcuccg

SEQ ID NO: 24414 - RNA, 22 nt, Homo sapiens
cagcagaugaaauguaucuuga

SEQ ID NO: 24415 - RNA, 18 nt, Homo sapiens
ccgcccgcgggcgcgucc

SEQ ID NO: 24416 - RNA, 22 nt, Homo sapiens
cuccuccuccuccuccucggag

SEQ ID NO: 24417 - RNA, 19 nt, Homo sapiens
cucgggagggcgcugccgc

SEQ ID NO: 24418 - RNA, 22 nt, Homo sapiens
cugccgccgcccgcgggcgcgu

SEQ ID NO: 24419 - RNA, 19 nt, Homo sapiens
gaaauccacgccgcccccc

SEQ ID NO: 24420 - RNA, 22 nt, Homo sapiens
gacacgguggugggcacaucag

SEQ ID NO: 24421 - RNA, 21 nt, Homo sapiens
gagaaccaucuauggcacuau

SEQ ID NO: 24422 - RNA, 19 nt, Homo sapiens
gcagacucauuauucuggu

SEQ ID NO: 24423 - RNA, 15 nt, Homo sapiens
gcagcugaaggagga

SEQ ID NO: 24424 - RNA, 16 nt, Homo sapiens
gcagcugaaggaggac

SEQ ID NO: 24425 - RNA, 24 nt, Homo sapiens
gggaggaggggaggggacaagggc

SEQ ID NO: 24426 - RNA, 16 nt, Homo sapiens
gggucccugcggugcc

SEQ ID NO: 24427 - RNA, 20 nt, Homo sapiens
gucacagugcauuuuuuuuu

SEQ ID NO: 24428 - RNA, 21 nt, Homo sapiens
uccuuaagguugaagaugaag

SEQ ID NO: 24429 - RNA, 18 nt, Homo sapiens
ucgccuccucccaccccc

SEQ ID NO: 24430 - RNA, 17 nt, Homo sapiens
ucugcugugauguccag

SEQ ID NO: 24431 - RNA, 18 nt, Homo sapiens
auccuccucucccauucc

SEQ ID NO: 24432 - RNA, 18 nt, Homo sapiens
cauugguaggggcaaggg

SEQ ID NO: 24433 - RNA, 25 nt, Homo sapiens
ccucaggaguugccaaccccagacc

SEQ ID NO: 24434 - RNA, 16 nt, Homo sapiens
gagcaggucuagaagu

SEQ ID NO: 24435 - RNA, 20 nt, Homo sapiens
gcagaggagcagacaacaga

SEQ ID NO: 24436 - RNA, 15 nt, Homo sapiens
gccauaccagccacu

SEQ ID NO: 24437 - RNA, 21 nt, Homo sapiens
uccaccacugaggcuucuccc

SEQ ID NO: 24438 - RNA, 21 nt, Homo sapiens
ugcuucagaccaccucccagc

SEQ ID NO: 24439 - RNA, 27 nt, Homo sapiens
aagaauguacacauguacaguugagga

SEQ ID NO: 24440 - RNA, 17 nt, Homo sapiens
caaauaaaaagucccug

SEQ ID NO: 24441 - RNA, 15 nt, Homo sapiens
caacacaaugcugcc

SEQ ID NO: 24442 - RNA, 18 nt, Homo sapiens
cggcaggaagcuguggcu

SEQ ID NO: 24443 - RNA, 17 nt, Homo sapiens
gaaagcugucagguuga

SEQ ID NO: 24444 - RNA, 20 nt, Homo sapiens
uccagcuguggcuugacugc

SEQ ID NO: 24445 - RNA, 20 nt, Homo sapiens
uccaucacuuugggcagaug

SEQ ID NO: 24446 - RNA, 19 nt, Homo sapiens
ucuccuagcucaguacaua

SEQ ID NO: 24447 - RNA, 20 nt, Homo sapiens
ucuuggcuuuuuaaagccuc

SEQ ID NO: 24448 - RNA, 19 nt, Homo sapiens
ugccacaggccaggcugcc

SEQ ID NO: 24449 - RNA, 24 nt, Homo sapiens
ugggaauaauaauauuaccucaug

SEQ ID NO: 24450 - RNA, 19 nt, Homo sapiens
uggucaggaugcugcuucc

SEQ ID NO: 24451 - RNA, 21 nt, Homo sapiens
uuaaagggucauuaacugaau

SEQ ID NO: 24452 - RNA, 22 nt, Homo sapiens
uuucuagacugaauguuccaga

SEQ ID NO: 24453 - RNA, 18 nt, Homo sapiens
caggauccaggcgucgcc

SEQ ID NO: 24454 - RNA, 21 nt, Homo sapiens
ccacccccgccuuuccgccca

SEQ ID NO: 24455 - RNA, 21 nt, Homo sapiens
ccaggcaggugagcgagcagc

SEQ ID NO: 24456 - RNA, 18 nt, Homo sapiens
cccgcucgcgccccuccc

SEQ ID NO: 24457 - RNA, 18 nt, Homo sapiens
ccgcucgcgccccucccg

SEQ ID NO: 24458 - RNA, 19 nt, Homo sapiens
ccggcucgggcuccggggc

SEQ ID NO: 24459 - RNA, 22 nt, Homo sapiens
cggggcgagccauccccggcuc

SEQ ID NO: 24460 - RNA, 23 nt, Homo sapiens
gcaggauccaggcgucgccgcag

SEQ ID NO: 24461 - RNA, 19 nt, Homo sapiens
gcucccagguuccacgucc

SEQ ID NO: 24462 - RNA, 18 nt, Homo sapiens
ggagaggggcggggaggg

SEQ ID NO: 24463 - RNA, 22 nt, Homo sapiens
ggccgggcuggcuggggcuggg

SEQ ID NO: 24464 - RNA, 19 nt, Homo sapiens
gggaaagggcgggcggccg

SEQ ID NO: 24465 - RNA, 17 nt, Homo sapiens
ucgccgcagcgcccggg

SEQ ID NO: 24466 - RNA, 19 nt, Homo sapiens
ucgggcuccggggcccggc

SEQ ID NO: 24467 - RNA, 16 nt, Homo sapiens
ugaggggagacggggc

SEQ ID NO: 24468 - RNA, 18 nt, Homo sapiens
guaggggugggacagggg

SEQ ID NO: 24469 - RNA, 18 nt, Homo sapiens
acacaugggaagggagcc

SEQ ID NO: 24470 - RNA, 17 nt, Homo sapiens
ccccuuggccgccgagc

SEQ ID NO: 24471 - RNA, 18 nt, Homo sapiens
ccuggagcgccgccgggc

SEQ ID NO: 24472 - RNA, 21 nt, Homo sapiens
gccucccugccgcccuggcug

SEQ ID NO: 24473 - RNA, 20 nt, Homo sapiens
ggccacacucggcaguccca

SEQ ID NO: 24474 - RNA, 21 nt, Homo sapiens
gggccgcgcucucucgcgcug

SEQ ID NO: 24475 - RNA, 14 nt, Homo sapiens
ugccccaggucucc

SEQ ID NO: 24476 - RNA, 19 nt, Homo sapiens
gggccugaggacuguggga

SEQ ID NO: 24477 - RNA, 19 nt, Homo sapiens
ucugcagccagagaggggc

SEQ ID NO: 24478 - RNA, 23 nt, Homo sapiens
agcucaguggaacagguauugau

SEQ ID NO: 24479 - RNA, 19 nt, Homo sapiens
aguggaacagguauugaug

SEQ ID NO: 24480 - RNA, 14 nt, Homo sapiens
ugagaagaaaagua

SEQ ID NO: 24481 - RNA, 20 nt, Homo sapiens
agcuggcugagucuugcaaa

SEQ ID NO: 24482 - RNA, 19 nt, Homo sapiens
caccugagaguaaaugagu

SEQ ID NO: 24483 - RNA, 18 nt, Homo sapiens
cccccgcgcgccccggcc

SEQ ID NO: 24484 - RNA, 21 nt, Homo sapiens
ccgcccgcgccccgccggccg

SEQ ID NO: 24485 - RNA, 20 nt, Homo sapiens
ccgccggccgccgccucacc

SEQ ID NO: 24486 - RNA, 21 nt, Homo sapiens
ccgcguggccgcccgcgcccc

SEQ ID NO: 24487 - RNA, 18 nt, Homo sapiens
ccgugcccugacugugga

SEQ ID NO: 24488 - RNA, 16 nt, Homo sapiens
ccuggcaugagggagg

SEQ ID NO: 24489 - RNA, 19 nt, Homo sapiens
cuugguugguucuagauuc

SEQ ID NO: 24490 - RNA, 19 nt, Homo sapiens
gaguggcaagccaccaccu

SEQ ID NO: 24491 - RNA, 24 nt, Homo sapiens
gggaagggaggggagaaccaagca

SEQ ID NO: 24492 - RNA, 17 nt, Homo sapiens
uaggccuggcccuguau

SEQ ID NO: 24493 - RNA, 22 nt, Homo sapiens
ucuaaggucucaucagucucuu

SEQ ID NO: 24494 - RNA, 19 nt, Homo sapiens
uggggaaggaggguaggcc

SEQ ID NO: 24495 - RNA, 14 nt, Homo sapiens
ugugcugugaccug

SEQ ID NO: 24496 - RNA, 18 nt, Homo sapiens
aggcagcugcaggggccu

SEQ ID NO: 24497 - RNA, 16 nt, Homo sapiens
ccccgagcuccaggga

SEQ ID NO: 24498 - RNA, 16 nt, Homo sapiens
cgggccgcguccccga

SEQ ID NO: 24499 - RNA, 18 nt, Homo sapiens
gcggcgggagcccggcgg

SEQ ID NO: 24500 - RNA, 21 nt, Homo sapiens
ggacagcgcgcgcggcgggag

SEQ ID NO: 24501 - RNA, 20 nt, Homo sapiens
ucucucacaauuaaaaaugg

SEQ ID NO: 24502 - RNA, 19 nt, Homo sapiens
ugugaggcagcugcagggg

SEQ ID NO: 24503 - RNA, 21 nt, Homo sapiens
agugcgcgcgagacggcgcug

SEQ ID NO: 24504 - RNA, 21 nt, Homo sapiens
caaggacgugccgccacugga

SEQ ID NO: 24505 - RNA, 23 nt, Homo sapiens
cggagagcggggucgcgugcgcg

SEQ ID NO: 24506 - RNA, 17 nt, Homo sapiens
cggcauuccaccccucg

SEQ ID NO: 24507 - RNA, 16 nt, Homo sapiens
gcgcgcgagacggcgc

SEQ ID NO: 24508 - RNA, 19 nt, Homo sapiens
gcgcuggcguuagagacag

SEQ ID NO: 24509 - RNA, 16 nt, Homo sapiens
ucccguguacaauccc

SEQ ID NO: 24510 - RNA, 18 nt, Homo sapiens
ucgcgugcgcguuugggc

SEQ ID NO: 24511 - RNA, 22 nt, Homo sapiens
ugagaaacguuugcagaaagug

SEQ ID NO: 24512 - RNA, 19 nt, Homo sapiens
ugcgcagugcgcgcgagac

SEQ ID NO: 24513 - RNA, 17 nt, Homo sapiens
uggaugaagcagauuug

SEQ ID NO: 24514 - RNA, 18 nt, Homo sapiens
aaguaacagcugaccugg

SEQ ID NO: 24515 - RNA, 21 nt, Homo sapiens
agaaaaagaguaaaacacuuu

SEQ ID NO: 24516 - RNA, 21 nt, Homo sapiens
uagaaaagaugcaacaagaaa

SEQ ID NO: 24517 - RNA, 17 nt, Homo sapiens
ucauuugugcguugggu

SEQ ID NO: 24518 - RNA, 18 nt, Homo sapiens
uggcuugauuuauuaacc

SEQ ID NO: 24519 - RNA, 16 nt, Homo sapiens
aguucaguccuaagug

SEQ ID NO: 24520 - RNA, 20 nt, Homo sapiens
uaauguacacuacugauaua

SEQ ID NO: 24521 - RNA, 21 nt, Homo sapiens
uuuauuggggguuuuaguugg

SEQ ID NO: 24522 - RNA, 15 nt, Homo sapiens
agaggacacacacuc

SEQ ID NO: 24523 - RNA, 19 nt, Homo sapiens
cgggcuggagcgcgccgcc

SEQ ID NO: 24524 - RNA, 19 nt, Homo sapiens
cggggccccgggcuggagc

SEQ ID NO: 24525 - RNA, 19 nt, Homo sapiens
gagaacggcggcgggaacg

SEQ ID NO: 24526 - RNA, 18 nt, Homo sapiens
gaguccggggccccgggc

SEQ ID NO: 24527 - RNA, 18 nt, Homo sapiens
aggaaguugcauuaagau

SEQ ID NO: 24528 - RNA, 18 nt, Homo sapiens
uaaguuuacuaacaagug

SEQ ID NO: 24529 - RNA, 18 nt, Homo sapiens
uugucuuugcuuuaaggu

SEQ ID NO: 24530 - RNA, 18 nt, Homo sapiens
gagugcgccggccggcug

SEQ ID NO: 24531 - RNA, 17 nt, Homo sapiens
ucccggaaagggcgcgg

SEQ ID NO: 24532 - RNA, 19 nt, Homo sapiens
cccuccaccucccuccccc

SEQ ID NO: 24533 - RNA, 19 nt, Homo sapiens
uccccuccucauaagaacu

SEQ ID NO: 24534 - RNA, 20 nt, Homo sapiens
ugcaacaaaguguauggaca

SEQ ID NO: 24535 - RNA, 26 nt, Homo sapiens
agggaggcggggugccgggcggcggg

SEQ ID NO: 24536 - RNA, 19 nt, Homo sapiens
caauucugcucaaggcccg

SEQ ID NO: 24537 - RNA, 22 nt, Homo sapiens
ccgcccggccgcccggagcccc

SEQ ID NO: 24538 - RNA, 20 nt, Homo sapiens
ccuguuccuucucgggaggc

SEQ ID NO: 24539 - RNA, 21 nt, Homo sapiens
cgccgccgcuccugccuccgc

SEQ ID NO: 24540 - RNA, 20 nt, Homo sapiens
cgccggcuccgcgccgcccg

SEQ ID NO: 24541 - RNA, 24 nt, Homo sapiens
cugugccaucuccccucucugcca

SEQ ID NO: 24542 - RNA, 18 nt, Homo sapiens
gccgggcggcgggggcgc

SEQ ID NO: 24543 - RNA, 20 nt, Homo sapiens
gcgcggggcuggccggcugc

SEQ ID NO: 24544 - RNA, 19 nt, Homo sapiens
gcggggaggggaccgugcg

SEQ ID NO: 24545 - RNA, 18 nt, Homo sapiens
ggccccgggucgcggcgc

SEQ ID NO: 24546 - RNA, 19 nt, Homo sapiens
gggaggcggggugccgggc

SEQ ID NO: 24547 - RNA, 23 nt, Homo sapiens
gggggcggcggccuaggggcggg

SEQ ID NO: 24548 - RNA, 17 nt, Homo sapiens
uacacaacaacucucua

SEQ ID NO: 24549 - RNA, 19 nt, Homo sapiens
ucaagggcugguccuucug

SEQ ID NO: 24550 - RNA, 19 nt, Homo sapiens
ucugucauuuuuauuaagc

SEQ ID NO: 24551 - RNA, 17 nt, Homo sapiens
ucuguccuucccuugug

SEQ ID NO: 24552 - RNA, 16 nt, Homo sapiens
ugccauggagacggcg

SEQ ID NO: 24553 - RNA, 18 nt, Homo sapiens
ugccugugccaucucccc

SEQ ID NO: 24554 - RNA, 20 nt, Homo sapiens
uuacuauggaugggcugugg

SEQ ID NO: 24555 - RNA, 20 nt, Homo sapiens
uuguauagaaacaaucugug

SEQ ID NO: 24556 - RNA, 18 nt, Homo sapiens
aacuccaaagagugcaaa

SEQ ID NO: 24557 - RNA, 20 nt, Homo sapiens
caaaaugaggugcgguugug

SEQ ID NO: 24558 - RNA, 22 nt, Homo sapiens
uggcugacaaaccagcggccug

SEQ ID NO: 24559 - RNA, 16 nt, Homo sapiens
uuuguccccaucugug

SEQ ID NO: 24560 - RNA, 16 nt, Homo sapiens
ucugaugagcguccag

SEQ ID NO: 24561 - RNA, 18 nt, Homo sapiens
aagggagggcugggcagg

SEQ ID NO: 24562 - RNA, 23 nt, Homo sapiens
cggagccuugucccaggcugggc

SEQ ID NO: 24563 - RNA, 17 nt, Homo sapiens
gcggggugagggggggg

SEQ ID NO: 24564 - RNA, 18 nt, Homo sapiens
gggaaggcgggggcgggc

SEQ ID NO: 24565 - RNA, 16 nt, Homo sapiens
ugucccaggcugggcc

SEQ ID NO: 24566 - RNA, 22 nt, Homo sapiens
agacuccggggccggcaguccc

SEQ ID NO: 24567 - RNA, 17 nt, Homo sapiens
cccugcccagucccucc

SEQ ID NO: 24568 - RNA, 21 nt, Homo sapiens
gggccggcagucccugcccag

SEQ ID NO: 24569 - RNA, 15 nt, Homo sapiens
ggggguggguagugg

SEQ ID NO: 24570 - RNA, 19 nt, Homo sapiens
uaguggggguggguagugg

SEQ ID NO: 24571 - RNA, 19 nt, Homo sapiens
ugcuguagugggggugggu

SEQ ID NO: 24572 - RNA, 21 nt, Homo sapiens
uugcuuucucuggaaaccuuc

SEQ ID NO: 24573 - RNA, 16 nt, Homo sapiens
aggccacuuccagagg

SEQ ID NO: 24574 - RNA, 18 nt, Homo sapiens
auguugcuuugccgaccu

SEQ ID NO: 24575 - RNA, 17 nt, Homo sapiens
cacauggaccccgacgu

SEQ ID NO: 24576 - RNA, 18 nt, Homo sapiens
cccggcggcccgguuucc

SEQ ID NO: 24577 - RNA, 18 nt, Homo sapiens
ccgccuucuccccgcccc

SEQ ID NO: 24578 - RNA, 19 nt, Homo sapiens
ccuugacggcccugggccg

SEQ ID NO: 24579 - RNA, 16 nt, Homo sapiens
ggccaggauagccgag

SEQ ID NO: 24580 - RNA, 17 nt, Homo sapiens
ggggcccaccucugccu

SEQ ID NO: 24581 - RNA, 17 nt, Homo sapiens
ugcccuggcucuguccc

SEQ ID NO: 24582 - RNA, 19 nt, Homo sapiens
uggugagugcccuggcucu

SEQ ID NO: 24583 - RNA, 18 nt, Homo sapiens
agaaacgggccgcaacac

SEQ ID NO: 24584 - RNA, 19 nt, Homo sapiens
agauuguuugcacugcgga

SEQ ID NO: 24585 - RNA, 22 nt, Homo sapiens
caggauugcuauaauccuuuga

SEQ ID NO: 24586 - RNA, 19 nt, Homo sapiens
ccuccccccucugcuuguc

SEQ ID NO: 24587 - RNA, 19 nt, Homo sapiens
cggcugcuagagcuggagc

SEQ ID NO: 24588 - RNA, 17 nt, Homo sapiens
gaguguguguccggggu

SEQ ID NO: 24589 - RNA, 20 nt, Homo sapiens
uacggaguguuacgguguac

SEQ ID NO: 24590 - RNA, 23 nt, Homo sapiens
ucccuuccuuuuaucuuugagcc

SEQ ID NO: 24591 - RNA, 18 nt, Homo sapiens
ucuccauccgcuuccccu

SEQ ID NO: 24592 - RNA, 18 nt, Homo sapiens
ugcggcugcuagagcugg

SEQ ID NO: 24593 - RNA, 26 nt, Homo sapiens
auaauauauauuuccauauaauauau

SEQ ID NO: 24594 - RNA, 19 nt, Homo sapiens
cccgccccucccgccgggg

SEQ ID NO: 24595 - RNA, 19 nt, Homo sapiens
ccucccacccgccccuccc

SEQ ID NO: 24596 - RNA, 15 nt, Homo sapiens
cgcggccucccaccc

SEQ ID NO: 24597 - RNA, 17 nt, Homo sapiens
cggcggcucuuucucuc

SEQ ID NO: 24598 - RNA, 18 nt, Homo sapiens
gagccuucaaaaguugug

SEQ ID NO: 24599 - RNA, 21 nt, Homo sapiens
gagugacugguauuagcuuuu

SEQ ID NO: 24600 - RNA, 17 nt, Homo sapiens
gccgaggucgccccccc

SEQ ID NO: 24601 - RNA, 21 nt, Homo sapiens
gccgcggccucccacccgccc

SEQ ID NO: 24602 - RNA, 21 nt, Homo sapiens
ggccggcagguggcgguggcc

SEQ ID NO: 24603 - RNA, 18 nt, Homo sapiens
gguggcgguggccgcggc

SEQ ID NO: 24604 - RNA, 14 nt, Homo sapiens
ggugggggggaggc

SEQ ID NO: 24605 - RNA, 24 nt, Homo sapiens
uauaauauauauuuccauauaaua

SEQ ID NO: 24606 - RNA, 19 nt, Homo sapiens
uccgccgcggaccgccgug

SEQ ID NO: 24607 - RNA, 17 nt, Homo sapiens
ucucucggcucagcucc

SEQ ID NO: 24608 - RNA, 15 nt, Homo sapiens
ugauaucuggggggu

SEQ ID NO: 24609 - RNA, 18 nt, Homo sapiens
uguccauauacacacauu

SEQ ID NO: 24610 - RNA, 19 nt, Homo sapiens
caagccuugugugacaguc

SEQ ID NO: 24611 - RNA, 17 nt, Homo sapiens
caccccagcccugcccc

SEQ ID NO: 24612 - RNA, 16 nt, Homo sapiens
ccccagcccuggcugc

SEQ ID NO: 24613 - RNA, 19 nt, Homo sapiens
cccccucccgccccacccc

SEQ ID NO: 24614 - RNA, 20 nt, Homo sapiens
ccccggacucgugcgagccg

SEQ ID NO: 24615 - RNA, 19 nt, Homo sapiens
cccuucccuuccuuucccc

SEQ ID NO: 24616 - RNA, 19 nt, Homo sapiens
ccuucccuuccuuuccccu

SEQ ID NO: 24617 - RNA, 21 nt, Homo sapiens
cggggcccgccaugcgcgccu

SEQ ID NO: 24618 - RNA, 18 nt, Homo sapiens
gcgccugcuccgggcgcc

SEQ ID NO: 24619 - RNA, 19 nt, Homo sapiens
ggcaggcaccaggagcagg

SEQ ID NO: 24620 - RNA, 18 nt, Homo sapiens
ggguaggagaggaccagg

SEQ ID NO: 24621 - RNA, 18 nt, Homo sapiens
ugucagguccucagcaau

SEQ ID NO: 24622 - RNA, 23 nt, Homo sapiens
auauauauauguauguacauaua

SEQ ID NO: 24623 - RNA, 18 nt, Homo sapiens
aucaauucauaagggugu

SEQ ID NO: 24624 - RNA, 29 nt, Homo sapiens
uacauauauauguaaagggauauauauau

SEQ ID NO: 24625 - RNA, 25 nt, Homo sapiens
uacgagaaucacuugaaccuggagg

SEQ ID NO: 24626 - RNA, 22 nt, Homo sapiens
uauauauauguauguacauaua

SEQ ID NO: 24627 - RNA, 22 nt, Homo sapiens
aaaaugguagcuuuauuuuaau

SEQ ID NO: 24628 - RNA, 17 nt, Homo sapiens
uaucuugcauguuucuc

SEQ ID NO: 24629 - RNA, 22 nt, Homo sapiens
ccaggcucacgcaggacgaagu

SEQ ID NO: 24630 - RNA, 18 nt, Homo sapiens
aggcaguauuauauuuuu

SEQ ID NO: 24631 - RNA, 21 nt, Homo sapiens
auauauauauauguauauaua

SEQ ID NO: 24632 - RNA, 24 nt, Homo sapiens
uaauauauauauauguauauauaa

SEQ ID NO: 24633 - RNA, 23 nt, Homo sapiens
uauaauauauauauauguauaua

SEQ ID NO: 24634 - RNA, 24 nt, Homo sapiens
uauaauauauauauauguauauau

SEQ ID NO: 24635 - RNA, 26 nt, Homo sapiens
uauaauauauauauauguauauauau

SEQ ID NO: 24636 - RNA, 17 nt, Homo sapiens
ugagaggcaggcggugc

SEQ ID NO: 24637 - RNA, 20 nt, Homo sapiens
acgccgccuccuagccuucg

SEQ ID NO: 24638 - RNA, 21 nt, Homo sapiens
auuucaaacuggguuacacac

SEQ ID NO: 24639 - RNA, 22 nt, Homo sapiens
cuguugcaugcagagagaacac

SEQ ID NO: 24640 - RNA, 20 nt, Homo sapiens
uuguguuucuuuuucccuca

SEQ ID NO: 24641 - RNA, 24 nt, Homo sapiens
uuuuccuuuuuuuuucauuuuuuc

SEQ ID NO: 24642 - RNA, 22 nt, Homo sapiens
uuuuuccuuuuuucuuuuuuuc

SEQ ID NO: 24643 - RNA, 22 nt, Homo sapiens
uuuuucuuuuuuuccuuuuuuu

SEQ ID NO: 24644 - RNA, 21 nt, Homo sapiens
ggauuccugggacgauggaga

SEQ ID NO: 24645 - RNA, 17 nt, Homo sapiens
ugagugugugcgucuau

SEQ ID NO: 24646 - RNA, 19 nt, Homo sapiens
aaggagcaagaaaaggaaa

SEQ ID NO: 24647 - RNA, 17 nt, Homo sapiens
accccagccuuccuccc

SEQ ID NO: 24648 - RNA, 19 nt, Homo sapiens
agggggaggaagggggagg

SEQ ID NO: 24649 - RNA, 26 nt, Homo sapiens
caaaguuagugaccagcuuucuagac

SEQ ID NO: 24650 - RNA, 18 nt, Homo sapiens
caccaggaguugaagaag

SEQ ID NO: 24651 - RNA, 15 nt, Homo sapiens
gacaaggggcagcgu

SEQ ID NO: 24652 - RNA, 20 nt, Homo sapiens
ggcagacuccaaguguggcu

SEQ ID NO: 24653 - RNA, 19 nt, Homo sapiens
gggaaaggauauggugugg

SEQ ID NO: 24654 - RNA, 15 nt, Homo sapiens
gguacacauuguggg

SEQ ID NO: 24655 - RNA, 20 nt, Homo sapiens
gguggagggaguugaggaag

SEQ ID NO: 24656 - RNA, 15 nt, Homo sapiens
ggugggagggggagg

SEQ ID NO: 24657 - RNA, 14 nt, Homo sapiens
guggaagugguggg

SEQ ID NO: 24658 - RNA, 21 nt, Homo sapiens
ucugccugugcccagggccuu

SEQ ID NO: 24659 - RNA, 21 nt, Homo sapiens
ugagauguggcccacucguug

SEQ ID NO: 24660 - RNA, 18 nt, Homo sapiens
ugccugggucagagaaag

SEQ ID NO: 24661 - RNA, 18 nt, Homo sapiens
uggccagguacuggggcc

SEQ ID NO: 24662 - RNA, 18 nt, Homo sapiens
uugaagaaggagcaagaa

SEQ ID NO: 24663 - RNA, 19 nt, Homo sapiens
uuuuguuuuuuuuuuucuc

SEQ ID NO: 24664 - RNA, 15 nt, Homo sapiens
ugacgagcaaaccua

SEQ ID NO: 24665 - RNA, 19 nt, Homo sapiens
agggggagccccgcgcucu

SEQ ID NO: 24666 - RNA, 26 nt, Homo sapiens
ccgcgcucugccccucccccagcucg

SEQ ID NO: 24667 - RNA, 20 nt, Homo sapiens
ccucgcucgcucuuucuguc

SEQ ID NO: 24668 - RNA, 18 nt, Homo sapiens
cgacgccuucuguucccg

SEQ ID NO: 24669 - RNA, 22 nt, Homo sapiens
cuccucgcucgcucuuucuguc

SEQ ID NO: 24670 - RNA, 21 nt, Homo sapiens
gccccgcgcucugccccuccc

SEQ ID NO: 24671 - RNA, 23 nt, Homo sapiens
gcucgcucuuucugucuccucuc

SEQ ID NO: 24672 - RNA, 15 nt, Homo sapiens
gcucugccccucccc

SEQ ID NO: 24673 - RNA, 25 nt, Homo sapiens
uaaaagaacaaucagaaguuagaga

SEQ ID NO: 24674 - RNA, 18 nt, Homo sapiens
cagccgcggcugcucgcg

SEQ ID NO: 24675 - RNA, 23 nt, Homo sapiens
ccgcggccgccgccuucuccucg

SEQ ID NO: 24676 - RNA, 18 nt, Homo sapiens
ccucggccuccuccaggc

SEQ ID NO: 24677 - RNA, 15 nt, Homo sapiens
gcuccaggagcccgc

SEQ ID NO: 24678 - RNA, 22 nt, Homo sapiens
ggcuaaggcggggaacaccgcu

SEQ ID NO: 24679 - RNA, 20 nt, Homo sapiens
uuuucauuuuccaauaauaa

SEQ ID NO: 24680 - RNA, 27 nt, Homo sapiens
acccuaauuuguaguuuaagcauaugc

SEQ ID NO: 24681 - RNA, 21 nt, Homo sapiens
cgcggcggcucgcagccuccc

SEQ ID NO: 24682 - RNA, 21 nt, Homo sapiens
cggcggcggugagugaccgcg

SEQ ID NO: 24683 - RNA, 16 nt, Homo sapiens
cggugguggcgccggc

SEQ ID NO: 24684 - RNA, 22 nt, Homo sapiens
gaccgugguggcagugguggcg

SEQ ID NO: 24685 - RNA, 16 nt, Homo sapiens
gcccuggagcgggggc

SEQ ID NO: 24686 - RNA, 20 nt, Homo sapiens
uaguuuuucagaaaagacug

SEQ ID NO: 24687 - RNA, 16 nt, Homo sapiens
ugguggcagugguggc

SEQ ID NO: 24688 - RNA, 18 nt, Homo sapiens
uucagaaaagacugggga

SEQ ID NO: 24689 - RNA, 21 nt, Homo sapiens
uucagcuucaaauucucagaa

SEQ ID NO: 24690 - RNA, 16 nt, Homo sapiens
ggagcugugagugcug

SEQ ID NO: 24691 - RNA, 20 nt, Homo sapiens
aaggaguuuuauuucaaaug

SEQ ID NO: 24692 - RNA, 18 nt, Homo sapiens
ccugugguuggggggggc

SEQ ID NO: 24693 - RNA, 19 nt, Homo sapiens
ugagcgggguacacaugga

SEQ ID NO: 24694 - RNA, 23 nt, Homo sapiens
agagggaugcucagguuacuggc

SEQ ID NO: 24695 - RNA, 20 nt, Homo sapiens
caggagggcgggccggacug

SEQ ID NO: 24696 - RNA, 20 nt, Homo sapiens
gagggagaggugagcuccac

SEQ ID NO: 24697 - RNA, 19 nt, Homo sapiens
gcagggguggugugaggga

SEQ ID NO: 24698 - RNA, 16 nt, Homo sapiens
uaccccacccucugca

SEQ ID NO: 24699 - RNA, 17 nt, Homo sapiens
uacugguuuaaugacag

SEQ ID NO: 24700 - RNA, 21 nt, Homo sapiens
uccccugcaaugggagggucu

SEQ ID NO: 24701 - RNA, 19 nt, Homo sapiens
ugaagugaccuuuuggaga

SEQ ID NO: 24702 - RNA, 17 nt, Homo sapiens
ugugagggagguugugu

SEQ ID NO: 24703 - RNA, 17 nt, Homo sapiens
agggcccgggcccgcag

SEQ ID NO: 24704 - RNA, 16 nt, Homo sapiens
cacaaaacagguagga

SEQ ID NO: 24705 - RNA, 19 nt, Homo sapiens
gagggcccgggcccgcagc

SEQ ID NO: 24706 - RNA, 20 nt, Homo sapiens
uuucuaaaagcuuugccaga

SEQ ID NO: 24707 - RNA, 23 nt, Homo sapiens
ccgccagggucuggggccccggg

SEQ ID NO: 24708 - RNA, 19 nt, Homo sapiens
ccucggcggcgcucgcucc

SEQ ID NO: 24709 - RNA, 20 nt, Homo sapiens
gagggugguaaaguugggug

SEQ ID NO: 24710 - RNA, 18 nt, Homo sapiens
ggggagaggugggggagg

SEQ ID NO: 24711 - RNA, 22 nt, Homo sapiens
uccgcugcugcgccgcgagcuc

SEQ ID NO: 24712 - RNA, 19 nt, Homo sapiens
uggggccccgggccucggc

SEQ ID NO: 24713 - RNA, 21 nt, Homo sapiens
aggcaaaaaaaaggggacgcc

SEQ ID NO: 24714 - RNA, 22 nt, Homo sapiens
auauaaauugaaaauaugauug

SEQ ID NO: 24715 - RNA, 16 nt, Homo sapiens
cccgccgccuccgccc

SEQ ID NO: 24716 - RNA, 20 nt, Homo sapiens
cggcggcgggcgcggcugcc

SEQ ID NO: 24717 - RNA, 20 nt, Homo sapiens
cuucgcgccguggcccgccg

SEQ ID NO: 24718 - RNA, 18 nt, Homo sapiens
ggcggcggcgggcgcggc

SEQ ID NO: 24719 - RNA, 18 nt, Homo sapiens
gggagagagcggcauaca

SEQ ID NO: 24720 - RNA, 19 nt, Homo sapiens
gggggugcgucggggcgac

SEQ ID NO: 24721 - RNA, 16 nt, Homo sapiens
agggaaggggaagaaa

SEQ ID NO: 24722 - RNA, 18 nt, Homo sapiens
aaggcucgggccgaggag

SEQ ID NO: 24723 - RNA, 16 nt, Homo sapiens
ccugacacccaccggg

SEQ ID NO: 24724 - RNA, 16 nt, Homo sapiens
cgggccgaggaggggg

SEQ ID NO: 24725 - RNA, 15 nt, Homo sapiens
gcgcccacgacgccg

SEQ ID NO: 24726 - RNA, 18 nt, Homo sapiens
ggcugggggcaggcgucc

SEQ ID NO: 24727 - RNA, 18 nt, Homo sapiens
ucccagcaggccccgcgg

SEQ ID NO: 24728 - RNA, 18 nt, Homo sapiens
ugggggcaggcguccugc

SEQ ID NO: 24729 - RNA, 18 nt, Homo sapiens
ccacgcccuucccggccc

SEQ ID NO: 24730 - RNA, 22 nt, Homo sapiens
cgcggcgugcgggucuggagcc

SEQ ID NO: 24731 - RNA, 18 nt, Homo sapiens
cgggucuggagccucucc

SEQ ID NO: 24732 - RNA, 16 nt, Homo sapiens
gcgcgcggcgugcggg

SEQ ID NO: 24733 - RNA, 16 nt, Homo sapiens
gcuguggcugggagcg

SEQ ID NO: 24734 - RNA, 21 nt, Homo sapiens
ucauguuuuaaaaaagugaca

SEQ ID NO: 24735 - RNA, 18 nt, Homo sapiens
aaaaagccuucagagagc

SEQ ID NO: 24736 - RNA, 17 nt, Homo sapiens
aagacccucauugagga

SEQ ID NO: 24737 - RNA, 21 nt, Homo sapiens
cccagccuaauguuaaccccu

SEQ ID NO: 24738 - RNA, 18 nt, Homo sapiens
uuggugagggaaagaaaa

SEQ ID NO: 24739 - RNA, 23 nt, Homo sapiens
gcaucagucuuguuggaagcuuu

SEQ ID NO: 24740 - RNA, 21 nt, Homo sapiens
aggcaucugaauacgagucau

SEQ ID NO: 24741 - RNA, 20 nt, Homo sapiens
cauaaauaaugcccauuuua

SEQ ID NO: 24742 - RNA, 19 nt, Homo sapiens
gggaaaauaaagaacugaa

SEQ ID NO: 24743 - RNA, 15 nt, Homo sapiens
agcacccccagcagg

SEQ ID NO: 24744 - RNA, 19 nt, Homo sapiens
cccaggcucuuagguccgg

SEQ ID NO: 24745 - RNA, 23 nt, Homo sapiens
ccgggaggcggggacccgggcug

SEQ ID NO: 24746 - RNA, 17 nt, Homo sapiens
cggaaacaggggaccca

SEQ ID NO: 24747 - RNA, 15 nt, Homo sapiens
gcaggcagaccccca

SEQ ID NO: 24748 - RNA, 19 nt, Homo sapiens
ggggccgggaagcggaccu

SEQ ID NO: 24749 - RNA, 21 nt, Homo sapiens
uccuuggcccuaggagcuggg

SEQ ID NO: 24750 - RNA, 17 nt, Homo sapiens
ucugcucugccccgugu

SEQ ID NO: 24751 - RNA, 19 nt, Homo sapiens
ucuuggacacugagggcug

SEQ ID NO: 24752 - RNA, 17 nt, Homo sapiens
acaucuggcauucaccu

SEQ ID NO: 24753 - RNA, 18 nt, Homo sapiens
agucagaagcaguccacg

SEQ ID NO: 24754 - RNA, 19 nt, Homo sapiens
cccgcgccccccgccccgg

SEQ ID NO: 24755 - RNA, 20 nt, Homo sapiens
cccgucucucccuccuuccc

SEQ ID NO: 24756 - RNA, 22 nt, Homo sapiens
ccgcgccccccgccccggccgg

SEQ ID NO: 24757 - RNA, 18 nt, Homo sapiens
ccucgcccucuccuuccc

SEQ ID NO: 24758 - RNA, 19 nt, Homo sapiens
ccuggaggggugcgguggg

SEQ ID NO: 24759 - RNA, 23 nt, Homo sapiens
cgcgcgggcggcgucggggcccg

SEQ ID NO: 24760 - RNA, 23 nt, Homo sapiens
cggcggcggcucgggcgcgccuc

SEQ ID NO: 24761 - RNA, 18 nt, Homo sapiens
cgggcggcggcggcggcg

SEQ ID NO: 24762 - RNA, 21 nt, Homo sapiens
cgggcggcggcggcugcggcg

SEQ ID NO: 24763 - RNA, 19 nt, Homo sapiens
cggggggcggcggucaggc

SEQ ID NO: 24764 - RNA, 17 nt, Homo sapiens
cgucggggcccggccgg

SEQ ID NO: 24765 - RNA, 18 nt, Homo sapiens
cgucggggcccggccggg

SEQ ID NO: 24766 - RNA, 20 nt, Homo sapiens
cugccacugcugcuucuggg

SEQ ID NO: 24767 - RNA, 19 nt, Homo sapiens
gaagccugagcaggccagg

SEQ ID NO: 24768 - RNA, 18 nt, Homo sapiens
gauuggcgcaggaaccag

SEQ ID NO: 24769 - RNA, 18 nt, Homo sapiens
gcgcgccucgcccucucc

SEQ ID NO: 24770 - RNA, 23 nt, Homo sapiens
gcgcgcgggcggcgucggggccc

SEQ ID NO: 24771 - RNA, 18 nt, Homo sapiens
gcggcggcggcugcagcc

SEQ ID NO: 24772 - RNA, 20 nt, Homo sapiens
gcggcucgggcggcggcggc

SEQ ID NO: 24773 - RNA, 19 nt, Homo sapiens
gcuccugcccgcggcucgg

SEQ ID NO: 24774 - RNA, 19 nt, Homo sapiens
ggcccgcgacuccgguggc

SEQ ID NO: 24775 - RNA, 23 nt, Homo sapiens
ggccgggccggggucgcggcgcc

SEQ ID NO: 24776 - RNA, 21 nt, Homo sapiens
ggcggcggcggcggcggcggc

SEQ ID NO: 24777 - RNA, 21 nt, Homo sapiens
ggcggcggcggcugcggcggc

SEQ ID NO: 24778 - RNA, 21 nt, Homo sapiens
ggcgguggcggcggcggcggc

SEQ ID NO: 24779 - RNA, 18 nt, Homo sapiens
gggccggggggcggccgg

SEQ ID NO: 24780 - RNA, 22 nt, Homo sapiens
ggggcggcggucaggcgggggg

SEQ ID NO: 24781 - RNA, 17 nt, Homo sapiens
gggggacggggcggcgg

SEQ ID NO: 24782 - RNA, 21 nt, Homo sapiens
ggggggcggccgggccggggg

SEQ ID NO: 24783 - RNA, 22 nt, Homo sapiens
gguggcggcggcggcgguggcg

SEQ ID NO: 24784 - RNA, 20 nt, Homo sapiens
guggcggcggcggcggcggc

SEQ ID NO: 24785 - RNA, 22 nt, Homo sapiens
ucacgcacgcgugcacucgcac

SEQ ID NO: 24786 - RNA, 18 nt, Homo sapiens
uccucucucuccucccuc

SEQ ID NO: 24787 - RNA, 19 nt, Homo sapiens
ucgcccucuccuucccggc

SEQ ID NO: 24788 - RNA, 18 nt, Homo sapiens
ugaaauauuugccuuggu

SEQ ID NO: 24789 - RNA, 20 nt, Homo sapiens
ugcaguggcuuuuuagcaca

SEQ ID NO: 24790 - RNA, 19 nt, Homo sapiens
ugccccuccccugccuccc

SEQ ID NO: 24791 - RNA, 22 nt, Homo sapiens
uggaggugcgggaagugcaucc

SEQ ID NO: 24792 - RNA, 21 nt, Homo sapiens
uguccagggucccuuccuggg

SEQ ID NO: 24793 - RNA, 23 nt, Homo sapiens
uucaccuuugcuaagagauagag

SEQ ID NO: 24794 - RNA, 21 nt, Homo sapiens
aggaacuguggggaggacucu

SEQ ID NO: 24795 - RNA, 21 nt, Homo sapiens
aggugcagagucagucugggg

SEQ ID NO: 24796 - RNA, 16 nt, Homo sapiens
ccagucccacacugcc

SEQ ID NO: 24797 - RNA, 19 nt, Homo sapiens
cggggucggggcgccucgg

SEQ ID NO: 24798 - RNA, 17 nt, Homo sapiens
gcgcggggucggggcgc

SEQ ID NO: 24799 - RNA, 21 nt, Homo sapiens
ggcaucugggggccucuucca

SEQ ID NO: 24800 - RNA, 15 nt, Homo sapiens
ggcccacacagcccg

SEQ ID NO: 24801 - RNA, 18 nt, Homo sapiens
ggcgccucgggcuggagc

SEQ ID NO: 24802 - RNA, 18 nt, Homo sapiens
gggagacagagcugucug

SEQ ID NO: 24803 - RNA, 14 nt, Homo sapiens
uacagccagucucc

SEQ ID NO: 24804 - RNA, 15 nt, Homo sapiens
ucucucaacccaggc

SEQ ID NO: 24805 - RNA, 21 nt, Homo sapiens
ucuggaggcagagaagaggcu

SEQ ID NO: 24806 - RNA, 19 nt, Homo sapiens
agaauccgggcccgggccc

SEQ ID NO: 24807 - RNA, 22 nt, Homo sapiens
agcgaggggaggggguuagagg

SEQ ID NO: 24808 - RNA, 20 nt, Homo sapiens
cacugcuccuaucccacucc

SEQ ID NO: 24809 - RNA, 15 nt, Homo sapiens
cauaaccuggaaccc

SEQ ID NO: 24810 - RNA, 23 nt, Homo sapiens
ccccaccacaagcucugcauacc

SEQ ID NO: 24811 - RNA, 21 nt, Homo sapiens
ccucucuuuccugucccaggu

SEQ ID NO: 24812 - RNA, 21 nt, Homo sapiens
ccuugggaacauguuuggagg

SEQ ID NO: 24813 - RNA, 16 nt, Homo sapiens
cuugccuggcugaagc

SEQ ID NO: 24814 - RNA, 18 nt, Homo sapiens
gggcacccaucagcccag

SEQ ID NO: 24815 - RNA, 18 nt, Homo sapiens
ggggcccauguugggcug

SEQ ID NO: 24816 - RNA, 20 nt, Homo sapiens
ggugagugugugcagcagcu

SEQ ID NO: 24817 - RNA, 19 nt, Homo sapiens
uggccccugugggagcagg

SEQ ID NO: 24818 - RNA, 15 nt, Homo sapiens
ugguuccucucuuuc

SEQ ID NO: 24819 - RNA, 18 nt, Homo sapiens
ugucccuggggugaggcc

SEQ ID NO: 24820 - RNA, 23 nt, Homo sapiens
acagggacccgggcucuggggga

SEQ ID NO: 24821 - RNA, 18 nt, Homo sapiens
aggggaaggaggggggcg

SEQ ID NO: 24822 - RNA, 22 nt, Homo sapiens
aggggaaggaggggggcggggg

SEQ ID NO: 24823 - RNA, 22 nt, Homo sapiens
aggggggcggggggcccauggg

SEQ ID NO: 24824 - RNA, 22 nt, Homo sapiens
caccucagggccugggcacacg

SEQ ID NO: 24825 - RNA, 23 nt, Homo sapiens
ccuccacagcccggcggcgccgc

SEQ ID NO: 24826 - RNA, 23 nt, Homo sapiens
cggcccccgucggguguuggggc

SEQ ID NO: 24827 - RNA, 18 nt, Homo sapiens
cgggguccugagauucug

SEQ ID NO: 24828 - RNA, 19 nt, Homo sapiens
cguccucugucggggucuc

SEQ ID NO: 24829 - RNA, 16 nt, Homo sapiens
cugugggguucaggga

SEQ ID NO: 24830 - RNA, 20 nt, Homo sapiens
ggagacccugagcccacagg

SEQ ID NO: 24831 - RNA, 25 nt, Homo sapiens
ggaggggaaggaggggggcgggggg

SEQ ID NO: 24832 - RNA, 17 nt, Homo sapiens
gggccccucucgccgcc

SEQ ID NO: 24833 - RNA, 21 nt, Homo sapiens
ggggggcggggggcccauggg

SEQ ID NO: 24834 - RNA, 24 nt, Homo sapiens
uuggggcuggcaggugagcggggc

SEQ ID NO: 24835 - RNA, 19 nt, Homo sapiens
ugguugcgauugcggcagc

SEQ ID NO: 24836 - RNA, 24 nt, Homo sapiens
uucugcuucucaucaagggcaugu

SEQ ID NO: 24837 - RNA, 19 nt, Homo sapiens
aacacacaaacacacacuc

SEQ ID NO: 24838 - RNA, 16 nt, Homo sapiens
acaggacagucucaaa

SEQ ID NO: 24839 - RNA, 16 nt, Homo sapiens
augacgccccuucugu

SEQ ID NO: 24840 - RNA, 16 nt, Homo sapiens
uauguugagaacagua

SEQ ID NO: 24841 - RNA, 16 nt, Homo sapiens
uggaauggaaggaucu

SEQ ID NO: 24842 - RNA, 19 nt, Homo sapiens
uguaucacagugcccuuga

SEQ ID NO: 24843 - RNA, 18 nt, Homo sapiens
uucauuuucaguuauugc

SEQ ID NO: 24844 - RNA, 19 nt, Homo sapiens
uugagaccaaaacaaucaa

SEQ ID NO: 24845 - RNA, 22 nt, Homo sapiens
auaaaugaaucagguagcauga

SEQ ID NO: 24846 - RNA, 17 nt, Homo sapiens
cgggcucgggacggagg

SEQ ID NO: 24847 - RNA, 23 nt, Homo sapiens
gagggcgcgcgggcucgggacgg

SEQ ID NO: 24848 - RNA, 18 nt, Homo sapiens
ugagauguuagcaauacu

SEQ ID NO: 24849 - RNA, 18 nt, Homo sapiens
ugagggcgcgcgggcucg

SEQ ID NO: 24850 - RNA, 19 nt, Homo sapiens
accaaguaugugguguaag

SEQ ID NO: 24851 - RNA, 17 nt, Homo sapiens
aguuuucuagaacuugu

SEQ ID NO: 24852 - RNA, 18 nt, Homo sapiens
cucagucaauuuacauag

SEQ ID NO: 24853 - RNA, 22 nt, Homo sapiens
gaaugcauggcuggaaaaauga

SEQ ID NO: 24854 - RNA, 21 nt, Homo sapiens
gcuugacaaaaugcuguguuc

SEQ ID NO: 24855 - RNA, 18 nt, Homo sapiens
guugcuucaguuuucuag

SEQ ID NO: 24856 - RNA, 23 nt, Homo sapiens
uguccuaugcauagcuuuucagu

SEQ ID NO: 24857 - RNA, 14 nt, Homo sapiens
agagggggucgugu

SEQ ID NO: 24858 - RNA, 17 nt, Homo sapiens
agcaggaaaacucuagc

SEQ ID NO: 24859 - RNA, 18 nt, Homo sapiens
gcucggcgccaucuuggc

SEQ ID NO: 24860 - RNA, 16 nt, Homo sapiens
ucucuccaaugcaggc

SEQ ID NO: 24861 - RNA, 18 nt, Homo sapiens
ccaagucuuuucucuaaa

SEQ ID NO: 24862 - RNA, 18 nt, Homo sapiens
cgggagagagccgagcgu

SEQ ID NO: 24863 - RNA, 22 nt, Homo sapiens
cucagcgagcucucuucgccuc

SEQ ID NO: 24864 - RNA, 23 nt, Homo sapiens
ccugccauuaccgcauccuucau

SEQ ID NO: 24865 - RNA, 23 nt, Homo sapiens
aaccacaaauaaaaucuucucug

SEQ ID NO: 24866 - RNA, 20 nt, Homo sapiens
ccaaggaugagauggcugag

SEQ ID NO: 24867 - RNA, 18 nt, Homo sapiens
cggaaguugggguaggag

SEQ ID NO: 24868 - RNA, 19 nt, Homo sapiens
acagugaccuccacgggga

SEQ ID NO: 24869 - RNA, 20 nt, Homo sapiens
agacaaagaaauuaugaaga

SEQ ID NO: 24870 - RNA, 19 nt, Homo sapiens
agcgcaaggggaggagagg

SEQ ID NO: 24871 - RNA, 21 nt, Homo sapiens
aguggaaagacagggggaggg

SEQ ID NO: 24872 - RNA, 18 nt, Homo sapiens
caaguggaggccaaucaa

SEQ ID NO: 24873 - RNA, 18 nt, Homo sapiens
cagccgcgcgccgccccc

SEQ ID NO: 24874 - RNA, 24 nt, Homo sapiens
ccgccccgccgccgccgagucccg

SEQ ID NO: 24875 - RNA, 18 nt, Homo sapiens
ccgccgccgccgaguccc

SEQ ID NO: 24876 - RNA, 16 nt, Homo sapiens
cgagcuggugacuucc

SEQ ID NO: 24877 - RNA, 19 nt, Homo sapiens
cgagcuggugacuuccucc

SEQ ID NO: 24878 - RNA, 15 nt, Homo sapiens
cgccgcgcgcccggc

SEQ ID NO: 24879 - RNA, 17 nt, Homo sapiens
cgcugcggcggcggcgg

SEQ ID NO: 24880 - RNA, 17 nt, Homo sapiens
cgggcgcggcggcggcg

SEQ ID NO: 24881 - RNA, 19 nt, Homo sapiens
cugcaaggaggccagggcu

SEQ ID NO: 24882 - RNA, 19 nt, Homo sapiens
gagagagagagagaaagag

SEQ ID NO: 24883 - RNA, 16 nt, Homo sapiens
gcccugacccuucccc

SEQ ID NO: 24884 - RNA, 25 nt, Homo sapiens
gcgccgcgcgcccggccgcgcuccg

SEQ ID NO: 24885 - RNA, 17 nt, Homo sapiens
gcgcggagugggggcgc

SEQ ID NO: 24886 - RNA, 19 nt, Homo sapiens
gcgggcgcggcggcggcgg

SEQ ID NO: 24887 - RNA, 16 nt, Homo sapiens
gcuugcggccgcaggc

SEQ ID NO: 24888 - RNA, 20 nt, Homo sapiens
ggacugaaaaucuuccuucu

SEQ ID NO: 24889 - RNA, 16 nt, Homo sapiens
ggaggagaggguggga

SEQ ID NO: 24890 - RNA, 18 nt, Homo sapiens
ggcggcgccgcgcgcccg

SEQ ID NO: 24891 - RNA, 21 nt, Homo sapiens
gggagagggcgggacagcggg

SEQ ID NO: 24892 - RNA, 21 nt, Homo sapiens
gggccaucuuccucagcccuu

SEQ ID NO: 24893 - RNA, 18 nt, Homo sapiens
ggggaccucccucacugg

SEQ ID NO: 24894 - RNA, 21 nt, Homo sapiens
ggggggaaugaaaaggcgguc

SEQ ID NO: 24895 - RNA, 19 nt, Homo sapiens
gguggcgaauggcggccug

SEQ ID NO: 24896 - RNA, 17 nt, Homo sapiens
ggugggagagggcggaa

SEQ ID NO: 24897 - RNA, 18 nt, Homo sapiens
guggcgaauggcggccug

SEQ ID NO: 24898 - RNA, 23 nt, Homo sapiens
ucccuguuugguuuaucacagca

SEQ ID NO: 24899 - RNA, 17 nt, Homo sapiens
uggaaaguuucgguggc

SEQ ID NO: 24900 - RNA, 18 nt, Homo sapiens
uucauguauggaccugug

SEQ ID NO: 24901 - RNA, 18 nt, Homo sapiens
uucuguuuuugcuugccu

SEQ ID NO: 24902 - RNA, 19 nt, Homo sapiens
uugcuucuguuuuugcuug

SEQ ID NO: 24903 - RNA, 17 nt, Homo sapiens
auauaugcauacauaua

SEQ ID NO: 24904 - RNA, 21 nt, Homo sapiens
uaauguacugcauaaaauauu

SEQ ID NO: 24905 - RNA, 14 nt, Homo sapiens
aaggaagggaauug

SEQ ID NO: 24906 - RNA, 17 nt, Homo sapiens
cccgggccggaagcggg

SEQ ID NO: 24907 - RNA, 19 nt, Homo sapiens
ccgucccggcucccgcggc

SEQ ID NO: 24908 - RNA, 18 nt, Homo sapiens
cgccgcgcgcccuccccg

SEQ ID NO: 24909 - RNA, 19 nt, Homo sapiens
gcccgggagacggaggucg

SEQ ID NO: 24910 - RNA, 17 nt, Homo sapiens
gcgugauggcgggcgcc

SEQ ID NO: 24911 - RNA, 25 nt, Homo sapiens
gcuaaagaguuuuuaaagggaaucu

SEQ ID NO: 24912 - RNA, 19 nt, Homo sapiens
ggcuaaagaguuuuuaaag

SEQ ID NO: 24913 - RNA, 20 nt, Homo sapiens
guggaucacgaggucaggag

SEQ ID NO: 24914 - RNA, 23 nt, Homo sapiens
uacagauuaccagggauuuaaau

SEQ ID NO: 24915 - RNA, 18 nt, Homo sapiens
uccgaucgccgcgcgccc

SEQ ID NO: 24916 - RNA, 19 nt, Homo sapiens
uccucggcugugacgccgc

SEQ ID NO: 24917 - RNA, 23 nt, Homo sapiens
ugccuguaaucccagcacuuugg

SEQ ID NO: 24918 - RNA, 20 nt, Homo sapiens
ugugccugucaucucugcca

SEQ ID NO: 24919 - RNA, 19 nt, Homo sapiens
acgcugcuuuugcaccuuu

SEQ ID NO: 24920 - RNA, 25 nt, Homo sapiens
ccgccccuuucugcuggaggacccc

SEQ ID NO: 24921 - RNA, 16 nt, Homo sapiens
cucgcucucucccucg

SEQ ID NO: 24922 - RNA, 22 nt, Homo sapiens
cucguucuuggcugccccaggu

SEQ ID NO: 24923 - RNA, 19 nt, Homo sapiens
gcaccuuuucccccgcccc

SEQ ID NO: 24924 - RNA, 22 nt, Homo sapiens
uugccccaggagacaccguguc

SEQ ID NO: 24925 - RNA, 18 nt, Homo sapiens
uugcucaacuacugcaga

SEQ ID NO: 24926 - RNA, 17 nt, Homo sapiens
accccuugcggacaagg

SEQ ID NO: 24927 - RNA, 18 nt, Homo sapiens
agguaucuggaauguuca

SEQ ID NO: 24928 - RNA, 21 nt, Homo sapiens
caaggucccugggaaugcugc

SEQ ID NO: 24929 - RNA, 19 nt, Homo sapiens
cacugagguagcaaugugu

SEQ ID NO: 24930 - RNA, 22 nt, Homo sapiens
cagccgcugcaggugccaccug

SEQ ID NO: 24931 - RNA, 20 nt, Homo sapiens
ccagggcugcuaaggcucua

SEQ ID NO: 24932 - RNA, 16 nt, Homo sapiens
ccugcaccaggagugc

SEQ ID NO: 24933 - RNA, 17 nt, Homo sapiens
ccuuaaacugagcaucc

SEQ ID NO: 24934 - RNA, 19 nt, Homo sapiens
cgcuccccgccccucgccc

SEQ ID NO: 24935 - RNA, 15 nt, Homo sapiens
cuggccaccauccag

SEQ ID NO: 24936 - RNA, 22 nt, Homo sapiens
ggguuagggagagcaggcuggg

SEQ ID NO: 24937 - RNA, 23 nt, Homo sapiens
ucaugcacggggaagcaaaacca

SEQ ID NO: 24938 - RNA, 15 nt, Homo sapiens
uucgccgccaccaug

SEQ ID NO: 24939 - RNA, 17 nt, Homo sapiens
gcccggggcaaggacag

SEQ ID NO: 24940 - RNA, 25 nt, Homo sapiens
uggagaccucgggcaggacccaggc

SEQ ID NO: 24941 - RNA, 18 nt, Homo sapiens
aggaugugggggcugggu

SEQ ID NO: 24942 - RNA, 19 nt, Homo sapiens
aucuuccuagcccgagagc

SEQ ID NO: 24943 - RNA, 18 nt, Homo sapiens
cuccugcguguuggggaa

SEQ ID NO: 24944 - RNA, 22 nt, Homo sapiens
gguggggccucuaggcaggaag

SEQ ID NO: 24945 - RNA, 17 nt, Homo sapiens
gugcccugaggucuugg

SEQ ID NO: 24946 - RNA, 19 nt, Homo sapiens
guuauacauugcucagugg

SEQ ID NO: 24947 - RNA, 14 nt, Homo sapiens
uccacccgguccug

SEQ ID NO: 24948 - RNA, 23 nt, Homo sapiens
ucugacccuggagaaaaagagag

SEQ ID NO: 24949 - RNA, 17 nt, Homo sapiens
ugaggagcugggaggac

SEQ ID NO: 24950 - RNA, 25 nt, Homo sapiens
ugggaggacaggaagcuccggacuc

SEQ ID NO: 24951 - RNA, 21 nt, Homo sapiens
cccuggguggggcaggggugg

SEQ ID NO: 24952 - RNA, 19 nt, Homo sapiens
gggggcugagcugaggugg

SEQ ID NO: 24953 - RNA, 15 nt, Homo sapiens
guggagcuggcaggg

SEQ ID NO: 24954 - RNA, 22 nt, Homo sapiens
uuggucccagcugggccaaggg

SEQ ID NO: 24955 - RNA, 19 nt, Homo sapiens
acgggagagagaagggucg

SEQ ID NO: 24956 - RNA, 20 nt, Homo sapiens
agcggcgggcacggcggcgg

SEQ ID NO: 24957 - RNA, 21 nt, Homo sapiens
cccgucccgcucggaugggca

SEQ ID NO: 24958 - RNA, 21 nt, Homo sapiens
gccgccgcaacgccgcgcccg

SEQ ID NO: 24959 - RNA, 19 nt, Homo sapiens
gccggcuggcgggcggcgc

SEQ ID NO: 24960 - RNA, 21 nt, Homo sapiens
ggccggcuggcgggcggcgcc

SEQ ID NO: 24961 - RNA, 18 nt, Homo sapiens
ggcggcacugcggcccgg

SEQ ID NO: 24962 - RNA, 19 nt, Homo sapiens
ggucaggagggcgcggcgc

SEQ ID NO: 24963 - RNA, 22 nt, Homo sapiens
uggcgggcggcgccucucaggc

SEQ ID NO: 24964 - RNA, 23 nt, Homo sapiens
aaaaacaacaacaaaugagagau

SEQ ID NO: 24965 - RNA, 18 nt, Homo sapiens
agugcaacaggaaagugc

SEQ ID NO: 24966 - RNA, 15 nt, Homo sapiens
cacuucaucuauuua

SEQ ID NO: 24967 - RNA, 22 nt, Homo sapiens
caggguuguuggguagagaagg

SEQ ID NO: 24968 - RNA, 25 nt, Homo sapiens
caucauguuuuuaaauuagcuugca

SEQ ID NO: 24969 - RNA, 20 nt, Homo sapiens
cuuagggaaaucaggagggg

SEQ ID NO: 24970 - RNA, 20 nt, Homo sapiens
gacuguaaaugaguuaccug

SEQ ID NO: 24971 - RNA, 23 nt, Homo sapiens
ggcgguugauuuccaccuguggg

SEQ ID NO: 24972 - RNA, 20 nt, Homo sapiens
gugccccgcaaccccgcggg

SEQ ID NO: 24973 - RNA, 21 nt, Homo sapiens
uaaaaaaacacuucucuuucu

SEQ ID NO: 24974 - RNA, 21 nt, Homo sapiens
ucuguauuuccuguagaaccu

SEQ ID NO: 24975 - RNA, 18 nt, Homo sapiens
ugggaugcaucacgcggc

SEQ ID NO: 24976 - RNA, 18 nt, Homo sapiens
uugaagaggcagaaagga

SEQ ID NO: 24977 - RNA, 20 nt, Homo sapiens
ggaggaaagcucauguaaca

SEQ ID NO: 24978 - RNA, 17 nt, Homo sapiens
ucacagcuccgcacagc

SEQ ID NO: 24979 - RNA, 17 nt, Homo sapiens
ugagugauuuuucagug

SEQ ID NO: 24980 - RNA, 18 nt, Homo sapiens
ugcacaaaugcccugcaa

SEQ ID NO: 24981 - RNA, 24 nt, Homo sapiens
aagcagacagcagcaggcuggccc

SEQ ID NO: 24982 - RNA, 18 nt, Homo sapiens
auccuaggguuugacagc

SEQ ID NO: 24983 - RNA, 21 nt, Homo sapiens
gcggcugagaccagaacaagc

SEQ ID NO: 24984 - RNA, 17 nt, Homo sapiens
ggggggaggggagaagc

SEQ ID NO: 24985 - RNA, 22 nt, Homo sapiens
uggaggcagaucggggggaggg

SEQ ID NO: 24986 - RNA, 18 nt, Homo sapiens
uucucggcccgggcuguc

SEQ ID NO: 24987 - RNA, 22 nt, Homo sapiens
aagaaacuacuacuguauuuug

SEQ ID NO: 24988 - RNA, 22 nt, Homo sapiens
agggaggaaagaaaggggggag

SEQ ID NO: 24989 - RNA, 19 nt, Homo sapiens
cggcaccuccagccugccu

SEQ ID NO: 24990 - RNA, 19 nt, Homo sapiens
cuuaggcaugauaaacauu

SEQ ID NO: 24991 - RNA, 20 nt, Homo sapiens
ucaucuucagcugccaagug

SEQ ID NO: 24992 - RNA, 16 nt, Homo sapiens
ugagaaggggagggag

SEQ ID NO: 24993 - RNA, 20 nt, Homo sapiens
uggcuccaaauugcuuggcu

SEQ ID NO: 24994 - RNA, 18 nt, Homo sapiens
agcuacuuacuguguagc

SEQ ID NO: 24995 - RNA, 17 nt, Homo sapiens
acgggacuggcaugguc

SEQ ID NO: 24996 - RNA, 22 nt, Homo sapiens
caguagacaaacauuuacagca

SEQ ID NO: 24997 - RNA, 17 nt, Homo sapiens
cccugggccccauucgc

SEQ ID NO: 24998 - RNA, 22 nt, Homo sapiens
gaggagaaccccagggaagaug

SEQ ID NO: 24999 - RNA, 19 nt, Homo sapiens
gccagcaaucuacccgugu

SEQ ID NO: 25000 - RNA, 19 nt, Homo sapiens
gcugagggagggagggggc

SEQ ID NO: 25001 - RNA, 22 nt, Homo sapiens
gcuugugcaguagacaaacauu

SEQ ID NO: 25002 - RNA, 23 nt, Homo sapiens
uggcccugaaggucugcccuggg

SEQ ID NO: 25003 - RNA, 16 nt, Homo sapiens
uguaaggagagaccag

SEQ ID NO: 25004 - RNA, 22 nt, Homo sapiens
aaaaaaagaaacagccuggaga

SEQ ID NO: 25005 - RNA, 24 nt, Homo sapiens
agagagacgaggacagagagagac

SEQ ID NO: 25006 - RNA, 18 nt, Homo sapiens
agaguuaggugacaaugg

SEQ ID NO: 25007 - RNA, 20 nt, Homo sapiens
aggacagacaccaagaaaga

SEQ ID NO: 25008 - RNA, 16 nt, Homo sapiens
agggguguugguccca

SEQ ID NO: 25009 - RNA, 22 nt, Homo sapiens
aggugaggggcagggcugggug

SEQ ID NO: 25010 - RNA, 17 nt, Homo sapiens
cacccacaggaacucag

SEQ ID NO: 25011 - RNA, 17 nt, Homo sapiens
ccccagggagacagguc

SEQ ID NO: 25012 - RNA, 20 nt, Homo sapiens
gaggggcagggcuggguggg

SEQ ID NO: 25013 - RNA, 20 nt, Homo sapiens
gcagagaugaaaacagcaag

SEQ ID NO: 25014 - RNA, 17 nt, Homo sapiens
ggggaggggagggcagg

SEQ ID NO: 25015 - RNA, 19 nt, Homo sapiens
gugcccaucgaguugggac

SEQ ID NO: 25016 - RNA, 19 nt, Homo sapiens
uacaguguccccuggccau

SEQ ID NO: 25017 - RNA, 18 nt, Homo sapiens
uggcaggaaggggagcac

SEQ ID NO: 25018 - RNA, 24 nt, Homo sapiens
uuugcccaucucuggggcacgaac

SEQ ID NO: 25019 - RNA, 18 nt, Homo sapiens
agcggcuguggggaggcg

SEQ ID NO: 25020 - RNA, 25 nt, Homo sapiens
auauaggcuauguacagaauuauau

SEQ ID NO: 25021 - RNA, 17 nt, Homo sapiens
cagccgcucaaccacgc

SEQ ID NO: 25022 - RNA, 17 nt, Homo sapiens
cuccagccgcccacccg

SEQ ID NO: 25023 - RNA, 17 nt, Homo sapiens
cuuggaaccaacagguc

SEQ ID NO: 25024 - RNA, 24 nt, Homo sapiens
ggaggcggcagagggggcugucgg

SEQ ID NO: 25025 - RNA, 16 nt, Homo sapiens
ucugugcaguggccag

SEQ ID NO: 25026 - RNA, 25 nt, Homo sapiens
ucugugcaguggccagccauaggaa

SEQ ID NO: 25027 - RNA, 19 nt, Homo sapiens
ugagguaggucucuuuaca

SEQ ID NO: 25028 - RNA, 18 nt, Homo sapiens
ugccaccucaaaaagcag

SEQ ID NO: 25029 - RNA, 18 nt, Homo sapiens
uucacauuuucagauuuu

SEQ ID NO: 25030 - RNA, 18 nt, Homo sapiens
agaggggcgcggacaucc

SEQ ID NO: 25031 - RNA, 18 nt, Homo sapiens
ucacguagccgcugggcg

SEQ ID NO: 25032 - RNA, 17 nt, Homo sapiens
ggcugagggggagagaa

SEQ ID NO: 25033 - RNA, 18 nt, Homo sapiens
uagcccucagaguccacu

SEQ ID NO: 25034 - RNA, 21 nt, Homo sapiens
uggccauaggauugggagcac

SEQ ID NO: 25035 - RNA, 18 nt, Homo sapiens
uuagggacgggagcuaag

SEQ ID NO: 25036 - RNA, 19 nt, Homo sapiens
acaccccaggagcuucagc

SEQ ID NO: 25037 - RNA, 20 nt, Homo sapiens
augaagguccucagcggcac

SEQ ID NO: 25038 - RNA, 18 nt, Homo sapiens
caccggugccaccugcag

SEQ ID NO: 25039 - RNA, 17 nt, Homo sapiens
acacaggcugugggagc

SEQ ID NO: 25040 - RNA, 19 nt, Homo sapiens
ccgagccgcagaauccugg

SEQ ID NO: 25041 - RNA, 20 nt, Homo sapiens
cgaguguguaugcgcgcgug

SEQ ID NO: 25042 - RNA, 18 nt, Homo sapiens
cgccggagugugcggcaa

SEQ ID NO: 25043 - RNA, 25 nt, Homo sapiens
cgcgcuccucgccgcugcccagcgu

SEQ ID NO: 25044 - RNA, 20 nt, Homo sapiens
gcgcgcgccggcucccccgg

SEQ ID NO: 25045 - RNA, 19 nt, Homo sapiens
ucucuguuugcuuuuuugu

SEQ ID NO: 25046 - RNA, 19 nt, Homo sapiens
ugcguggagguauguguug

SEQ ID NO: 25047 - RNA, 18 nt, Homo sapiens
ugggaaggcugcugccuu

SEQ ID NO: 25048 - RNA, 18 nt, Homo sapiens
acagggguugcgauggcu

SEQ ID NO: 25049 - RNA, 20 nt, Homo sapiens
acuugggacaagagccaggg

SEQ ID NO: 25050 - RNA, 18 nt, Homo sapiens
gaaaauuuuuggggggug

SEQ ID NO: 25051 - RNA, 18 nt, Homo sapiens
gcgauggcuuggcuuggg

SEQ ID NO: 25052 - RNA, 19 nt, Homo sapiens
ggagagauuaagcugaagg

SEQ ID NO: 25053 - RNA, 23 nt, Homo sapiens
uaggacaucuaauuagagagugc

SEQ ID NO: 25054 - RNA, 20 nt, Homo sapiens
uucacaagguaaugucauca

SEQ ID NO: 25055 - RNA, 16 nt, Homo sapiens
uucaugugcguccgug

SEQ ID NO: 25056 - RNA, 18 nt, Homo sapiens
aacacacagaaaaaucaa

SEQ ID NO: 25057 - RNA, 20 nt, Homo sapiens
acagcagcaaaccaacaggc

SEQ ID NO: 25058 - RNA, 20 nt, Homo sapiens
accaggaaaugcuucccucc

SEQ ID NO: 25059 - RNA, 22 nt, Homo sapiens
caggaggaaagaucucagcggg

SEQ ID NO: 25060 - RNA, 21 nt, Homo sapiens
gcacggggaaguuaguguugc

SEQ ID NO: 25061 - RNA, 18 nt, Homo sapiens
uuaguguugcaguuucac

SEQ ID NO: 25062 - RNA, 18 nt, Homo sapiens
aggggaaggagaaacaag

SEQ ID NO: 25063 - RNA, 19 nt, Homo sapiens
cucguuucugcagauuauu

SEQ ID NO: 25064 - RNA, 23 nt, Homo sapiens
gguaagggaggcaaggacggagg

SEQ ID NO: 25065 - RNA, 17 nt, Homo sapiens
cucgugauuacauuuag

SEQ ID NO: 25066 - RNA, 21 nt, Homo sapiens
agaaaaccuacuccacacaga

SEQ ID NO: 25067 - RNA, 21 nt, Homo sapiens
gggguagggagaagagaccac

SEQ ID NO: 25068 - RNA, 17 nt, Homo sapiens
ucccacaacuguguucu

SEQ ID NO: 25069 - RNA, 18 nt, Homo sapiens
aaguacccccaaaaagga

SEQ ID NO: 25070 - RNA, 21 nt, Homo sapiens
aauaugagaugguaauagcua

SEQ ID NO: 25071 - RNA, 19 nt, Homo sapiens
accagacuuuauaggcaug

SEQ ID NO: 25072 - RNA, 16 nt, Homo sapiens
agugggcuuaagcagg

SEQ ID NO: 25073 - RNA, 19 nt, Homo sapiens
aguuguaaggcuacaacua

SEQ ID NO: 25074 - RNA, 17 nt, Homo sapiens
ccaaacuaaagucgugu

SEQ ID NO: 25075 - RNA, 16 nt, Homo sapiens
ccccgccaccaccgcc

SEQ ID NO: 25076 - RNA, 23 nt, Homo sapiens
ccgcggcccgcgcucccggugcc

SEQ ID NO: 25077 - RNA, 19 nt, Homo sapiens
cuugauacuguuuagccau

SEQ ID NO: 25078 - RNA, 19 nt, Homo sapiens
gaauggagaggaggaagaa

SEQ ID NO: 25079 - RNA, 18 nt, Homo sapiens
gcuugauaagccaaagcc

SEQ ID NO: 25080 - RNA, 19 nt, Homo sapiens
uaucaaaaaacuuuacaau

SEQ ID NO: 25081 - RNA, 19 nt, Homo sapiens
uauuauuuaagccacugau

SEQ ID NO: 25082 - RNA, 19 nt, Homo sapiens
uguagugaggaaggagggu

SEQ ID NO: 25083 - RNA, 18 nt, Homo sapiens
uuuccagguaccuaauuu

SEQ ID NO: 25084 - RNA, 18 nt, Homo sapiens
aggagggagggagggagc

SEQ ID NO: 25085 - RNA, 23 nt, Homo sapiens
agggagcgagggggccgcuugcu

SEQ ID NO: 25086 - RNA, 20 nt, Homo sapiens
caggccuggcuccggccccg

SEQ ID NO: 25087 - RNA, 19 nt, Homo sapiens
ccgaggcggggagagggcg

SEQ ID NO: 25088 - RNA, 23 nt, Homo sapiens
ccggcucucgcuccggcuccggc

SEQ ID NO: 25089 - RNA, 14 nt, Homo sapiens
gacgccgaggcccc

SEQ ID NO: 25090 - RNA, 24 nt, Homo sapiens
gccccggcucucgcuccggcuccg

SEQ ID NO: 25091 - RNA, 21 nt, Homo sapiens
gcggcggggagggcgcggagg

SEQ ID NO: 25092 - RNA, 18 nt, Homo sapiens
ggaggagggagggaggga

SEQ ID NO: 25093 - RNA, 18 nt, Homo sapiens
ggcggggacgccgaggcc

SEQ ID NO: 25094 - RNA, 20 nt, Homo sapiens
cagcagcaaagcaaggacuc

SEQ ID NO: 25095 - RNA, 20 nt, Homo sapiens
cccaacaacaauucuuuucu

SEQ ID NO: 25096 - RNA, 17 nt, Homo sapiens
aacaaaauauaauuccc

SEQ ID NO: 25097 - RNA, 22 nt, Homo sapiens
uaucacacacauguucagaggu

SEQ ID NO: 25098 - RNA, 25 nt, Homo sapiens
uguccauuuaaacacaaagaauuuu

SEQ ID NO: 25099 - RNA, 21 nt, Homo sapiens
agggauaaaaagcuacaaguu

SEQ ID NO: 25100 - RNA, 19 nt, Homo sapiens
augaagacugagugaagac

SEQ ID NO: 25101 - RNA, 18 nt, Homo sapiens
uaauaaaauuaauaugau

SEQ ID NO: 25102 - RNA, 17 nt, Homo sapiens
uacacugcuggugugaa

SEQ ID NO: 25103 - RNA, 20 nt, Homo sapiens
cggcccgcuccuccuucucc

SEQ ID NO: 25104 - RNA, 21 nt, Homo sapiens
gcggcgaagccuccacggccc

SEQ ID NO: 25105 - RNA, 18 nt, Homo sapiens
uccacggcccgcuccucc

SEQ ID NO: 25106 - RNA, 21 nt, Homo sapiens
cacccagggcagggccugggg

SEQ ID NO: 25107 - RNA, 18 nt, Homo sapiens
ccccggacucggacgccg

SEQ ID NO: 25108 - RNA, 20 nt, Homo sapiens
cccucucccuccuggggcuc

SEQ ID NO: 25109 - RNA, 21 nt, Homo sapiens
ccgguucgggcugcugcagca

SEQ ID NO: 25110 - RNA, 22 nt, Homo sapiens
ccuuggccuugcuccauccccg

SEQ ID NO: 25111 - RNA, 21 nt, Homo sapiens
ccuuggucuccuuccagcccu

SEQ ID NO: 25112 - RNA, 19 nt, Homo sapiens
cggggccgcucccaggacc

SEQ ID NO: 25113 - RNA, 20 nt, Homo sapiens
cugcaccccgggcagccaau

SEQ ID NO: 25114 - RNA, 20 nt, Homo sapiens
cuggcacccuuucuccgcuu

SEQ ID NO: 25115 - RNA, 22 nt, Homo sapiens
gagcagcaggagcagcgggucc

SEQ ID NO: 25116 - RNA, 18 nt, Homo sapiens
gcccuggccuugggcccu

SEQ ID NO: 25117 - RNA, 23 nt, Homo sapiens
gggccagaggcaggucauaccca

SEQ ID NO: 25118 - RNA, 25 nt, Homo sapiens
uccccgcacucuucugcgcccgacu

SEQ ID NO: 25119 - RNA, 19 nt, Homo sapiens
ucgggcugcugcagcagcc

SEQ ID NO: 25120 - RNA, 22 nt, Homo sapiens
ucucccacugccgcucccccag

SEQ ID NO: 25121 - RNA, 20 nt, Homo sapiens
ugauguccuccaggggcugc

SEQ ID NO: 25122 - RNA, 18 nt, Homo sapiens
uucugcccgacaccccag

SEQ ID NO: 25123 - RNA, 18 nt, Homo sapiens
ccucccucugugccuguc

SEQ ID NO: 25124 - RNA, 14 nt, Homo sapiens
gacccgaccgcccu

SEQ ID NO: 25125 - RNA, 21 nt, Homo sapiens
gcuggcuuacucacugcucgc

SEQ ID NO: 25126 - RNA, 17 nt, Homo sapiens
caccaagcaccccuggg

SEQ ID NO: 25127 - RNA, 22 nt, Homo sapiens
ccaggauuucuuuuuucccaca

SEQ ID NO: 25128 - RNA, 19 nt, Homo sapiens
cuaggaauucccucccacu

SEQ ID NO: 25129 - RNA, 20 nt, Homo sapiens
ugugucagcaaaugaguaga

SEQ ID NO: 25130 - RNA, 19 nt, Homo sapiens
uuacaaaaaggacuacggc

SEQ ID NO: 25131 - RNA, 20 nt, Homo sapiens
ccagagggguguugcuuguc

SEQ ID NO: 25132 - RNA, 19 nt, Homo sapiens
uuaaaaacugaaaauauca

SEQ ID NO: 25133 - RNA, 19 nt, Homo sapiens
cagggaccugggagccggg

SEQ ID NO: 25134 - RNA, 19 nt, Homo sapiens
gguggagugggaucaucag

SEQ ID NO: 25135 - RNA, 20 nt, Homo sapiens
uggcaaggagagaugagggg

SEQ ID NO: 25136 - RNA, 19 nt, Homo sapiens
uugaggugggguggagugg

SEQ ID NO: 25137 - RNA, 15 nt, Homo sapiens
uuggguagcaaaguu

SEQ ID NO: 25138 - RNA, 24 nt, Homo sapiens
uauuuuauuuuuucuuucucuccu

SEQ ID NO: 25139 - RNA, 21 nt, Homo sapiens
uuuguugaguuugacaaaugu

SEQ ID NO: 25140 - RNA, 17 nt, Homo sapiens
aaagccagacagcgcuc

SEQ ID NO: 25141 - RNA, 23 nt, Homo sapiens
agccagacagcgcucgaucaggu

SEQ ID NO: 25142 - RNA, 20 nt, Homo sapiens
cacggaacgcaggaagcacg

SEQ ID NO: 25143 - RNA, 21 nt, Homo sapiens
ccaauccacaagugguucuac

SEQ ID NO: 25144 - RNA, 22 nt, Homo sapiens
ccggcuuagacuccgauggggc

SEQ ID NO: 25145 - RNA, 20 nt, Homo sapiens
cgcggucgggcuguugcuuc

SEQ ID NO: 25146 - RNA, 17 nt, Homo sapiens
gaaucuuuucccggagg

SEQ ID NO: 25147 - RNA, 17 nt, Homo sapiens
gccccugaaaucggcag

SEQ ID NO: 25148 - RNA, 17 nt, Homo sapiens
ugaggaaugcacacagc

SEQ ID NO: 25149 - RNA, 21 nt, Homo sapiens
aggugugagccaugcaauggg

SEQ ID NO: 25150 - RNA, 17 nt, Homo sapiens
guuuucagguaccgaau

SEQ ID NO: 25151 - RNA, 16 nt, Homo sapiens
ucuuuuacagguguga

SEQ ID NO: 25152 - RNA, 15 nt, Homo sapiens
agcucagaaggagga

SEQ ID NO: 25153 - RNA, 22 nt, Homo sapiens
uaucuugaaauuaauaugcagg

SEQ ID NO: 25154 - RNA, 23 nt, Homo sapiens
ucucacauuagcauuuuuuuuuu

SEQ ID NO: 25155 - RNA, 18 nt, Homo sapiens
ucuugcucuaucucccag

SEQ ID NO: 25156 - RNA, 19 nt, Homo sapiens
ugcuaucuugaaauuaaua

SEQ ID NO: 25157 - RNA, 21 nt, Homo sapiens
cacaucuuaaacuuuggggaa

SEQ ID NO: 25158 - RNA, 19 nt, Homo sapiens
cagccuuauaaacuguuuc

SEQ ID NO: 25159 - RNA, 18 nt, Homo sapiens
gcccuggcuaaaaagcag

SEQ ID NO: 25160 - RNA, 20 nt, Homo sapiens
uacucuuccuuuuguaacau

SEQ ID NO: 25161 - RNA, 22 nt, Homo sapiens
uacugaacagucauuauagacu

SEQ ID NO: 25162 - RNA, 19 nt, Homo sapiens
uagcuggcugcuggagcug

SEQ ID NO: 25163 - RNA, 22 nt, Homo sapiens
uauauaguaacuggaugcuagc

SEQ ID NO: 25164 - RNA, 21 nt, Homo sapiens
uauauauauauauauauauaa

SEQ ID NO: 25165 - RNA, 24 nt, Homo sapiens
uauauauauauauauauauaaaga

SEQ ID NO: 25166 - RNA, 24 nt, Human papillomavirus type 25
uauauauauauauauauauauaua

SEQ ID NO: 25167 - RNA, 19 nt, Homo sapiens
uauggcugcugugagggua

SEQ ID NO: 25168 - RNA, 19 nt, Homo sapiens
uauuccauuuugugugugu

SEQ ID NO: 25169 - RNA, 26 nt, Homo sapiens
ucagucuguacuugucucuuuaauuu

SEQ ID NO: 25170 - RNA, 24 nt, Homo sapiens
ucuuuuacaaacacgacuuaaaga

SEQ ID NO: 25171 - RNA, 17 nt, Homo sapiens
ugauauaaacagacuuu

SEQ ID NO: 25172 - RNA, 21 nt, Homo sapiens
ggacuggacauggcucacgga

SEQ ID NO: 25173 - RNA, 17 nt, Homo sapiens
ugccucagaacuuccag

SEQ ID NO: 25174 - RNA, 18 nt, Homo sapiens
gaccgggcgucuuccugc

SEQ ID NO: 25175 - RNA, 23 nt, Homo sapiens
guggaggucgggggcguggggac

SEQ ID NO: 25176 - RNA, 14 nt, Homo sapiens
uggaggucgggggc

SEQ ID NO: 25177 - RNA, 19 nt, Homo sapiens
uggggagcgaggaaugaaa

SEQ ID NO: 25178 - RNA, 24 nt, Homo sapiens
aggaaguagcucccaugguggcag

SEQ ID NO: 25179 - RNA, 19 nt, Homo sapiens
ggagcuggaggaagugcug

SEQ ID NO: 25180 - RNA, 19 nt, Homo sapiens
uuggagcuggaggaagugc

SEQ ID NO: 25181 - RNA, 20 nt, Homo sapiens
aaggcuaacuuggaaaagga

SEQ ID NO: 25182 - RNA, 21 nt, Homo sapiens
ggagaaaugaccauuguccac

SEQ ID NO: 25183 - RNA, 18 nt, Homo sapiens
ucaugcucaguaccacau

SEQ ID NO: 25184 - RNA, 15 nt, Homo sapiens
augcagaguccuuug

SEQ ID NO: 25185 - RNA, 17 nt, Homo sapiens
gcaagcagccagccagc

SEQ ID NO: 25186 - RNA, 23 nt, Homo sapiens
aaaaucaaaaccaaaaaaacaaa

SEQ ID NO: 25187 - RNA, 20 nt, Homo sapiens
acaaaagaaggagggggaac

SEQ ID NO: 25188 - RNA, 19 nt, Homo sapiens
agaaggagggggaacaaaa

SEQ ID NO: 25189 - RNA, 20 nt, Homo sapiens
ggccuuuucacgcaggugcu

SEQ ID NO: 25190 - RNA, 22 nt, Homo sapiens
uaaaauauucauuuauacuuuu

SEQ ID NO: 25191 - RNA, 20 nt, Homo sapiens
ucucagggccuuuucacgca

SEQ ID NO: 25192 - RNA, 18 nt, Homo sapiens
ucugggcccuuccagccu

SEQ ID NO: 25193 - RNA, 17 nt, Homo sapiens
ugcaggggucacagcag

SEQ ID NO: 25194 - RNA, 23 nt, Homo sapiens
ugugguaguucaaaacagugguc

SEQ ID NO: 25195 - RNA, 19 nt, Homo sapiens
aggcggcgguggccgcggg

SEQ ID NO: 25196 - RNA, 14 nt, Homo sapiens
gcggcgguggccgc

SEQ ID NO: 25197 - RNA, 18 nt, Homo sapiens
agccaguugucuuuucag

SEQ ID NO: 25198 - RNA, 15 nt, Homo sapiens
ugucccaaggcucca

SEQ ID NO: 25199 - RNA, 15 nt, Homo sapiens
ccccagccccucccu

SEQ ID NO: 25200 - RNA, 20 nt, Homo sapiens
gcggauagccugagccucag

SEQ ID NO: 25201 - RNA, 18 nt, Homo sapiens
gcuggggcuggugcagga

SEQ ID NO: 25202 - RNA, 20 nt, Homo sapiens
gcuggugcaggagccagggc

SEQ ID NO: 25203 - RNA, 18 nt, Homo sapiens
gggcuggugcaggagcca

SEQ ID NO: 25204 - RNA, 19 nt, Homo sapiens
ugcaggcagaggcuuccgg

SEQ ID NO: 25205 - RNA, 21 nt, Homo sapiens
ccgccgccugccgcuccgccc

SEQ ID NO: 25206 - RNA, 15 nt, Homo sapiens
ccugccgcuccgccc

SEQ ID NO: 25207 - RNA, 17 nt, Homo sapiens
gccgcgccgccgccgcc

SEQ ID NO: 25208 - RNA, 19 nt, Homo sapiens
gccugccgcuccgcccgcc

SEQ ID NO: 25209 - RNA, 18 nt, Homo sapiens
guguguaugcaugugugu

SEQ ID NO: 25210 - RNA, 20 nt, Homo sapiens
guguguguggggguuucauu

SEQ ID NO: 25211 - RNA, 16 nt, Homo sapiens
uggggguuucauucag

SEQ ID NO: 25212 - RNA, 21 nt, Homo sapiens
uguggcugugugugugugugu

SEQ ID NO: 25213 - RNA, 21 nt, Homo sapiens
uguguaugcaugugugugugu

SEQ ID NO: 25214 - RNA, 19 nt, Homo sapiens
uguguguggcugugugugu

SEQ ID NO: 25215 - RNA, 20 nt, Homo sapiens
uuuuauuuucucucuuucuu

SEQ ID NO: 25216 - RNA, 18 nt, Homo sapiens
ccagcaccuggcuggugu

SEQ ID NO: 25217 - RNA, 23 nt, Homo sapiens
ccgaauccgggcucuaaggagug

SEQ ID NO: 25218 - RNA, 20 nt, Homo sapiens
ccuuggugaggcagggcccc

SEQ ID NO: 25219 - RNA, 19 nt, Homo sapiens
gaggcagcaggcaccuagu

SEQ ID NO: 25220 - RNA, 24 nt, Homo sapiens
gggcuggcagggaaugguggcagc

SEQ ID NO: 25221 - RNA, 18 nt, Homo sapiens
ggggccagugggugagca

SEQ ID NO: 25222 - RNA, 21 nt, Homo sapiens
gggggcuggaggaggcuggag

SEQ ID NO: 25223 - RNA, 21 nt, Homo sapiens
uguccucuccccauagcuggu

SEQ ID NO: 25224 - RNA, 17 nt, Homo sapiens
ugugguuuacacgcagg

SEQ ID NO: 25225 - RNA, 19 nt, Homo sapiens
ugugguuuacacgcaggca

SEQ ID NO: 25226 - RNA, 20 nt, Homo sapiens
acgcuaugcagaggcacacg

SEQ ID NO: 25227 - RNA, 19 nt, Homo sapiens
aucggcagguuaaaugaau

SEQ ID NO: 25228 - RNA, 17 nt, Homo sapiens
caaacucauuauuugca

SEQ ID NO: 25229 - RNA, 14 nt, Homo sapiens
gccauuaaaaaaag

SEQ ID NO: 25230 - RNA, 16 nt, Homo sapiens
uccagcauuugcaaaa

SEQ ID NO: 25231 - RNA, 19 nt, Homo sapiens
uguauaucuuuagcugcca

SEQ ID NO: 25232 - RNA, 19 nt, Homo sapiens
aaaagauggugagugaagg

SEQ ID NO: 25233 - RNA, 22 nt, Homo sapiens
cagaaucaugaaucccuagagu

SEQ ID NO: 25234 - RNA, 16 nt, Homo sapiens
uggugagugaagggug

SEQ ID NO: 25235 - RNA, 18 nt, Homo sapiens
aauagcaguuaucaaaug

SEQ ID NO: 25236 - RNA, 15 nt, Homo sapiens
gcgguggcagcagca

SEQ ID NO: 25237 - RNA, 19 nt, Homo sapiens
gcugggggcggggcggcgg

SEQ ID NO: 25238 - RNA, 23 nt, Homo sapiens
gggaagggaggaacgccgggcac

SEQ ID NO: 25239 - RNA, 19 nt, Homo sapiens
gggggaagggaggaacgcc

SEQ ID NO: 25240 - RNA, 21 nt, Homo sapiens
uccaaaacaugguaccacugc

SEQ ID NO: 25241 - RNA, 20 nt, Homo sapiens
uuuuagcagguugguguuuu

SEQ ID NO: 25242 - RNA, 24 nt, Homo sapiens
gaugaugaugauaaugauaacugu

SEQ ID NO: 25243 - RNA, 25 nt, Homo sapiens
uugaaagcuuuaaauaaggauccuu

SEQ ID NO: 25244 - RNA, 18 nt, Homo sapiens
gcccucggugcauggcag

SEQ ID NO: 25245 - RNA, 20 nt, Homo sapiens
uuuauugagaagucuguugc

SEQ ID NO: 25246 - RNA, 15 nt, Homo sapiens
ggggaaagggucagg

SEQ ID NO: 25247 - RNA, 24 nt, Homo sapiens
uauucuauuagccaagugccaccu

SEQ ID NO: 25248 - RNA, 16 nt, Homo sapiens
aacaugggggagggcc

SEQ ID NO: 25249 - RNA, 19 nt, Homo sapiens
cgggcugggaggaguggga

SEQ ID NO: 25250 - RNA, 22 nt, Homo sapiens
ggagaggguggggggcccugac

SEQ ID NO: 25251 - RNA, 19 nt, Homo sapiens
uaaaacuaacucgaggcag

SEQ ID NO: 25252 - RNA, 17 nt, Homo sapiens
ugggaggagugggaggc

SEQ ID NO: 25253 - RNA, 22 nt, Homo sapiens
uggggcgggggugacccggggg

SEQ ID NO: 25254 - RNA, 23 nt, Homo sapiens
ugggggagggccugucccagagg

SEQ ID NO: 25255 - RNA, 22 nt, Homo sapiens
ugguucuucaggcagugguucu

SEQ ID NO: 25256 - RNA, 18 nt, Homo sapiens
agaaacaugcuggaaaga

SEQ ID NO: 25257 - RNA, 22 nt, Homo sapiens
ccugagcuucgccagaucuucc

SEQ ID NO: 25258 - RNA, 18 nt, Homo sapiens
uaccuugugaacauuucu

SEQ ID NO: 25259 - RNA, 22 nt, Homo sapiens
ugggguaccuugugaacauuuc

SEQ ID NO: 25260 - RNA, 16 nt, Homo sapiens
acgagcuggaugaggu

SEQ ID NO: 25261 - RNA, 19 nt, Homo sapiens
agaaggagcgggaagcaaa

SEQ ID NO: 25262 - RNA, 19 nt, Homo sapiens
aggguggggggcauccacu

SEQ ID NO: 25263 - RNA, 19 nt, Homo sapiens
aguggagguagaaaggagg

SEQ ID NO: 25264 - RNA, 18 nt, Homo sapiens
caaguggcucuuccugga

SEQ ID NO: 25265 - RNA, 23 nt, Homo sapiens
cacuugacagaugagugcacgga

SEQ ID NO: 25266 - RNA, 17 nt, Homo sapiens
cagcagaguccuggcag

SEQ ID NO: 25267 - RNA, 18 nt, Homo sapiens
cuugauaacugagaacuu

SEQ ID NO: 25268 - RNA, 19 nt, Homo sapiens
gacacgauucagcgcucaa

SEQ ID NO: 25269 - RNA, 22 nt, Homo sapiens
gaccaggugauuaaaaucuugu

SEQ ID NO: 25270 - RNA, 21 nt, Homo sapiens
gaggaaacacauucauaccgg

SEQ ID NO: 25271 - RNA, 19 nt, Homo sapiens
gaucagauaaucaaucagg

SEQ ID NO: 25272 - RNA, 20 nt, Homo sapiens
gccucuguuuguuucagagc

SEQ ID NO: 25273 - RNA, 18 nt, Homo sapiens
gcucaggcuuccuggccc

SEQ ID NO: 25274 - RNA, 22 nt, Homo sapiens
gcugcaaaggauucugggugcg

SEQ ID NO: 25275 - RNA, 18 nt, Homo sapiens
gggaugaggggggaaaga

SEQ ID NO: 25276 - RNA, 20 nt, Homo sapiens
gggccagggcagcccaaagg

SEQ ID NO: 25277 - RNA, 19 nt, Homo sapiens
gggcuggcagggugggggc

SEQ ID NO: 25278 - RNA, 21 nt, Homo sapiens
gggguggugcgggggcaggug

SEQ ID NO: 25279 - RNA, 16 nt, Homo sapiens
gguggugcgggggcag

SEQ ID NO: 25280 - RNA, 19 nt, Homo sapiens
uagagugccuauguaucaa

SEQ ID NO: 25281 - RNA, 19 nt, Homo sapiens
ucaaucauaccucaauaaa

SEQ ID NO: 25282 - RNA, 18 nt, Homo sapiens
ucuugugcaucagucucc

SEQ ID NO: 25283 - RNA, 17 nt, Homo sapiens
ugagacgagcugguuug

SEQ ID NO: 25284 - RNA, 18 nt, Homo sapiens
ugagauccaaacggucau

SEQ ID NO: 25285 - RNA, 17 nt, Homo sapiens
ugcaggacaacuguaua

SEQ ID NO: 25286 - RNA, 19 nt, Homo sapiens
ugcccugaccuuacauucc

SEQ ID NO: 25287 - RNA, 17 nt, Homo sapiens
ugccgaaugagguaguu

SEQ ID NO: 25288 - RNA, 21 nt, Homo sapiens
uggagaauguguuugcugugg

SEQ ID NO: 25289 - RNA, 21 nt, Homo sapiens
ugggaaaaaaauaaagaagga

SEQ ID NO: 25290 - RNA, 17 nt, Homo sapiens
ugggaaaaggugguggc

SEQ ID NO: 25291 - RNA, 19 nt, Homo sapiens
uugggggguccuaggagaa

SEQ ID NO: 25292 - RNA, 18 nt, Homo sapiens
uuuguuucagagcggcaa

SEQ ID NO: 25293 - RNA, 18 nt, Homo sapiens
augggcuucuuggccuuc

SEQ ID NO: 25294 - RNA, 16 nt, Homo sapiens
ccuccagcuccuccac

SEQ ID NO: 25295 - RNA, 15 nt, Homo sapiens
ccuugagccucagcc

SEQ ID NO: 25296 - RNA, 19 nt, Homo sapiens
cggcggcggcggcggcgga

SEQ ID NO: 25297 - RNA, 18 nt, Homo sapiens
cggcggcgguggcgcugc

SEQ ID NO: 25298 - RNA, 19 nt, Homo sapiens
cgguccucggggcuggggc

SEQ ID NO: 25299 - RNA, 17 nt, Homo sapiens
cuuccugcggggagggg

SEQ ID NO: 25300 - RNA, 18 nt, Homo sapiens
ggacgccuggaggcgccc

SEQ ID NO: 25301 - RNA, 18 nt, Homo sapiens
ggcgggccacagcggagg

SEQ ID NO: 25302 - RNA, 14 nt, Homo sapiens
ggcgguggcggggg

SEQ ID NO: 25303 - RNA, 20 nt, Homo sapiens
ggcgguggcggggguggggg

SEQ ID NO: 25304 - RNA, 21 nt, Homo sapiens
gggagaggcggggccuguggg

SEQ ID NO: 25305 - RNA, 24 nt, Homo sapiens
gggcagcggcggcgcaggcggggg

SEQ ID NO: 25306 - RNA, 20 nt, Homo sapiens
ggggaaggggcgggcgaugc

SEQ ID NO: 25307 - RNA, 17 nt, Homo sapiens
ggggaggggaggccggg

SEQ ID NO: 25308 - RNA, 18 nt, Homo sapiens
ggggcagcgggaggcgcu

SEQ ID NO: 25309 - RNA, 16 nt, Homo sapiens
ggggcggcggcggugg

SEQ ID NO: 25310 - RNA, 21 nt, Homo sapiens
gggggcggcggcgguggcgcu

SEQ ID NO: 25311 - RNA, 20 nt, Homo sapiens
ggugguggcgguggcggggg

SEQ ID NO: 25312 - RNA, 14 nt, Homo sapiens
guggcgguggcggg

SEQ ID NO: 25313 - RNA, 15 nt, Homo sapiens
guggcgguggcgggg

SEQ ID NO: 25314 - RNA, 18 nt, Homo sapiens
ucggggcuggggcuugcg

SEQ ID NO: 25315 - RNA, 18 nt, Homo sapiens
acgucaugaaaaggucua

SEQ ID NO: 25316 - RNA, 15 nt, Homo sapiens
agggauggacaacaa

SEQ ID NO: 25317 - RNA, 19 nt, Homo sapiens
gcaggcggggccagggggg

SEQ ID NO: 25318 - RNA, 16 nt, Homo sapiens
guguaaauguguaaau

SEQ ID NO: 25319 - RNA, 17 nt, Homo sapiens
ucuugaccuuuucccag

SEQ ID NO: 25320 - RNA, 16 nt, Homo sapiens
uucaaauguuccuuuc

SEQ ID NO: 25321 - RNA, 17 nt, Homo sapiens
gugcauacugccugcug

SEQ ID NO: 25322 - RNA, 19 nt, Homo sapiens
ucacauaaaguuuuauguu

SEQ ID NO: 25323 - RNA, 20 nt, Homo sapiens
ucauuggcuuucucuguggc

SEQ ID NO: 25324 - RNA, 17 nt, Homo sapiens
accaucagaacugaaac

SEQ ID NO: 25325 - RNA, 23 nt, Homo sapiens
agcaauugaaaagggugguagca

SEQ ID NO: 25326 - RNA, 20 nt, Homo sapiens
auuguuuuacuccuaagcaa

SEQ ID NO: 25327 - RNA, 15 nt, Homo sapiens
ccaaugucauaaaag

SEQ ID NO: 25328 - RNA, 20 nt, Homo sapiens
cggccccggcucccgcggcc

SEQ ID NO: 25329 - RNA, 22 nt, Homo sapiens
gcgcuccgugggcgcaggccgc

SEQ ID NO: 25330 - RNA, 21 nt, Homo sapiens
uaguuugucaguuaucauuga

SEQ ID NO: 25331 - RNA, 21 nt, Homo sapiens
uccgugggcgcaggccgcuuc

SEQ ID NO: 25332 - RNA, 18 nt, Homo sapiens
ugagggggcaaggguggc

SEQ ID NO: 25333 - RNA, 18 nt, Homo sapiens
uggccgagggcaucgugc

SEQ ID NO: 25334 - RNA, 22 nt, Homo sapiens
uuggcgauuaaacauaauccug

SEQ ID NO: 25335 - RNA, 22 nt, Homo sapiens
augcaaggcucaauaguuuucc

SEQ ID NO: 25336 - RNA, 22 nt, Homo sapiens
caccggguuggcggcgcgcccg

SEQ ID NO: 25337 - RNA, 14 nt, Homo sapiens
cagaggucaaguau

SEQ ID NO: 25338 - RNA, 20 nt, Homo sapiens
ccggguccggacggccgggc

SEQ ID NO: 25339 - RNA, 22 nt, Homo sapiens
cucuccgcuccccgagccucgg

SEQ ID NO: 25340 - RNA, 17 nt, Homo sapiens
gcuuucuccuggagccg

SEQ ID NO: 25341 - RNA, 17 nt, Homo sapiens
uccccgagccucggccc

SEQ ID NO: 25342 - RNA, 18 nt, Homo sapiens
cccggccgccgucuuccc

SEQ ID NO: 25343 - RNA, 14 nt, Homo sapiens
cucccggccgccgu

SEQ ID NO: 25344 - RNA, 18 nt, Homo sapiens
gggaagaggggaaugggc

SEQ ID NO: 25345 - RNA, 21 nt, Homo sapiens
uaaaaaagacacacaaaaaua

SEQ ID NO: 25346 - RNA, 20 nt, Homo sapiens
uacauuaccuguacacauaa

SEQ ID NO: 25347 - RNA, 17 nt, Homo sapiens
cuggggggagggugccg

SEQ ID NO: 25348 - RNA, 20 nt, Homo sapiens
ggcuggggagggcgugcggg

SEQ ID NO: 25349 - RNA, 19 nt, Homo sapiens
gggagggcgugcgggcggc

SEQ ID NO: 25350 - RNA, 16 nt, Homo sapiens
ggguuugcucgugugu

SEQ ID NO: 25351 - RNA, 18 nt, Homo sapiens
guuggacugugacauccc

SEQ ID NO: 25352 - RNA, 19 nt, Homo sapiens
ugcccuucaaaguggggcc

SEQ ID NO: 25353 - RNA, 19 nt, Homo sapiens
ugugauaauagacacuaua

SEQ ID NO: 25354 - RNA, 22 nt, Homo sapiens
uuggcagacacagcuguucaua

SEQ ID NO: 25355 - RNA, 21 nt, Homo sapiens
caucacaaaauacaaauguau

SEQ ID NO: 25356 - RNA, 15 nt, Homo sapiens
uaaaacaaguccacu

SEQ ID NO: 25357 - RNA, 22 nt, Homo sapiens
ucucuaaaauuaaaacaagucc

SEQ ID NO: 25358 - RNA, 18 nt, Homo sapiens
acacagccgcacacucac

SEQ ID NO: 25359 - RNA, 21 nt, Homo sapiens
aggagcggcggcggcccgagg

SEQ ID NO: 25360 - RNA, 18 nt, Homo sapiens
agggaaggggacugcuaa

SEQ ID NO: 25361 - RNA, 21 nt, Homo sapiens
agucguuugccugcuaaggag

SEQ ID NO: 25362 - RNA, 19 nt, Homo sapiens
auuuacaaguaauaauaua

SEQ ID NO: 25363 - RNA, 18 nt, Homo sapiens
cagcagcagcaggggccc

SEQ ID NO: 25364 - RNA, 18 nt, Homo sapiens
ccaggcuggggacagagc

SEQ ID NO: 25365 - RNA, 16 nt, Homo sapiens
gcggcggcggcccgag

SEQ ID NO: 25366 - RNA, 18 nt, Homo sapiens
gcugccccaccccgcgcg

SEQ ID NO: 25367 - RNA, 22 nt, Homo sapiens
ggcaggagagacaccgcuuggg

SEQ ID NO: 25368 - RNA, 18 nt, Homo sapiens
ggcaggagcggcggcggc

SEQ ID NO: 25369 - RNA, 18 nt, Homo sapiens
ggcaggcaggggagaggc

SEQ ID NO: 25370 - RNA, 17 nt, Homo sapiens
ggcuggcaggaagggaa

SEQ ID NO: 25371 - RNA, 18 nt, Homo sapiens
ggggagaggcugagggga

SEQ ID NO: 25372 - RNA, 16 nt, Homo sapiens
ggggcgcccgccgggg

SEQ ID NO: 25373 - RNA, 23 nt, Homo sapiens
gggggcugccccggcagcccuug

SEQ ID NO: 25374 - RNA, 17 nt, Homo sapiens
uaaauuuccaaugagaa

SEQ ID NO: 25375 - RNA, 16 nt, Homo sapiens
cggcgcgcacgggaac

SEQ ID NO: 25376 - RNA, 19 nt, Homo sapiens
aaaaaaaaaaaaaaaaagc

SEQ ID NO: 25377 - RNA, 19 nt, Homo sapiens
aaaacuaaaacacucuaaa

SEQ ID NO: 25378 - RNA, 18 nt, Homo sapiens
aaauagacauuuguagac

SEQ ID NO: 25379 - RNA, 16 nt, Homo sapiens
aguaagccaagauagu

SEQ ID NO: 25380 - RNA, 16 nt, Homo sapiens
uaaacuguacaaauac

SEQ ID NO: 25381 - RNA, 23 nt, Homo sapiens
ucuaaaaaaaaaaaaaaaaagcu

SEQ ID NO: 25382 - RNA, 18 nt, Homo sapiens
uuaaugccuauucagagu

SEQ ID NO: 25383 - RNA, 19 nt, Homo sapiens
uucgaagugucuauuuaaa

SEQ ID NO: 25384 - RNA, 20 nt, Homo sapiens
uuuugcauauuucuuccaga

SEQ ID NO: 25385 - RNA, 20 nt, Homo sapiens
cauguacagaaaaauaccca

SEQ ID NO: 25386 - RNA, 16 nt, Homo sapiens
ccaccaagaaaucucu

SEQ ID NO: 25387 - RNA, 15 nt, Homo sapiens
ugcuaaagcugagag

SEQ ID NO: 25388 - RNA, 18 nt, Homo sapiens
accccacccugcucucuc

SEQ ID NO: 25389 - RNA, 19 nt, Homo sapiens
acuaaagaaugccuacugc

SEQ ID NO: 25390 - RNA, 22 nt, Homo sapiens
cacagcacugaaauucucuaca

SEQ ID NO: 25391 - RNA, 18 nt, Homo sapiens
ccgcgagagugcgcggcg

SEQ ID NO: 25392 - RNA, 18 nt, Homo sapiens
ccuccgcccucucccagc

SEQ ID NO: 25393 - RNA, 18 nt, Homo sapiens
ccuuaccccacccugcuc

SEQ ID NO: 25394 - RNA, 18 nt, Homo sapiens
gagguaucauuauuccug

SEQ ID NO: 25395 - RNA, 20 nt, Homo sapiens
gcggcggagaggagcgggga

SEQ ID NO: 25396 - RNA, 18 nt, Homo sapiens
gcuccugggacagcagag

SEQ ID NO: 25397 - RNA, 18 nt, Homo sapiens
gggugggagguaucauua

SEQ ID NO: 25398 - RNA, 21 nt, Homo sapiens
uccgcccucucccagcgccgc

SEQ ID NO: 25399 - RNA, 19 nt, Homo sapiens
ugagagagggcggggaggc

SEQ ID NO: 25400 - RNA, 18 nt, Homo sapiens
uguucagcgacuuaacua

SEQ ID NO: 25401 - RNA, 19 nt, Homo sapiens
uuguguggucgggggcucc

SEQ ID NO: 25402 - RNA, 16 nt, Homo sapiens
caccagccagaccccc

SEQ ID NO: 25403 - RNA, 23 nt, Homo sapiens
cagccgcaccagcucugcccucc

SEQ ID NO: 25404 - RNA, 17 nt, Homo sapiens
gccuaccugggaaugcu

SEQ ID NO: 25405 - RNA, 22 nt, Homo sapiens
uaucugguaccaaagugugcaa

SEQ ID NO: 25406 - RNA, 20 nt, Homo sapiens
caauaggacagcacauaccu

SEQ ID NO: 25407 - RNA, 22 nt, Homo sapiens
ugccgaggauucgccugcgcca

SEQ ID NO: 25408 - RNA, 22 nt, Homo sapiens
gaggaccccaggguugcaagca

SEQ ID NO: 25409 - RNA, 20 nt, Homo sapiens
ugccccuucccaaggggcag

SEQ ID NO: 25410 - RNA, 19 nt, Homo sapiens
acaggagcuggugacgcgg

SEQ ID NO: 25411 - RNA, 21 nt, Homo sapiens
cuggguuggcggaggcugggg

SEQ ID NO: 25412 - RNA, 18 nt, Homo sapiens
ucauauggucccggaugc

SEQ ID NO: 25413 - RNA, 18 nt, Homo sapiens
ugaggagggcgggggugg

SEQ ID NO: 25414 - RNA, 15 nt, Homo sapiens
uggcauucauauggu

SEQ ID NO: 25415 - RNA, 14 nt, Homo sapiens
aagcaggucugggg

SEQ ID NO: 25416 - RNA, 21 nt, Homo sapiens
aggagugugggugauugucag

SEQ ID NO: 25417 - RNA, 17 nt, Homo sapiens
caccgugaauugcaggg

SEQ ID NO: 25418 - RNA, 16 nt, Homo sapiens
gaaggcuggacgugcu

SEQ ID NO: 25419 - RNA, 21 nt, Homo sapiens
gcacugagugugcuguugagg

SEQ ID NO: 25420 - RNA, 22 nt, Homo sapiens
ggaaaccuggggagggggaggg

SEQ ID NO: 25421 - RNA, 25 nt, Homo sapiens
guggggguggggcaccuccauggcc

SEQ ID NO: 25422 - RNA, 20 nt, Homo sapiens
ucaugaacggucugggaaca

SEQ ID NO: 25423 - RNA, 20 nt, Homo sapiens
ucgcuggguggugggucugg

SEQ ID NO: 25424 - RNA, 17 nt, Homo sapiens
ugagaggaagaagacau

SEQ ID NO: 25425 - RNA, 19 nt, Homo sapiens
ugcacugagugugcuguug

SEQ ID NO: 25426 - RNA, 19 nt, Homo sapiens
ugcaggagaggugggaagg

SEQ ID NO: 25427 - RNA, 17 nt, Homo sapiens
ugucaggugugggggug

SEQ ID NO: 25428 - RNA, 17 nt, Homo sapiens
acggaggagacagaggc

SEQ ID NO: 25429 - RNA, 21 nt, Homo sapiens
gccgcggcgggcaguaagcug

SEQ ID NO: 25430 - RNA, 21 nt, Homo sapiens
ggaggagacagaggcgauggu

SEQ ID NO: 25431 - RNA, 23 nt, Homo sapiens
ggagugacucgacuccgccuccg

SEQ ID NO: 25432 - RNA, 26 nt, Homo sapiens
accgccuggccagccacagcucgggg

SEQ ID NO: 25433 - RNA, 19 nt, Homo sapiens
acgccgcugcccggcggcg

SEQ ID NO: 25434 - RNA, 21 nt, Homo sapiens
agauguaguuaggaaauuuca

SEQ ID NO: 25435 - RNA, 19 nt, Homo sapiens
agggcacgccgcugcccgg

SEQ ID NO: 25436 - RNA, 19 nt, Homo sapiens
caguggugcacgaucacau

SEQ ID NO: 25437 - RNA, 19 nt, Homo sapiens
cccggcggcggcucgcucc

SEQ ID NO: 25438 - RNA, 18 nt, Homo sapiens
cggcgcccucucccccga

SEQ ID NO: 25439 - RNA, 26 nt, Homo sapiens
cggcgccuccguggccgcgccgcucg

SEQ ID NO: 25440 - RNA, 21 nt, Homo sapiens
cgggcagcaacggcggcggcg

SEQ ID NO: 25441 - RNA, 20 nt, Homo sapiens
gcgcccucgccgccgcgccg

SEQ ID NO: 25442 - RNA, 22 nt, Homo sapiens
gcgggaagggacggagcuuccu

SEQ ID NO: 25443 - RNA, 21 nt, Homo sapiens
uaaguuacaaaauagagucaa

SEQ ID NO: 25444 - RNA, 19 nt, Homo sapiens
uacuggauuuaaagugcag

SEQ ID NO: 25445 - RNA, 19 nt, Homo sapiens
uauggucacauuuugguuu

SEQ ID NO: 25446 - RNA, 16 nt, Homo sapiens
ucuccucucccuucga

SEQ ID NO: 25447 - RNA, 19 nt, Homo sapiens
uuaggaaauuucagugugu

SEQ ID NO: 25448 - RNA, 21 nt, Homo sapiens
aaggaucauuuauuaaacaca

SEQ ID NO: 25449 - RNA, 17 nt, Homo sapiens
augguuuauucuugaua

SEQ ID NO: 25450 - RNA, 18 nt, Homo sapiens
cauaguuugcucuugaua

SEQ ID NO: 25451 - RNA, 22 nt, Homo sapiens
aaaauguuacuucuucuaagaa

SEQ ID NO: 25452 - RNA, 17 nt, Homo sapiens
augacauugguguggaa

SEQ ID NO: 25453 - RNA, 18 nt, Homo sapiens
cccuggagcccagggcag

SEQ ID NO: 25454 - RNA, 18 nt, Homo sapiens
ucaguuaggcaaucccug

SEQ ID NO: 25455 - RNA, 23 nt, Homo sapiens
ucuaaucuuauuucagguuagug

SEQ ID NO: 25456 - RNA, 18 nt, Homo sapiens
uuggagaacucaaaaacu

SEQ ID NO: 25457 - RNA, 21 nt, Homo sapiens
aaggggaagugucuuggggac

SEQ ID NO: 25458 - RNA, 18 nt, Homo sapiens
aaugugaugugugagaga

SEQ ID NO: 25459 - RNA, 15 nt, Homo sapiens
accccagggccgacg

SEQ ID NO: 25460 - RNA, 17 nt, Homo sapiens
cacgcccuacuuugccc

SEQ ID NO: 25461 - RNA, 17 nt, Homo sapiens
gacugugugguggugcu

SEQ ID NO: 25462 - RNA, 17 nt, Homo sapiens
gugaaaagccagcauga

SEQ ID NO: 25463 - RNA, 27 nt, Homo sapiens
ugccucugaacacccuccccuuccccg

SEQ ID NO: 25464 - RNA, 24 nt, Homo sapiens
uguguccucuggggugaaaagcca

SEQ ID NO: 25465 - RNA, 22 nt, Homo sapiens
ccgggcuggggcuggguccggc

SEQ ID NO: 25466 - RNA, 18 nt, Homo sapiens
gcucuggggcggggcggc

SEQ ID NO: 25467 - RNA, 20 nt, Homo sapiens
ggcuggggccgggcuggggc

SEQ ID NO: 25468 - RNA, 24 nt, Homo sapiens
ggcuggggccgggcuggggcuggg

SEQ ID NO: 25469 - RNA, 22 nt, Homo sapiens
gggcuggguccggguccgagga

SEQ ID NO: 25470 - RNA, 18 nt, Homo sapiens
ggggcuggcuggggccgg

SEQ ID NO: 25471 - RNA, 16 nt, Homo sapiens
ucaggaggcugagaug

SEQ ID NO: 25472 - RNA, 20 nt, Homo sapiens
uucccacauaacaauauuuu

SEQ ID NO: 25473 - RNA, 21 nt, Homo sapiens
uuccuguuuuucggcggcugc

SEQ ID NO: 25474 - RNA, 18 nt, Homo sapiens
uuuuaugaccuuaagaca

SEQ ID NO: 25475 - RNA, 18 nt, Homo sapiens
cccucagcaaaccuucug

SEQ ID NO: 25476 - RNA, 19 nt, Homo sapiens
uacgagaagugcuugaacc

SEQ ID NO: 25477 - RNA, 19 nt, Homo sapiens
ugggugugguggugccugu

SEQ ID NO: 25478 - RNA, 20 nt, Homo sapiens
cagccucccaggaccccggc

SEQ ID NO: 25479 - RNA, 19 nt, Homo sapiens
cccggcggugggggcccgg

SEQ ID NO: 25480 - RNA, 17 nt, Homo sapiens
ccgcccccgggccccgc

SEQ ID NO: 25481 - RNA, 22 nt, Homo sapiens
ccgccgccgccgaucccggccg

SEQ ID NO: 25482 - RNA, 19 nt, Homo sapiens
ccgcucgcccgccagcccc

SEQ ID NO: 25483 - RNA, 18 nt, Homo sapiens
ccggccgcccgcucgccc

SEQ ID NO: 25484 - RNA, 17 nt, Homo sapiens
ccgggccccgcgucgcc

SEQ ID NO: 25485 - RNA, 17 nt, Homo sapiens
cgcucgccgccgccgcc

SEQ ID NO: 25486 - RNA, 19 nt, Homo sapiens
gcccgcucgcccgccagcc

SEQ ID NO: 25487 - RNA, 25 nt, Homo sapiens
gcucgcccgccagccccgcggaacc

SEQ ID NO: 25488 - RNA, 19 nt, Homo sapiens
aaaauaccuuacauccguu

SEQ ID NO: 25489 - RNA, 25 nt, Homo sapiens
aacaauuuuaauaauaccaagauuu

SEQ ID NO: 25490 - RNA, 18 nt, Homo sapiens
aaguugcaguuccauugc

SEQ ID NO: 25491 - RNA, 21 nt, Homo sapiens
aauugcacuucuguccuuuag

SEQ ID NO: 25492 - RNA, 14 nt, Homo sapiens
aggaagcaagcagg

SEQ ID NO: 25493 - RNA, 17 nt, Homo sapiens
caaaauauucuugcaag

SEQ ID NO: 25494 - RNA, 19 nt, Homo sapiens
caauaucacuugcaguguu

SEQ ID NO: 25495 - RNA, 23 nt, Homo sapiens
cagcgcucuaggcaauggggaga

SEQ ID NO: 25496 - RNA, 18 nt, Homo sapiens
caucgcucccaucccucg

SEQ ID NO: 25497 - RNA, 18 nt, Homo sapiens
ccagcgggcccccacgcc

SEQ ID NO: 25498 - RNA, 19 nt, Homo sapiens
ccccaagggaggaaauuca

SEQ ID NO: 25499 - RNA, 20 nt, Homo sapiens
cuuaugcucagauaugacua

SEQ ID NO: 25500 - RNA, 17 nt, Homo sapiens
gagcggggguugccuuc

SEQ ID NO: 25501 - RNA, 22 nt, Homo sapiens
ggacaaaaggggaggggauggc

SEQ ID NO: 25502 - RNA, 18 nt, Homo sapiens
ggggaaaaaagguacugc

SEQ ID NO: 25503 - RNA, 17 nt, Homo sapiens
gggggcggcaggagcgg

SEQ ID NO: 25504 - RNA, 19 nt, Homo sapiens
uacaaaaucauuguguuga

SEQ ID NO: 25505 - RNA, 20 nt, Homo sapiens
uauucugccguuacaccucc

SEQ ID NO: 25506 - RNA, 20 nt, Homo sapiens
ucaaaucuagcugagaacac

SEQ ID NO: 25507 - RNA, 19 nt, Homo sapiens
ucaauuguaguaagugugc

SEQ ID NO: 25508 - RNA, 19 nt, Homo sapiens
ucacuuucagaguugaaac

SEQ ID NO: 25509 - RNA, 19 nt, Homo sapiens
ucccggcgcggcgccccga

SEQ ID NO: 25510 - RNA, 16 nt, Homo sapiens
ucggcgcagccccggg

SEQ ID NO: 25511 - RNA, 16 nt, Homo sapiens
ucuggacuguuuuuga

SEQ ID NO: 25512 - RNA, 14 nt, Homo sapiens
ugaaugcugccugu

SEQ ID NO: 25513 - RNA, 19 nt, Homo sapiens
ugaggcuuccaaugugcaa

SEQ ID NO: 25514 - RNA, 21 nt, Homo sapiens
uggggcacaguggaguccuuc

SEQ ID NO: 25515 - RNA, 18 nt, Homo sapiens
uguaggguuucccuccug

SEQ ID NO: 25516 - RNA, 22 nt, Homo sapiens
uucaucauagggaucuuagaug

SEQ ID NO: 25517 - RNA, 21 nt, Homo sapiens
uuuaaaagcacuuuagccauc

SEQ ID NO: 25518 - RNA, 19 nt, Homo sapiens
uuuaaaaguuuuuuuguag

SEQ ID NO: 25519 - RNA, 19 nt, Homo sapiens
uuugauuucucgaaauuuu

SEQ ID NO: 25520 - RNA, 21 nt, Homo sapiens
aacauauaccaguuaugggag

SEQ ID NO: 25521 - RNA, 17 nt, Homo sapiens
aacaugacccuugaaau

SEQ ID NO: 25522 - RNA, 19 nt, Homo sapiens
aagaggcguuuucuaagga

SEQ ID NO: 25523 - RNA, 20 nt, Homo sapiens
auaucauuuaaguacaauuu

SEQ ID NO: 25524 - RNA, 18 nt, Homo sapiens
ccuugcugugcaggcacc

SEQ ID NO: 25525 - RNA, 20 nt, Homo sapiens
gcaagucauucuugguaaca

SEQ ID NO: 25526 - RNA, 23 nt, Homo sapiens
aagggcacugggggaagggcugc

SEQ ID NO: 25527 - RNA, 18 nt, Homo sapiens
caccacuagcacccugcc

SEQ ID NO: 25528 - RNA, 24 nt, Homo sapiens
ccaucccugcucauuucccagacc

SEQ ID NO: 25529 - RNA, 19 nt, Homo sapiens
ccccucccagucccuuccc

SEQ ID NO: 25530 - RNA, 18 nt, Homo sapiens
ggccaggaggcacauucc

SEQ ID NO: 25531 - RNA, 21 nt, Homo sapiens
ggggaagggcugcuuuggggg

SEQ ID NO: 25532 - RNA, 18 nt, Homo sapiens
uauuuauugucuguagug

SEQ ID NO: 25533 - RNA, 21 nt, Homo sapiens
uccccuuuccccucccaucuc

SEQ ID NO: 25534 - RNA, 21 nt, Homo sapiens
ucugaagcaggggacaaagcu

SEQ ID NO: 25535 - RNA, 23 nt, Homo sapiens
ugggguggagaaggagccccaga

SEQ ID NO: 25536 - RNA, 17 nt, Homo sapiens
uucugcauagaccuuuc

SEQ ID NO: 25537 - RNA, 17 nt, Homo sapiens
aggcagacagaugcagg

SEQ ID NO: 25538 - RNA, 18 nt, Homo sapiens
ggccuggcaggggucagc

SEQ ID NO: 25539 - RNA, 16 nt, Homo sapiens
uaccccuccccauuug

SEQ ID NO: 25540 - RNA, 16 nt, Homo sapiens
ucaggaaguggcccug

SEQ ID NO: 25541 - RNA, 16 nt, Homo sapiens
ucuggagaacagauuu

SEQ ID NO: 25542 - RNA, 24 nt, Homo sapiens
caaaugagucggaguuguagaaaa

SEQ ID NO: 25543 - RNA, 17 nt, Homo sapiens
uggacgcgcggcuuggc

SEQ ID NO: 25544 - RNA, 18 nt, Homo sapiens
uaaccuuaguuuccaagu

SEQ ID NO: 25545 - RNA, 15 nt, Homo sapiens
ugugagccaggccuu

SEQ ID NO: 25546 - RNA, 21 nt, Homo sapiens
agaugggauuucaucauguug

SEQ ID NO: 25547 - RNA, 24 nt, Homo sapiens
agcgaggccuugcgcagcgugucc

SEQ ID NO: 25548 - RNA, 20 nt, Homo sapiens
cauucuguacuucucuugac

SEQ ID NO: 25549 - RNA, 25 nt, Homo sapiens
gcccgccucguccgcccgcccgacc

SEQ ID NO: 25550 - RNA, 18 nt, Homo sapiens
ucgcgucccggccgcagg

SEQ ID NO: 25551 - RNA, 15 nt, Homo sapiens
ucguccgcccgcccg

SEQ ID NO: 25552 - RNA, 19 nt, Homo sapiens
cuucugccccaggccuuuc

SEQ ID NO: 25553 - RNA, 15 nt, Homo sapiens
ggccugugagcaucu

SEQ ID NO: 25554 - RNA, 19 nt, Homo sapiens
ggggggaaggggagaaagc

SEQ ID NO: 25555 - RNA, 18 nt, Homo sapiens
ugagaaggaguugggcuc

SEQ ID NO: 25556 - RNA, 19 nt, Homo sapiens
ugaggcccuuguaguuacc

SEQ ID NO: 25557 - RNA, 15 nt, Homo sapiens
uggccaccgcgcggc

SEQ ID NO: 25558 - RNA, 18 nt, Homo sapiens
uggcguugaugggcugcu

SEQ ID NO: 25559 - RNA, 18 nt, Homo sapiens
uucaugaguuugucaugc

SEQ ID NO: 25560 - RNA, 16 nt, Homo sapiens
uccaauguccucuucu

SEQ ID NO: 25561 - RNA, 17 nt, Homo sapiens
ugacaaagauuuucaca

SEQ ID NO: 25562 - RNA, 21 nt, Homo sapiens
ugcauuucuuuggucaccuuu

SEQ ID NO: 25563 - RNA, 22 nt, Homo sapiens
ccccgcgcacgaugccgugucc

SEQ ID NO: 25564 - RNA, 17 nt, Homo sapiens
cggcgccugcugcgugc

SEQ ID NO: 25565 - RNA, 19 nt, Homo sapiens
uguccaggcucugucccuc

SEQ ID NO: 25566 - RNA, 18 nt, Homo sapiens
cccccgcucccggcugcc

SEQ ID NO: 25567 - RNA, 20 nt, Homo sapiens
cccggcugccuccuuggccc

SEQ ID NO: 25568 - RNA, 18 nt, Homo sapiens
cucucgagauacacucgc

SEQ ID NO: 25569 - RNA, 16 nt, Homo sapiens
gcucccggcugccucc

SEQ ID NO: 25570 - RNA, 19 nt, Homo sapiens
ggccccacucgcccgcggc

SEQ ID NO: 25571 - RNA, 17 nt, Homo sapiens
ggcugcaccgcggucug

SEQ ID NO: 25572 - RNA, 19 nt, Homo sapiens
gcggcaguggcggcgaccc

SEQ ID NO: 25573 - RNA, 17 nt, Homo sapiens
gcugcgccgccguggcc

SEQ ID NO: 25574 - RNA, 14 nt, Homo sapiens
caccccagaacuca

SEQ ID NO: 25575 - RNA, 19 nt, Homo sapiens
gaggcugugguugggaggc

SEQ ID NO: 25576 - RNA, 16 nt, Homo sapiens
gcggccguucucucgg

SEQ ID NO: 25577 - RNA, 18 nt, Homo sapiens
ggcggccguucucucggg

SEQ ID NO: 25578 - RNA, 17 nt, Homo sapiens
guaacauauauauagca

SEQ ID NO: 25579 - RNA, 18 nt, Homo sapiens
guuauuugguucuagcaa

SEQ ID NO: 25580 - RNA, 18 nt, Homo sapiens
uaccuuauuuaauaaucc

SEQ ID NO: 25581 - RNA, 16 nt, Homo sapiens
ugcccucgaauuggcc

SEQ ID NO: 25582 - RNA, 20 nt, Homo sapiens
ugggaggcgggauaggcuug

SEQ ID NO: 25583 - RNA, 20 nt, Homo sapiens
caggaagucaagaguucugc

SEQ ID NO: 25584 - RNA, 20 nt, Homo sapiens
aggcagagguugcggugagc

SEQ ID NO: 25585 - RNA, 21 nt, Homo sapiens
aucaugccauugcacuccagc

SEQ ID NO: 25586 - RNA, 18 nt, Homo sapiens
caaaaccuuaaagacugg

SEQ ID NO: 25587 - RNA, 18 nt, Homo sapiens
gagacugaggcaggagga

SEQ ID NO: 25588 - RNA, 19 nt, Homo sapiens
ggagacugaggcaggagga

SEQ ID NO: 25589 - RNA, 17 nt, Homo sapiens
gguuguuuucuccuugg

SEQ ID NO: 25590 - RNA, 16 nt, Homo sapiens
ugcaccgucccucccc

SEQ ID NO: 25591 - RNA, 23 nt, Homo sapiens
uggagagagaggaagaaaguuuu

SEQ ID NO: 25592 - RNA, 25 nt, Homo sapiens
uggagagagaggaagaaaguuuuuc

SEQ ID NO: 25593 - RNA, 17 nt, Homo sapiens
aacggccggcgcacuca

SEQ ID NO: 25594 - RNA, 18 nt, Homo sapiens
aggcagggggcggcggcc

SEQ ID NO: 25595 - RNA, 16 nt, Homo sapiens
agggaggggggcgcgg

SEQ ID NO: 25596 - RNA, 21 nt, Homo sapiens
ggcgcggcuguuccuaaccuc

SEQ ID NO: 25597 - RNA, 19 nt, Homo sapiens
uggcggugggcggccaagg

SEQ ID NO: 25598 - RNA, 21 nt, Homo sapiens
agccagacccgcuaagccuag

SEQ ID NO: 25599 - RNA, 17 nt, Homo sapiens
aguaagcacauggacaa

SEQ ID NO: 25600 - RNA, 19 nt, Homo sapiens
cagcugugguaggccaggg

SEQ ID NO: 25601 - RNA, 21 nt, Homo sapiens
cuguggcggcuucggguccga

SEQ ID NO: 25602 - RNA, 22 nt, Homo sapiens
gaggacccaggccacacgggca

SEQ ID NO: 25603 - RNA, 17 nt, Homo sapiens
gcgguggcggcggcggc

SEQ ID NO: 25604 - RNA, 18 nt, Homo sapiens
gugggcacagggucauag

SEQ ID NO: 25605 - RNA, 21 nt, Homo sapiens
uccgcgcucgguccgcggugg

SEQ ID NO: 25606 - RNA, 18 nt, Homo sapiens
ucugccuuggcagggugg

SEQ ID NO: 25607 - RNA, 25 nt, Homo sapiens
aggggagugggguccccugaguggg

SEQ ID NO: 25608 - RNA, 21 nt, Homo sapiens
ggccaugggaaggccucuucc

SEQ ID NO: 25609 - RNA, 21 nt, Homo sapiens
uggggucgccgauucgcgcag

SEQ ID NO: 25610 - RNA, 18 nt, Homo sapiens
uguggggcugauguggcc

SEQ ID NO: 25611 - RNA, 21 nt, Homo sapiens
uugcauaguuagucacaccuc

SEQ ID NO: 25612 - RNA, 17 nt, Homo sapiens
acauuagguucagguga

SEQ ID NO: 25613 - RNA, 17 nt, Homo sapiens
agucggggggauggggc

SEQ ID NO: 25614 - RNA, 18 nt, Homo sapiens
cacaggagccugugcggg

SEQ ID NO: 25615 - RNA, 17 nt, Homo sapiens
cagccucccucuuuccc

SEQ ID NO: 25616 - RNA, 22 nt, Homo sapiens
cagcuugaagggaucuggggcu

SEQ ID NO: 25617 - RNA, 22 nt, Homo sapiens
caugugcaggaagggggacgcg

SEQ ID NO: 25618 - RNA, 20 nt, Homo sapiens
cgggggccagcacgcaucgc

SEQ ID NO: 25619 - RNA, 19 nt, Homo sapiens
gagcagccagcugcaggcc

SEQ ID NO: 25620 - RNA, 15 nt, Homo sapiens
gcaggccuggcuccu

SEQ ID NO: 25621 - RNA, 18 nt, Homo sapiens
ggccgggggcgcgguggc

SEQ ID NO: 25622 - RNA, 15 nt, Homo sapiens
gggagaacaggagga

SEQ ID NO: 25623 - RNA, 23 nt, Homo sapiens
ggggcccaccaagcugcgcuucg

SEQ ID NO: 25624 - RNA, 15 nt, Homo sapiens
ugagcuggcacagac

SEQ ID NO: 25625 - RNA, 19 nt, Homo sapiens
ccgccgccuccgcuggccc

SEQ ID NO: 25626 - RNA, 15 nt, Homo sapiens
gugcgcuccgccgcc

SEQ ID NO: 25627 - RNA, 21 nt, Homo sapiens
ucggggcugugcaggaccggg

SEQ ID NO: 25628 - RNA, 19 nt, Homo sapiens
gccuggggaccgcgccccc

SEQ ID NO: 25629 - RNA, 19 nt, Homo sapiens
ccguugaccacggcuggga

SEQ ID NO: 25630 - RNA, 16 nt, Homo sapiens
gguggccugcguggca

SEQ ID NO: 25631 - RNA, 19 nt, Homo sapiens
gcaggaaagaaguuucuga

SEQ ID NO: 25632 - RNA, 18 nt, Homo sapiens
ugaaggaccuggagcaag

SEQ ID NO: 25633 - RNA, 21 nt, Homo sapiens
ugaaggaccuggagcgccuug

SEQ ID NO: 25634 - RNA, 21 nt, Homo sapiens
aaccgcccaaccggucacagg

SEQ ID NO: 25635 - RNA, 22 nt, Homo sapiens
cgaggaggcgcgggacgcguga

SEQ ID NO: 25636 - RNA, 18 nt, Homo sapiens
acagcagccuucccuuug

SEQ ID NO: 25637 - RNA, 26 nt, Homo sapiens
agagggaacagggugcuugggugucc

SEQ ID NO: 25638 - RNA, 19 nt, Homo sapiens
aggagagggaaucucaucu

SEQ ID NO: 25639 - RNA, 20 nt, Homo sapiens
ccugucgggcuggggccaca

SEQ ID NO: 25640 - RNA, 25 nt, Homo sapiens
gaacagggugcuugaagguggggga

SEQ ID NO: 25641 - RNA, 18 nt, Homo sapiens
uacacagaugcuuauuug

SEQ ID NO: 25642 - RNA, 23 nt, Homo sapiens
uccacgcaaucuacacauggucg

SEQ ID NO: 25643 - RNA, 17 nt, Homo sapiens
ugacaggcucaagcugc

SEQ ID NO: 25644 - RNA, 23 nt, Homo sapiens
uggcaacaugcacuggaagcucc

SEQ ID NO: 25645 - RNA, 23 nt, Homo sapiens
uucccuuugucgggguccacgca

SEQ ID NO: 25646 - RNA, 15 nt, Homo sapiens
uuuccagacaccgga

SEQ ID NO: 25647 - RNA, 19 nt, Homo sapiens
aagcgagggggggccgagg

SEQ ID NO: 25648 - RNA, 22 nt, Homo sapiens
aagugggaggagggaagcgagg

SEQ ID NO: 25649 - RNA, 19 nt, Homo sapiens
aggcggagguggcgccgcc

SEQ ID NO: 25650 - RNA, 24 nt, Homo sapiens
agguggagggaggaccggcggccg

SEQ ID NO: 25651 - RNA, 25 nt, Homo sapiens
agugggaggagggaagcgagggggg

SEQ ID NO: 25652 - RNA, 19 nt, Homo sapiens
cacaugggaacuacauuuu

SEQ ID NO: 25653 - RNA, 16 nt, Homo sapiens
ccgcgggccgggagcg

SEQ ID NO: 25654 - RNA, 20 nt, Homo sapiens
gccgccgccgcgggccggga

SEQ ID NO: 25655 - RNA, 20 nt, Homo sapiens
gcgccgccgccgccgcgggg

SEQ ID NO: 25656 - RNA, 19 nt, Homo sapiens
ggaacuacauuuuguuccu

SEQ ID NO: 25657 - RNA, 18 nt, Homo sapiens
gggaagcgagggggggcc

SEQ ID NO: 25658 - RNA, 21 nt, Homo sapiens
gggaaggcugagccgggcgcc

SEQ ID NO: 25659 - RNA, 18 nt, Homo sapiens
uacaauaagcuucaaagg

SEQ ID NO: 25660 - RNA, 19 nt, Homo sapiens
uggcgccgccgccgccgcg

SEQ ID NO: 25661 - RNA, 19 nt, Homo sapiens
uuuaagaauaaaaguaaaa

SEQ ID NO: 25662 - RNA, 21 nt, Homo sapiens
uuuauuauuuacauaauacaa

SEQ ID NO: 25663 - RNA, 18 nt, Homo sapiens
agcauaggucaguaauug

SEQ ID NO: 25664 - RNA, 17 nt, Homo sapiens
cgcgagcccagacgcgg

SEQ ID NO: 25665 - RNA, 19 nt, Homo sapiens
cuuuaauaaaaaaauccca

SEQ ID NO: 25666 - RNA, 17 nt, Homo sapiens
gcccucccucauuggcu

SEQ ID NO: 25667 - RNA, 18 nt, Homo sapiens
agcuacaaggaggguggu

SEQ ID NO: 25668 - RNA, 21 nt, Homo sapiens
caaggagggugguuaaucugc

SEQ ID NO: 25669 - RNA, 16 nt, Homo sapiens
ccaugccacacacgug

SEQ ID NO: 25670 - RNA, 15 nt, Homo sapiens
gcccacaagccccuc

SEQ ID NO: 25671 - RNA, 18 nt, Homo sapiens
guuaacuauaaucacauu

SEQ ID NO: 25672 - RNA, 17 nt, Homo sapiens
ugagcagggcugaguug

SEQ ID NO: 25673 - RNA, 15 nt, Homo sapiens
ugccggaccccuccc

SEQ ID NO: 25674 - RNA, 17 nt, Homo sapiens
uggauugguaagaauca

SEQ ID NO: 25675 - RNA, 15 nt, Homo sapiens
uggcacaccgaaggg

SEQ ID NO: 25676 - RNA, 19 nt, Homo sapiens
ugggagccacaggcugggg

SEQ ID NO: 25677 - RNA, 21 nt, Homo sapiens
acaugaaugugugucagggaa

SEQ ID NO: 25678 - RNA, 20 nt, Homo sapiens
agcuuaccuuucacugucuu

SEQ ID NO: 25679 - RNA, 19 nt, Homo sapiens
agguacaauagugcuagca

SEQ ID NO: 25680 - RNA, 24 nt, Homo sapiens
cagcagcuauuuaaaauaagacag

SEQ ID NO: 25681 - RNA, 17 nt, Homo sapiens
ccuuucacugucuucua

SEQ ID NO: 25682 - RNA, 21 nt, Homo sapiens
uagcuuaaguuucuccgcucu

SEQ ID NO: 25683 - RNA, 25 nt, Homo sapiens
ugcaaguaaaacaaacagcuguacc

SEQ ID NO: 25684 - RNA, 18 nt, Homo sapiens
caaauuuagggaccaaac

SEQ ID NO: 25685 - RNA, 19 nt, Homo sapiens
caagaucucucucucucuu

SEQ ID NO: 25686 - RNA, 19 nt, Homo sapiens
cuucauugcugaucacuuu

SEQ ID NO: 25687 - RNA, 23 nt, Homo sapiens
uaaaaaaguaaaaaacaaaaaua

SEQ ID NO: 25688 - RNA, 22 nt, Homo sapiens
uguaaacugguguguguucagc

SEQ ID NO: 25689 - RNA, 21 nt, Homo sapiens
uuugucagauggaguuacgca

SEQ ID NO: 25690 - RNA, 24 nt, Homo sapiens
gggcugcuccaaccuccugcccug

SEQ ID NO: 25691 - RNA, 22 nt, Homo sapiens
ccuuugcuccaaguaauuuuug

SEQ ID NO: 25692 - RNA, 22 nt, Homo sapiens
cuaccauauaguuauaauuaua

SEQ ID NO: 25693 - RNA, 22 nt, Homo sapiens
ucuauauauaaauguuucaaau

SEQ ID NO: 25694 - RNA, 21 nt, Homo sapiens
uuuaaacauuuacuuugccaa

SEQ ID NO: 25695 - RNA, 17 nt, Homo sapiens
aacauugaaauaauccu

SEQ ID NO: 25696 - RNA, 18 nt, Homo sapiens
ggagaaaguuacgcaggc

SEQ ID NO: 25697 - RNA, 24 nt, Homo sapiens
gugguuuuuuuuuuuuuuuuuuac

SEQ ID NO: 25698 - RNA, 24 nt, Homo sapiens
cagggacuucaaauugaucagauu

SEQ ID NO: 25699 - RNA, 17 nt, Homo sapiens
uaguaagaauggcugag

SEQ ID NO: 25700 - RNA, 19 nt, Homo sapiens
ugagcggagccgauugcgg

SEQ ID NO: 25701 - RNA, 20 nt, Homo sapiens
acagcuaccugauggggauu

SEQ ID NO: 25702 - RNA, 16 nt, Homo sapiens
aggugggguggggcag

SEQ ID NO: 25703 - RNA, 22 nt, Homo sapiens
caaacaccugcggcgucccgcu

SEQ ID NO: 25704 - RNA, 18 nt, Homo sapiens
cacuguuugacauucagc

SEQ ID NO: 25705 - RNA, 18 nt, Homo sapiens
caggagcccaugggggcu

SEQ ID NO: 25706 - RNA, 20 nt, Homo sapiens
cauguggucccacugggggc

SEQ ID NO: 25707 - RNA, 25 nt, Homo sapiens
ccaccugugugugugugugugugua

SEQ ID NO: 25708 - RNA, 16 nt, Homo sapiens
cccauagugugugugu

SEQ ID NO: 25709 - RNA, 29 nt, Homo sapiens
ccccauaguguguguguuugugccuuugc

SEQ ID NO: 25710 - RNA, 19 nt, Homo sapiens
ccucccccuccucccaguc

SEQ ID NO: 25711 - RNA, 18 nt, Homo sapiens
cggcggcggcggcggcgg

SEQ ID NO: 25712 - RNA, 19 nt, Homo sapiens
cggcggcgggguugggggg

SEQ ID NO: 25713 - RNA, 18 nt, Homo sapiens
cuucaaacuggccaucuc

SEQ ID NO: 25714 - RNA, 18 nt, Homo sapiens
gaggugggaguggaggug

SEQ ID NO: 25715 - RNA, 20 nt, Homo sapiens
gaggugggaguggagguggg

SEQ ID NO: 25716 - RNA, 18 nt, Homo sapiens
gaguguguaagggccaga

SEQ ID NO: 25717 - RNA, 17 nt, Homo sapiens
gcaguggcggcggcggc

SEQ ID NO: 25718 - RNA, 17 nt, Homo sapiens
gcgggcugcgcugcccg

SEQ ID NO: 25719 - RNA, 18 nt, Homo sapiens
gggcgcgggcggcgggcg

SEQ ID NO: 25720 - RNA, 15 nt, Homo sapiens
ggggagggggggcag

SEQ ID NO: 25721 - RNA, 18 nt, Homo sapiens
ggggggcgcgggcggcgg

SEQ ID NO: 25722 - RNA, 17 nt, Homo sapiens
guggagguggggugggg

SEQ ID NO: 25723 - RNA, 18 nt, Homo sapiens
gugugugugugugugugu

SEQ ID NO: 25724 - RNA, 18 nt, Homo sapiens
ucccaccaaccccucgcc

SEQ ID NO: 25725 - RNA, 21 nt, Homo sapiens
ucggaggugagaugugauuug

SEQ ID NO: 25726 - RNA, 19 nt, Homo sapiens
ugccccagagccucucucc

SEQ ID NO: 25727 - RNA, 20 nt, Homo sapiens
uggaggacacugguggcuag

SEQ ID NO: 25728 - RNA, 20 nt, Homo sapiens
uggcaccagugcguguggcc

SEQ ID NO: 25729 - RNA, 19 nt, Homo sapiens
uguggucccacugggggcc

SEQ ID NO: 25730 - RNA, 18 nt, Homo sapiens
ugugugugugugugugug

SEQ ID NO: 25731 - RNA, 18 nt, Homo sapiens
caccugguccaagaggug

SEQ ID NO: 25732 - RNA, 18 nt, Homo sapiens
cccagggggcacaccugg

SEQ ID NO: 25733 - RNA, 20 nt, Homo sapiens
ccucucuccggcucucuggc

SEQ ID NO: 25734 - RNA, 18 nt, Homo sapiens
cucucggucgggggcucc

SEQ ID NO: 25735 - RNA, 18 nt, Homo sapiens
gcccuggcccugacuccc

SEQ ID NO: 25736 - RNA, 19 nt, Homo sapiens
aaaguggcccuccagaacc

SEQ ID NO: 25737 - RNA, 20 nt, Homo sapiens
aagguccaaggacccacagg

SEQ ID NO: 25738 - RNA, 24 nt, Homo sapiens
aauauauauuauacauauauauau

SEQ ID NO: 25739 - RNA, 14 nt, Homo sapiens
accgcggcgggcgg

SEQ ID NO: 25740 - RNA, 22 nt, Homo sapiens
accgcggcgggcggcggcggcc

SEQ ID NO: 25741 - RNA, 20 nt, Homo sapiens
accggcgggucccacggcgc

SEQ ID NO: 25742 - RNA, 15 nt, Homo sapiens
acggaggggaaaaac

SEQ ID NO: 25743 - RNA, 24 nt, Homo sapiens
acggugcuccgcggcggcggcccc

SEQ ID NO: 25744 - RNA, 18 nt, Homo sapiens
agacgccgaggcagaucc

SEQ ID NO: 25745 - RNA, 21 nt, Homo sapiens
agagacaggcaguucacugug

SEQ ID NO: 25746 - RNA, 22 nt, Homo sapiens
auauauauuauacauauauaua

SEQ ID NO: 25747 - RNA, 17 nt, Homo sapiens
augcauugcugacaugc

SEQ ID NO: 25748 - RNA, 15 nt, Homo sapiens
cacguggcugcagug

SEQ ID NO: 25749 - RNA, 20 nt, Homo sapiens
ccccggcgggcgaagccgcc

SEQ ID NO: 25750 - RNA, 18 nt, Homo sapiens
cccgcgcccccgccccgg

SEQ ID NO: 25751 - RNA, 19 nt, Homo sapiens
cccguggcuguugcacgcu

SEQ ID NO: 25752 - RNA, 18 nt, Homo sapiens
ccgccgggcugcagcccc

SEQ ID NO: 25753 - RNA, 22 nt, Homo sapiens
ccuguuucuguccaguuuuguu

SEQ ID NO: 25754 - RNA, 18 nt, Homo sapiens
cgacagccgggacgcggc

SEQ ID NO: 25755 - RNA, 15 nt, Homo sapiens
cgccgggggcccagg

SEQ ID NO: 25756 - RNA, 20 nt, Homo sapiens
cggcgccgccgggggcccag

SEQ ID NO: 25757 - RNA, 16 nt, Homo sapiens
cggcggcggcgcgggc

SEQ ID NO: 25758 - RNA, 19 nt, Homo sapiens
cggcggcggcggcggcgcg

SEQ ID NO: 25759 - RNA, 17 nt, Homo sapiens
cggcgggaagccgcgag

SEQ ID NO: 25760 - RNA, 20 nt, Homo sapiens
cgggacccgccagagugugc

SEQ ID NO: 25761 - RNA, 19 nt, Homo sapiens
cgggacgcggccacggcgc

SEQ ID NO: 25762 - RNA, 19 nt, Homo sapiens
cgggacggugagggcuggg

SEQ ID NO: 25763 - RNA, 18 nt, Homo sapiens
cgggcggcggcggcggcg

SEQ ID NO: 25764 - RNA, 19 nt, Homo sapiens
cgggcggcggcggggacgg

SEQ ID NO: 25765 - RNA, 18 nt, Homo sapiens
cgggcucgggcggcggcg

SEQ ID NO: 25766 - RNA, 23 nt, Homo sapiens
gacggugcuccgcggcggcggcc

SEQ ID NO: 25767 - RNA, 20 nt, Homo sapiens
gccaggcucggcuggccaca

SEQ ID NO: 25768 - RNA, 16 nt, Homo sapiens
gccaucugcccuggac

SEQ ID NO: 25769 - RNA, 18 nt, Homo sapiens
gcccuggacgcuugcugu

SEQ ID NO: 25770 - RNA, 18 nt, Homo sapiens
gccucccacggccgcgcg

SEQ ID NO: 25771 - RNA, 17 nt, Homo sapiens
gcggcggacaauggccc

SEQ ID NO: 25772 - RNA, 17 nt, Homo sapiens
gcgugcaugugcgucuc

SEQ ID NO: 25773 - RNA, 22 nt, Homo sapiens
gcucgggcucgggcggcggcgg

SEQ ID NO: 25774 - RNA, 18 nt, Homo sapiens
ggacgcuggggaggggcg

SEQ ID NO: 25775 - RNA, 18 nt, Homo sapiens
ggcgcgggcgggugcgcg

SEQ ID NO: 25776 - RNA, 18 nt, Homo sapiens
ggcggcggcgcgggcggg

SEQ ID NO: 25777 - RNA, 17 nt, Homo sapiens
ggcgggcggcggcggcc

SEQ ID NO: 25778 - RNA, 17 nt, Homo sapiens
guggaccggcggcgucc

SEQ ID NO: 25779 - RNA, 15 nt, Homo sapiens
uaagcuacaagauga

SEQ ID NO: 25780 - RNA, 21 nt, Homo sapiens
uagcaauguccacuccuuuaa

SEQ ID NO: 25781 - RNA, 18 nt, Homo sapiens
uauaaaaacucauuaggu

SEQ ID NO: 25782 - RNA, 24 nt, Homo sapiens
uauacauauauauauuuauuuaua

SEQ ID NO: 25783 - RNA, 17 nt, Homo sapiens
uaugugacgugugagaa

SEQ ID NO: 25784 - RNA, 18 nt, Homo sapiens
ucagagcaaagaguggcc

SEQ ID NO: 25785 - RNA, 21 nt, Homo sapiens
ugagucgagugguuuacacag

SEQ ID NO: 25786 - RNA, 14 nt, Homo sapiens
ugcagaaaacucau

SEQ ID NO: 25787 - RNA, 19 nt, Homo sapiens
ugcugguggggcgugggca

SEQ ID NO: 25788 - RNA, 20 nt, Homo sapiens
uggaaagguccagaaggggc

SEQ ID NO: 25789 - RNA, 19 nt, Homo sapiens
uggcuuccgcguguccgug

SEQ ID NO: 25790 - RNA, 19 nt, Homo sapiens
uguauuauuagaucuuuga

SEQ ID NO: 25791 - RNA, 22 nt, Homo sapiens
ugugacgugugagaacacuuug

SEQ ID NO: 25792 - RNA, 18 nt, Homo sapiens
ugugucugaacuucugcc

SEQ ID NO: 25793 - RNA, 19 nt, Homo sapiens
cacgcuggacgcccgggug

SEQ ID NO: 25794 - RNA, 22 nt, Homo sapiens
cugcaacuggaacggaaagucg

SEQ ID NO: 25795 - RNA, 20 nt, Homo sapiens
gcgcucggggccaggaggac

SEQ ID NO: 25796 - RNA, 21 nt, Homo sapiens
gcggcucuugacauguugccc

SEQ ID NO: 25797 - RNA, 19 nt, Homo sapiens
gcucggggccaggaggacg

SEQ ID NO: 25798 - RNA, 27 nt, Homo sapiens
ggcggcggcagcuguagcggcggcggc

SEQ ID NO: 25799 - RNA, 19 nt, Homo sapiens
accccaccugugagccgcg

SEQ ID NO: 25800 - RNA, 21 nt, Homo sapiens
agagcauccccccggcgggcc

SEQ ID NO: 25801 - RNA, 20 nt, Homo sapiens
ccagccccggcuuucucugg

SEQ ID NO: 25802 - RNA, 22 nt, Homo sapiens
ccccggccccgagagacuucuc

SEQ ID NO: 25803 - RNA, 18 nt, Homo sapiens
ccgcccgaguucagguuc

SEQ ID NO: 25804 - RNA, 18 nt, Homo sapiens
ccgcgcaggaucccugcc

SEQ ID NO: 25805 - RNA, 18 nt, Homo sapiens
cugguccccuugcccgcc

SEQ ID NO: 25806 - RNA, 19 nt, Homo sapiens
gccgugcgccccuguggcc

SEQ ID NO: 25807 - RNA, 15 nt, Homo sapiens
ggaggcagcggccgg

SEQ ID NO: 25808 - RNA, 15 nt, Homo sapiens
gggcgggaaggggaa

SEQ ID NO: 25809 - RNA, 22 nt, Homo sapiens
ugcuuaagaaaccaucgucuua

SEQ ID NO: 25810 - RNA, 20 nt, Homo sapiens
ugguguugguuauacauuaa

SEQ ID NO: 25811 - RNA, 22 nt, Homo sapiens
uugaaagcacuaugaaaacugu

SEQ ID NO: 25812 - RNA, 23 nt, Homo sapiens
ccgagggggcaccggcggcugag

SEQ ID NO: 25813 - RNA, 22 nt, Homo sapiens
gcuguguucauagcaacagaac

SEQ ID NO: 25814 - RNA, 22 nt, Homo sapiens
gggcagaaaggagaaugauucu

SEQ ID NO: 25815 - RNA, 19 nt, Homo sapiens
gguuuccgagggggcaccg

SEQ ID NO: 25816 - RNA, 23 nt, Homo sapiens
ccugccaguuaacuccccucccg

SEQ ID NO: 25817 - RNA, 19 nt, Homo sapiens
caccuguaaucucagcacu

SEQ ID NO: 25818 - RNA, 17 nt, Homo sapiens
cagcagccgccacuucc

SEQ ID NO: 25819 - RNA, 20 nt, Homo sapiens
cagcggcgucgcacacacuc

SEQ ID NO: 25820 - RNA, 17 nt, Homo sapiens
caguggcucacgugacc

SEQ ID NO: 25821 - RNA, 22 nt, Homo sapiens
cccacgccuuccuccuuccggc

SEQ ID NO: 25822 - RNA, 17 nt, Homo sapiens
ccccgccccuuucccuc

SEQ ID NO: 25823 - RNA, 23 nt, Homo sapiens
ccucuguuuucugcuacucaguu

SEQ ID NO: 25824 - RNA, 23 nt, Homo sapiens
cguuaaauauuuucaucucauua

SEQ ID NO: 25825 - RNA, 18 nt, Homo sapiens
cuuggcaaauagcauuaa

SEQ ID NO: 25826 - RNA, 18 nt, Homo sapiens
gacaggaggaucacuuga

SEQ ID NO: 25827 - RNA, 17 nt, Homo sapiens
gaugucaacuggccaca

SEQ ID NO: 25828 - RNA, 18 nt, Homo sapiens
ggaggucuuuggccugag

SEQ ID NO: 25829 - RNA, 20 nt, Homo sapiens
gugggucacgaggucaggag

SEQ ID NO: 25830 - RNA, 17 nt, Homo sapiens
ucuuggcaaauagcauu

SEQ ID NO: 25831 - RNA, 17 nt, Homo sapiens
uugggaggccaaggcgg

SEQ ID NO: 25832 - RNA, 16 nt, Homo sapiens
uuucaugggugaagcc

SEQ ID NO: 25833 - RNA, 22 nt, Homo sapiens
uuucugggaaccaaguuucaag

SEQ ID NO: 25834 - RNA, 22 nt, Homo sapiens
acuggacaaggagucggagcuc

SEQ ID NO: 25835 - RNA, 18 nt, Homo sapiens
aggaagccgcggcaggcc

SEQ ID NO: 25836 - RNA, 18 nt, Homo sapiens
aggaggaggcggggccag

SEQ ID NO: 25837 - RNA, 19 nt, Homo sapiens
aggaggucuggcaggaccu

SEQ ID NO: 25838 - RNA, 18 nt, Homo sapiens
cccgucacggggugcucc

SEQ ID NO: 25839 - RNA, 21 nt, Homo sapiens
cugcgcgccgcgccuccgcug

SEQ ID NO: 25840 - RNA, 15 nt, Homo sapiens
gcaggaggccucccg

SEQ ID NO: 25841 - RNA, 19 nt, Homo sapiens
gccagccuggggagagcac

SEQ ID NO: 25842 - RNA, 20 nt, Homo sapiens
ggcaggaccagaagaggaga

SEQ ID NO: 25843 - RNA, 18 nt, Homo sapiens
ugaaggaggaggcggggc

SEQ ID NO: 25844 - RNA, 15 nt, Homo sapiens
aaccccguucccacg

SEQ ID NO: 25845 - RNA, 24 nt, Homo sapiens
aagaaaguaacccuagauccacuu

SEQ ID NO: 25846 - RNA, 19 nt, Homo sapiens
agcuaaaagcauaggcaca

SEQ ID NO: 25847 - RNA, 18 nt, Homo sapiens
agcugugaaauaggcaca

SEQ ID NO: 25848 - RNA, 22 nt, Homo sapiens
aggcaguaauagaaagaguaga

SEQ ID NO: 25849 - RNA, 19 nt, Homo sapiens
augaagguuuuugaugcca

SEQ ID NO: 25850 - RNA, 22 nt, Homo sapiens
auugaguuucuuuuaaacauuu

SEQ ID NO: 25851 - RNA, 23 nt, Homo sapiens
ccaaacucuaauuguguuugugu

SEQ ID NO: 25852 - RNA, 17 nt, Homo sapiens
ccaaauaauuggaacug

SEQ ID NO: 25853 - RNA, 17 nt, Homo sapiens
gcaaaaucaguugcaaa

SEQ ID NO: 25854 - RNA, 19 nt, Homo sapiens
uaaaguuaaaagacuuccu

SEQ ID NO: 25855 - RNA, 19 nt, Homo sapiens
uaacccuagauccacuuuu

SEQ ID NO: 25856 - RNA, 17 nt, Homo sapiens
ucagaaacugaugaauu

SEQ ID NO: 25857 - RNA, 20 nt, Homo sapiens
ucccauuaaaugacaacaua

SEQ ID NO: 25858 - RNA, 18 nt, Homo sapiens
ucuuuaguuacuaccaug

SEQ ID NO: 25859 - RNA, 22 nt, Homo sapiens
ugauugaaaacuuucacaagaa

SEQ ID NO: 25860 - RNA, 22 nt, Homo sapiens
uuaguuacuaccauguuguuag

SEQ ID NO: 25861 - RNA, 19 nt, Homo sapiens
ccgcgcgcuggccgccagg

SEQ ID NO: 25862 - RNA, 19 nt, Homo sapiens
ccggccccgcucggcuagg

SEQ ID NO: 25863 - RNA, 18 nt, Homo sapiens
cggcagggagugugacua

SEQ ID NO: 25864 - RNA, 16 nt, Homo sapiens
caccagcacuccacgu

SEQ ID NO: 25865 - RNA, 17 nt, Homo sapiens
cagcaccagcacuccac

SEQ ID NO: 25866 - RNA, 21 nt, Homo sapiens
cccggccccguuugggccucg

SEQ ID NO: 25867 - RNA, 21 nt, Homo sapiens
gagcagugcuguucacagccc

SEQ ID NO: 25868 - RNA, 27 nt, Homo sapiens
caggucuccgcugaaugggcggacgcg

SEQ ID NO: 25869 - RNA, 19 nt, Homo sapiens
ccgccgccucuccgcaggu

SEQ ID NO: 25870 - RNA, 19 nt, Homo sapiens
ccgcggccgccgccucucc

SEQ ID NO: 25871 - RNA, 17 nt, Homo sapiens
cguggcaggugggggaa

SEQ ID NO: 25872 - RNA, 18 nt, Homo sapiens
gaggccgcggccgccgcc

SEQ ID NO: 25873 - RNA, 20 nt, Homo sapiens
ggaagaacagaggcgggagc

SEQ ID NO: 25874 - RNA, 21 nt, Homo sapiens
uagaaagucaagucaaucacu

SEQ ID NO: 25875 - RNA, 20 nt, Homo sapiens
acccauauguaccuuuuugu

SEQ ID NO: 25876 - RNA, 18 nt, Homo sapiens
acaagaaauuuauagcag

SEQ ID NO: 25877 - RNA, 20 nt, Homo sapiens
uaauugccugaacuacugug

SEQ ID NO: 25878 - RNA, 23 nt, Homo sapiens
uaauugccugaacuacuguggac

SEQ ID NO: 25879 - RNA, 18 nt, Homo sapiens
ccgccccgccccgccccc

SEQ ID NO: 25880 - RNA, 22 nt, Homo sapiens
uggagaguuauaaaaaaaggga

SEQ ID NO: 25881 - RNA, 14 nt, Homo sapiens
uuucccacauuucc

SEQ ID NO: 25882 - RNA, 17 nt, Homo sapiens
ccccagccucgccgccc

SEQ ID NO: 25883 - RNA, 17 nt, Homo sapiens
ggcgcgggcagcgcgcg

SEQ ID NO: 25884 - RNA, 20 nt, Homo sapiens
uuggugguaagaugccucuu

SEQ ID NO: 25885 - RNA, 21 nt, Homo sapiens
auucugauaaaauauuuuuau

SEQ ID NO: 25886 - RNA, 19 nt, Homo sapiens
uacaacaaauggcuaauac

SEQ ID NO: 25887 - RNA, 24 nt, Homo sapiens
uacaguucugcaauucuagagucu

SEQ ID NO: 25888 - RNA, 19 nt, Homo sapiens
ugcaccuuuaaauucucua

SEQ ID NO: 25889 - RNA, 16 nt, Homo sapiens
aagcccaccauggugg

SEQ ID NO: 25890 - RNA, 16 nt, Homo sapiens
ccugacuuacaaucac

SEQ ID NO: 25891 - RNA, 23 nt, Homo sapiens
cgccgccacaaucuccaccucuu

SEQ ID NO: 25892 - RNA, 23 nt, Homo sapiens
gggaaagugcugagaaggaagaa

SEQ ID NO: 25893 - RNA, 17 nt, Homo sapiens
gucacccuucagcugcu

SEQ ID NO: 25894 - RNA, 19 nt, Homo sapiens
ucaucuucagcugcgugug

SEQ ID NO: 25895 - RNA, 21 nt, Homo sapiens
uugcucacagcuuuauuccuc

SEQ ID NO: 25896 - RNA, 18 nt, Homo sapiens
agagguugggggacggga

SEQ ID NO: 25897 - RNA, 18 nt, Homo sapiens
cuccaccguccuucuugg

SEQ ID NO: 25898 - RNA, 22 nt, Homo sapiens
uuuaugagcaggagagguuggg

SEQ ID NO: 25899 - RNA, 18 nt, Homo sapiens
aggcaggcggaggcggcc

SEQ ID NO: 25900 - RNA, 22 nt, Homo sapiens
ccauggugguggaagcgguugc

SEQ ID NO: 25901 - RNA, 17 nt, Homo sapiens
ccgugagccggcgcucc

SEQ ID NO: 25902 - RNA, 19 nt, Homo sapiens
ccucgcgguccucaacgca

SEQ ID NO: 25903 - RNA, 23 nt, Homo sapiens
cggaggcggcucggcuuccgcgu

SEQ ID NO: 25904 - RNA, 21 nt, Homo sapiens
cucgccgcucccugccccucg

SEQ ID NO: 25905 - RNA, 15 nt, Homo sapiens
gagcgaagcgcccuc

SEQ ID NO: 25906 - RNA, 21 nt, Homo sapiens
uguccuggcugggagcgaagc

SEQ ID NO: 25907 - RNA, 17 nt, Homo sapiens
agcucacauaccauccc

SEQ ID NO: 25908 - RNA, 18 nt, Homo sapiens
aguagcugggguugggac

SEQ ID NO: 25909 - RNA, 18 nt, Homo sapiens
ccagaaacagaccccagu

SEQ ID NO: 25910 - RNA, 19 nt, Homo sapiens
ggagggcacaggguccuuc

SEQ ID NO: 25911 - RNA, 21 nt, Homo sapiens
uaacuacagggccaugagccu

SEQ ID NO: 25912 - RNA, 18 nt, Homo sapiens
ugaggccaaaaguaggca

SEQ ID NO: 25913 - RNA, 21 nt, Homo sapiens
ugccccuuccccaagaggcuc

SEQ ID NO: 25914 - RNA, 18 nt, Homo sapiens
uguugggggacagcgaag

SEQ ID NO: 25915 - RNA, 20 nt, Homo sapiens
ccagagcugggcuauccucc

SEQ ID NO: 25916 - RNA, 25 nt, Homo sapiens
cccaccuucauguuucuuuucaagc

SEQ ID NO: 25917 - RNA, 21 nt, Homo sapiens
guguggagaccucucuauugc

SEQ ID NO: 25918 - RNA, 22 nt, Homo sapiens
aagcauuugauaugugcaccca

SEQ ID NO: 25919 - RNA, 19 nt, Homo sapiens
ccccuuuuuuuccucacug

SEQ ID NO: 25920 - RNA, 16 nt, Homo sapiens
acagguccagucugca

SEQ ID NO: 25921 - RNA, 18 nt, Homo sapiens
cacagguccagucugcac

SEQ ID NO: 25922 - RNA, 19 nt, Homo sapiens
cacgccuggcucuggggaa

SEQ ID NO: 25923 - RNA, 16 nt, Homo sapiens
cacugauuguguggcu

SEQ ID NO: 25924 - RNA, 19 nt, Homo sapiens
ccugccccaugccaggccc

SEQ ID NO: 25925 - RNA, 22 nt, Homo sapiens
cgaggugagggaggugauggug

SEQ ID NO: 25926 - RNA, 17 nt, Homo sapiens
cuuccucugaaacagga

SEQ ID NO: 25927 - RNA, 20 nt, Homo sapiens
gaggacccugggcugagacc

SEQ ID NO: 25928 - RNA, 18 nt, Homo sapiens
gcaauccuggccgacagc

SEQ ID NO: 25929 - RNA, 17 nt, Homo sapiens
gcccugcuugggcugca

SEQ ID NO: 25930 - RNA, 15 nt, Homo sapiens
ggaggggugggcuug

SEQ ID NO: 25931 - RNA, 17 nt, Homo sapiens
ggaggugauggugggag

SEQ ID NO: 25932 - RNA, 25 nt, Homo sapiens
gggcaccugcuggccgugcggcacg

SEQ ID NO: 25933 - RNA, 18 nt, Homo sapiens
ggugggaggagggguggg

SEQ ID NO: 25934 - RNA, 18 nt, Homo sapiens
uggaauguuuacaacaga

SEQ ID NO: 25935 - RNA, 15 nt, Homo sapiens
uggcuuguccaaggu

SEQ ID NO: 25936 - RNA, 23 nt, Homo sapiens
uggaaaggacuugaaggccucug

SEQ ID NO: 25937 - RNA, 16 nt, Homo sapiens
gagcuaccaacccagc

SEQ ID NO: 25938 - RNA, 20 nt, Homo sapiens
gcugaacuguuucucaggga

SEQ ID NO: 25939 - RNA, 18 nt, Homo sapiens
ucuccacaaaagaaaaac

SEQ ID NO: 25940 - RNA, 21 nt, Homo sapiens
ugggaaacagcagaaaagaaa

SEQ ID NO: 25941 - RNA, 17 nt, Homo sapiens
cagugaggaagccagag

SEQ ID NO: 25942 - RNA, 20 nt, Homo sapiens
ccagaggguacaguaacguc

SEQ ID NO: 25943 - RNA, 19 nt, Homo sapiens
ccauagacaaggaccugca

SEQ ID NO: 25944 - RNA, 21 nt, Homo sapiens
cgccgcuccgggcccagucgg

SEQ ID NO: 25945 - RNA, 19 nt, Homo sapiens
cggccuccgcgccgcuccg

SEQ ID NO: 25946 - RNA, 23 nt, Homo sapiens
cgggaugggauacccguguggcu

SEQ ID NO: 25947 - RNA, 15 nt, Homo sapiens
cuccgcgccgcuccg

SEQ ID NO: 25948 - RNA, 21 nt, Homo sapiens
gagaaacagugauuccuucua

SEQ ID NO: 25949 - RNA, 16 nt, Homo sapiens
gcccuuggccuaggcc

SEQ ID NO: 25950 - RNA, 18 nt, Homo sapiens
gcccuuggggacagcagc

SEQ ID NO: 25951 - RNA, 18 nt, Homo sapiens
gccuucagugacacgcag

SEQ ID NO: 25952 - RNA, 18 nt, Homo sapiens
ggauggguagcugguaga

SEQ ID NO: 25953 - RNA, 15 nt, Homo sapiens
guucagguacaugga

SEQ ID NO: 25954 - RNA, 15 nt, Homo sapiens
uagaaugccaucacu

SEQ ID NO: 25955 - RNA, 19 nt, Homo sapiens
uguccuugagcccuuggcc

SEQ ID NO: 25956 - RNA, 22 nt, Homo sapiens
aaguauucuuuguguauaaugu

SEQ ID NO: 25957 - RNA, 20 nt, Homo sapiens
agccguaacuguuuuaaaaa

SEQ ID NO: 25958 - RNA, 17 nt, Homo sapiens
cagccgccgccgcagcc

SEQ ID NO: 25959 - RNA, 18 nt, Homo sapiens
cagcuuguuuauuuuaga

SEQ ID NO: 25960 - RNA, 17 nt, Homo sapiens
ccgccgcccgggcccgc

SEQ ID NO: 25961 - RNA, 18 nt, Homo sapiens
ggcgcagacgggcggcca

SEQ ID NO: 25962 - RNA, 19 nt, Homo sapiens
uaccacagaaaggguuauu

SEQ ID NO: 25963 - RNA, 21 nt, Homo sapiens
cgcucacuggagauccugcag

SEQ ID NO: 25964 - RNA, 16 nt, Homo sapiens
cggggcuggcccgggg

SEQ ID NO: 25965 - RNA, 22 nt, Homo sapiens
ugaaaauuaagaguagcauguu

SEQ ID NO: 25966 - RNA, 19 nt, Homo sapiens
ugccauuggggccuccccc

SEQ ID NO: 25967 - RNA, 21 nt, Homo sapiens
aggagugggggagcuaagggg

SEQ ID NO: 25968 - RNA, 17 nt, Homo sapiens
agggaggagugggggag

SEQ ID NO: 25969 - RNA, 23 nt, Homo sapiens
agggauggcgaugggguccugcu

SEQ ID NO: 25970 - RNA, 23 nt, Homo sapiens
aggggaggagaaguugccugugc

SEQ ID NO: 25971 - RNA, 17 nt, Homo sapiens
aggggcgccuuccucca

SEQ ID NO: 25972 - RNA, 21 nt, Homo sapiens
auggacagucucaccaggcca

SEQ ID NO: 25973 - RNA, 16 nt, Homo sapiens
auggacccgucagaga

SEQ ID NO: 25974 - RNA, 25 nt, Homo sapiens
cagaacuugccaugcagcuuggagu

SEQ ID NO: 25975 - RNA, 16 nt, Homo sapiens
cagcugugaguccacu

SEQ ID NO: 25976 - RNA, 17 nt, Homo sapiens
ccaacccaauugcugcu

SEQ ID NO: 25977 - RNA, 22 nt, Homo sapiens
cccccaccuccuauggacaguc

SEQ ID NO: 25978 - RNA, 19 nt, Homo sapiens
cgggaggaggcaggguggc

SEQ ID NO: 25979 - RNA, 14 nt, Homo sapiens
gaaagcaguucagg

SEQ ID NO: 25980 - RNA, 19 nt, Homo sapiens
gcagguccuggggccuggg

SEQ ID NO: 25981 - RNA, 17 nt, Homo sapiens
gccugugcugucuugca

SEQ ID NO: 25982 - RNA, 18 nt, Homo sapiens
ggaggugggggguuggug

SEQ ID NO: 25983 - RNA, 18 nt, Homo sapiens
ggcaaugucccccuugcu

SEQ ID NO: 25984 - RNA, 23 nt, Homo sapiens
gggaggagugggggagcuaaggg

SEQ ID NO: 25985 - RNA, 16 nt, Homo sapiens
gggcacggggaagggu

SEQ ID NO: 25986 - RNA, 24 nt, Homo sapiens
gggccuguagggaggaguggggga

SEQ ID NO: 25987 - RNA, 18 nt, Homo sapiens
gggcggcggcgagggaag

SEQ ID NO: 25988 - RNA, 17 nt, Homo sapiens
ggggcugcagagcuggc

SEQ ID NO: 25989 - RNA, 23 nt, Homo sapiens
ggguauucaggggaggagaaguu

SEQ ID NO: 25990 - RNA, 24 nt, Homo sapiens
gguccuggggccugggggagaggg

SEQ ID NO: 25991 - RNA, 17 nt, Homo sapiens
ucaucccuggccagugu

SEQ ID NO: 25992 - RNA, 18 nt, Homo sapiens
uccccuccccaucggcuc

SEQ ID NO: 25993 - RNA, 20 nt, Homo sapiens
ucgaggcuggagcaggggug

SEQ ID NO: 25994 - RNA, 23 nt, Homo sapiens
ucguaccagcacaggcggcugcg

SEQ ID NO: 25995 - RNA, 19 nt, Homo sapiens
ugagcagaguagccauugg

SEQ ID NO: 25996 - RNA, 16 nt, Homo sapiens
uggcugcggugcccug

SEQ ID NO: 25997 - RNA, 20 nt, Homo sapiens
uuucugcacucggaauuuga

SEQ ID NO: 25998 - RNA, 18 nt, Homo sapiens
gggaggaggcaggguggc

SEQ ID NO: 25999 - RNA, 23 nt, Homo sapiens
ugcugcucucacugugcccgucg

SEQ ID NO: 26000 - RNA, 17 nt, Homo sapiens
uuuguggggaaguggcu

SEQ ID NO: 26001 - RNA, 16 nt, Homo sapiens
agaagcaccguggggc

SEQ ID NO: 26002 - RNA, 20 nt, Homo sapiens
agggguguggcagggugggg

SEQ ID NO: 26003 - RNA, 21 nt, Homo sapiens
gagaagcaccguggggccugg

SEQ ID NO: 26004 - RNA, 18 nt, Homo sapiens
ggcacggcugggcccuuc

SEQ ID NO: 26005 - RNA, 21 nt, Homo sapiens
uggagcugggcacggcugggc

SEQ ID NO: 26006 - RNA, 18 nt, Homo sapiens
ugggggccugcugguggg

SEQ ID NO: 26007 - RNA, 23 nt, Homo sapiens
uggggguugggggccugcuggug

SEQ ID NO: 26008 - RNA, 18 nt, Homo sapiens
augugugaguuccagcag

SEQ ID NO: 26009 - RNA, 19 nt, Homo sapiens
uacagguaauaagugacag

SEQ ID NO: 26010 - RNA, 16 nt, Homo sapiens
ucagagagauuagaua

SEQ ID NO: 26011 - RNA, 18 nt, Homo sapiens
uuugcccauguucauaca

SEQ ID NO: 26012 - RNA, 22 nt, Homo sapiens
acagcauuaaauaggaacuacg

SEQ ID NO: 26013 - RNA, 18 nt, Homo sapiens
acaggaaaaugauggaag

SEQ ID NO: 26014 - RNA, 20 nt, Homo sapiens
aggaguaccauuaauuauaa

SEQ ID NO: 26015 - RNA, 20 nt, Homo sapiens
aguggguuuaaauuuguguu

SEQ ID NO: 26016 - RNA, 21 nt, Homo sapiens
auaguugaagaaccaucaucu

SEQ ID NO: 26017 - RNA, 18 nt, Homo sapiens
cagcacccaaguacugcu

SEQ ID NO: 26018 - RNA, 24 nt, Homo sapiens
ccgucauccacggccaccaccacc

SEQ ID NO: 26019 - RNA, 17 nt, Homo sapiens
cuuuuuguuuucuaccc

SEQ ID NO: 26020 - RNA, 20 nt, Homo sapiens
gagcucugagcccuaaacca

SEQ ID NO: 26021 - RNA, 21 nt, Homo sapiens
ggagagcuguggcacuaucuc

SEQ ID NO: 26022 - RNA, 22 nt, Homo sapiens
guagaaaaauauccauggucau

SEQ ID NO: 26023 - RNA, 21 nt, Homo sapiens
uacaggugccugccaccaggc

SEQ ID NO: 26024 - RNA, 18 nt, Homo sapiens
uacauacacuuggucucu

SEQ ID NO: 26025 - RNA, 17 nt, Homo sapiens
ugauauugagcagaugg

SEQ ID NO: 26026 - RNA, 20 nt, Homo sapiens
ugcguaguggguuuaaauuu

SEQ ID NO: 26027 - RNA, 19 nt, Homo sapiens
ugugauucaucuuuaguag

SEQ ID NO: 26028 - RNA, 19 nt, Homo sapiens
aguucugcaggaauaguuu

SEQ ID NO: 26029 - RNA, 19 nt, Homo sapiens
ccaacuccccuucccuccc

SEQ ID NO: 26030 - RNA, 21 nt, Homo sapiens
ccucucaugguccacaacugg

SEQ ID NO: 26031 - RNA, 20 nt, Homo sapiens
ggaggaguguacagggucug

SEQ ID NO: 26032 - RNA, 18 nt, Homo sapiens
guggcugcacuugcugga

SEQ ID NO: 26033 - RNA, 17 nt, Homo sapiens
uacaaugagucuaaagg

SEQ ID NO: 26034 - RNA, 16 nt, Homo sapiens
ucaggaaggccccuug

SEQ ID NO: 26035 - RNA, 21 nt, Homo sapiens
uccugcggcccgccgacccgc

SEQ ID NO: 26036 - RNA, 18 nt, Homo sapiens
uggaacgagagguauugc

SEQ ID NO: 26037 - RNA, 15 nt, Homo sapiens
guccacagggaucug

SEQ ID NO: 26038 - RNA, 21 nt, Homo sapiens
uacaagaacaaugcagaagga

SEQ ID NO: 26039 - RNA, 18 nt, Homo sapiens
aggggcggggcguggggg

SEQ ID NO: 26040 - RNA, 19 nt, Homo sapiens
aggggcggggcgugggggu

SEQ ID NO: 26041 - RNA, 14 nt, Homo sapiens
caggacggccugcc

SEQ ID NO: 26042 - RNA, 17 nt, Homo sapiens
ccucaucaucuacucug

SEQ ID NO: 26043 - RNA, 19 nt, Homo sapiens
cggggcgugggggugaggg

SEQ ID NO: 26044 - RNA, 19 nt, Homo sapiens
ggcgcgccuggcuuggagc

SEQ ID NO: 26045 - RNA, 21 nt, Homo sapiens
agaggcagacuugaggucuaa

SEQ ID NO: 26046 - RNA, 22 nt, Homo sapiens
cagacuugaggucuaauuuugc

SEQ ID NO: 26047 - RNA, 18 nt, Homo sapiens
cauggugaugugagacac

SEQ ID NO: 26048 - RNA, 17 nt, Homo sapiens
cuucuacauggugaugu

SEQ ID NO: 26049 - RNA, 18 nt, Homo sapiens
guaauuuuccuuuuguga

SEQ ID NO: 26050 - RNA, 20 nt, Homo sapiens
ucagaguguacuguacauaa

SEQ ID NO: 26051 - RNA, 16 nt, Homo sapiens
ucuuugcuuuacuucu

SEQ ID NO: 26052 - RNA, 21 nt, Homo sapiens
uucauaauugaaaguucacuc

SEQ ID NO: 26053 - RNA, 23 nt, Homo sapiens
aggcggcgggcgccggcgucuuc

SEQ ID NO: 26054 - RNA, 19 nt, Homo sapiens
aggggaggggaggggggga

SEQ ID NO: 26055 - RNA, 19 nt, Homo sapiens
aggggagggggggaggggg

SEQ ID NO: 26056 - RNA, 20 nt, Homo sapiens
cagcggcuccucaaggcggc

SEQ ID NO: 26057 - RNA, 21 nt, Homo sapiens
cagggagcgggggcagcggcu

SEQ ID NO: 26058 - RNA, 21 nt, Homo sapiens
ccuuuuugccucggcagcugg

SEQ ID NO: 26059 - RNA, 18 nt, Homo sapiens
gagaagagggaucuucuc

SEQ ID NO: 26060 - RNA, 16 nt, Homo sapiens
gccucggcagcugggu

SEQ ID NO: 26061 - RNA, 19 nt, Homo sapiens
gcugccccaggagagcggc

SEQ ID NO: 26062 - RNA, 16 nt, Homo sapiens
ggagggggggaggggg

SEQ ID NO: 26063 - RNA, 19 nt, Homo sapiens
gggaggggagggggggagg

SEQ ID NO: 26064 - RNA, 20 nt, Homo sapiens
ggggaggggagggggggagg

SEQ ID NO: 26065 - RNA, 24 nt, Homo sapiens
ggggaggggagggggggagggggc

SEQ ID NO: 26066 - RNA, 20 nt, Homo sapiens
ggggagggggggagggggca

SEQ ID NO: 26067 - RNA, 22 nt, Homo sapiens
ggggaggggugccuccagggag

SEQ ID NO: 26068 - RNA, 15 nt, Homo sapiens
acgucggcucuguua

SEQ ID NO: 26069 - RNA, 22 nt, Homo sapiens
aggggcgugugcgcgcguggcg

SEQ ID NO: 26070 - RNA, 17 nt, Homo sapiens
caggccguuccuucugc

SEQ ID NO: 26071 - RNA, 17 nt, Homo sapiens
ccggcgaguucggagcc

SEQ ID NO: 26072 - RNA, 19 nt, Homo sapiens
cgcguggcggggcccggcc

SEQ ID NO: 26073 - RNA, 23 nt, Homo sapiens
cuccugggcgaggacacgucggc

SEQ ID NO: 26074 - RNA, 16 nt, Homo sapiens
cuucuccuccagguga

SEQ ID NO: 26075 - RNA, 18 nt, Homo sapiens
gacuaugaacaagccuac

SEQ ID NO: 26076 - RNA, 19 nt, Homo sapiens
gcgcgcguggcggggcccg

SEQ ID NO: 26077 - RNA, 15 nt, Homo sapiens
gcgcggcggcggcgg

SEQ ID NO: 26078 - RNA, 18 nt, Homo sapiens
ggaaagucaucgaggggc

SEQ ID NO: 26079 - RNA, 23 nt, Homo sapiens
ggcggcggggaguggagcggcgg

SEQ ID NO: 26080 - RNA, 21 nt, Homo sapiens
uauccuguaacagguuuuucu

SEQ ID NO: 26081 - RNA, 19 nt, Homo sapiens
ucuccaucagcgacguucu

SEQ ID NO: 26082 - RNA, 18 nt, Homo sapiens
ucucgcagccuuccagca

SEQ ID NO: 26083 - RNA, 18 nt, Homo sapiens
ucuuuccaagaugaugac

SEQ ID NO: 26084 - RNA, 18 nt, Homo sapiens
ugaggagccgagucaggg

SEQ ID NO: 26085 - RNA, 18 nt, Homo sapiens
uuuaucagaagggaauga

SEQ ID NO: 26086 - RNA, 18 nt, Homo sapiens
gcccuguuccggcugccg

SEQ ID NO: 26087 - RNA, 21 nt, Homo sapiens
ggcggcggcggcggcgguggc

SEQ ID NO: 26088 - RNA, 22 nt, Homo sapiens
uccccgacggcggcccuguucc

SEQ ID NO: 26089 - RNA, 19 nt, Homo sapiens
uuaauauaaaaaaugccau

SEQ ID NO: 26090 - RNA, 18 nt, Homo sapiens
aaaagaaaaagaaggcau

SEQ ID NO: 26091 - RNA, 24 nt, Homo sapiens
agacgccgaggcuuccgcgccccc

SEQ ID NO: 26092 - RNA, 20 nt, Homo sapiens
caggauccuccagaaggucc

SEQ ID NO: 26093 - RNA, 18 nt, Homo sapiens
cccuuccgcgccccuccc

SEQ ID NO: 26094 - RNA, 18 nt, Homo sapiens
cggaaaagcuucugggca

SEQ ID NO: 26095 - RNA, 22 nt, Homo sapiens
gcccgcggggcggucgcggccg

SEQ ID NO: 26096 - RNA, 17 nt, Homo sapiens
gcggucgcggccgugac

SEQ ID NO: 26097 - RNA, 15 nt, Homo sapiens
ggcuccgggcccggc

SEQ ID NO: 26098 - RNA, 18 nt, Homo sapiens
gguccucccucccguuau

SEQ ID NO: 26099 - RNA, 18 nt, Homo sapiens
guccaggcgggcaguccc

SEQ ID NO: 26100 - RNA, 19 nt, Homo sapiens
gugcuucuuuaacauuauc

SEQ ID NO: 26101 - RNA, 18 nt, Homo sapiens
uccaugaguuugagacca

SEQ ID NO: 26102 - RNA, 18 nt, Homo sapiens
ucgcggccgugacggcgg

SEQ ID NO: 26103 - RNA, 17 nt, Homo sapiens
ugacuucagaagaagag

SEQ ID NO: 26104 - RNA, 18 nt, Homo sapiens
uggaacucauaaaugaca

SEQ ID NO: 26105 - RNA, 21 nt, Homo sapiens
uucaccgauaugguuugugga

SEQ ID NO: 26106 - RNA, 16 nt, Homo sapiens
uuccuggugccgcagc

SEQ ID NO: 26107 - RNA, 17 nt, Homo sapiens
uugggagguccaggcgg

SEQ ID NO: 26108 - RNA, 18 nt, Homo sapiens
aaacuucaagucacagac

SEQ ID NO: 26109 - RNA, 20 nt, Homo sapiens
caacaguagagacugggucu

SEQ ID NO: 26110 - RNA, 16 nt, Homo sapiens
cagaguugauauucag

SEQ ID NO: 26111 - RNA, 18 nt, Homo sapiens
cccuggggaaggcaguuu

SEQ ID NO: 26112 - RNA, 22 nt, Homo sapiens
gaaaauaccacuugauuuuccc

SEQ ID NO: 26113 - RNA, 18 nt, Homo sapiens
gccaccaacaguagagac

SEQ ID NO: 26114 - RNA, 17 nt, Homo sapiens
gcggccccgccuuggcc

SEQ ID NO: 26115 - RNA, 16 nt, Homo sapiens
ucacugucucuguugu

SEQ ID NO: 26116 - RNA, 18 nt, Homo sapiens
ucuaaugucuccccucua

SEQ ID NO: 26117 - RNA, 20 nt, Homo sapiens
ugacagauuggagcaggguu

SEQ ID NO: 26118 - RNA, 22 nt, Homo sapiens
uguugcaaaaaacacauagaaa

SEQ ID NO: 26119 - RNA, 21 nt, Homo sapiens
uucacugucucuguuguuuca

SEQ ID NO: 26120 - RNA, 17 nt, Homo sapiens
gcccuccuucucuuucc

SEQ ID NO: 26121 - RNA, 19 nt, Homo sapiens
gcccuccuucucuuuccuc

SEQ ID NO: 26122 - RNA, 18 nt, Homo sapiens
gaagagagaggacaaaga

SEQ ID NO: 26123 - RNA, 19 nt, Homo sapiens
ugaacuugugauacugugu

SEQ ID NO: 26124 - RNA, 17 nt, Homo sapiens
agcugcaugcugggugc

SEQ ID NO: 26125 - RNA, 19 nt, Homo sapiens
cggcauccaucucuccucg

SEQ ID NO: 26126 - RNA, 18 nt, Homo sapiens
cuuagggcgcccuccgca

SEQ ID NO: 26127 - RNA, 19 nt, Homo sapiens
gcgcagggcggggaugggg

SEQ ID NO: 26128 - RNA, 18 nt, Homo sapiens
gcggggggggagggcggg

SEQ ID NO: 26129 - RNA, 17 nt, Homo sapiens
gggcggggagaagugga

SEQ ID NO: 26130 - RNA, 21 nt, Homo sapiens
gucuguguggugccggguggg

SEQ ID NO: 26131 - RNA, 20 nt, Homo sapiens
uggggaaaggggagggaacg

SEQ ID NO: 26132 - RNA, 19 nt, Homo sapiens
caccacacuuccacccccc

SEQ ID NO: 26133 - RNA, 14 nt, Homo sapiens
cagagcucagcgug

SEQ ID NO: 26134 - RNA, 18 nt, Homo sapiens
ccugggcugugcaucccc

SEQ ID NO: 26135 - RNA, 20 nt, Homo sapiens
gagcacccugugcaggucug

SEQ ID NO: 26136 - RNA, 18 nt, Homo sapiens
uaucuaguuguuggauau

SEQ ID NO: 26137 - RNA, 22 nt, Homo sapiens
ggcugggaguccccaggcuucg

SEQ ID NO: 26138 - RNA, 18 nt, Homo sapiens
gguccuuagaucagcugg

SEQ ID NO: 26139 - RNA, 21 nt, Homo sapiens
uggggcugggaguccccaggc

SEQ ID NO: 26140 - RNA, 22 nt, Homo sapiens
accggccgcuuucccccacccg

SEQ ID NO: 26141 - RNA, 23 nt, Homo sapiens
agaaaauuuaaaaaaagaaaaag

SEQ ID NO: 26142 - RNA, 21 nt, Homo sapiens
agggaagacgaaaaaaaagaa

SEQ ID NO: 26143 - RNA, 18 nt, Homo sapiens
caaaagaaaggguaagaa

SEQ ID NO: 26144 - RNA, 19 nt, Homo sapiens
caccucgaggccgggcucc

SEQ ID NO: 26145 - RNA, 17 nt, Homo sapiens
ccgcuuucccccacccg

SEQ ID NO: 26146 - RNA, 24 nt, Homo sapiens
ccgggcuccggcgccucacgcccg

SEQ ID NO: 26147 - RNA, 21 nt, Homo sapiens
gagauggaaagagagaaagag

SEQ ID NO: 26148 - RNA, 18 nt, Homo sapiens
ugcuuguugcgggcgugc

SEQ ID NO: 26149 - RNA, 22 nt, Homo sapiens
uggggguccgguaugcaccucg

SEQ ID NO: 26150 - RNA, 22 nt, Homo sapiens
gcgggucagccaguggccgggc

SEQ ID NO: 26151 - RNA, 16 nt, Homo sapiens
aggggagggggcgggc

SEQ ID NO: 26152 - RNA, 16 nt, Homo sapiens
cagaugaggccagaaa

SEQ ID NO: 26153 - RNA, 21 nt, Homo sapiens
cagugucagaugaggccagaa

SEQ ID NO: 26154 - RNA, 18 nt, Homo sapiens
cuggucuucaggggcucc

SEQ ID NO: 26155 - RNA, 16 nt, Homo sapiens
gcugggggccaagagg

SEQ ID NO: 26156 - RNA, 21 nt, Homo sapiens
ggaguggggucagcucuggga

SEQ ID NO: 26157 - RNA, 21 nt, Homo sapiens
ggauuccaguagcugugggca

SEQ ID NO: 26158 - RNA, 21 nt, Homo sapiens
ggccaagagguccaggaggag

SEQ ID NO: 26159 - RNA, 18 nt, Homo sapiens
ggggauuccaguagcugu

SEQ ID NO: 26160 - RNA, 16 nt, Homo sapiens
uaucaggguucaccgg

SEQ ID NO: 26161 - RNA, 23 nt, Homo sapiens
accuauuuuacaauugagaaaau

SEQ ID NO: 26162 - RNA, 14 nt, Homo sapiens
aggaaauagcaaca

SEQ ID NO: 26163 - RNA, 21 nt, Homo sapiens
aggaauguuggacgguguuac

SEQ ID NO: 26164 - RNA, 21 nt, Homo sapiens
cugugugugugugugugugua

SEQ ID NO: 26165 - RNA, 18 nt, Homo sapiens
guguaugugugugugugu

SEQ ID NO: 26166 - RNA, 24 nt, Homo sapiens
uacagaaauggggggcagcuugag

SEQ ID NO: 26167 - RNA, 17 nt, Homo sapiens
ugcucaguuauuuccag

SEQ ID NO: 26168 - RNA, 16 nt, Homo sapiens
ugucaggauuuucuga

SEQ ID NO: 26169 - RNA, 19 nt, Homo sapiens
uguguaugugugugugugu

SEQ ID NO: 26170 - RNA, 23 nt, Homo sapiens
ugugucucugugugugugugugu

SEQ ID NO: 26171 - RNA, 21 nt, Homo sapiens
uguguguguaugugugugugu

SEQ ID NO: 26172 - RNA, 18 nt, Homo sapiens
ugugugugugugugugug

SEQ ID NO: 26173 - RNA, 19 nt, Homo sapiens
uguguguguguguuacauu

SEQ ID NO: 26174 - RNA, 21 nt, Homo sapiens
uuaggaaauagcaacaguuuu

SEQ ID NO: 26175 - RNA, 18 nt, Homo sapiens
uuuccaagauuuuuagaa

SEQ ID NO: 26176 - RNA, 15 nt, Homo sapiens
accgggaagccccca

SEQ ID NO: 26177 - RNA, 22 nt, Homo sapiens
agacggcagagaacagguucua

SEQ ID NO: 26178 - RNA, 19 nt, Homo sapiens
agggggcauucucagcugg

SEQ ID NO: 26179 - RNA, 16 nt, Homo sapiens
ccuaggucucgacucc

SEQ ID NO: 26180 - RNA, 21 nt, Homo sapiens
cggggaggcccagagucugug

SEQ ID NO: 26181 - RNA, 20 nt, Homo sapiens
gcucuucaauagcccacaua

SEQ ID NO: 26182 - RNA, 23 nt, Homo sapiens
ggccauugccaaagacugagggc

SEQ ID NO: 26183 - RNA, 15 nt, Homo sapiens
ucauccaguaggacc

SEQ ID NO: 26184 - RNA, 18 nt, Homo sapiens
uggauauguguguggcag

SEQ ID NO: 26185 - RNA, 25 nt, Homo sapiens
uggccaggaugcaucugcuggggac

SEQ ID NO: 26186 - RNA, 16 nt, Homo sapiens
ugggugggaagcagca

SEQ ID NO: 26187 - RNA, 17 nt, Homo sapiens
uuccuguuccuuccucu

SEQ ID NO: 26188 - RNA, 21 nt, Homo sapiens
aagugacucucucgugaccuc

SEQ ID NO: 26189 - RNA, 17 nt, Homo sapiens
cugcagaagguuuucag

SEQ ID NO: 26190 - RNA, 19 nt, Homo sapiens
ggaaggggggcuuacagaa

SEQ ID NO: 26191 - RNA, 21 nt, Homo sapiens
uuagguagggaugggaugugg

SEQ ID NO: 26192 - RNA, 18 nt, Homo sapiens
cggggaguguuaaaaggc

SEQ ID NO: 26193 - RNA, 16 nt, Homo sapiens
gcugagucgccgccgc

SEQ ID NO: 26194 - RNA, 16 nt, Homo sapiens
uagaaacaauaagaga

SEQ ID NO: 26195 - RNA, 19 nt, Homo sapiens
ucccugagcacacuguuca

SEQ ID NO: 26196 - RNA, 18 nt, Homo sapiens
ucgcgcccgaccaccggg

SEQ ID NO: 26197 - RNA, 20 nt, Homo sapiens
caaugugugugugugugugu

SEQ ID NO: 26198 - RNA, 14 nt, Homo sapiens
ggcaggaugguauu

SEQ ID NO: 26199 - RNA, 24 nt, Homo sapiens
gggaaaacaugauggacaacagaa

SEQ ID NO: 26200 - RNA, 20 nt, Homo sapiens
aagugucauuagcacaaagg

SEQ ID NO: 26201 - RNA, 18 nt, Homo sapiens
ccccaguuccgcacuccc

SEQ ID NO: 26202 - RNA, 19 nt, Homo sapiens
ccgaccggccggcgccucc

SEQ ID NO: 26203 - RNA, 21 nt, Homo sapiens
ccggccccaguuccgcacucc

SEQ ID NO: 26204 - RNA, 16 nt, Homo sapiens
cugcuggagacggaau

SEQ ID NO: 26205 - RNA, 22 nt, Homo sapiens
gcagaaggguuggagggcagga

SEQ ID NO: 26206 - RNA, 20 nt, Homo sapiens
ggaauugggggaggaggugc

SEQ ID NO: 26207 - RNA, 18 nt, Homo sapiens
ggagggcaggaggggugg

SEQ ID NO: 26208 - RNA, 16 nt, Homo sapiens
ugcugagacagggaga

SEQ ID NO: 26209 - RNA, 14 nt, Homo sapiens
ugggaauuggggga

SEQ ID NO: 26210 - RNA, 24 nt, Homo sapiens
acaauguacauuacauuuuaugaa

SEQ ID NO: 26211 - RNA, 24 nt, Homo sapiens
acaguaaagcuguagauggugggc

SEQ ID NO: 26212 - RNA, 18 nt, Homo sapiens
agggaaacaaagaguuaa

SEQ ID NO: 26213 - RNA, 21 nt, Homo sapiens
augcacuuaucaaggcaugua

SEQ ID NO: 26214 - RNA, 24 nt, Homo sapiens
ggcuacaaaaacgcuuuccuuuuc

SEQ ID NO: 26215 - RNA, 14 nt, Homo sapiens
uaacauuguguguu

SEQ ID NO: 26216 - RNA, 16 nt, Homo sapiens
ucugugcagcacccag

SEQ ID NO: 26217 - RNA, 19 nt, Homo sapiens
uugagguuuaguguauauu

SEQ ID NO: 26218 - RNA, 22 nt, Homo sapiens
agcggcgggcggcguucggggg

SEQ ID NO: 26219 - RNA, 20 nt, Homo sapiens
gcgggcggcguucgggggag

SEQ ID NO: 26220 - RNA, 22 nt, Homo sapiens
gcggggggaggggagguguagg

SEQ ID NO: 26221 - RNA, 17 nt, Homo sapiens
ggagcgagcgggagcgg

SEQ ID NO: 26222 - RNA, 18 nt, Homo sapiens
ggcggcuggcggggggag

SEQ ID NO: 26223 - RNA, 18 nt, Homo sapiens
agcgcaaugcgagcuaga

SEQ ID NO: 26224 - RNA, 22 nt, Homo sapiens
aguauguaaggacagaguuaga

SEQ ID NO: 26225 - RNA, 19 nt, Homo sapiens
augcauugaguauguaagg

SEQ ID NO: 26226 - RNA, 18 nt, Homo sapiens
gcccucggagaccgcagc

SEQ ID NO: 26227 - RNA, 17 nt, Homo sapiens
gcgcggggagaacucgc

SEQ ID NO: 26228 - RNA, 18 nt, Homo sapiens
guggagaagagggcgggg

SEQ ID NO: 26229 - RNA, 21 nt, Homo sapiens
aagcuacucacaauuccauug

SEQ ID NO: 26230 - RNA, 22 nt, Homo sapiens
acaucaaggaaaauaguugcag

SEQ ID NO: 26231 - RNA, 21 nt, Homo sapiens
uaugcguguguggauugugug

SEQ ID NO: 26232 - RNA, 16 nt, Homo sapiens
ugcuaugcgugugugg

SEQ ID NO: 26233 - RNA, 18 nt, Homo sapiens
ccgacucggucucgcucc

SEQ ID NO: 26234 - RNA, 18 nt, Homo sapiens
gcccccucugcuggcccg

SEQ ID NO: 26235 - RNA, 20 nt, Homo sapiens
ggcgcccccucugcuggccc

SEQ ID NO: 26236 - RNA, 17 nt, Homo sapiens
ucccuggggcugccggg

SEQ ID NO: 26237 - RNA, 19 nt, Homo sapiens
ucgcuccucccggggcccc

SEQ ID NO: 26238 - RNA, 18 nt, Homo sapiens
ggcgccuggggcggcggc

SEQ ID NO: 26239 - RNA, 24 nt, Homo sapiens
uggguugacaggccaauggugggg

SEQ ID NO: 26240 - RNA, 18 nt, Homo sapiens
aaggauuauugaucaacg

SEQ ID NO: 26241 - RNA, 20 nt, Homo sapiens
aaguggaaagcgggaaccag

SEQ ID NO: 26242 - RNA, 24 nt, Homo sapiens
agaaguggggcggggggcgggggg

SEQ ID NO: 26243 - RNA, 16 nt, Homo sapiens
aggaggagguggucgg

SEQ ID NO: 26244 - RNA, 22 nt, Homo sapiens
aggagguggucgggggagcagg

SEQ ID NO: 26245 - RNA, 24 nt, Homo sapiens
aggcugggcuuggggagucccggg

SEQ ID NO: 26246 - RNA, 19 nt, Homo sapiens
aggggagugaggggaggag

SEQ ID NO: 26247 - RNA, 22 nt, Homo sapiens
aggggagugaggggaggagugg

SEQ ID NO: 26248 - RNA, 21 nt, Homo sapiens
agggggagccgcggaggggcc

SEQ ID NO: 26249 - RNA, 22 nt, Homo sapiens
agguagagacuccccaggcggc

SEQ ID NO: 26250 - RNA, 20 nt, Homo sapiens
agugaggggaggaguggagg

SEQ ID NO: 26251 - RNA, 21 nt, Homo sapiens
aguggggcggggggcgggggg

SEQ ID NO: 26252 - RNA, 22 nt, Homo sapiens
agugggggaaggugaggggagg

SEQ ID NO: 26253 - RNA, 17 nt, Homo sapiens
auuggguagggggcagg

SEQ ID NO: 26254 - RNA, 22 nt, Homo sapiens
gaaggaggccccacaccugcuu

SEQ ID NO: 26255 - RNA, 25 nt, Homo sapiens
gagaaggggggaggggacaggcucu

SEQ ID NO: 26256 - RNA, 20 nt, Homo sapiens
gaggcugggcuuggggaguc

SEQ ID NO: 26257 - RNA, 17 nt, Homo sapiens
gcaaaaucaagcggaag

SEQ ID NO: 26258 - RNA, 21 nt, Homo sapiens
gcgggggggugaguggaucag

SEQ ID NO: 26259 - RNA, 15 nt, Homo sapiens
gcucugcccagcccc

SEQ ID NO: 26260 - RNA, 17 nt, Homo sapiens
ggacagagggauggaag

SEQ ID NO: 26261 - RNA, 19 nt, Homo sapiens
ggagugaggggaggagugg

SEQ ID NO: 26262 - RNA, 15 nt, Homo sapiens
ggcggggggcggggg

SEQ ID NO: 26263 - RNA, 19 nt, Homo sapiens
ggcugcugcacacagaggc

SEQ ID NO: 26264 - RNA, 22 nt, Homo sapiens
gggaggaguggaggggaacagg

SEQ ID NO: 26265 - RNA, 22 nt, Homo sapiens
ggggaggagggagagagggggc

SEQ ID NO: 26266 - RNA, 19 nt, Homo sapiens
ggggaggaguggaggggaa

SEQ ID NO: 26267 - RNA, 22 nt, Homo sapiens
ggggaggaguggaggggaacag

SEQ ID NO: 26268 - RNA, 16 nt, Homo sapiens
ggggcggggggcgggg

SEQ ID NO: 26269 - RNA, 18 nt, Homo sapiens
ggggcggggggcgggggg

SEQ ID NO: 26270 - RNA, 19 nt, Homo sapiens
ggggcgggggggugagugg

SEQ ID NO: 26271 - RNA, 17 nt, Homo sapiens
gggggcagggggaaagg

SEQ ID NO: 26272 - RNA, 19 nt, Homo sapiens
ggggggcagugggggaagg

SEQ ID NO: 26273 - RNA, 15 nt, Homo sapiens
ggggggcgggggggu

SEQ ID NO: 26274 - RNA, 18 nt, Homo sapiens
ggggggcgggggggugag

SEQ ID NO: 26275 - RNA, 21 nt, Homo sapiens
ggggggcgggggggugagugg

SEQ ID NO: 26276 - RNA, 20 nt, Homo sapiens
gggggugaguggaucagagc

SEQ ID NO: 26277 - RNA, 16 nt, Homo sapiens
ggguggaggcgguggg

SEQ ID NO: 26278 - RNA, 16 nt, Homo sapiens
guggaggcgguggggg

SEQ ID NO: 26279 - RNA, 23 nt, Homo sapiens
uaauuuacaaaccaaccuuacag

SEQ ID NO: 26280 - RNA, 24 nt, Homo sapiens
uggcuccuggagaaggggggaggg

SEQ ID NO: 26281 - RNA, 22 nt, Homo sapiens
uuguucuuuuucuaaaaauguu

SEQ ID NO: 26282 - RNA, 16 nt, Homo sapiens
uaggaaaaggugguca

SEQ ID NO: 26283 - RNA, 18 nt, Homo sapiens
aaagauagcaaaaugcua

SEQ ID NO: 26284 - RNA, 19 nt, Homo sapiens
aaauuauauaucauuuauu

SEQ ID NO: 26285 - RNA, 23 nt, Homo sapiens
cagagacuuggaacacugaauug

SEQ ID NO: 26286 - RNA, 23 nt, Homo sapiens
ccuuuuaagguucaaaaaugguu

SEQ ID NO: 26287 - RNA, 17 nt, Homo sapiens
ggaaaguuaaauuaagg

SEQ ID NO: 26288 - RNA, 17 nt, Homo sapiens
uguuucauucauauggu

SEQ ID NO: 26289 - RNA, 23 nt, Homo sapiens
uguuuguuucuaaucccauuauu

SEQ ID NO: 26290 - RNA, 20 nt, Homo sapiens
uucagcacagguuuaugccu

SEQ ID NO: 26291 - RNA, 20 nt, Homo sapiens
uuguacaugccuuuccuugg

SEQ ID NO: 26292 - RNA, 18 nt, Homo sapiens
uugugcuuucucuggagg

SEQ ID NO: 26293 - RNA, 20 nt, Homo sapiens
cuugacaucagccucuggca

SEQ ID NO: 26294 - RNA, 17 nt, Homo sapiens
gcgcggggcggggacgc

SEQ ID NO: 26295 - RNA, 21 nt, Homo sapiens
aucgcggccguuccccgccgg

SEQ ID NO: 26296 - RNA, 22 nt, Homo sapiens
ccgccgcggcucccgccccccg

SEQ ID NO: 26297 - RNA, 15 nt, Homo sapiens
ccguuccccgccggg

SEQ ID NO: 26298 - RNA, 18 nt, Homo sapiens
gccgcggcucccgccccc

SEQ ID NO: 26299 - RNA, 23 nt, Homo sapiens
gggcgccucggcagcguggcugc

SEQ ID NO: 26300 - RNA, 22 nt, Homo sapiens
ucucagaaguauuuuggcuucu

SEQ ID NO: 26301 - RNA, 18 nt, Homo sapiens
acuaacauuuuuaauguc

SEQ ID NO: 26302 - RNA, 19 nt, Homo sapiens
caaugcaaauaucaaaucu

SEQ ID NO: 26303 - RNA, 19 nt, Homo sapiens
uacugcagaugcucagaaa

SEQ ID NO: 26304 - RNA, 18 nt, Homo sapiens
uguuuccauacaguacag

SEQ ID NO: 26305 - RNA, 15 nt, Homo sapiens
caccggaaugcugac

SEQ ID NO: 26306 - RNA, 16 nt, Homo sapiens
ccuccuccuccagauc

SEQ ID NO: 26307 - RNA, 23 nt, Homo sapiens
gggcauagagggaggaaguuaau

SEQ ID NO: 26308 - RNA, 18 nt, Homo sapiens
ggggaagaaagcagucaa

SEQ ID NO: 26309 - RNA, 21 nt, Homo sapiens
uacgaucucuccuaagauccc

SEQ ID NO: 26310 - RNA, 19 nt, Homo sapiens
uugaagagacaaaagugaa

SEQ ID NO: 26311 - RNA, 19 nt, Homo sapiens
cccaccugcccccuagccc

SEQ ID NO: 26312 - RNA, 22 nt, Homo sapiens
uggcugguuaagugcuugcagg

SEQ ID NO: 26313 - RNA, 21 nt, Homo sapiens
uuuuuuuuuaccccuuugacu

SEQ ID NO: 26314 - RNA, 17 nt, Homo sapiens
cccggccucugccccau

SEQ ID NO: 26315 - RNA, 18 nt, Homo sapiens
cguuugguuuugguuuuc

SEQ ID NO: 26316 - RNA, 18 nt, Homo sapiens
uaugacauaaaauuggua

SEQ ID NO: 26317 - RNA, 23 nt, Homo sapiens
ucacuuuuacuguuuuuuuuuuc

SEQ ID NO: 26318 - RNA, 19 nt, Homo sapiens
cccugccacauccuccugc

SEQ ID NO: 26319 - RNA, 21 nt, Homo sapiens
uauuaacagugcaguguggaa

SEQ ID NO: 26320 - RNA, 21 nt, Homo sapiens
acgguggcagggagugggggg

SEQ ID NO: 26321 - RNA, 23 nt, Homo sapiens
ucccaccacacugcccugggucu

SEQ ID NO: 26322 - RNA, 22 nt, Homo sapiens
ugcccugggucugggagccucc

SEQ ID NO: 26323 - RNA, 21 nt, Homo sapiens
gcccccucccagccauuuugg

SEQ ID NO: 26324 - RNA, 21 nt, Homo sapiens
gcugcaaaguugcucagaggg

SEQ ID NO: 26325 - RNA, 23 nt, Homo sapiens
ucccaccacauugcccugggucu

SEQ ID NO: 26326 - RNA, 19 nt, Homo sapiens
aagaucagaguugacuaac

SEQ ID NO: 26327 - RNA, 20 nt, Homo sapiens
aaggagcauccaauaucuuu

SEQ ID NO: 26328 - RNA, 16 nt, Homo sapiens
ggagcuaauaccaccu

SEQ ID NO: 26329 - RNA, 22 nt, Homo sapiens
ugacuaacauguaaaacaaaug

SEQ ID NO: 26330 - RNA, 18 nt, Homo sapiens
ccgccggccgcucucccc

SEQ ID NO: 26331 - RNA, 20 nt, Homo sapiens
ccggcccggcugccugugcg

SEQ ID NO: 26332 - RNA, 21 nt, Homo sapiens
cgccgcugccgacgccgcccg

SEQ ID NO: 26333 - RNA, 17 nt, Homo sapiens
cgcggcccgcccggccu

SEQ ID NO: 26334 - RNA, 18 nt, Homo sapiens
cgcggucgccgcgccggc

SEQ ID NO: 26335 - RNA, 18 nt, Homo sapiens
cgucgccucucgcgccgc

SEQ ID NO: 26336 - RNA, 20 nt, Homo sapiens
cucccgcccgcugcccgccg

SEQ ID NO: 26337 - RNA, 18 nt, Homo sapiens
gcccgcugcccgccggcc

SEQ ID NO: 26338 - RNA, 16 nt, Homo sapiens
gccgcggucgccgcgc

SEQ ID NO: 26339 - RNA, 18 nt, Homo sapiens
gccgcucuccccguggcc

SEQ ID NO: 26340 - RNA, 16 nt, Homo sapiens
gcguccgaaaauggcc

SEQ ID NO: 26341 - RNA, 16 nt, Homo sapiens
ugaccacugucuugca

SEQ ID NO: 26342 - RNA, 23 nt, Homo sapiens
agcccuguccccacauguggaca

SEQ ID NO: 26343 - RNA, 23 nt, Homo sapiens
gcgcggcgggaggggcaccgcgg

SEQ ID NO: 26344 - RNA, 18 nt, Homo sapiens
gcggcgcggcgggagggg

SEQ ID NO: 26345 - RNA, 19 nt, Homo sapiens
aagaggggcugagaggggu

SEQ ID NO: 26346 - RNA, 19 nt, Homo sapiens
aggggcugagagggguugg

SEQ ID NO: 26347 - RNA, 22 nt, Homo sapiens
gggauggcgggcagcucagggg

SEQ ID NO: 26348 - RNA, 18 nt, Homo sapiens
ugccagcuuggggauuga

SEQ ID NO: 26349 - RNA, 15 nt, Homo sapiens
ugggaaaagaggggc

SEQ ID NO: 26350 - RNA, 19 nt, Homo sapiens
gcacagcccuccccuuccc

SEQ ID NO: 26351 - RNA, 20 nt, Homo sapiens
uccccggcucccuccgaugg

SEQ ID NO: 26352 - RNA, 17 nt, Homo sapiens
ugcaguggccgguacag

SEQ ID NO: 26353 - RNA, 19 nt, Homo sapiens
uggcaagucaaaaccccag

SEQ ID NO: 26354 - RNA, 21 nt, Homo sapiens
ggaggggcagucugaaaaagu

SEQ ID NO: 26355 - RNA, 19 nt, Homo sapiens
cgcgcagcccgcgcagccc

SEQ ID NO: 26356 - RNA, 14 nt, Homo sapiens
agcagagcccccuc

SEQ ID NO: 26357 - RNA, 19 nt, Homo sapiens
cacgucggugucaggguga

SEQ ID NO: 26358 - RNA, 19 nt, Homo sapiens
gcgggccauggcugggacc

SEQ ID NO: 26359 - RNA, 17 nt, Homo sapiens
uauaaaaccuaaucuau

SEQ ID NO: 26360 - RNA, 19 nt, Homo sapiens
ugagggguggccacaaggc

SEQ ID NO: 26361 - RNA, 22 nt, Homo sapiens
aaggaaggaagggguuggaaag

SEQ ID NO: 26362 - RNA, 18 nt, Homo sapiens
aggaaggaggccuuuucc

SEQ ID NO: 26363 - RNA, 21 nt, Homo sapiens
aggggaagaauggaaggaugg

SEQ ID NO: 26364 - RNA, 19 nt, Homo sapiens
auuaaaauuaaaccuaaug

SEQ ID NO: 26365 - RNA, 15 nt, Homo sapiens
cauuuuaaaauccca

SEQ ID NO: 26366 - RNA, 14 nt, Homo sapiens
ccgcggggaccugc

SEQ ID NO: 26367 - RNA, 19 nt, Homo sapiens
cucacgccugugaucccag

SEQ ID NO: 26368 - RNA, 21 nt, Homo sapiens
cucuucgucacuggccugucc

SEQ ID NO: 26369 - RNA, 17 nt, Homo sapiens
gagcugaggcuguuucc

SEQ ID NO: 26370 - RNA, 17 nt, Homo sapiens
ggagggaggggaaggaa

SEQ ID NO: 26371 - RNA, 17 nt, Homo sapiens
ggaggggaagaauggaa

SEQ ID NO: 26372 - RNA, 17 nt, Homo sapiens
gggggagagggaggaag

SEQ ID NO: 26373 - RNA, 18 nt, Homo sapiens
gggguguguuuuccucca

SEQ ID NO: 26374 - RNA, 17 nt, Homo sapiens
gugaagguggugugggg

SEQ ID NO: 26375 - RNA, 17 nt, Homo sapiens
gugugugggugugaagg

SEQ ID NO: 26376 - RNA, 18 nt, Homo sapiens
uaauagugacgauggugc

SEQ ID NO: 26377 - RNA, 19 nt, Homo sapiens
ucccaccccuuacuacucu

SEQ ID NO: 26378 - RNA, 19 nt, Homo sapiens
ugaugagcccaaaagcucc

SEQ ID NO: 26379 - RNA, 20 nt, Homo sapiens
ugguacuucuggcugaggcu

SEQ ID NO: 26380 - RNA, 18 nt, Homo sapiens
ugugagugacccuaagag

SEQ ID NO: 26381 - RNA, 19 nt, Homo sapiens
cagccgcggcggucgcggc

SEQ ID NO: 26382 - RNA, 20 nt, Homo sapiens
cagccgcggcggucgcggcg

SEQ ID NO: 26383 - RNA, 24 nt, Homo sapiens
ccccugcucgggucuccgcuuucc

SEQ ID NO: 26384 - RNA, 22 nt, Homo sapiens
cgggucuccgcuuuccuucccc

SEQ ID NO: 26385 - RNA, 16 nt, Homo sapiens
gagaaaacaggagaga

SEQ ID NO: 26386 - RNA, 16 nt, Homo sapiens
gagagcagccauaggc

SEQ ID NO: 26387 - RNA, 16 nt, Homo sapiens
gaggaaagccccccaa

SEQ ID NO: 26388 - RNA, 20 nt, Homo sapiens
gccgcggcggucgcggcggc

SEQ ID NO: 26389 - RNA, 16 nt, Homo sapiens
gcgccgcgcgccggcc

SEQ ID NO: 26390 - RNA, 21 nt, Homo sapiens
gcggcggcuggcggcggcccc

SEQ ID NO: 26391 - RNA, 16 nt, Homo sapiens
ggagaaaacaggagag

SEQ ID NO: 26392 - RNA, 14 nt, Homo sapiens
ggaggaaagagagc

SEQ ID NO: 26393 - RNA, 17 nt, Homo sapiens
gguggaggaaagagagc

SEQ ID NO: 26394 - RNA, 20 nt, Homo sapiens
guugaaagguucuaccagga

SEQ ID NO: 26395 - RNA, 17 nt, Homo sapiens
uacaauaacuuuuuucc

SEQ ID NO: 26396 - RNA, 18 nt, Homo sapiens
uacccuauacuccaaucc

SEQ ID NO: 26397 - RNA, 21 nt, Homo sapiens
ucaacauuucuauaauuucau

SEQ ID NO: 26398 - RNA, 26 nt, Homo sapiens
ucccgggauuggagagcagccauagg

SEQ ID NO: 26399 - RNA, 15 nt, Homo sapiens
uguaggguuggggag

SEQ ID NO: 26400 - RNA, 17 nt, Homo sapiens
uuucgcccaacaugcag

SEQ ID NO: 26401 - RNA, 21 nt, Homo sapiens
uuuggugguugguagguuugu

SEQ ID NO: 26402 - RNA, 18 nt, Homo sapiens
gaagauugugaggugggg

SEQ ID NO: 26403 - RNA, 22 nt, Homo sapiens
uaaaaauaacuuugcuuuacca

SEQ ID NO: 26404 - RNA, 23 nt, Homo sapiens
uaagaaaaaguaaauaaugaaga

SEQ ID NO: 26405 - RNA, 20 nt, Homo sapiens
uccuggugugguggugcaug

SEQ ID NO: 26406 - RNA, 18 nt, Homo sapiens
ugccuaugaggcacuuug

SEQ ID NO: 26407 - RNA, 23 nt, Homo sapiens
ugccuguaaucccagcacuuugg

SEQ ID NO: 26408 - RNA, 15 nt, Homo sapiens
agggguguuggaaag

SEQ ID NO: 26409 - RNA, 19 nt, Homo sapiens
cacaggucuuauugaagag

SEQ ID NO: 26410 - RNA, 18 nt, Homo sapiens
cugacauuuaaccuaauc

SEQ ID NO: 26411 - RNA, 17 nt, Homo sapiens
gcgggcucaggacacaa

SEQ ID NO: 26412 - RNA, 21 nt, Homo sapiens
ugacuaugaauuucaggggug

SEQ ID NO: 26413 - RNA, 27 nt, Homo sapiens
uuaguaguuuucucuuguaccaucaag

SEQ ID NO: 26414 - RNA, 18 nt, Homo sapiens
aaaaagcucuauaauauc

SEQ ID NO: 26415 - RNA, 18 nt, Homo sapiens
aaaugaguuugugauuua

SEQ ID NO: 26416 - RNA, 16 nt, Homo sapiens
agcaaucuguaaauca

SEQ ID NO: 26417 - RNA, 22 nt, Homo sapiens
cuaacugaaagggaaaaaugua

SEQ ID NO: 26418 - RNA, 17 nt, Homo sapiens
gccauuuaauuagcaau

SEQ ID NO: 26419 - RNA, 18 nt, Homo sapiens
gccgcaacugcugccucg

SEQ ID NO: 26420 - RNA, 16 nt, Homo sapiens
ggcuaccgcagcgguu

SEQ ID NO: 26421 - RNA, 20 nt, Homo sapiens
guaucuauauauaaaauaua

SEQ ID NO: 26422 - RNA, 16 nt, Homo sapiens
uagaagauugugugcg

SEQ ID NO: 26423 - RNA, 19 nt, Homo sapiens
ugguauuccuagcugaaau

SEQ ID NO: 26424 - RNA, 21 nt, Homo sapiens
ccaccugaggcuacuuuuuag

SEQ ID NO: 26425 - RNA, 23 nt, Homo sapiens
cccuugguucgccaccuugcucc

SEQ ID NO: 26426 - RNA, 18 nt, Homo sapiens
ccuccgugcucagaagcc

SEQ ID NO: 26427 - RNA, 18 nt, Homo sapiens
ggccuucuggccaccuga

SEQ ID NO: 26428 - RNA, 23 nt, Homo sapiens
uggaggguggugaagaacaacca

SEQ ID NO: 26429 - RNA, 21 nt, Homo sapiens
acgcuuggcagcuccggcugc

SEQ ID NO: 26430 - RNA, 18 nt, Homo sapiens
aggaagaggaggaaugaa

SEQ ID NO: 26431 - RNA, 15 nt, Homo sapiens
aggaggcgggggaga

SEQ ID NO: 26432 - RNA, 19 nt, Homo sapiens
ccccgggacgccgccgagc

SEQ ID NO: 26433 - RNA, 22 nt, Homo sapiens
ccggccccacggcccuccggcc

SEQ ID NO: 26434 - RNA, 18 nt, Homo sapiens
cggcgcccgccaacgccu

SEQ ID NO: 26435 - RNA, 18 nt, Homo sapiens
cgggggcacgggggugcg

SEQ ID NO: 26436 - RNA, 19 nt, Homo sapiens
gcacgggggugcgggugcc

SEQ ID NO: 26437 - RNA, 18 nt, Homo sapiens
gccaucgcggguccccuc

SEQ ID NO: 26438 - RNA, 17 nt, Homo sapiens
gccuggagauuuaaggu

SEQ ID NO: 26439 - RNA, 18 nt, Homo sapiens
gcgcggggugcucgcgcc

SEQ ID NO: 26440 - RNA, 19 nt, Homo sapiens
ggcgcgcagacgguggaag

SEQ ID NO: 26441 - RNA, 18 nt, Homo sapiens
gggcacgggggugcgggu

SEQ ID NO: 26442 - RNA, 19 nt, Homo sapiens
uacaauauacuauggccau

SEQ ID NO: 26443 - RNA, 22 nt, Homo sapiens
ugagacaaagagaaggguaagg

SEQ ID NO: 26444 - RNA, 15 nt, Homo sapiens
aggugcugggugaga

SEQ ID NO: 26445 - RNA, 18 nt, Homo sapiens
cccuugucaaguccugcc

SEQ ID NO: 26446 - RNA, 16 nt, Homo sapiens
cucgaaaaccuagacu

SEQ ID NO: 26447 - RNA, 15 nt, Homo sapiens
ggccaggagcagagg

SEQ ID NO: 26448 - RNA, 23 nt, Homo sapiens
ggcugcccguagggagggcgacg

SEQ ID NO: 26449 - RNA, 21 nt, Homo sapiens
guccggccuuugggggggggg

SEQ ID NO: 26450 - RNA, 17 nt, Homo sapiens
ugcccucccccuccccc

SEQ ID NO: 26451 - RNA, 17 nt, Homo sapiens
ugcccuugcccaaggcc

SEQ ID NO: 26452 - RNA, 17 nt, Homo sapiens
agaagagggaccauucu

SEQ ID NO: 26453 - RNA, 21 nt, Homo sapiens
agccccaggguggucccuucc

SEQ ID NO: 26454 - RNA, 17 nt, Homo sapiens
cccgcuccggcuccggc

SEQ ID NO: 26455 - RNA, 19 nt, Homo sapiens
cccuggaaccuggguccgg

SEQ ID NO: 26456 - RNA, 22 nt, Homo sapiens
ccggcuccggcuuugcucggcc

SEQ ID NO: 26457 - RNA, 21 nt, Homo sapiens
cggccccgcuccggcuccggc

SEQ ID NO: 26458 - RNA, 21 nt, Homo sapiens
gcaggagccaugcuuggggca

SEQ ID NO: 26459 - RNA, 19 nt, Homo sapiens
gccccgcuccggcuccggc

SEQ ID NO: 26460 - RNA, 20 nt, Homo sapiens
gcggccccgcuccggcuccg

SEQ ID NO: 26461 - RNA, 18 nt, Homo sapiens
gggcacgggguagggugu

SEQ ID NO: 26462 - RNA, 18 nt, Homo sapiens
ugggcuguggcccugugg

SEQ ID NO: 26463 - RNA, 24 nt, Homo sapiens
aagaauccgaagaugaucuguggc

SEQ ID NO: 26464 - RNA, 25 nt, Homo sapiens
acuuagagacagguauagcuugugc

SEQ ID NO: 26465 - RNA, 20 nt, Homo sapiens
agcaauuucaucaacagauc

SEQ ID NO: 26466 - RNA, 20 nt, Homo sapiens
aggggcgggagacgggcgag

SEQ ID NO: 26467 - RNA, 23 nt, Homo sapiens
ccuuauuuuguuuuuuaucucug

SEQ ID NO: 26468 - RNA, 21 nt, Homo sapiens
cggcggcggcggcgacgacgu

SEQ ID NO: 26469 - RNA, 21 nt, Homo sapiens
cgggggcgggcggcgggaccg

SEQ ID NO: 26470 - RNA, 18 nt, Homo sapiens
gcuguuugcucaacucuu

SEQ ID NO: 26471 - RNA, 24 nt, Homo sapiens
ggagacgggcgagguggcgcaucg

SEQ ID NO: 26472 - RNA, 18 nt, Homo sapiens
ggaggggcgggagacggg

SEQ ID NO: 26473 - RNA, 15 nt, Homo sapiens
gggggcgggcggcgg

SEQ ID NO: 26474 - RNA, 22 nt, Homo sapiens
gguacggggucccuccgguucc

SEQ ID NO: 26475 - RNA, 21 nt, Homo sapiens
uauccugaauccuuuccggcu

SEQ ID NO: 26476 - RNA, 23 nt, Homo sapiens
ucaaugauauaugcaacuaauac

SEQ ID NO: 26477 - RNA, 19 nt, Homo sapiens
ucaauuucaugguuguauu

SEQ ID NO: 26478 - RNA, 21 nt, Homo sapiens
uccuaauuuuaaaacuaaagg

SEQ ID NO: 26479 - RNA, 21 nt, Homo sapiens
ugccccggacccggcggcggc

SEQ ID NO: 26480 - RNA, 20 nt, Homo sapiens
uggauugaaguccuuauuuu

SEQ ID NO: 26481 - RNA, 21 nt, Homo sapiens
uguccgguacggggucccucc

SEQ ID NO: 26482 - RNA, 17 nt, Homo sapiens
uguuuuuucccagaggc

SEQ ID NO: 26483 - RNA, 18 nt, Homo sapiens
uucaccauaaacugaugc

SEQ ID NO: 26484 - RNA, 24 nt, Homo sapiens
aggcgcaggcggggccccccugcu

SEQ ID NO: 26485 - RNA, 15 nt, Homo sapiens
ccccagcugcuccac

SEQ ID NO: 26486 - RNA, 23 nt, Homo sapiens
ccccagcugcuccaccuccuucc

SEQ ID NO: 26487 - RNA, 16 nt, Homo sapiens
ccuccuuccucucugu

SEQ ID NO: 26488 - RNA, 19 nt, Homo sapiens
ccugcucugccccuagccc

SEQ ID NO: 26489 - RNA, 21 nt, Homo sapiens
cucugggggucuuccuauggc

SEQ ID NO: 26490 - RNA, 16 nt, Homo sapiens
gacccucucucugggg

SEQ ID NO: 26491 - RNA, 15 nt, Homo sapiens
gcuccaccuccuucc

SEQ ID NO: 26492 - RNA, 20 nt, Homo sapiens
gugagccccagccuagcccc

SEQ ID NO: 26493 - RNA, 23 nt, Homo sapiens
uacaaacuuuacaaaguaaaagg

SEQ ID NO: 26494 - RNA, 17 nt, Homo sapiens
ugcccuggggcggggcc

SEQ ID NO: 26495 - RNA, 18 nt, Homo sapiens
ugcuccaccuccuuccuc

SEQ ID NO: 26496 - RNA, 19 nt, Homo sapiens
ugcuugagugggggaggag

SEQ ID NO: 26497 - RNA, 21 nt, Homo sapiens
uuuuuuuuuccgauaaugacu

SEQ ID NO: 26498 - RNA, 15 nt, Homo sapiens
augccauguuucacg

SEQ ID NO: 26499 - RNA, 21 nt, Homo sapiens
acaugaccacagucuucuguu

SEQ ID NO: 26500 - RNA, 23 nt, Homo sapiens
agcuguuuuuaagaaaccugaaa

SEQ ID NO: 26501 - RNA, 17 nt, Homo sapiens
cauucccucuuggggaa

SEQ ID NO: 26502 - RNA, 20 nt, Homo sapiens
ccagggcugcagauccucug

SEQ ID NO: 26503 - RNA, 19 nt, Homo sapiens
cggcugagucggcaggguu

SEQ ID NO: 26504 - RNA, 18 nt, Homo sapiens
uagcauucauuuuuggcu

SEQ ID NO: 26505 - RNA, 20 nt, Homo sapiens
ucaugugacuucuagacgug

SEQ ID NO: 26506 - RNA, 16 nt, Homo sapiens
ucccaaccgcuuccuc

SEQ ID NO: 26507 - RNA, 19 nt, Homo sapiens
uggagaaauccggcagcag

SEQ ID NO: 26508 - RNA, 19 nt, Homo sapiens
caggccagcccucgggaca

SEQ ID NO: 26509 - RNA, 19 nt, Homo sapiens
gccccggggggccugcuuc

SEQ ID NO: 26510 - RNA, 19 nt, Homo sapiens
gggaagguccgauagagga

SEQ ID NO: 26511 - RNA, 19 nt, Homo sapiens
gggacaggugcaggagucg

SEQ ID NO: 26512 - RNA, 14 nt, Homo sapiens
gcccuggagcgagc

SEQ ID NO: 26513 - RNA, 20 nt, Homo sapiens
acuccacccuaccccaagca

SEQ ID NO: 26514 - RNA, 21 nt, Homo sapiens
cagcaucgaucaaaggcauca

SEQ ID NO: 26515 - RNA, 17 nt, Homo sapiens
cuagucauuuacuucca

SEQ ID NO: 26516 - RNA, 23 nt, Homo sapiens
ucaguuugaggguauguuaagua

SEQ ID NO: 26517 - RNA, 19 nt, Homo sapiens
uggugaaaggcuuugcuuc

SEQ ID NO: 26518 - RNA, 18 nt, Homo sapiens
uguggauucuuuucucca

SEQ ID NO: 26519 - RNA, 19 nt, Homo sapiens
acaaaaauggcucugauug

SEQ ID NO: 26520 - RNA, 21 nt, Homo sapiens
aggagguucuguuggcuacca

SEQ ID NO: 26521 - RNA, 20 nt, Homo sapiens
uaauggucuuccaaagauau

SEQ ID NO: 26522 - RNA, 23 nt, Homo sapiens
ucauaaaggagagaaaauauuuc

SEQ ID NO: 26523 - RNA, 19 nt, Homo sapiens
uuaguaguacucaaacgag

SEQ ID NO: 26524 - RNA, 19 nt, Homo sapiens
uucugcaaaccaccauuuu

SEQ ID NO: 26525 - RNA, 18 nt, Homo sapiens
aagcaggaaggucucugc

SEQ ID NO: 26526 - RNA, 26 nt, Homo sapiens
ggcccggggaggggaaaagggucggg

SEQ ID NO: 26527 - RNA, 28 nt, Homo sapiens
ggggaggggguggggaaaggggggagcg

SEQ ID NO: 26528 - RNA, 19 nt, Homo sapiens
ggguauacacugaagucug

SEQ ID NO: 26529 - RNA, 18 nt, Homo sapiens
ucgggggagggggugggg

SEQ ID NO: 26530 - RNA, 19 nt, Homo sapiens
ucgggggagggggugggga

SEQ ID NO: 26531 - RNA, 18 nt, Homo sapiens
ugaagaaggaaaaaggca

SEQ ID NO: 26532 - RNA, 18 nt, Homo sapiens
ugaagucugaguuucaaa

SEQ ID NO: 26533 - RNA, 18 nt, Homo sapiens
uggggaaaggggggagcc

SEQ ID NO: 26534 - RNA, 19 nt, Homo sapiens
uucuguguccccuacacau

SEQ ID NO: 26535 - RNA, 19 nt, Homo sapiens
aaaggaaauagucaacuug

SEQ ID NO: 26536 - RNA, 21 nt, Homo sapiens
auccaaguuguggucccuuua

SEQ ID NO: 26537 - RNA, 21 nt, Homo sapiens
caagcugcaguuucugaggua

SEQ ID NO: 26538 - RNA, 17 nt, Homo sapiens
cagcagucgccacuucc

SEQ ID NO: 26539 - RNA, 22 nt, Homo sapiens
acacggggcagguggcagaggc

SEQ ID NO: 26540 - RNA, 21 nt, Homo sapiens
agcuugcucgcucccagcucc

SEQ ID NO: 26541 - RNA, 18 nt, Homo sapiens
cccgagcugcuggccugg

SEQ ID NO: 26542 - RNA, 18 nt, Homo sapiens
cucuggagaccagagggg

SEQ ID NO: 26543 - RNA, 19 nt, Homo sapiens
cugauccuuccccucuccc

SEQ ID NO: 26544 - RNA, 19 nt, Homo sapiens
cuggggugggguggaaugg

SEQ ID NO: 26545 - RNA, 21 nt, Homo sapiens
gaaugcuucagucacuggaga

SEQ ID NO: 26546 - RNA, 22 nt, Homo sapiens
gccgcagagagccacucuggag

SEQ ID NO: 26547 - RNA, 20 nt, Homo sapiens
gcuugcucgcucccagcucc

SEQ ID NO: 26548 - RNA, 18 nt, Homo sapiens
guuguguuaaaaaacagg

SEQ ID NO: 26549 - RNA, 20 nt, Homo sapiens
guuguguuaaaaaacaggca

SEQ ID NO: 26550 - RNA, 21 nt, Homo sapiens
ucccagcucccuggccuggcu

SEQ ID NO: 26551 - RNA, 25 nt, Homo sapiens
uggccuggcccccugauccuucccc

SEQ ID NO: 26552 - RNA, 19 nt, Homo sapiens
acagucaauauacauuuua

SEQ ID NO: 26553 - RNA, 21 nt, Homo sapiens
gaaguggaaaauucuuagagg

SEQ ID NO: 26554 - RNA, 17 nt, Homo sapiens
uucuuguccuuagcaca

SEQ ID NO: 26555 - RNA, 20 nt, Homo sapiens
agaaggcacacaguggcagu

SEQ ID NO: 26556 - RNA, 28 nt, Homo sapiens
aggcagcuagucccgagagcuuguggug

SEQ ID NO: 26557 - RNA, 18 nt, Homo sapiens
gcgaaggcagcuaguccc

SEQ ID NO: 26558 - RNA, 19 nt, Homo sapiens
agaggcaggucugggaggg

SEQ ID NO: 26559 - RNA, 21 nt, Homo sapiens
agguugcaaauguggcugcug

SEQ ID NO: 26560 - RNA, 16 nt, Homo sapiens
gggguggggguggggg

SEQ ID NO: 26561 - RNA, 18 nt, Homo sapiens
gggguggggguggggugg

SEQ ID NO: 26562 - RNA, 23 nt, Homo sapiens
gggguggggugggcaaggguggg

SEQ ID NO: 26563 - RNA, 22 nt, Homo sapiens
ggguggggugggcaaggguggg

SEQ ID NO: 26564 - RNA, 19 nt, Homo sapiens
ugcaggcuuggaccgcuac

SEQ ID NO: 26565 - RNA, 18 nt, Homo sapiens
uggggguggggguggggu

SEQ ID NO: 26566 - RNA, 18 nt, Homo sapiens
ccacgcccuugcagggcc

SEQ ID NO: 26567 - RNA, 24 nt, Homo sapiens
cucaccccuuccuggucuccuugc

SEQ ID NO: 26568 - RNA, 19 nt, Homo sapiens
gaaagagguuuucaauuuu

SEQ ID NO: 26569 - RNA, 17 nt, Homo sapiens
gaacgcaggcccucgcg

SEQ ID NO: 26570 - RNA, 18 nt, Homo sapiens
gcucagagcccccgguag

SEQ ID NO: 26571 - RNA, 14 nt, Homo sapiens
ggccacaccggcca

SEQ ID NO: 26572 - RNA, 14 nt, Homo sapiens
ggccacgcuggagc

SEQ ID NO: 26573 - RNA, 21 nt, Homo sapiens
guuacuguuaacaagaguccc

SEQ ID NO: 26574 - RNA, 19 nt, Homo sapiens
ucucaccccuuccuggucu

SEQ ID NO: 26575 - RNA, 16 nt, Homo sapiens
ugcagggccacaccgg

SEQ ID NO: 26576 - RNA, 17 nt, Homo sapiens
ugcuggauaaggcuuug

SEQ ID NO: 26577 - RNA, 17 nt, Homo sapiens
ccucgggccaccuuugg

SEQ ID NO: 26578 - RNA, 19 nt, Homo sapiens
ccuugguggggccaucgcu

SEQ ID NO: 26579 - RNA, 16 nt, Homo sapiens
gccacagcgacgagcc

SEQ ID NO: 26580 - RNA, 18 nt, Homo sapiens
ugcccuggccgggcuccc

SEQ ID NO: 26581 - RNA, 21 nt, Homo sapiens
ugccucgggccaccuuugggu

SEQ ID NO: 26582 - RNA, 17 nt, Homo sapiens
gccuagaggaaaagaaa

SEQ ID NO: 26583 - RNA, 24 nt, Homo sapiens
uaauuuauauauauauaugcauau

SEQ ID NO: 26584 - RNA, 19 nt, Homo sapiens
uacagagaugccaccaccu

SEQ ID NO: 26585 - RNA, 24 nt, Homo sapiens
uauauauauauaugcauauuuaua

SEQ ID NO: 26586 - RNA, 15 nt, Homo sapiens
aagaccccaaagagg

SEQ ID NO: 26587 - RNA, 20 nt, Homo sapiens
acauguaugugugugagagu

SEQ ID NO: 26588 - RNA, 19 nt, Homo sapiens
aggaggcuccagcacuguc

SEQ ID NO: 26589 - RNA, 18 nt, Homo sapiens
caacaggaucaccuaaua

SEQ ID NO: 26590 - RNA, 18 nt, Homo sapiens
cacagcagcaaaaagauu

SEQ ID NO: 26591 - RNA, 19 nt, Homo sapiens
cagcagccuaagggaaccu

SEQ ID NO: 26592 - RNA, 22 nt, Homo sapiens
ccgcguccuccucggccuccuc

SEQ ID NO: 26593 - RNA, 20 nt, Homo sapiens
ccggcccuuuuucucuucug

SEQ ID NO: 26594 - RNA, 17 nt, Homo sapiens
cgccggcagccggcgcc

SEQ ID NO: 26595 - RNA, 18 nt, Homo sapiens
gcaaaaagauuuagcaau

SEQ ID NO: 26596 - RNA, 16 nt, Homo sapiens
guagguugaaagggua

SEQ ID NO: 26597 - RNA, 19 nt, Homo sapiens
guggagaagaccccaaaga

SEQ ID NO: 26598 - RNA, 23 nt, Homo sapiens
uagaaaccacgugagaaaacugg

SEQ ID NO: 26599 - RNA, 20 nt, Homo sapiens
ucacuccugguuuuuuuuuu

SEQ ID NO: 26600 - RNA, 21 nt, Homo sapiens
ucagaacuuucacucccacua

SEQ ID NO: 26601 - RNA, 21 nt, Homo sapiens
uccagggcuguugcauuggca

SEQ ID NO: 26602 - RNA, 22 nt, Homo sapiens
ucccgccggcagccggcgccgc

SEQ ID NO: 26603 - RNA, 17 nt, Homo sapiens
uccuguggccuccucag

SEQ ID NO: 26604 - RNA, 17 nt, Homo sapiens
ugagaaaacugggcuuc

SEQ ID NO: 26605 - RNA, 14 nt, Homo sapiens
ugagcuugaguaac

SEQ ID NO: 26606 - RNA, 20 nt, Homo sapiens
ugaguccaguaagagcuuga

SEQ ID NO: 26607 - RNA, 18 nt, Homo sapiens
uguaugugugugagagug

SEQ ID NO: 26608 - RNA, 17 nt, Homo sapiens
uuacaucaguuucuuua

SEQ ID NO: 26609 - RNA, 15 nt, Homo sapiens
uuuuacccagcccag

SEQ ID NO: 26610 - RNA, 19 nt, Homo sapiens
aacgcgagccggggggucg

SEQ ID NO: 26611 - RNA, 17 nt, Homo sapiens
ccgccgcgccggcuggc

SEQ ID NO: 26612 - RNA, 17 nt, Homo sapiens
gcccgaucccgggcgcc

SEQ ID NO: 26613 - RNA, 15 nt, Homo sapiens
gccgcgccggcuggc

SEQ ID NO: 26614 - RNA, 20 nt, Homo sapiens
gcgcagggccugggcuuggg

SEQ ID NO: 26615 - RNA, 20 nt, Homo sapiens
gcuggggcuccccuacacgg

SEQ ID NO: 26616 - RNA, 19 nt, Homo sapiens
uauugaaaucuuuuuaaau

SEQ ID NO: 26617 - RNA, 19 nt, Homo sapiens
auuguguuucucuaguuuu

SEQ ID NO: 26618 - RNA, 18 nt, Homo sapiens
ccaacauucacauuuauu

SEQ ID NO: 26619 - RNA, 21 nt, Homo sapiens
gcuggcaaaggcagugcuggc

SEQ ID NO: 26620 - RNA, 19 nt, Homo sapiens
ucagaaagcaugcuuucug

SEQ ID NO: 26621 - RNA, 17 nt, Homo sapiens
ugguaaaaucuuuguag

SEQ ID NO: 26622 - RNA, 21 nt, Homo sapiens
uugcuuauuguguuucucuag

SEQ ID NO: 26623 - RNA, 16 nt, Homo sapiens
agauuccagaggcuug

SEQ ID NO: 26624 - RNA, 19 nt, Homo sapiens
gagguggccgcguggacgu

SEQ ID NO: 26625 - RNA, 19 nt, Homo sapiens
gcucaggcaccagccagca

SEQ ID NO: 26626 - RNA, 24 nt, Homo sapiens
gggucagagcucuggaagcucuug

SEQ ID NO: 26627 - RNA, 21 nt, Homo sapiens
gggugggggcuggggguuggg

SEQ ID NO: 26628 - RNA, 19 nt, Homo sapiens
gguggaggcagggaggggc

SEQ ID NO: 26629 - RNA, 20 nt, Homo sapiens
ggugggggcuggggguuggg

SEQ ID NO: 26630 - RNA, 20 nt, Homo sapiens
gguggugcccucacaucugg

SEQ ID NO: 26631 - RNA, 14 nt, Homo sapiens
gugcccucacaucu

SEQ ID NO: 26632 - RNA, 20 nt, Homo sapiens
uaccccaccaucccacuacc

SEQ ID NO: 26633 - RNA, 22 nt, Homo sapiens
uccuuuguagcccucuccacug

SEQ ID NO: 26634 - RNA, 20 nt, Homo sapiens
auguagcugggcguggggga

SEQ ID NO: 26635 - RNA, 19 nt, Homo sapiens
ccucugacucugccucuga

SEQ ID NO: 26636 - RNA, 18 nt, Homo sapiens
gagccuccagaaggagug

SEQ ID NO: 26637 - RNA, 18 nt, Homo sapiens
gaggccuuggaagaaggu

SEQ ID NO: 26638 - RNA, 19 nt, Homo sapiens
gcccccucucaggcugaga

SEQ ID NO: 26639 - RNA, 19 nt, Homo sapiens
ggcagaaguagcaucagag

SEQ ID NO: 26640 - RNA, 21 nt, Homo sapiens
ggccuugggggaugaagaggg

SEQ ID NO: 26641 - RNA, 21 nt, Homo sapiens
uaaaguugcagauggaacuaa

SEQ ID NO: 26642 - RNA, 16 nt, Homo sapiens
ugcccagaccucagcc

SEQ ID NO: 26643 - RNA, 18 nt, Homo sapiens
uggagggaggcaggagag

SEQ ID NO: 26644 - RNA, 18 nt, Homo sapiens
uguccggggaucccugag

SEQ ID NO: 26645 - RNA, 17 nt, Homo sapiens
ugugacgucuaacgcug

SEQ ID NO: 26646 - RNA, 17 nt, Homo sapiens
acacaaucgcacacccc

SEQ ID NO: 26647 - RNA, 23 nt, Homo sapiens
uaugcaacaaauuuuauuuagca

SEQ ID NO: 26648 - RNA, 23 nt, Homo sapiens
agaggggaaguugacacaacgug

SEQ ID NO: 26649 - RNA, 15 nt, Homo sapiens
ccacagagugguugc

SEQ ID NO: 26650 - RNA, 18 nt, Homo sapiens
ccacuccugccagcugcc

SEQ ID NO: 26651 - RNA, 24 nt, Homo sapiens
cuucaauuuuauuucuauuuuaaa

SEQ ID NO: 26652 - RNA, 14 nt, Homo sapiens
cuuuggaagagggg

SEQ ID NO: 26653 - RNA, 21 nt, Homo sapiens
gaaucagaaagauggugaaga

SEQ ID NO: 26654 - RNA, 22 nt, Homo sapiens
gcaugccuuugugugacccggu

SEQ ID NO: 26655 - RNA, 18 nt, Homo sapiens
ugggacagaagaggcugu

SEQ ID NO: 26656 - RNA, 23 nt, Homo sapiens
aguaguuauucaguauaagguuu

SEQ ID NO: 26657 - RNA, 19 nt, Homo sapiens
uccaaccagugaggaaaac

SEQ ID NO: 26658 - RNA, 20 nt, Homo sapiens
uuagcacaggaguauguaua

SEQ ID NO: 26659 - RNA, 18 nt, Homo sapiens
aaguggaaaaacuggagg

SEQ ID NO: 26660 - RNA, 18 nt, Homo sapiens
gaggagucgagcgggcag

SEQ ID NO: 26661 - RNA, 18 nt, Homo sapiens
gccccggcagccggcgcc

SEQ ID NO: 26662 - RNA, 18 nt, Homo sapiens
ggugggcggcucuccagg

SEQ ID NO: 26663 - RNA, 19 nt, Homo sapiens
ugaggggugaagcugggug

SEQ ID NO: 26664 - RNA, 18 nt, Homo sapiens
ugcugccauccccauggu

SEQ ID NO: 26665 - RNA, 19 nt, Homo sapiens
gaaacuuaaaaaauuauca

SEQ ID NO: 26666 - RNA, 18 nt, Homo sapiens
gcgucggccucgcagugc

SEQ ID NO: 26667 - RNA, 22 nt, Homo sapiens
caucgugugugugugugugugu

SEQ ID NO: 26668 - RNA, 18 nt, Homo sapiens
cgugggcuucgccuggcc

SEQ ID NO: 26669 - RNA, 21 nt, Homo sapiens
gggagagugggagggagcggg

SEQ ID NO: 26670 - RNA, 18 nt, Homo sapiens
ugugugugugugugugug

SEQ ID NO: 26671 - RNA, 19 nt, Homo sapiens
ugugugugugugugugugu

SEQ ID NO: 26672 - RNA, 18 nt, Homo sapiens
agaggcgccccgucgugg

SEQ ID NO: 26673 - RNA, 24 nt, Homo sapiens
auauauauauauauauguauauau

SEQ ID NO: 26674 - RNA, 22 nt, Homo sapiens
auauauauauauauguauauau

SEQ ID NO: 26675 - RNA, 22 nt, Homo sapiens
auauauauauauguauauauau

SEQ ID NO: 26676 - RNA, 22 nt, Homo sapiens
auauauauauguauauauauau

SEQ ID NO: 26677 - RNA, 22 nt, Homo sapiens
cauauauauauauauauguaua

SEQ ID NO: 26678 - RNA, 23 nt, Homo sapiens
cauauauauauauauauguauau

SEQ ID NO: 26679 - RNA, 25 nt, Homo sapiens
cauauauauauauauauguauauau

SEQ ID NO: 26680 - RNA, 23 nt, Homo sapiens
caucuuucuguugauuauguggc

SEQ ID NO: 26681 - RNA, 18 nt, Homo sapiens
cauuuccacagcugccag

SEQ ID NO: 26682 - RNA, 17 nt, Homo sapiens
cccaccgccccuccccc

SEQ ID NO: 26683 - RNA, 18 nt, Homo sapiens
ccucgggggcuccgcggc

SEQ ID NO: 26684 - RNA, 19 nt, Homo sapiens
gaaugggguggggcaggaa

SEQ ID NO: 26685 - RNA, 19 nt, Homo sapiens
gccuuagccucccuccucc

SEQ ID NO: 26686 - RNA, 18 nt, Homo sapiens
gggccuuaagacagggcu

SEQ ID NO: 26687 - RNA, 22 nt, Homo sapiens
uauauauauauauauguauaua

SEQ ID NO: 26688 - RNA, 24 nt, Homo sapiens
uauauauauauauauguauauaua

SEQ ID NO: 26689 - RNA, 22 nt, Homo sapiens
uauauauauauauguauauaua

SEQ ID NO: 26690 - RNA, 24 nt, Homo sapiens
uauauauauauauguauauauaua

SEQ ID NO: 26691 - RNA, 22 nt, Homo sapiens
uauauauauauguauauauaua

SEQ ID NO: 26692 - RNA, 24 nt, Homo sapiens
uauauauauauguauauauauaua

SEQ ID NO: 26693 - RNA, 22 nt, Homo sapiens
uauauauauguauauauauaua

SEQ ID NO: 26694 - RNA, 25 nt, Homo sapiens
uauguauauauauauaauccauaua

SEQ ID NO: 26695 - RNA, 16 nt, Homo sapiens
ugcccuuagccacagc

SEQ ID NO: 26696 - RNA, 15 nt, Homo sapiens
ugggcccucgggggc

SEQ ID NO: 26697 - RNA, 17 nt, Homo sapiens
cccgccucucgcccugg

SEQ ID NO: 26698 - RNA, 23 nt, Homo sapiens
ccucuccggcucccgccucucgc

SEQ ID NO: 26699 - RNA, 17 nt, Homo sapiens
gagccagaguggcauga

SEQ ID NO: 26700 - RNA, 23 nt, Homo sapiens
ucuccggcucccgccucucgccc

SEQ ID NO: 26701 - RNA, 18 nt, Homo sapiens
uggcuccccuccucuccc

SEQ ID NO: 26702 - RNA, 18 nt, Homo sapiens
aagcagaaaaguuggaac

SEQ ID NO: 26703 - RNA, 20 nt, Homo sapiens
cccauccuggguucucugcc

SEQ ID NO: 26704 - RNA, 18 nt, Homo sapiens
ccgcgcccaacaccuccc

SEQ ID NO: 26705 - RNA, 18 nt, Homo sapiens
acccccacccgccauccc

SEQ ID NO: 26706 - RNA, 18 nt, Homo sapiens
aggggggggggagagggg

SEQ ID NO: 26707 - RNA, 19 nt, Homo sapiens
ggggggagaggggauaugg

SEQ ID NO: 26708 - RNA, 21 nt, Homo sapiens
ugcagaggcucccgcgccggc

SEQ ID NO: 26709 - RNA, 19 nt, Homo sapiens
cagcgcgcuucccgggggc

SEQ ID NO: 26710 - RNA, 21 nt, Homo sapiens
gucauauaauuuuuugaaaca

SEQ ID NO: 26711 - RNA, 19 nt, Homo sapiens
caguggcgagccccugcag

SEQ ID NO: 26712 - RNA, 17 nt, Homo sapiens
uccacugccuucaguca

SEQ ID NO: 26713 - RNA, 18 nt, Homo sapiens
aaaaaaagaaaaaaaagg

SEQ ID NO: 26714 - RNA, 25 nt, Homo sapiens
aaaccagaacaggguagguuuuugu

SEQ ID NO: 26715 - RNA, 17 nt, Homo sapiens
aagcagucucacaaucu

SEQ ID NO: 26716 - RNA, 18 nt, Homo sapiens
aggaggaggggaggaggc

SEQ ID NO: 26717 - RNA, 19 nt, Homo sapiens
ggaggaggcggagggccga

SEQ ID NO: 26718 - RNA, 21 nt, Homo sapiens
ggcggcggcgagaggagcggc

SEQ ID NO: 26719 - RNA, 20 nt, Homo sapiens
gggaaggaggcggugcgggc

SEQ ID NO: 26720 - RNA, 20 nt, Homo sapiens
uaauguauaucaguuucucu

SEQ ID NO: 26721 - RNA, 21 nt, Homo sapiens
uagagauauucaaccugaaca

SEQ ID NO: 26722 - RNA, 18 nt, Homo sapiens
ucauuaacaguagagugu

SEQ ID NO: 26723 - RNA, 19 nt, Homo sapiens
uggggguuggggguggaac

SEQ ID NO: 26724 - RNA, 20 nt, Homo sapiens
aacgacguguguaaaugaca

SEQ ID NO: 26725 - RNA, 19 nt, Homo sapiens
caccgcccgcccccccccg

SEQ ID NO: 26726 - RNA, 16 nt, Homo sapiens
cacgccugccgugccc

SEQ ID NO: 26727 - RNA, 16 nt, Homo sapiens
ccccggccccuucccc

SEQ ID NO: 26728 - RNA, 20 nt, Homo sapiens
ccccggccccuuccccuccc

SEQ ID NO: 26729 - RNA, 18 nt, Homo sapiens
ccgcccaccuggccugac

SEQ ID NO: 26730 - RNA, 19 nt, Homo sapiens
ccgcugcggcaacgaugug

SEQ ID NO: 26731 - RNA, 23 nt, Homo sapiens
cggcagccgccccgcuccugcag

SEQ ID NO: 26732 - RNA, 19 nt, Homo sapiens
gcacagggccagcccgggg

SEQ ID NO: 26733 - RNA, 17 nt, Homo sapiens
gccagcccggggcggga

SEQ ID NO: 26734 - RNA, 15 nt, Homo sapiens
gccccuuccccuccc

SEQ ID NO: 26735 - RNA, 21 nt, Homo sapiens
gcccggggcgggagucuuagu

SEQ ID NO: 26736 - RNA, 24 nt, Homo sapiens
gcccuuuuguccgcccaccuggcc

SEQ ID NO: 26737 - RNA, 17 nt, Homo sapiens
gccgcccuggccgccug

SEQ ID NO: 26738 - RNA, 17 nt, Homo sapiens
gccgugcccccuccccg

SEQ ID NO: 26739 - RNA, 20 nt, Homo sapiens
gcggagggagggcgcggggg

SEQ ID NO: 26740 - RNA, 21 nt, Homo sapiens
gggagggagggaggacacagc

SEQ ID NO: 26741 - RNA, 17 nt, Homo sapiens
guaucaaaaauauaccc

SEQ ID NO: 26742 - RNA, 17 nt, Homo sapiens
uggauggaggcgcaggc

SEQ ID NO: 26743 - RNA, 18 nt, Homo sapiens
uggcguggaggugcgugg

SEQ ID NO: 26744 - RNA, 24 nt, Homo sapiens
cccguuuuuugggccccccuuuuu

SEQ ID NO: 26745 - RNA, 22 nt, Homo sapiens
gcgagugcgguugucugcgugc

SEQ ID NO: 26746 - RNA, 21 nt, Homo sapiens
uccaaaagggcgggaggagca

SEQ ID NO: 26747 - RNA, 18 nt, Homo sapiens
ugucugcgugcucgugag

SEQ ID NO: 26748 - RNA, 16 nt, Homo sapiens
agcucugacagagacu

SEQ ID NO: 26749 - RNA, 21 nt, Homo sapiens
aggcaggcggcugggaggugg

SEQ ID NO: 26750 - RNA, 17 nt, Homo sapiens
aggccaaggcaggcggc

SEQ ID NO: 26751 - RNA, 18 nt, Homo sapiens
ggcagaggcugcaaucuc

SEQ ID NO: 26752 - RNA, 20 nt, Homo sapiens
uaaaaugucagagguacacu

SEQ ID NO: 26753 - RNA, 19 nt, Homo sapiens
acaggugagagucaggaag

SEQ ID NO: 26754 - RNA, 19 nt, Homo sapiens
ucgggcacgucggccuccu

SEQ ID NO: 26755 - RNA, 18 nt, Homo sapiens
caccgggcgcacgcucag

SEQ ID NO: 26756 - RNA, 16 nt, Homo sapiens
cagcauguauugacag

SEQ ID NO: 26757 - RNA, 17 nt, Homo sapiens
ccauaaauaauaucuug

SEQ ID NO: 26758 - RNA, 21 nt, Homo sapiens
ccgcccugcccugccccucgc

SEQ ID NO: 26759 - RNA, 19 nt, Homo sapiens
gaguauuaaauagaaauaa

SEQ ID NO: 26760 - RNA, 24 nt, Homo sapiens
uauguauauaugaacacauauaua

SEQ ID NO: 26761 - RNA, 22 nt, Homo sapiens
ucuacaguaguugguuucaaac

SEQ ID NO: 26762 - RNA, 17 nt, Homo sapiens
ucacaauguuaaaaucc

SEQ ID NO: 26763 - RNA, 24 nt, Homo sapiens
uuacauauuaauguacuuuuugaa

SEQ ID NO: 26764 - RNA, 27 nt, Homo sapiens
auggugcuaaguauuggauccggaugg

SEQ ID NO: 26765 - RNA, 21 nt, Homo sapiens
caccucaagggaauaacagaa

SEQ ID NO: 26766 - RNA, 17 nt, Homo sapiens
ccccaggugagcccuuc

SEQ ID NO: 26767 - RNA, 21 nt, Homo sapiens
ccggcucuggccccggcuccg

SEQ ID NO: 26768 - RNA, 21 nt, Homo sapiens
ccuggcucguguccccacgcc

SEQ ID NO: 26769 - RNA, 21 nt, Homo sapiens
cgcgcuccggcucuggccccg

SEQ ID NO: 26770 - RNA, 26 nt, Homo sapiens
cggcgccuggcucguguccccacgcc

SEQ ID NO: 26771 - RNA, 27 nt, Homo sapiens
cuccggcggcggcgccuggcucguguc

SEQ ID NO: 26772 - RNA, 21 nt, Homo sapiens
gccccggcuccgcuggcuccg

SEQ ID NO: 26773 - RNA, 20 nt, Homo sapiens
gcggcugcguggacgcggac

SEQ ID NO: 26774 - RNA, 17 nt, Homo sapiens
gcuccggcggcggcgcc

SEQ ID NO: 26775 - RNA, 18 nt, Homo sapiens
ggccccggcuccgcuggc

SEQ ID NO: 26776 - RNA, 20 nt, Homo sapiens
gggcggcgcgcgggcucugc

SEQ ID NO: 26777 - RNA, 23 nt, Homo sapiens
gggcugggcagggcugggcuggg

SEQ ID NO: 26778 - RNA, 18 nt, Homo sapiens
gugggcugcaguuccagc

SEQ ID NO: 26779 - RNA, 18 nt, Homo sapiens
uaagacacaggcauagcc

SEQ ID NO: 26780 - RNA, 25 nt, Homo sapiens
ucacauacacgaaguuuuuuuuuuc

SEQ ID NO: 26781 - RNA, 19 nt, Homo sapiens
ucccuuuguggugaggacg

SEQ ID NO: 26782 - RNA, 19 nt, Homo sapiens
ucuccucgccuccuaaugg

SEQ ID NO: 26783 - RNA, 19 nt, Homo sapiens
uggccugggcauggaggcu

SEQ ID NO: 26784 - RNA, 18 nt, Homo sapiens
uggcucucaaagagccug

SEQ ID NO: 26785 - RNA, 20 nt, Homo sapiens
ugggcgggagcugcgcccuc

SEQ ID NO: 26786 - RNA, 22 nt, Homo sapiens
ugguaucuuuuuggcagcaguu

SEQ ID NO: 26787 - RNA, 21 nt, Homo sapiens
aaguauuauuuuauguauauu

SEQ ID NO: 26788 - RNA, 23 nt, Homo sapiens
caaaugcaauucaagugugaaua

SEQ ID NO: 26789 - RNA, 23 nt, Homo sapiens
caggaaaaugaccuguucugaag

SEQ ID NO: 26790 - RNA, 22 nt, Homo sapiens
uauuggaagcaaguuguuucug

SEQ ID NO: 26791 - RNA, 19 nt, Homo sapiens
ucucagaagucacuucaag

SEQ ID NO: 26792 - RNA, 23 nt, Homo sapiens
aaacaggagaaaagagugaaucg

SEQ ID NO: 26793 - RNA, 16 nt, Homo sapiens
cacauuucuccacaaa

SEQ ID NO: 26794 - RNA, 21 nt, Homo sapiens
gcucuagccaaagucccuccc

SEQ ID NO: 26795 - RNA, 18 nt, Homo sapiens
uaagggucagcaacccug

SEQ ID NO: 26796 - RNA, 21 nt, Homo sapiens
ugagacuguacagagaaagag

SEQ ID NO: 26797 - RNA, 17 nt, Homo sapiens
ugcucagucauugccag

SEQ ID NO: 26798 - RNA, 25 nt, Homo sapiens
uggagguuuguauaccgcuguaucu

SEQ ID NO: 26799 - RNA, 19 nt, Homo sapiens
uuuugguaaaaaguagucc

SEQ ID NO: 26800 - RNA, 21 nt, Homo sapiens
ucggcuggaggagagcaggau

SEQ ID NO: 26801 - RNA, 21 nt, Homo sapiens
cccgcccgagaucgggcccgg

SEQ ID NO: 26802 - RNA, 21 nt, Homo sapiens
cgccucccgcucaacccgggc

SEQ ID NO: 26803 - RNA, 22 nt, Homo sapiens
cugagcggccccgggcuggggc

SEQ ID NO: 26804 - RNA, 19 nt, Homo sapiens
gagaagucgagguugcggc

SEQ ID NO: 26805 - RNA, 21 nt, Homo sapiens
gaggcugagaagucgagguug

SEQ ID NO: 26806 - RNA, 17 nt, Homo sapiens
gccccgggcuggggcgg

SEQ ID NO: 26807 - RNA, 16 nt, Homo sapiens
ucagugggguggcagg

SEQ ID NO: 26808 - RNA, 21 nt, Homo sapiens
ugcccuaggcggggauccccc

SEQ ID NO: 26809 - RNA, 18 nt, Homo sapiens
gcccgcccgcccguugcc

SEQ ID NO: 26810 - RNA, 18 nt, Homo sapiens
gcgccgccgccgccagga

SEQ ID NO: 26811 - RNA, 23 nt, Homo sapiens
ucugcuccacgccgggggccaag

SEQ ID NO: 26812 - RNA, 18 nt, Homo sapiens
agcagucuuuuggaguau

SEQ ID NO: 26813 - RNA, 21 nt, Homo sapiens
uauguguuuaacugccaacua

SEQ ID NO: 26814 - RNA, 21 nt, Homo sapiens
ugaauggguuagcacaaagug

SEQ ID NO: 26815 - RNA, 15 nt, Homo sapiens
uggugucugucaggc

SEQ ID NO: 26816 - RNA, 15 nt, Homo sapiens
cauuuugauauccca

SEQ ID NO: 26817 - RNA, 16 nt, Homo sapiens
ccgcccgcccggccgc

SEQ ID NO: 26818 - RNA, 21 nt, Homo sapiens
ccgcccggccgcucgcgcgcc

SEQ ID NO: 26819 - RNA, 23 nt, Homo sapiens
gcccgcccggccgcucgcgcgcc

SEQ ID NO: 26820 - RNA, 24 nt, Homo sapiens
uauaaagauuugcagcacagugag

SEQ ID NO: 26821 - RNA, 21 nt, Homo sapiens
aaaggauugauucaaaauaaa

SEQ ID NO: 26822 - RNA, 17 nt, Homo sapiens
acagguccaguuggcca

SEQ ID NO: 26823 - RNA, 18 nt, Homo sapiens
augacaauuaaggugaca

SEQ ID NO: 26824 - RNA, 16 nt, Homo sapiens
caacacugagacauac

SEQ ID NO: 26825 - RNA, 23 nt, Homo sapiens
cgcagccaguggaguuaggaaag

SEQ ID NO: 26826 - RNA, 16 nt, Homo sapiens
acacaacaucacugug

SEQ ID NO: 26827 - RNA, 18 nt, Homo sapiens
acuguacuucaucaaagu

SEQ ID NO: 26828 - RNA, 15 nt, Homo sapiens
caugggagggauucc

SEQ ID NO: 26829 - RNA, 18 nt, Homo sapiens
gcauagcaggaaagucgc

SEQ ID NO: 26830 - RNA, 21 nt, Homo sapiens
gccuuucggagaguaaguaca

SEQ ID NO: 26831 - RNA, 19 nt, Homo sapiens
ucaaaugccaucagcucgu

SEQ ID NO: 26832 - RNA, 17 nt, Homo sapiens
ucaauguucuaacugga

SEQ ID NO: 26833 - RNA, 18 nt, Homo sapiens
uggaaaaucugaacauca

SEQ ID NO: 26834 - RNA, 16 nt, Homo sapiens
uguacacagauuagag

SEQ ID NO: 26835 - RNA, 16 nt, Homo sapiens
uuaguugacucaagcu

SEQ ID NO: 26836 - RNA, 24 nt, Homo sapiens
aggcgaggagagggaucaggcagc

SEQ ID NO: 26837 - RNA, 20 nt, Homo sapiens
caccauccuaguugccuccc

SEQ ID NO: 26838 - RNA, 22 nt, Homo sapiens
aacagccugggcuguugggaaa

SEQ ID NO: 26839 - RNA, 22 nt, Homo sapiens
ccagagaagacugcccuucaaa

SEQ ID NO: 26840 - RNA, 19 nt, Homo sapiens
cugcacucuacacucucua

SEQ ID NO: 26841 - RNA, 16 nt, Homo sapiens
gaacccaagaggcgga

SEQ ID NO: 26842 - RNA, 16 nt, Homo sapiens
uggcuuucuuccuuuu

SEQ ID NO: 26843 - RNA, 18 nt, Homo sapiens
uggcuuucuuccuuuucc

SEQ ID NO: 26844 - RNA, 19 nt, Homo sapiens
ugggcuguugggaaaagga

SEQ ID NO: 26845 - RNA, 23 nt, Homo sapiens
aggcagaggugaaagcacaugga

SEQ ID NO: 26846 - RNA, 18 nt, Homo sapiens
cacacacacacaagcaca

SEQ ID NO: 26847 - RNA, 23 nt, Homo sapiens
ccuccaccucccauugcaauggu

SEQ ID NO: 26848 - RNA, 19 nt, Homo sapiens
ggaggagaaggagguggga

SEQ ID NO: 26849 - RNA, 24 nt, Homo sapiens
gggaggggcaggggagagcgguca

SEQ ID NO: 26850 - RNA, 20 nt, Homo sapiens
ggggaggggcaggggagagc

SEQ ID NO: 26851 - RNA, 22 nt, Homo sapiens
ggggaggggcaggggagagcgg

SEQ ID NO: 26852 - RNA, 18 nt, Homo sapiens
ggucaggaagcggggagg

SEQ ID NO: 26853 - RNA, 21 nt, Homo sapiens
guggcggggcagggacgggag

SEQ ID NO: 26854 - RNA, 16 nt, Homo sapiens
ucauuuagacaaugag

SEQ ID NO: 26855 - RNA, 23 nt, Homo sapiens
ugggaacuggucaagcccagagg

SEQ ID NO: 26856 - RNA, 19 nt, Homo sapiens
uggugggguacacaaaagc

SEQ ID NO: 26857 - RNA, 19 nt, Homo sapiens
uuuugcccugccuccccag

SEQ ID NO: 26858 - RNA, 19 nt, Homo sapiens
acgggucuggcagcuccuc

SEQ ID NO: 26859 - RNA, 15 nt, Homo sapiens
auggagauggguaga

SEQ ID NO: 26860 - RNA, 22 nt, Homo sapiens
cagcuccucauggucccggucg

SEQ ID NO: 26861 - RNA, 21 nt, Homo sapiens
caguggauucuacucaaggga

SEQ ID NO: 26862 - RNA, 18 nt, Homo sapiens
ccacccaagaagaaaaua

SEQ ID NO: 26863 - RNA, 19 nt, Homo sapiens
ccccaaauuuuuccuuaaa

SEQ ID NO: 26864 - RNA, 19 nt, Homo sapiens
gaugaggaguggagaggug

SEQ ID NO: 26865 - RNA, 17 nt, Homo sapiens
ggagaggugucuaccaa

SEQ ID NO: 26866 - RNA, 21 nt, Homo sapiens
ucaggaaguccaggaggcugc

SEQ ID NO: 26867 - RNA, 17 nt, Homo sapiens
ugcccuggccauacucc

SEQ ID NO: 26868 - RNA, 17 nt, Homo sapiens
aaaugcaauggcucaaa

SEQ ID NO: 26869 - RNA, 22 nt, Homo sapiens
acgcgggcgcacggcagaaggc

SEQ ID NO: 26870 - RNA, 20 nt, Homo sapiens
acugcaguuuucugucugca

SEQ ID NO: 26871 - RNA, 14 nt, Homo sapiens
aggagcaacaucuu

SEQ ID NO: 26872 - RNA, 19 nt, Homo sapiens
aguaaccuaacauuuccau

SEQ ID NO: 26873 - RNA, 17 nt, Homo sapiens
auaccuaggauugcaau

SEQ ID NO: 26874 - RNA, 22 nt, Homo sapiens
augugcacaaaaccaaaaaaua

SEQ ID NO: 26875 - RNA, 16 nt, Homo sapiens
auuaaacuaaaauccc

SEQ ID NO: 26876 - RNA, 21 nt, Homo sapiens
cauguguucacugcaguuuuc

SEQ ID NO: 26877 - RNA, 19 nt, Homo sapiens
ccugacacaaugaagaacc

SEQ ID NO: 26878 - RNA, 20 nt, Homo sapiens
cuagauaucuauauauagga

SEQ ID NO: 26879 - RNA, 18 nt, Homo sapiens
cuagccaggcgugguggc

SEQ ID NO: 26880 - RNA, 18 nt, Homo sapiens
gcauguguucacugcagu

SEQ ID NO: 26881 - RNA, 17 nt, Homo sapiens
ggaacccgggaggcgga

SEQ ID NO: 26882 - RNA, 22 nt, Homo sapiens
ggagcucccugaugcacccaac

SEQ ID NO: 26883 - RNA, 22 nt, Homo sapiens
ucaaucauguuuuggcaugugu

SEQ ID NO: 26884 - RNA, 18 nt, Homo sapiens
ugcaauaaauccuaaagc

SEQ ID NO: 26885 - RNA, 16 nt, Homo sapiens
uggcacugccaucugu

SEQ ID NO: 26886 - RNA, 21 nt, Homo sapiens
aggccacacccaugugacugc

SEQ ID NO: 26887 - RNA, 19 nt, Homo sapiens
ccaccaccuccuguugggu

SEQ ID NO: 26888 - RNA, 19 nt, Homo sapiens
gaccacagcggggcugugg

SEQ ID NO: 26889 - RNA, 20 nt, Homo sapiens
gauuccacgguguuggggag

SEQ ID NO: 26890 - RNA, 19 nt, Homo sapiens
gcauagcucguuaaaaccc

SEQ ID NO: 26891 - RNA, 22 nt, Homo sapiens
ugguggacuucuaggccccuac

SEQ ID NO: 26892 - RNA, 18 nt, Homo sapiens
uaaagaaaauacucccuc

SEQ ID NO: 26893 - RNA, 21 nt, Homo sapiens
aacauguacuacaaaagcuua

SEQ ID NO: 26894 - RNA, 19 nt, Homo sapiens
aacgacagauuuuauugca

SEQ ID NO: 26895 - RNA, 19 nt, Homo sapiens
aagaagacaugaaggauuc

SEQ ID NO: 26896 - RNA, 20 nt, Homo sapiens
acaccagaucaucucuguau

SEQ ID NO: 26897 - RNA, 18 nt, Homo sapiens
acugguuaagaaauccaa

SEQ ID NO: 26898 - RNA, 21 nt, Homo sapiens
acuugcuugcuugguuuucuu

SEQ ID NO: 26899 - RNA, 20 nt, Homo sapiens
cacaauuagcagcaccaggc

SEQ ID NO: 26900 - RNA, 17 nt, Homo sapiens
cgguuuugucauagcug

SEQ ID NO: 26901 - RNA, 22 nt, Homo sapiens
cugacgucucuggugcucuggc

SEQ ID NO: 26902 - RNA, 22 nt, Homo sapiens
gauuuccauuccagaauuugaa

SEQ ID NO: 26903 - RNA, 22 nt, Homo sapiens
gcaaguguguaaacaauaacaa

SEQ ID NO: 26904 - RNA, 19 nt, Homo sapiens
gucagugacauauagaugc

SEQ ID NO: 26905 - RNA, 19 nt, Homo sapiens
guggaaaguggaaaaguug

SEQ ID NO: 26906 - RNA, 20 nt, Homo sapiens
uaccaggcuggccucacaag

SEQ ID NO: 26907 - RNA, 22 nt, Homo sapiens
uacuucagagacuuuuauuuua

SEQ ID NO: 26908 - RNA, 20 nt, Homo sapiens
uagaauaggcagcaacuugc

SEQ ID NO: 26909 - RNA, 19 nt, Homo sapiens
uagcuuuggccuuuggacu

SEQ ID NO: 26910 - RNA, 22 nt, Homo sapiens
uauuauuggcugcauuacagag

SEQ ID NO: 26911 - RNA, 17 nt, Homo sapiens
ucaguuuacauagcuuc

SEQ ID NO: 26912 - RNA, 18 nt, Homo sapiens
ugaucagaucuuaauucc

SEQ ID NO: 26913 - RNA, 15 nt, Homo sapiens
ugcugcuguuuucag

SEQ ID NO: 26914 - RNA, 18 nt, Homo sapiens
ugcuuggacauuuacaca

SEQ ID NO: 26915 - RNA, 18 nt, Homo sapiens
uuccuugaauauaacaua

SEQ ID NO: 26916 - RNA, 18 nt, Homo sapiens
uuguaaaacauucaaugu

SEQ ID NO: 26917 - RNA, 19 nt, Homo sapiens
uugggaaaucaucagaaga

SEQ ID NO: 26918 - RNA, 20 nt, Homo sapiens
uauuuugauuguggaugacu

SEQ ID NO: 26919 - RNA, 21 nt, Homo sapiens
uguccaccucuccucuccauc

SEQ ID NO: 26920 - RNA, 23 nt, Homo sapiens
uuacuucuuucuacccuauuaua

SEQ ID NO: 26921 - RNA, 23 nt, Homo sapiens
cuggauuuccucacccaccugcc

SEQ ID NO: 26922 - RNA, 16 nt, Homo sapiens
gagucggcggcuagga

SEQ ID NO: 26923 - RNA, 22 nt, Homo sapiens
gccuugugugagucggcggcua

SEQ ID NO: 26924 - RNA, 20 nt, Homo sapiens
uagaggaauuccauauauua

SEQ ID NO: 26925 - RNA, 23 nt, Homo sapiens
ucacacauguacacuugaaacca

SEQ ID NO: 26926 - RNA, 20 nt, Homo sapiens
ugguguggugagaugauaac

SEQ ID NO: 26927 - RNA, 19 nt, Homo sapiens
gcccuccaggccccuccuc

SEQ ID NO: 26928 - RNA, 22 nt, Homo sapiens
gcugagugagagcugggggagc

SEQ ID NO: 26929 - RNA, 17 nt, Homo sapiens
ugagaccagugacagaa

SEQ ID NO: 26930 - RNA, 19 nt, Homo sapiens
ugccgugggcgcgaguccc

SEQ ID NO: 26931 - RNA, 23 nt, Homo sapiens
acaauguuugguucccccuggag

SEQ ID NO: 26932 - RNA, 21 nt, Homo sapiens
agaccagccucagcaacauag

SEQ ID NO: 26933 - RNA, 18 nt, Homo sapiens
auuuccaaaguugguuca

SEQ ID NO: 26934 - RNA, 19 nt, Homo sapiens
cagccgcugagcccgcccc

SEQ ID NO: 26935 - RNA, 22 nt, Homo sapiens
cggagaaacuuacuugcuuugc

SEQ ID NO: 26936 - RNA, 18 nt, Homo sapiens
gcuuucaucuaccaccag

SEQ ID NO: 26937 - RNA, 20 nt, Homo sapiens
gggaggauggcuugauccua

SEQ ID NO: 26938 - RNA, 17 nt, Homo sapiens
guuuuagagcccuuaca

SEQ ID NO: 26939 - RNA, 16 nt, Homo sapiens
uaaaucacacaaaggu

SEQ ID NO: 26940 - RNA, 18 nt, Homo sapiens
ucucgggccgggcgcagu

SEQ ID NO: 26941 - RNA, 17 nt, Homo sapiens
uugggaggccgaggcgg

SEQ ID NO: 26942 - RNA, 21 nt, Homo sapiens
uuucuagcuccaaaugaaaac

SEQ ID NO: 26943 - RNA, 20 nt, Homo sapiens
uuuguuguuuuaauggauug

SEQ ID NO: 26944 - RNA, 23 nt, Homo sapiens
uuuuucgcuuuuaauguuuuuuu

SEQ ID NO: 26945 - RNA, 21 nt, Homo sapiens
uuuuuuuuuuuuuucgcuuuu

SEQ ID NO: 26946 - RNA, 20 nt, Homo sapiens
agcuucguuuguuuguuguu

SEQ ID NO: 26947 - RNA, 22 nt, Homo sapiens
cccauuaacauuauagaaaaca

SEQ ID NO: 26948 - RNA, 22 nt, Homo sapiens
cuaggacaaaauacuguacaug

SEQ ID NO: 26949 - RNA, 21 nt, Homo sapiens
cuguauuagcaguucacucag

SEQ ID NO: 26950 - RNA, 20 nt, Homo sapiens
aaaacuaaaauccagagcag

SEQ ID NO: 26951 - RNA, 21 nt, Homo sapiens
uauuacuuauaacugaauaac

SEQ ID NO: 26952 - RNA, 18 nt, Homo sapiens
ucauuagcagagucaguu

SEQ ID NO: 26953 - RNA, 19 nt, Homo sapiens
acgcagagaaggaggcugc

SEQ ID NO: 26954 - RNA, 21 nt, Homo sapiens
agagaaauaugugacagguag

SEQ ID NO: 26955 - RNA, 18 nt, Homo sapiens
agaggggguggagguggg

SEQ ID NO: 26956 - RNA, 17 nt, Homo sapiens
aggaggaggagaggaag

SEQ ID NO: 26957 - RNA, 20 nt, Homo sapiens
ccacccaaaagaaaagaaaa

SEQ ID NO: 26958 - RNA, 17 nt, Homo sapiens
ugccaaaaacguggggc

SEQ ID NO: 26959 - RNA, 24 nt, Homo sapiens
uaauagaguaucuuucaaacacaa

SEQ ID NO: 26960 - RNA, 17 nt, Homo sapiens
aagcagcagagcuggag

SEQ ID NO: 26961 - RNA, 16 nt, Homo sapiens
cagaaaaagagacaug

SEQ ID NO: 26962 - RNA, 20 nt, Homo sapiens
gaagcagcagagcuggaggu

SEQ ID NO: 26963 - RNA, 18 nt, Homo sapiens
ggcgaccuguccucgugc

SEQ ID NO: 26964 - RNA, 18 nt, Homo sapiens
gggcgggcccggggagga

SEQ ID NO: 26965 - RNA, 21 nt, Homo sapiens
ggggcgggcccggggaggagc

SEQ ID NO: 26966 - RNA, 19 nt, Homo sapiens
uaaauuuccagguguagaa

SEQ ID NO: 26967 - RNA, 21 nt, Homo sapiens
ugagaaccagccacccggagc

SEQ ID NO: 26968 - RNA, 16 nt, Homo sapiens
uguagaaagaggccac

SEQ ID NO: 26969 - RNA, 17 nt, Homo sapiens
cgggcgggcugcgcgcg

SEQ ID NO: 26970 - RNA, 17 nt, Homo sapiens
cggcuguggggacaggg

SEQ ID NO: 26971 - RNA, 19 nt, Homo sapiens
gaggauaaagggcugaugc

SEQ ID NO: 26972 - RNA, 18 nt, Homo sapiens
gcucagaggggcuuccuc

SEQ ID NO: 26973 - RNA, 16 nt, Homo sapiens
gggcugaugcaggacu

SEQ ID NO: 26974 - RNA, 19 nt, Homo sapiens
caguccccugagccauccc

SEQ ID NO: 26975 - RNA, 19 nt, Homo sapiens
cgucguggggcuucugggg

SEQ ID NO: 26976 - RNA, 21 nt, Homo sapiens
ggcaccaggagccuggggggg

SEQ ID NO: 26977 - RNA, 19 nt, Homo sapiens
ggcgcaccgugugcccugg

SEQ ID NO: 26978 - RNA, 20 nt, Homo sapiens
guggacaguccccugagcca

SEQ ID NO: 26979 - RNA, 20 nt, Homo sapiens
uugcauugcagaaaugccag

SEQ ID NO: 26980 - RNA, 14 nt, Homo sapiens
aggauaaaguaaga

SEQ ID NO: 26981 - RNA, 19 nt, Homo sapiens
caggaguuugagacgaacc

SEQ ID NO: 26982 - RNA, 17 nt, Homo sapiens
ggacagacagggagaaa

SEQ ID NO: 26983 - RNA, 21 nt, Homo sapiens
ucuggaccuaauaauucaaua

SEQ ID NO: 26984 - RNA, 21 nt, Homo sapiens
agggucccggcagccaccgcc

SEQ ID NO: 26985 - RNA, 19 nt, Homo sapiens
cccggcagccaccgccgcg

SEQ ID NO: 26986 - RNA, 20 nt, Homo sapiens
ccgccgcuccagcugaaacc

SEQ ID NO: 26987 - RNA, 18 nt, Homo sapiens
aaaaagaaaaaaaaaaca

SEQ ID NO: 26988 - RNA, 22 nt, Homo sapiens
aaucucauaauuucuguuuuua

SEQ ID NO: 26989 - RNA, 19 nt, Homo sapiens
cccaguucccuaggcccgg

SEQ ID NO: 26990 - RNA, 19 nt, Homo sapiens
ccccuuugcccccuccccc

SEQ ID NO: 26991 - RNA, 19 nt, Homo sapiens
ccgacuuucccucccaacc

SEQ ID NO: 26992 - RNA, 18 nt, Homo sapiens
gagcucaagucaguaaag

SEQ ID NO: 26993 - RNA, 18 nt, Homo sapiens
guggauagcuuuuuuuuu

SEQ ID NO: 26994 - RNA, 18 nt, Homo sapiens
guuaaccaaaaugacagg

SEQ ID NO: 26995 - RNA, 18 nt, Homo sapiens
ucccccuucccacagcuc

SEQ ID NO: 26996 - RNA, 19 nt, Homo sapiens
ucucagggccucccuacgu

SEQ ID NO: 26997 - RNA, 19 nt, Homo sapiens
uucccacagcuccucuucc

SEQ ID NO: 26998 - RNA, 17 nt, Homo sapiens
accuuugguggggcagu

SEQ ID NO: 26999 - RNA, 20 nt, Homo sapiens
uccuacauuaggaagucaga

SEQ ID NO: 27000 - RNA, 21 nt, Homo sapiens
uccuuggguuugaagucacag

SEQ ID NO: 27001 - RNA, 23 nt, Homo sapiens
ucucagaaaaggguggagcucag

SEQ ID NO: 27002 - RNA, 19 nt, Homo sapiens
uggagguucugaucacagg

SEQ ID NO: 27003 - RNA, 17 nt, Homo sapiens
agacuggguuggagcuu

SEQ ID NO: 27004 - RNA, 22 nt, Homo sapiens
cagugaagcuccaggagcaggc

SEQ ID NO: 27005 - RNA, 18 nt, Homo sapiens
ccuccgccccgcagcgcc

SEQ ID NO: 27006 - RNA, 19 nt, Homo sapiens
cgcuucucgucgccccucg

SEQ ID NO: 27007 - RNA, 17 nt, Homo sapiens
gacagguggcgggcgcg

SEQ ID NO: 27008 - RNA, 19 nt, Homo sapiens
ggcagacagguggcgggcg

SEQ ID NO: 27009 - RNA, 21 nt, Homo sapiens
uccaauccaggucccugauug

SEQ ID NO: 27010 - RNA, 18 nt, Homo sapiens
ucucgucgccccucggag

SEQ ID NO: 27011 - RNA, 17 nt, Homo sapiens
auguuuccucugccaga

SEQ ID NO: 27012 - RNA, 18 nt, Homo sapiens
gacaugguaauggauucc

SEQ ID NO: 27013 - RNA, 17 nt, Homo sapiens
gaucagaagcuaguuga

SEQ ID NO: 27014 - RNA, 20 nt, Homo sapiens
accggcucuuccugcgggcc

SEQ ID NO: 27015 - RNA, 22 nt, Homo sapiens
augcagcuguccuggacuguug

SEQ ID NO: 27016 - RNA, 19 nt, Homo sapiens
acugcaacuuuuucuucug

SEQ ID NO: 27017 - RNA, 21 nt, Homo sapiens
agaagggggugaggggguggg

SEQ ID NO: 27018 - RNA, 19 nt, Homo sapiens
agcucuaguccuuguuuuc

SEQ ID NO: 27019 - RNA, 21 nt, Homo sapiens
cagcacagcagccaccucugu

SEQ ID NO: 27020 - RNA, 16 nt, Homo sapiens
cagcaggccagagcuc

SEQ ID NO: 27021 - RNA, 18 nt, Homo sapiens
ccagagggugauggugug

SEQ ID NO: 27022 - RNA, 20 nt, Homo sapiens
ccccagcccucaggccuuuc

SEQ ID NO: 27023 - RNA, 19 nt, Homo sapiens
ccucuuacggggaaugccc

SEQ ID NO: 27024 - RNA, 19 nt, Homo sapiens
cgcuucccaugacacgccc

SEQ ID NO: 27025 - RNA, 21 nt, Homo sapiens
gaggacacagaggggaaauug

SEQ ID NO: 27026 - RNA, 21 nt, Homo sapiens
gcauguuacucugacacacua

SEQ ID NO: 27027 - RNA, 18 nt, Homo sapiens
gccccuggaaagaggcag

SEQ ID NO: 27028 - RNA, 18 nt, Homo sapiens
gcccuuuucuuggagcag

SEQ ID NO: 27029 - RNA, 16 nt, Homo sapiens
gggagaggacacagag

SEQ ID NO: 27030 - RNA, 19 nt, Homo sapiens
ggggugagggggugggugg

SEQ ID NO: 27031 - RNA, 15 nt, Homo sapiens
ugacacacggaagcc

SEQ ID NO: 27032 - RNA, 17 nt, Homo sapiens
uggaagccgagugagcc

SEQ ID NO: 27033 - RNA, 20 nt, Homo sapiens
ugggguuucuuagggagugc

SEQ ID NO: 27034 - RNA, 16 nt, Homo sapiens
aauuuuuuucacgugc

SEQ ID NO: 27035 - RNA, 21 nt, Homo sapiens
aggcggcgggagcggcggccg

SEQ ID NO: 27036 - RNA, 18 nt, Homo sapiens
ccucccggccgccccucg

SEQ ID NO: 27037 - RNA, 17 nt, Homo sapiens
cgccucccggccgcccc

SEQ ID NO: 27038 - RNA, 17 nt, Homo sapiens
gccgucgccgccgccgg

SEQ ID NO: 27039 - RNA, 20 nt, Homo sapiens
ggauuuucaacccucuuucu

SEQ ID NO: 27040 - RNA, 18 nt, Homo sapiens
ggcggcgggagcggcggc

SEQ ID NO: 27041 - RNA, 19 nt, Homo sapiens
uagaacacaaaaaguuucu

SEQ ID NO: 27042 - RNA, 18 nt, Homo sapiens
uauccacuaaaagcugcu

SEQ ID NO: 27043 - RNA, 21 nt, Homo sapiens
ucggguaggcggcgggagcgg

SEQ ID NO: 27044 - RNA, 18 nt, Homo sapiens
ugaguagaguuauugagc

SEQ ID NO: 27045 - RNA, 18 nt, Homo sapiens
uuugccagauaaaguguc

SEQ ID NO: 27046 - RNA, 20 nt, Homo sapiens
gaggccagaucaggccaggc

SEQ ID NO: 27047 - RNA, 22 nt, Homo sapiens
caaacaguugagcaacugggcu

SEQ ID NO: 27048 - RNA, 17 nt, Homo sapiens
ccccguggggccagggu

SEQ ID NO: 27049 - RNA, 16 nt, Homo sapiens
gccuccccguggggcc

SEQ ID NO: 27050 - RNA, 20 nt, Homo sapiens
ugauacauguuggccuuaug

SEQ ID NO: 27051 - RNA, 18 nt, Homo sapiens
acagaugaagaaauugag

SEQ ID NO: 27052 - RNA, 17 nt, Homo sapiens
agcgguguggacuccca

SEQ ID NO: 27053 - RNA, 18 nt, Homo sapiens
caggcucuggggcaguca

SEQ ID NO: 27054 - RNA, 18 nt, Homo sapiens
gaguuggccccaauucca

SEQ ID NO: 27055 - RNA, 23 nt, Homo sapiens
ggcuggugggcagggcagaggag

SEQ ID NO: 27056 - RNA, 22 nt, Homo sapiens
ugaggcagauugcguuaagugc

SEQ ID NO: 27057 - RNA, 20 nt, Homo sapiens
aacaguaguuaauuuagugu

SEQ ID NO: 27058 - RNA, 16 nt, Homo sapiens
cggccaggcgauggga

SEQ ID NO: 27059 - RNA, 20 nt, Homo sapiens
gaaaaaauucuuucuaugaa

SEQ ID NO: 27060 - RNA, 17 nt, Homo sapiens
gacgaaauucagacaug

SEQ ID NO: 27061 - RNA, 21 nt, Homo sapiens
ggaaaguucaugaggacaaag

SEQ ID NO: 27062 - RNA, 25 nt, Homo sapiens
uaauucucuuuuguaauucaguugc

SEQ ID NO: 27063 - RNA, 19 nt, Homo sapiens
uggugugucaaauggccug

SEQ ID NO: 27064 - RNA, 18 nt, Homo sapiens
aggcgggggugggcuggg

SEQ ID NO: 27065 - RNA, 22 nt, Homo sapiens
ggugggcagcucauucugcagg

SEQ ID NO: 27066 - RNA, 19 nt, Homo sapiens
ucaguuugugguaggaaga

SEQ ID NO: 27067 - RNA, 18 nt, Homo sapiens
uccaucucaucaugaaga

SEQ ID NO: 27068 - RNA, 14 nt, Homo sapiens
uccgugguguccag

SEQ ID NO: 27069 - RNA, 16 nt, Homo sapiens
ugagccaaguaagcug

SEQ ID NO: 27070 - RNA, 19 nt, Homo sapiens
ugagccaaguaagcugucu

SEQ ID NO: 27071 - RNA, 25 nt, Homo sapiens
ugcugguggggaggggaagcagggc

SEQ ID NO: 27072 - RNA, 16 nt, Homo sapiens
uggcugcuucgaagcc

SEQ ID NO: 27073 - RNA, 16 nt, Homo sapiens
uguccaggcgggggug

SEQ ID NO: 27074 - RNA, 15 nt, Homo sapiens
aaugguguuuucucc

SEQ ID NO: 27075 - RNA, 19 nt, Homo sapiens
aauguguauuuggagcuga

SEQ ID NO: 27076 - RNA, 19 nt, Homo sapiens
acauauuaaacgugaauug

SEQ ID NO: 27077 - RNA, 20 nt, Homo sapiens
accaugaaaaugucacugaa

SEQ ID NO: 27078 - RNA, 20 nt, Homo sapiens
cacacuuugcaguccaggaa

SEQ ID NO: 27079 - RNA, 16 nt, Homo sapiens
cagaugcuggugauug

SEQ ID NO: 27080 - RNA, 19 nt, Homo sapiens
cuggauuugccacaucuag

SEQ ID NO: 27081 - RNA, 15 nt, Homo sapiens
gauauguagcuugug

SEQ ID NO: 27082 - RNA, 18 nt, Homo sapiens
gcauaccccgguuagaag

SEQ ID NO: 27083 - RNA, 17 nt, Homo sapiens
gccccaaacacacacuc

SEQ ID NO: 27084 - RNA, 21 nt, Homo sapiens
gcccggcccgcggcggcuucc

SEQ ID NO: 27085 - RNA, 15 nt, Homo sapiens
gugggaagagggaga

SEQ ID NO: 27086 - RNA, 21 nt, Homo sapiens
uaacugccauaucagaaagaa

SEQ ID NO: 27087 - RNA, 17 nt, Homo sapiens
ucacugccauucaaugu

SEQ ID NO: 27088 - RNA, 15 nt, Homo sapiens
uccugucaguaucug

SEQ ID NO: 27089 - RNA, 16 nt, Homo sapiens
uggggguuuugcggag

SEQ ID NO: 27090 - RNA, 20 nt, Homo sapiens
uuggaggauauguagcuugu

SEQ ID NO: 27091 - RNA, 18 nt, Homo sapiens
aaagaaaaaagagucauu

SEQ ID NO: 27092 - RNA, 17 nt, Homo sapiens
cuuauuccucuccaccc

SEQ ID NO: 27093 - RNA, 22 nt, Homo sapiens
ucuaacuggacauuuuggugau

SEQ ID NO: 27094 - RNA, 21 nt, Homo sapiens
agauuaaaaauguacacauga

SEQ ID NO: 27095 - RNA, 22 nt, Homo sapiens
aggcaaaaggaaacagaagaca

SEQ ID NO: 27096 - RNA, 17 nt, Homo sapiens
auaacauaaaaccuaag

SEQ ID NO: 27097 - RNA, 18 nt, Homo sapiens
aucauacuacaucagcag

SEQ ID NO: 27098 - RNA, 17 nt, Homo sapiens
gguaaucugcacaaaca

SEQ ID NO: 27099 - RNA, 17 nt, Homo sapiens
uggauuauugguuauuu

SEQ ID NO: 27100 - RNA, 18 nt, Homo sapiens
agaaugugaagaaaauga

SEQ ID NO: 27101 - RNA, 17 nt, Homo sapiens
gcuaaguuugcaaccac

SEQ ID NO: 27102 - RNA, 18 nt, Homo sapiens
uaaaaauuucauaauucc

SEQ ID NO: 27103 - RNA, 18 nt, Homo sapiens
uggucccuuuucugugcc

SEQ ID NO: 27104 - RNA, 16 nt, Homo sapiens
gguggagggaagggaa

SEQ ID NO: 27105 - RNA, 17 nt, Homo sapiens
gccugcccgccgcccuc

SEQ ID NO: 27106 - RNA, 17 nt, Homo sapiens
auggcuccacugggaga

SEQ ID NO: 27107 - RNA, 19 nt, Homo sapiens
ccccugcaucccuuccccc

SEQ ID NO: 27108 - RNA, 21 nt, Homo sapiens
ccucacccuugagcccuuugc

SEQ ID NO: 27109 - RNA, 17 nt, Homo sapiens
gaauacccacuucuuca

SEQ ID NO: 27110 - RNA, 18 nt, Homo sapiens
ggaaggggaauacccacu

SEQ ID NO: 27111 - RNA, 20 nt, Homo sapiens
ggagucuugggccacucugg

SEQ ID NO: 27112 - RNA, 15 nt, Homo sapiens
gucuuggagaccuau

SEQ ID NO: 27113 - RNA, 22 nt, Homo sapiens
ucacccuugagcccuuugcccc

SEQ ID NO: 27114 - RNA, 17 nt, Homo sapiens
uggggugggaaggggaa

SEQ ID NO: 27115 - RNA, 14 nt, Homo sapiens
ugugaucucaccac

SEQ ID NO: 27116 - RNA, 18 nt, Homo sapiens
uuagccagacgugguggc

SEQ ID NO: 27117 - RNA, 23 nt, Homo sapiens
aggcaguauuggcacagcuuggg

SEQ ID NO: 27118 - RNA, 24 nt, Homo sapiens
aucauccuuccauuucuugaaucc

SEQ ID NO: 27119 - RNA, 19 nt, Homo sapiens
auggucuacagaaggcucu

SEQ ID NO: 27120 - RNA, 19 nt, Homo sapiens
caguauuggcacagcuugg

SEQ ID NO: 27121 - RNA, 18 nt, Homo sapiens
cauuagauggccauuagu

SEQ ID NO: 27122 - RNA, 19 nt, Homo sapiens
gcaaauuuagcagaggaga

SEQ ID NO: 27123 - RNA, 18 nt, Homo sapiens
uccacauuuucucuaagc

SEQ ID NO: 27124 - RNA, 18 nt, Homo sapiens
ucuccuccucuauaaucu

SEQ ID NO: 27125 - RNA, 18 nt, Homo sapiens
uucaccuaccucucugug

SEQ ID NO: 27126 - RNA, 16 nt, Homo sapiens
uucccaauugccagca

SEQ ID NO: 27127 - RNA, 20 nt, Homo sapiens
acauccugucucccacugca

SEQ ID NO: 27128 - RNA, 17 nt, Homo sapiens
cacuggagguggacauc

SEQ ID NO: 27129 - RNA, 20 nt, Homo sapiens
ccaagaagucaaugaauccc

SEQ ID NO: 27130 - RNA, 19 nt, Homo sapiens
ccaggcugagccaagaagc

SEQ ID NO: 27131 - RNA, 20 nt, Homo sapiens
gaaaguaugaaacacuggag

SEQ ID NO: 27132 - RNA, 17 nt, Homo sapiens
gcgggggcgcacgggca

SEQ ID NO: 27133 - RNA, 21 nt, Homo sapiens
ucccagaauccuuccagggau

SEQ ID NO: 27134 - RNA, 23 nt, Homo sapiens
ugacugguaagggaucuaguaac

SEQ ID NO: 27135 - RNA, 15 nt, Homo sapiens
uggccgggccgaugc

SEQ ID NO: 27136 - RNA, 19 nt, Homo sapiens
ugucccagaauccuuccag

SEQ ID NO: 27137 - RNA, 22 nt, Homo sapiens
uugcuugaagugaucugcccca

SEQ ID NO: 27138 - RNA, 19 nt, Homo sapiens
gagagcagaggagcaggaa

SEQ ID NO: 27139 - RNA, 21 nt, Homo sapiens
uaccaguuccuggggacacaa

SEQ ID NO: 27140 - RNA, 19 nt, Homo sapiens
ggccagcagaacggguggc

SEQ ID NO: 27141 - RNA, 18 nt, Homo sapiens
gggagcaggccgggcugg

SEQ ID NO: 27142 - RNA, 20 nt, Homo sapiens
gggcgugcgagcggcgcucu

SEQ ID NO: 27143 - RNA, 14 nt, Homo sapiens
gucucgacagggcu

SEQ ID NO: 27144 - RNA, 24 nt, Homo sapiens
uauaaauaucuugcaucuauacac

SEQ ID NO: 27145 - RNA, 23 nt, Homo sapiens
ugagagguacguguaagggacug

SEQ ID NO: 27146 - RNA, 20 nt, Homo sapiens
aacaagugugcugguggcaa

SEQ ID NO: 27147 - RNA, 19 nt, Homo sapiens
acaaagaggcagagugagg

SEQ ID NO: 27148 - RNA, 19 nt, Homo sapiens
acacagccuggcagugccc

SEQ ID NO: 27149 - RNA, 19 nt, Homo sapiens
ggccuugagguuaaugccu

SEQ ID NO: 27150 - RNA, 18 nt, Homo sapiens
ggcucagccugagaugag

SEQ ID NO: 27151 - RNA, 18 nt, Homo sapiens
gggaagaggggagcagac

SEQ ID NO: 27152 - RNA, 19 nt, Homo sapiens
gggcauuguugcuccagua

SEQ ID NO: 27153 - RNA, 18 nt, Homo sapiens
ucagagaggagaaaaaga

SEQ ID NO: 27154 - RNA, 17 nt, Homo sapiens
ucagagucuaccuuuca

SEQ ID NO: 27155 - RNA, 21 nt, Homo sapiens
ucagagucuaccuuucauggc

SEQ ID NO: 27156 - RNA, 18 nt, Homo sapiens
uccccuucccaaaagaaa

SEQ ID NO: 27157 - RNA, 21 nt, Homo sapiens
ugaggauuuaaaugucccaug

SEQ ID NO: 27158 - RNA, 19 nt, Homo sapiens
ugccauguguauacaagaa

SEQ ID NO: 27159 - RNA, 14 nt, Homo sapiens
ugcccucuaagcaa

SEQ ID NO: 27160 - RNA, 19 nt, Homo sapiens
ugcugggagggccuugagg

SEQ ID NO: 27161 - RNA, 20 nt, Homo sapiens
uggaacaccuggagcuuuga

SEQ ID NO: 27162 - RNA, 20 nt, Homo sapiens
uggcaaaaagaugaugaaag

SEQ ID NO: 27163 - RNA, 19 nt, Homo sapiens
uguggcucagccugagaug

SEQ ID NO: 27164 - RNA, 17 nt, Homo sapiens
augagaagaugcaggug

SEQ ID NO: 27165 - RNA, 20 nt, Homo sapiens
aacugccccucaaggaagaa

SEQ ID NO: 27166 - RNA, 20 nt, Homo sapiens
ccugacaucucccuuuccca

SEQ ID NO: 27167 - RNA, 21 nt, Homo sapiens
ggagggugggggaaaaggcgg

SEQ ID NO: 27168 - RNA, 20 nt, Homo sapiens
gggaagggguggggccuggc

SEQ ID NO: 27169 - RNA, 23 nt, Homo sapiens
gggagggugggggaaaaggcggg

SEQ ID NO: 27170 - RNA, 16 nt, Homo sapiens
uacccuccauggggcc

SEQ ID NO: 27171 - RNA, 19 nt, Homo sapiens
ucauccucacuucuguucc

SEQ ID NO: 27172 - RNA, 20 nt, Homo sapiens
ucaugggagggugggggaaa

SEQ ID NO: 27173 - RNA, 17 nt, Homo sapiens
uccacaagcacuagcgg

SEQ ID NO: 27174 - RNA, 19 nt, Homo sapiens
ugagggacaaggguggggc

SEQ ID NO: 27175 - RNA, 23 nt, Homo sapiens
ugccugauuacagggguggggcc

SEQ ID NO: 27176 - RNA, 22 nt, Homo sapiens
ugcugggggaaggcuuccaguu

SEQ ID NO: 27177 - RNA, 16 nt, Homo sapiens
agggggcgaggcugcg

SEQ ID NO: 27178 - RNA, 20 nt, Homo sapiens
ccacaggugcgagccaccgc

SEQ ID NO: 27179 - RNA, 22 nt, Homo sapiens
cguuccucucaagccccucgcc

SEQ ID NO: 27180 - RNA, 18 nt, Homo sapiens
gagggauccggcggcggc

SEQ ID NO: 27181 - RNA, 20 nt, Homo sapiens
gagggcccgggcuucagugc

SEQ ID NO: 27182 - RNA, 18 nt, Homo sapiens
gcgagcgcaacggcggcg

SEQ ID NO: 27183 - RNA, 19 nt, Homo sapiens
gcggcgagcgcaacggcgg

SEQ ID NO: 27184 - RNA, 20 nt, Homo sapiens
ggauccggcggcggcggggg

SEQ ID NO: 27185 - RNA, 18 nt, Homo sapiens
uccggcggcggcgggggg

SEQ ID NO: 27186 - RNA, 19 nt, Homo sapiens
uccuguggccagcaguucu

SEQ ID NO: 27187 - RNA, 23 nt, Homo sapiens
aaaacccccccgccacugaaucg

SEQ ID NO: 27188 - RNA, 24 nt, Homo sapiens
acuugucacucaccccucuaacag

SEQ ID NO: 27189 - RNA, 18 nt, Homo sapiens
aggaagcucagugauggu

SEQ ID NO: 27190 - RNA, 21 nt, Homo sapiens
aguuucuuaauaaaauauuuu

SEQ ID NO: 27191 - RNA, 18 nt, Homo sapiens
ccuugcagauuccucaua

SEQ ID NO: 27192 - RNA, 20 nt, Homo sapiens
cucaaaugaguucucccuug

SEQ ID NO: 27193 - RNA, 17 nt, Homo sapiens
uuauguuuauacaacgu

SEQ ID NO: 27194 - RNA, 21 nt, Homo sapiens
aaguagcugacucucaauugg

SEQ ID NO: 27195 - RNA, 20 nt, Homo sapiens
gaacagaaaaucuguacaca

SEQ ID NO: 27196 - RNA, 16 nt, Homo sapiens
ggcagagagcgcagag

SEQ ID NO: 27197 - RNA, 19 nt, Homo sapiens
ggcggcggcgcgggcagag

SEQ ID NO: 27198 - RNA, 22 nt, Homo sapiens
ugaggcggcggcggcgcgggca

SEQ ID NO: 27199 - RNA, 22 nt, Homo sapiens
aauaguacaaauuccuauugcu

SEQ ID NO: 27200 - RNA, 16 nt, Homo sapiens
cgggcccaggcggagg

SEQ ID NO: 27201 - RNA, 18 nt, Homo sapiens
uaaaauaccuauauagca

SEQ ID NO: 27202 - RNA, 18 nt, Homo sapiens
gagagacgcggcgccaag

SEQ ID NO: 27203 - RNA, 25 nt, Homo sapiens
uucgggcccagggacgacgcagcgg

SEQ ID NO: 27204 - RNA, 19 nt, Homo sapiens
agacccugcccaaggagga

SEQ ID NO: 27205 - RNA, 21 nt, Homo sapiens
aggaggcagugggcuuccugg

SEQ ID NO: 27206 - RNA, 18 nt, Homo sapiens
aggcagugggcuuccugg

SEQ ID NO: 27207 - RNA, 20 nt, Homo sapiens
gagcacagaaacacaguggc

SEQ ID NO: 27208 - RNA, 19 nt, Homo sapiens
ucugggggcaccagcugga

SEQ ID NO: 27209 - RNA, 18 nt, Homo sapiens
ccuccccucccucucucc

SEQ ID NO: 27210 - RNA, 18 nt, Homo sapiens
ugagcaagggggugcugg

SEQ ID NO: 27211 - RNA, 16 nt, Homo sapiens
aggaggggggaaaaac

SEQ ID NO: 27212 - RNA, 22 nt, Homo sapiens
aggauguucaagcaguuuauuu

SEQ ID NO: 27213 - RNA, 16 nt, Homo sapiens
agggaugucucuucca

SEQ ID NO: 27214 - RNA, 24 nt, Homo sapiens
ccuuucuuccaagauggaugccug

SEQ ID NO: 27215 - RNA, 22 nt, Homo sapiens
gaauauugcauuuauccauucu

SEQ ID NO: 27216 - RNA, 18 nt, Homo sapiens
gauaaagggaauuaaacu

SEQ ID NO: 27217 - RNA, 21 nt, Homo sapiens
ggggguggggaaggaaaagcu

SEQ ID NO: 27218 - RNA, 18 nt, Homo sapiens
gguagggggcagaagagg

SEQ ID NO: 27219 - RNA, 16 nt, Homo sapiens
ucaccaauuccacugg

SEQ ID NO: 27220 - RNA, 18 nt, Homo sapiens
ugguagggggcagaagag

SEQ ID NO: 27221 - RNA, 26 nt, Homo sapiens
uuaagagauugaaaagagcgaggcau

SEQ ID NO: 27222 - RNA, 17 nt, Homo sapiens
caaugcauuuuaauaca

SEQ ID NO: 27223 - RNA, 18 nt, Homo sapiens
gcugcauacauuguguca

SEQ ID NO: 27224 - RNA, 22 nt, Homo sapiens
ggaguagaaacuuacaaacaaa

SEQ ID NO: 27225 - RNA, 20 nt, Homo sapiens
gguccgacuuuacccuuccc

SEQ ID NO: 27226 - RNA, 18 nt, Homo sapiens
uuugaugggaguagaaac

SEQ ID NO: 27227 - RNA, 18 nt, Homo sapiens
aaggggaaggggagcgaa

SEQ ID NO: 27228 - RNA, 18 nt, Homo sapiens
acccagagaggucucugu

SEQ ID NO: 27229 - RNA, 19 nt, Homo sapiens
aggauggagggguuaggac

SEQ ID NO: 27230 - RNA, 20 nt, Homo sapiens
cacuggagcccauuggggaa

SEQ ID NO: 27231 - RNA, 22 nt, Homo sapiens
ccgccgcccgggcuagaaaccc

SEQ ID NO: 27232 - RNA, 19 nt, Homo sapiens
ccuggagcugccagcucgg

SEQ ID NO: 27233 - RNA, 16 nt, Homo sapiens
cgggcaccacuggagc

SEQ ID NO: 27234 - RNA, 19 nt, Homo sapiens
cuccgcgcaaaguuucugg

SEQ ID NO: 27235 - RNA, 19 nt, Homo sapiens
cugcagccggguaaccuag

SEQ ID NO: 27236 - RNA, 17 nt, Homo sapiens
cugcgggcaccacugga

SEQ ID NO: 27237 - RNA, 20 nt, Homo sapiens
cugugugagugugugugugu

SEQ ID NO: 27238 - RNA, 19 nt, Homo sapiens
gcugggcguggggcagagg

SEQ ID NO: 27239 - RNA, 25 nt, Homo sapiens
ggaaggguuaaggaaaggggaaggg

SEQ ID NO: 27240 - RNA, 18 nt, Homo sapiens
uagagaggauggaggggu

SEQ ID NO: 27241 - RNA, 21 nt, Homo sapiens
ucugacaucuuugauuucugg

SEQ ID NO: 27242 - RNA, 17 nt, Homo sapiens
ucugcccagucaagccc

SEQ ID NO: 27243 - RNA, 25 nt, Homo sapiens
ucugugugagugugugugugugugu

SEQ ID NO: 27244 - RNA, 18 nt, Homo sapiens
ugccccgccuccgucguc

SEQ ID NO: 27245 - RNA, 19 nt, Homo sapiens
ugccuuuugcugcgggcac

SEQ ID NO: 27246 - RNA, 18 nt, Homo sapiens
ugugugugugugugugug

SEQ ID NO: 27247 - RNA, 19 nt, Homo sapiens
ugugugugugugugugugu

SEQ ID NO: 27248 - RNA, 18 nt, Homo sapiens
uucugagggucccugggu

SEQ ID NO: 27249 - RNA, 18 nt, Homo sapiens
aagaccagaccagccugg

SEQ ID NO: 27250 - RNA, 17 nt, Homo sapiens
agaugucagugagagca

SEQ ID NO: 27251 - RNA, 20 nt, Homo sapiens
guguuuuggaugcacuggcc

SEQ ID NO: 27252 - RNA, 18 nt, Homo sapiens
ucuagcagugcccgggcc

SEQ ID NO: 27253 - RNA, 16 nt, Homo sapiens
ugacccaugccuguaa

SEQ ID NO: 27254 - RNA, 21 nt, Homo sapiens
ugcacuggccagugggccgca

SEQ ID NO: 27255 - RNA, 14 nt, Homo sapiens
ugugauugugccac

SEQ ID NO: 27256 - RNA, 23 nt, Homo sapiens
aauuucuuuacacaaacaucuua

SEQ ID NO: 27257 - RNA, 21 nt, Homo sapiens
agagaaauuccgucggggugg

SEQ ID NO: 27258 - RNA, 21 nt, Homo sapiens
aguccuugcuuggugguucca

SEQ ID NO: 27259 - RNA, 22 nt, Homo sapiens
cauaagucuccgcuggaauggg

SEQ ID NO: 27260 - RNA, 18 nt, Homo sapiens
caucauguccugcucugc

SEQ ID NO: 27261 - RNA, 22 nt, Homo sapiens
gagggugaaagauauccauacu

SEQ ID NO: 27262 - RNA, 16 nt, Homo sapiens
gccugaugacccugaa

SEQ ID NO: 27263 - RNA, 16 nt, Homo sapiens
gcuuggugguuccacu

SEQ ID NO: 27264 - RNA, 18 nt, Homo sapiens
gcuuguugugguuguuau

SEQ ID NO: 27265 - RNA, 20 nt, Homo sapiens
guugugguuguuauggauuu

SEQ ID NO: 27266 - RNA, 21 nt, Homo sapiens
uauuauuauccaugucaucuu

SEQ ID NO: 27267 - RNA, 21 nt, Homo sapiens
uccaacaucucccuuucuuua

SEQ ID NO: 27268 - RNA, 18 nt, Homo sapiens
ucugggacagccugauga

SEQ ID NO: 27269 - RNA, 21 nt, Homo sapiens
ugaggacaagggauacugucu

SEQ ID NO: 27270 - RNA, 19 nt, Homo sapiens
uggaauggggcgauagccu

SEQ ID NO: 27271 - RNA, 22 nt, Homo sapiens
uggauuuguuugcuugcuugcu

SEQ ID NO: 27272 - RNA, 18 nt, Homo sapiens
uggcauuuagcaggcauu

SEQ ID NO: 27273 - RNA, 22 nt, Homo sapiens
ugucaauuuuauugcuuuuuga

SEQ ID NO: 27274 - RNA, 19 nt, Homo sapiens
aaaggaaaaaaaaaggaaa

SEQ ID NO: 27275 - RNA, 18 nt, Homo sapiens
aaaggugagaguucaagc

SEQ ID NO: 27276 - RNA, 16 nt, Homo sapiens
acaaaaucaagugguu

SEQ ID NO: 27277 - RNA, 22 nt, Homo sapiens
uacuucaaaguugucuuuaaaa

SEQ ID NO: 27278 - RNA, 22 nt, Homo sapiens
ucaaaggugagaguucaagcau

SEQ ID NO: 27279 - RNA, 22 nt, Homo sapiens
uucuuugagcagcggcugcacc

SEQ ID NO: 27280 - RNA, 21 nt, Homo sapiens
ccgccgggcagcucggccgga

SEQ ID NO: 27281 - RNA, 24 nt, Homo sapiens
ccucggcgguccgguccgggaggc

SEQ ID NO: 27282 - RNA, 15 nt, Homo sapiens
cggggucccggccgg

SEQ ID NO: 27283 - RNA, 17 nt, Homo sapiens
gaggaggcgggaguggc

SEQ ID NO: 27284 - RNA, 19 nt, Homo sapiens
gcgggaguggcagaggagg

SEQ ID NO: 27285 - RNA, 18 nt, Homo sapiens
gcgggccaggcagcggcg

SEQ ID NO: 27286 - RNA, 22 nt, Homo sapiens
ggaguggcagaggaggucccag

SEQ ID NO: 27287 - RNA, 18 nt, Homo sapiens
gggcagggcgcgggccgg

SEQ ID NO: 27288 - RNA, 19 nt, Homo sapiens
ggggaggaggcgggagugg

SEQ ID NO: 27289 - RNA, 18 nt, Homo sapiens
gguggaaggaggccgcac

SEQ ID NO: 27290 - RNA, 17 nt, Homo sapiens
uaggagcccagggcggc

SEQ ID NO: 27291 - RNA, 19 nt, Homo sapiens
gccucaagccuccucuucc

SEQ ID NO: 27292 - RNA, 19 nt, Homo sapiens
aauuucauuuuuaaaaugc

SEQ ID NO: 27293 - RNA, 19 nt, Homo sapiens
cagcauucuuggagaugga

SEQ ID NO: 27294 - RNA, 18 nt, Homo sapiens
cugaugaacaccagcaga

SEQ ID NO: 27295 - RNA, 21 nt, Homo sapiens
gagcuugggcacccagugugc

SEQ ID NO: 27296 - RNA, 19 nt, Homo sapiens
uguggguauauacauuuac

SEQ ID NO: 27297 - RNA, 17 nt, Homo sapiens
uugccaguuuguuccag

SEQ ID NO: 27298 - RNA, 18 nt, Homo sapiens
aucuguguuuguugaugu

SEQ ID NO: 27299 - RNA, 18 nt, Homo sapiens
caccacguuccccacccg

SEQ ID NO: 27300 - RNA, 21 nt, Homo sapiens
cagccgcugcacggcgcgucc

SEQ ID NO: 27301 - RNA, 20 nt, Homo sapiens
ccgcccgcagcuccguuucc

SEQ ID NO: 27302 - RNA, 15 nt, Homo sapiens
cgcgcgccggccggc

SEQ ID NO: 27303 - RNA, 19 nt, Homo sapiens
cgggggcggcggaggcgcg

SEQ ID NO: 27304 - RNA, 18 nt, Homo sapiens
cggguuugccgucgccgc

SEQ ID NO: 27305 - RNA, 18 nt, Homo sapiens
gccgccgcaccacguucc

SEQ ID NO: 27306 - RNA, 18 nt, Homo sapiens
uuuuccugucauuugaga

SEQ ID NO: 27307 - RNA, 20 nt, Homo sapiens
ccccuuuauuccccuucuug

SEQ ID NO: 27308 - RNA, 18 nt, Homo sapiens
cuucucuuguaucugugu

SEQ ID NO: 27309 - RNA, 18 nt, Homo sapiens
gcaggcagagagcuccuc

SEQ ID NO: 27310 - RNA, 18 nt, Homo sapiens
agaaaauuaaaagagaga

SEQ ID NO: 27311 - RNA, 20 nt, Homo sapiens
agggggaggggaauguagga

SEQ ID NO: 27312 - RNA, 18 nt, Homo sapiens
gggccgcggcggggccgg

SEQ ID NO: 27313 - RNA, 19 nt, Homo sapiens
ggggaagagcugugagggg

SEQ ID NO: 27314 - RNA, 18 nt, Homo sapiens
ggggaggcggagcugggg

SEQ ID NO: 27315 - RNA, 19 nt, Homo sapiens
ucaacauccuaugguuaau

SEQ ID NO: 27316 - RNA, 17 nt, Homo sapiens
uccgggccgcggcgggg

SEQ ID NO: 27317 - RNA, 20 nt, Homo sapiens
ugcauuagggcacauaguaa

SEQ ID NO: 27318 - RNA, 23 nt, Homo sapiens
uuugugccuugacgagaauaaaa

SEQ ID NO: 27319 - RNA, 18 nt, Homo sapiens
aucucuguucuuuccagg

SEQ ID NO: 27320 - RNA, 18 nt, Homo sapiens
gaaccaaagugcuaagug

SEQ ID NO: 27321 - RNA, 15 nt, Homo sapiens
guaggugaaagggua

SEQ ID NO: 27322 - RNA, 15 nt, Homo sapiens
ucuuuccaggugacu

SEQ ID NO: 27323 - RNA, 24 nt, Homo sapiens
uucaugaauauucauuccuacacu

SEQ ID NO: 27324 - RNA, 19 nt, Homo sapiens
ccccugugcauauguucca

SEQ ID NO: 27325 - RNA, 18 nt, Homo sapiens
gaaauguuugucuuuucu

SEQ ID NO: 27326 - RNA, 24 nt, Homo sapiens
uaaaugaucaugaaaccaaaaaga

SEQ ID NO: 27327 - RNA, 20 nt, Homo sapiens
aaagcuaucucuucagugcc

SEQ ID NO: 27328 - RNA, 21 nt, Homo sapiens
cggguccguguccuccuuccc

SEQ ID NO: 27329 - RNA, 20 nt, Homo sapiens
cugggguggggugggguggg

SEQ ID NO: 27330 - RNA, 24 nt, Homo sapiens
gcugcccacgccguccuccgugcc

SEQ ID NO: 27331 - RNA, 19 nt, Homo sapiens
ggcccuugaaagcuaucuc

SEQ ID NO: 27332 - RNA, 15 nt, Homo sapiens
guggggugggguggg

SEQ ID NO: 27333 - RNA, 15 nt, Homo sapiens
ucuggccacguccag

SEQ ID NO: 27334 - RNA, 20 nt, Homo sapiens
ugcgcgcgugugccccuggg

SEQ ID NO: 27335 - RNA, 22 nt, Homo sapiens
uugaugggguugauucccuugg

SEQ ID NO: 27336 - RNA, 23 nt, Homo sapiens
agggggacgggcgaacugguggg

SEQ ID NO: 27337 - RNA, 22 nt, Homo sapiens
auguuguucaucaucucagaga

SEQ ID NO: 27338 - RNA, 20 nt, Homo sapiens
ccucucacaggcugggguga

SEQ ID NO: 27339 - RNA, 17 nt, Homo sapiens
cggguauaagcugaauc

SEQ ID NO: 27340 - RNA, 16 nt, Homo sapiens
cuagcaaaacccugca

SEQ ID NO: 27341 - RNA, 20 nt, Homo sapiens
cuaucaacucaggaauucuc

SEQ ID NO: 27342 - RNA, 16 nt, Homo sapiens
gaauguuucauucuga

SEQ ID NO: 27343 - RNA, 17 nt, Homo sapiens
gagguuuucagcccggg

SEQ ID NO: 27344 - RNA, 22 nt, Homo sapiens
gcggcugcugcuagggagucga

SEQ ID NO: 27345 - RNA, 19 nt, Homo sapiens
gggaaggaggggcgugggc

SEQ ID NO: 27346 - RNA, 18 nt, Homo sapiens
guuucuacagucagguga

SEQ ID NO: 27347 - RNA, 21 nt, Homo sapiens
ucuuuuaaaugaucacauuca

SEQ ID NO: 27348 - RNA, 20 nt, Homo sapiens
ugcuaagagauguaaaagcu

SEQ ID NO: 27349 - RNA, 18 nt, Homo sapiens
uuaaacauuuuucacuca

SEQ ID NO: 27350 - RNA, 20 nt, Homo sapiens
ugacaagugacaaccuuuuc

SEQ ID NO: 27351 - RNA, 20 nt, Homo sapiens
cuuuauuuaacucauaacuu

SEQ ID NO: 27352 - RNA, 19 nt, Homo sapiens
uccaugaggugaaagccug

SEQ ID NO: 27353 - RNA, 20 nt, Homo sapiens
ugacaagugacaaccuuuuc

SEQ ID NO: 27354 - RNA, 19 nt, Homo sapiens
aaaagcaugaaaauacagg

SEQ ID NO: 27355 - RNA, 19 nt, Homo sapiens
guugccaaaaagacuaugu

SEQ ID NO: 27356 - RNA, 17 nt, Homo sapiens
cagagggccacugggcu

SEQ ID NO: 27357 - RNA, 22 nt, Homo sapiens
gaaggucaagguccagaagcca

SEQ ID NO: 27358 - RNA, 19 nt, Homo sapiens
ugugugugccggucaagaa

SEQ ID NO: 27359 - RNA, 18 nt, Homo sapiens
ccacaggggaauuguuuu

SEQ ID NO: 27360 - RNA, 15 nt, Homo sapiens
cccuucucccucccc

SEQ ID NO: 27361 - RNA, 18 nt, Homo sapiens
gaaugcacuuuuccagcc

SEQ ID NO: 27362 - RNA, 17 nt, Homo sapiens
gccugguucuggguucc

SEQ ID NO: 27363 - RNA, 18 nt, Homo sapiens
gggaggcgggaagggggc

SEQ ID NO: 27364 - RNA, 18 nt, Homo sapiens
gguuccacccaguccagc

SEQ ID NO: 27365 - RNA, 20 nt, Homo sapiens
caguguuaaccccggugugc

SEQ ID NO: 27366 - RNA, 16 nt, Homo sapiens
ccucugacuucuucac

SEQ ID NO: 27367 - RNA, 18 nt, Homo sapiens
uguccacauauguauugu

SEQ ID NO: 27368 - RNA, 17 nt, Homo sapiens
gccccccgcggcuaccc

SEQ ID NO: 27369 - RNA, 21 nt, Homo sapiens
gcccgcccggggcgcgccccc

SEQ ID NO: 27370 - RNA, 20 nt, Homo sapiens
gcgccccgccggcgcgcucg

SEQ ID NO: 27371 - RNA, 19 nt, Homo sapiens
ggacuaugcucacuaucua

SEQ ID NO: 27372 - RNA, 18 nt, Homo sapiens
guuuccauuuauccauag

SEQ ID NO: 27373 - RNA, 25 nt, Homo sapiens
uaaaauauauacuuuuauacagaaa

SEQ ID NO: 27374 - RNA, 22 nt, Homo sapiens
aaacaauaucacuuacugguug

SEQ ID NO: 27375 - RNA, 18 nt, Homo sapiens
aagcauuaccaaagggga

SEQ ID NO: 27376 - RNA, 16 nt, Homo sapiens
caguguagccaagcuu

SEQ ID NO: 27377 - RNA, 21 nt, Homo sapiens
caugugcagagguaaugaaau

SEQ ID NO: 27378 - RNA, 18 nt, Homo sapiens
cauuccuaccgucaccuc

SEQ ID NO: 27379 - RNA, 22 nt, Homo sapiens
ccaauguaguaggcccuuuuua

SEQ ID NO: 27380 - RNA, 21 nt, Homo sapiens
cccuguuuguugaaccuuucc

SEQ ID NO: 27381 - RNA, 15 nt, Homo sapiens
ccgccgccuccugug

SEQ ID NO: 27382 - RNA, 18 nt, Homo sapiens
cuacagcugcagggcuga

SEQ ID NO: 27383 - RNA, 19 nt, Homo sapiens
cuggauuuaaauuucagaa

SEQ ID NO: 27384 - RNA, 18 nt, Homo sapiens
cuguguucucuccauccu

SEQ ID NO: 27385 - RNA, 20 nt, Homo sapiens
gaaaggggaugcagacauga

SEQ ID NO: 27386 - RNA, 15 nt, Homo sapiens
gcgccggggcugcgc

SEQ ID NO: 27387 - RNA, 17 nt, Homo sapiens
ggucccgccgcgccgcg

SEQ ID NO: 27388 - RNA, 19 nt, Homo sapiens
guuuauacaaaaggugcua

SEQ ID NO: 27389 - RNA, 18 nt, Homo sapiens
uaacuuguugauucagcu

SEQ ID NO: 27390 - RNA, 23 nt, Homo sapiens
uacauaaucuauaguaagauaua

SEQ ID NO: 27391 - RNA, 24 nt, Homo sapiens
uaccacuauuuggguguagagacc

SEQ ID NO: 27392 - RNA, 16 nt, Homo sapiens
uccgcggucccgccgc

SEQ ID NO: 27393 - RNA, 14 nt, Homo sapiens
uggccggcuggugc

SEQ ID NO: 27394 - RNA, 17 nt, Homo sapiens
uuagaauaccacuauuu

SEQ ID NO: 27395 - RNA, 18 nt, Homo sapiens
cccacggcagaauuugca

SEQ ID NO: 27396 - RNA, 17 nt, Homo sapiens
cuagcacacgugcaccg

SEQ ID NO: 27397 - RNA, 19 nt, Homo sapiens
gagggcgcccgggccgagg

SEQ ID NO: 27398 - RNA, 16 nt, Homo sapiens
ggagagcugaggggga

SEQ ID NO: 27399 - RNA, 16 nt, Homo sapiens
auccaguacuacuggc

SEQ ID NO: 27400 - RNA, 19 nt, Homo sapiens
cagugcucuuuccacugca

SEQ ID NO: 27401 - RNA, 18 nt, Homo sapiens
gacuucaguagcuucugu

SEQ ID NO: 27402 - RNA, 18 nt, Homo sapiens
gcauugagauucucauug

SEQ ID NO: 27403 - RNA, 16 nt, Homo sapiens
gcugggccugguggcu

SEQ ID NO: 27404 - RNA, 14 nt, Homo sapiens
ggaaauucugucca

SEQ ID NO: 27405 - RNA, 20 nt, Homo sapiens
gggaggaugccuugagccca

SEQ ID NO: 27406 - RNA, 20 nt, Homo sapiens
uacauagauuugucacauag

SEQ ID NO: 27407 - RNA, 20 nt, Homo sapiens
ucaggaaccacccuaauaaa

SEQ ID NO: 27408 - RNA, 18 nt, Homo sapiens
uccaacuccuaguucagu

SEQ ID NO: 27409 - RNA, 15 nt, Homo sapiens
uccccugguuuccau

SEQ ID NO: 27410 - RNA, 17 nt, Homo sapiens
ugcaguagcuaaggcaa

SEQ ID NO: 27411 - RNA, 21 nt, Homo sapiens
ugggaaauucuguccaguguu

SEQ ID NO: 27412 - RNA, 20 nt, Homo sapiens
aaaauuuaagaguauugaaa

SEQ ID NO: 27413 - RNA, 23 nt, Homo sapiens
aauggaugaaaaauuaccuauug

SEQ ID NO: 27414 - RNA, 15 nt, Homo sapiens
acaucacucagguga

SEQ ID NO: 27415 - RNA, 19 nt, Homo sapiens
gggaggccuggggaggagc

SEQ ID NO: 27416 - RNA, 20 nt, Homo sapiens
ggggaggagcgcccggggag

SEQ ID NO: 27417 - RNA, 24 nt, Homo sapiens
ggggaggagcgcccggggaggagc

SEQ ID NO: 27418 - RNA, 21 nt, Homo sapiens
uaaguggaagcuuagcuguag

SEQ ID NO: 27419 - RNA, 18 nt, Homo sapiens
uacagaaucuccucgccu

SEQ ID NO: 27420 - RNA, 20 nt, Homo sapiens
uggagacucagaagggaaga

SEQ ID NO: 27421 - RNA, 23 nt, Homo sapiens
uggguguuuucuaaaauuuaucc

SEQ ID NO: 27422 - RNA, 23 nt, Homo sapiens
ccccugaagagggcuuuagggag

SEQ ID NO: 27423 - RNA, 18 nt, Homo sapiens
gcccugggugggcacagg

SEQ ID NO: 27424 - RNA, 24 nt, Homo sapiens
gugggcacagggggcucagagaca

SEQ ID NO: 27425 - RNA, 16 nt, Homo sapiens
ugaaggguggcccagg

SEQ ID NO: 27426 - RNA, 21 nt, Homo sapiens
ccugggguagauccaggcugg

SEQ ID NO: 27427 - RNA, 18 nt, Homo sapiens
gcccucggugcauggcag

SEQ ID NO: 27428 - RNA, 22 nt, Homo sapiens
uacacaaacuccagaaaguaga

SEQ ID NO: 27429 - RNA, 16 nt, Homo sapiens
uccauggagugugggg

SEQ ID NO: 27430 - RNA, 19 nt, Homo sapiens
ccuucugcucucccagccc

SEQ ID NO: 27431 - RNA, 19 nt, Homo sapiens
gccugcccuucugcucucc

SEQ ID NO: 27432 - RNA, 18 nt, Homo sapiens
ccagaggggcucuguugc

SEQ ID NO: 27433 - RNA, 21 nt, Homo sapiens
gcagggagggcauccgggcac

SEQ ID NO: 27434 - RNA, 15 nt, Homo sapiens
ggagugugggccauu

SEQ ID NO: 27435 - RNA, 21 nt, Homo sapiens
ggauuccaggagauguggaga

SEQ ID NO: 27436 - RNA, 17 nt, Homo sapiens
gguauugcugacggccc

SEQ ID NO: 27437 - RNA, 20 nt, Homo sapiens
ugggauggugcuaguggcuc

SEQ ID NO: 27438 - RNA, 19 nt, Homo sapiens
cagcagguugcaggagaca

SEQ ID NO: 27439 - RNA, 20 nt, Homo sapiens
gcaggcgugagcuggccaca

SEQ ID NO: 27440 - RNA, 20 nt, Homo sapiens
gcugcucggagcuggcucca

SEQ ID NO: 27441 - RNA, 23 nt, Homo sapiens
ugaugucgacugcagggacccac

SEQ ID NO: 27442 - RNA, 21 nt, Homo sapiens
cccgacgcagccaucuagccc

SEQ ID NO: 27443 - RNA, 14 nt, Homo sapiens
cucgcggcccuagc

SEQ ID NO: 27444 - RNA, 20 nt, Homo sapiens
ggaggaagggccggcggggg

SEQ ID NO: 27445 - RNA, 21 nt, Homo sapiens
gggccggcgggggcucgcggc

SEQ ID NO: 27446 - RNA, 19 nt, Homo sapiens
ucccagagguuccagguca

SEQ ID NO: 27447 - RNA, 25 nt, Homo sapiens
uggggaaaaggggauuccaccacaa

SEQ ID NO: 27448 - RNA, 19 nt, Homo sapiens
aaagugcaugcguugaagu

SEQ ID NO: 27449 - RNA, 24 nt, Homo sapiens
aggccggggagggagcucuccggg

SEQ ID NO: 27450 - RNA, 18 nt, Homo sapiens
cgcuggaucacggcuggg

SEQ ID NO: 27451 - RNA, 20 nt, Homo sapiens
cggagccccaaacccgucgc

SEQ ID NO: 27452 - RNA, 21 nt, Homo sapiens
ucccccugccuuugcgcccgg

SEQ ID NO: 27453 - RNA, 20 nt, Homo sapiens
uaggacauuaacauagccca

SEQ ID NO: 27454 - RNA, 18 nt, Homo sapiens
ucguguggcccagguacc

SEQ ID NO: 27455 - RNA, 18 nt, Homo sapiens
ugcuacuccaacucucua

SEQ ID NO: 27456 - RNA, 22 nt, Homo sapiens
ggcgacauccgaggaguuguag

SEQ ID NO: 27457 - RNA, 19 nt, Homo sapiens
uagaauacauugaacuguc

SEQ ID NO: 27458 - RNA, 21 nt, Homo sapiens
agcuacccccacggggccacc

SEQ ID NO: 27459 - RNA, 18 nt, Homo sapiens
ggggaggggcuggucaag

SEQ ID NO: 27460 - RNA, 23 nt, Homo sapiens
agaccaagguccccgccgggcug

SEQ ID NO: 27461 - RNA, 15 nt, Homo sapiens
gaggccgcgccuccu

SEQ ID NO: 27462 - RNA, 22 nt, Homo sapiens
ucuccaggcgccccccccgccu

SEQ ID NO: 27463 - RNA, 20 nt, Homo sapiens
uacaagaaacacccagaaag

SEQ ID NO: 27464 - RNA, 18 nt, Homo sapiens
caaaugaggagccuggga

SEQ ID NO: 27465 - RNA, 24 nt, Homo sapiens
ugacuagcaaaugaggagccuggg

SEQ ID NO: 27466 - RNA, 19 nt, Homo sapiens
aaggucuuccacuagaguc

SEQ ID NO: 27467 - RNA, 18 nt, Homo sapiens
caaaggagaauucucaca

SEQ ID NO: 27468 - RNA, 15 nt, Homo sapiens
cacccaaaaaggaaa

SEQ ID NO: 27469 - RNA, 20 nt, Homo sapiens
ccuuccuccuccccuuuccc

SEQ ID NO: 27470 - RNA, 21 nt, Homo sapiens
uugugaaaaaaguuguuucug

SEQ ID NO: 27471 - RNA, 19 nt, Homo sapiens
cacgccacgcgccgugccc

SEQ ID NO: 27472 - RNA, 25 nt, Homo sapiens
ccgccucgcgcucgccccucgugcc

SEQ ID NO: 27473 - RNA, 21 nt, Homo sapiens
ccgugccccgccucgcgcucg

SEQ ID NO: 27474 - RNA, 18 nt, Homo sapiens
ccucgcgcucgccccucg

SEQ ID NO: 27475 - RNA, 20 nt, Homo sapiens
ccucgugccugccuucucgc

SEQ ID NO: 27476 - RNA, 17 nt, Homo sapiens
cucgcgccucgcucugg

SEQ ID NO: 27477 - RNA, 19 nt, Homo sapiens
ggagaaagugucgcaccgg

SEQ ID NO: 27478 - RNA, 18 nt, Homo sapiens
uccggagaaagugucgca

SEQ ID NO: 27479 - RNA, 22 nt, Homo sapiens
aauaaacaucauuuuuuagauu

SEQ ID NO: 27480 - RNA, 15 nt, Homo sapiens
cauacccuuguaccc

SEQ ID NO: 27481 - RNA, 16 nt, Homo sapiens
ccgcgcggccggcccc

SEQ ID NO: 27482 - RNA, 21 nt, Homo sapiens
ccggccccuggcuagccggcc

SEQ ID NO: 27483 - RNA, 19 nt, Homo sapiens
ggaaauaaacaucauuuuu

SEQ ID NO: 27484 - RNA, 21 nt, Homo sapiens
ucacacaccccgcgcggccgg

SEQ ID NO: 27485 - RNA, 17 nt, Homo sapiens
agacauccuacaggaaa

SEQ ID NO: 27486 - RNA, 22 nt, Homo sapiens
cauguuucccaaagcuuuuuua

SEQ ID NO: 27487 - RNA, 18 nt, Homo sapiens
gaaguggagacagcaugg

SEQ ID NO: 27488 - RNA, 19 nt, Homo sapiens
uaauguacagaacaggaua

SEQ ID NO: 27489 - RNA, 20 nt, Homo sapiens
auacaacaucuucauuccuc

SEQ ID NO: 27490 - RNA, 18 nt, Homo sapiens
ccccuuuccgggacaccu

SEQ ID NO: 27491 - RNA, 16 nt, Homo sapiens
cgaggucaggcguuca

SEQ ID NO: 27492 - RNA, 23 nt, Homo sapiens
cucagcuucucaugggauggcug

SEQ ID NO: 27493 - RNA, 20 nt, Homo sapiens
cuucugucccuguuguuggg

SEQ ID NO: 27494 - RNA, 20 nt, Homo sapiens
gaccagccuuggcuggacuu

SEQ ID NO: 27495 - RNA, 18 nt, Homo sapiens
gacgggggaggcuggggu

SEQ ID NO: 27496 - RNA, 19 nt, Homo sapiens
gaggaggauggaagggagg

SEQ ID NO: 27497 - RNA, 20 nt, Homo sapiens
gcauaucugcugcacaagug

SEQ ID NO: 27498 - RNA, 23 nt, Homo sapiens
gccccagggcuggauggacgggg

SEQ ID NO: 27499 - RNA, 17 nt, Homo sapiens
guugggacaaaugaggu

SEQ ID NO: 27500 - RNA, 18 nt, Homo sapiens
uaccaggcaugcagaagc

SEQ ID NO: 27501 - RNA, 19 nt, Homo sapiens
uauuuugccaaacauaccu

SEQ ID NO: 27502 - RNA, 16 nt, Homo sapiens
uccgggacaccugggu

SEQ ID NO: 27503 - RNA, 23 nt, Homo sapiens
ugccuguaaucccagcacuuugg

SEQ ID NO: 27504 - RNA, 17 nt, Homo sapiens
uggcagguggcaugagu

SEQ ID NO: 27505 - RNA, 17 nt, Homo sapiens
uugggaggcugaggcgg

SEQ ID NO: 27506 - RNA, 22 nt, Homo sapiens
aaaggucacuucaggaagggga

SEQ ID NO: 27507 - RNA, 18 nt, Homo sapiens
aaggaggaaagagggaac

SEQ ID NO: 27508 - RNA, 21 nt, Homo sapiens
aauauguagccauaaguuugg

SEQ ID NO: 27509 - RNA, 17 nt, Homo sapiens
agcagaaugauuuucac

SEQ ID NO: 27510 - RNA, 20 nt, Homo sapiens
agcugacucagacaucuuga

SEQ ID NO: 27511 - RNA, 18 nt, Homo sapiens
aguauauccuuccuuagc

SEQ ID NO: 27512 - RNA, 17 nt, Homo sapiens
cacauugccuucccuga

SEQ ID NO: 27513 - RNA, 19 nt, Homo sapiens
caggaaggggagagacuuc

SEQ ID NO: 27514 - RNA, 19 nt, Homo sapiens
caguacuucuaauuuuccu

SEQ ID NO: 27515 - RNA, 19 nt, Homo sapiens
cccuacaaaaucucuguau

SEQ ID NO: 27516 - RNA, 18 nt, Homo sapiens
cccucagacauucagguu

SEQ ID NO: 27517 - RNA, 22 nt, Homo sapiens
cuguauuagguuggguuagaag

SEQ ID NO: 27518 - RNA, 19 nt, Homo sapiens
cuugucacauuuuuucuuu

SEQ ID NO: 27519 - RNA, 21 nt, Homo sapiens
gaaguacuguagucguguaag

SEQ ID NO: 27520 - RNA, 23 nt, Homo sapiens
gaguucuugccccaucgacauuc

SEQ ID NO: 27521 - RNA, 18 nt, Homo sapiens
gcugcucacuugguuguc

SEQ ID NO: 27522 - RNA, 18 nt, Homo sapiens
uaauuaaaugaaauuaag

SEQ ID NO: 27523 - RNA, 20 nt, Homo sapiens
uauuacaacuaauaauuacc

SEQ ID NO: 27524 - RNA, 25 nt, Homo sapiens
ucaugcaaucuuuugaguaaaggaa

SEQ ID NO: 27525 - RNA, 23 nt, Homo sapiens
ucgaacuccuggccucaagugau

SEQ ID NO: 27526 - RNA, 18 nt, Homo sapiens
ugagagaauuacaucaga

SEQ ID NO: 27527 - RNA, 21 nt, Homo sapiens
uucaauucuccuuuauuaaca

SEQ ID NO: 27528 - RNA, 14 nt, Homo sapiens
uuccagauaaaggu

SEQ ID NO: 27529 - RNA, 19 nt, Homo sapiens
uuccagauuuagcucuggu

SEQ ID NO: 27530 - RNA, 18 nt, Homo sapiens
uuuggauuuggaaaggaa

SEQ ID NO: 27531 - RNA, 17 nt, Homo sapiens
cagacgacagcuggagc

SEQ ID NO: 27532 - RNA, 20 nt, Homo sapiens
cagggaugggcggacucggg

SEQ ID NO: 27533 - RNA, 22 nt, Homo sapiens
ccaggagggucggcuggcaggg

SEQ ID NO: 27534 - RNA, 22 nt, Homo sapiens
ccuccuccuccucuuccaaguc

SEQ ID NO: 27535 - RNA, 19 nt, Homo sapiens
ccuccuccucuuccaaguc

SEQ ID NO: 27536 - RNA, 16 nt, Homo sapiens
ccuucccacccccugu

SEQ ID NO: 27537 - RNA, 18 nt, Homo sapiens
cucuccuccuucuccucc

SEQ ID NO: 27538 - RNA, 14 nt, Homo sapiens
gagauuccagcccc

SEQ ID NO: 27539 - RNA, 20 nt, Homo sapiens
gaugccgcuguaccucuuga

SEQ ID NO: 27540 - RNA, 17 nt, Homo sapiens
gcaacagugcagaacca

SEQ ID NO: 27541 - RNA, 20 nt, Homo sapiens
gcagggucuugggauaacac

SEQ ID NO: 27542 - RNA, 20 nt, Homo sapiens
ggcacguggaauguuuuuca

SEQ ID NO: 27543 - RNA, 18 nt, Homo sapiens
gggugugggagacauugg

SEQ ID NO: 27544 - RNA, 17 nt, Homo sapiens
ggugggugugggagaca

SEQ ID NO: 27545 - RNA, 14 nt, Homo sapiens
gugaggggccaagg

SEQ ID NO: 27546 - RNA, 15 nt, Homo sapiens
uccccucucucuccu

SEQ ID NO: 27547 - RNA, 18 nt, Homo sapiens
uguguuuguuuguuuugu

SEQ ID NO: 27548 - RNA, 20 nt, Homo sapiens
aaccucacauauauauugau

SEQ ID NO: 27549 - RNA, 24 nt, Homo sapiens
aauuacauuuauuacaaagcagau

SEQ ID NO: 27550 - RNA, 21 nt, Homo sapiens
ccucccacgaguucuuugccc

SEQ ID NO: 27551 - RNA, 21 nt, Homo sapiens
ccuguucccauguaaaccggc

SEQ ID NO: 27552 - RNA, 17 nt, Homo sapiens
guuuugcuuuacaucau

SEQ ID NO: 27553 - RNA, 19 nt, Homo sapiens
uaacaaaaguauauauaau

SEQ ID NO: 27554 - RNA, 19 nt, Homo sapiens
uauuacauacaacagacau

SEQ ID NO: 27555 - RNA, 17 nt, Homo sapiens
ugagggaagguggaaca

SEQ ID NO: 27556 - RNA, 21 nt, Homo sapiens
ugagggaagguggaacagcaa

SEQ ID NO: 27557 - RNA, 19 nt, Homo sapiens
ugguuuugagacagggcug

SEQ ID NO: 27558 - RNA, 19 nt, Homo sapiens
cccaaucuaaauuugcaca

SEQ ID NO: 27559 - RNA, 20 nt, Homo sapiens
cucagaauuaagcaaauuaa

SEQ ID NO: 27560 - RNA, 17 nt, Homo sapiens
cucauccuaccucugug

SEQ ID NO: 27561 - RNA, 19 nt, Homo sapiens
uauggcuauucucuuucug

SEQ ID NO: 27562 - RNA, 22 nt, Homo sapiens
accagggagggguuccuuuggu

SEQ ID NO: 27563 - RNA, 21 nt, Homo sapiens
accaguagcacgaugagcuua

SEQ ID NO: 27564 - RNA, 17 nt, Homo sapiens
cagaugucuccuuguau

SEQ ID NO: 27565 - RNA, 21 nt, Homo sapiens
ggcaugaaccauugugucugu

SEQ ID NO: 27566 - RNA, 20 nt, Homo sapiens
uacuugaugcauucauacag

SEQ ID NO: 27567 - RNA, 20 nt, Homo sapiens
uuacauucauuucucauacg

SEQ ID NO: 27568 - RNA, 21 nt, Homo sapiens
caccugugcauucucuacucu

SEQ ID NO: 27569 - RNA, 20 nt, Homo sapiens
ccaaugauuccccugcuucu

SEQ ID NO: 27570 - RNA, 20 nt, Homo sapiens
cccgcccggucccggcgcgg

SEQ ID NO: 27571 - RNA, 22 nt, Homo sapiens
ccucggucccgugcgguccccg

SEQ ID NO: 27572 - RNA, 17 nt, Homo sapiens
cucccucccucucaucc

SEQ ID NO: 27573 - RNA, 18 nt, Homo sapiens
gaagcacaccauuaaaaa

SEQ ID NO: 27574 - RNA, 18 nt, Homo sapiens
gccaagaguucuuguaaa

SEQ ID NO: 27575 - RNA, 22 nt, Homo sapiens
gcucccgucccgcugucauccc

SEQ ID NO: 27576 - RNA, 18 nt, Homo sapiens
ggugugguggcgguggca

SEQ ID NO: 27577 - RNA, 16 nt, Homo sapiens
guggcgguggcacugc

SEQ ID NO: 27578 - RNA, 19 nt, Homo sapiens
guguauguguggcacgagc

SEQ ID NO: 27579 - RNA, 20 nt, Homo sapiens
ugggugccggguacuuuucu

SEQ ID NO: 27580 - RNA, 18 nt, Homo sapiens
ugugaugucuccuccugc

SEQ ID NO: 27581 - RNA, 21 nt, Homo sapiens
gcagcagcugucacacgggcc

SEQ ID NO: 27582 - RNA, 20 nt, Homo sapiens
ggcgcugguguggacaggag

SEQ ID NO: 27583 - RNA, 20 nt, Homo sapiens
gugcaggggcccucagggac

SEQ ID NO: 27584 - RNA, 20 nt, Homo sapiens
accgucuucugucccguggc

SEQ ID NO: 27585 - RNA, 20 nt, Homo sapiens
acguggcccggcagcagagg

SEQ ID NO: 27586 - RNA, 23 nt, Homo sapiens
caccacgccuggacgugcucccc

SEQ ID NO: 27587 - RNA, 16 nt, Homo sapiens
caccguuccuccuccc

SEQ ID NO: 27588 - RNA, 19 nt, Homo sapiens
caccuguuuucuuucaacc

SEQ ID NO: 27589 - RNA, 22 nt, Homo sapiens
caucccacuuuguaucuugcau

SEQ ID NO: 27590 - RNA, 20 nt, Homo sapiens
uaauucuuccaucccacuuu

SEQ ID NO: 27591 - RNA, 19 nt, Homo sapiens
uuucagauacuguuguguc

SEQ ID NO: 27592 - RNA, 20 nt, Homo sapiens
aaggacacagacgcggggga

SEQ ID NO: 27593 - RNA, 24 nt, Homo sapiens
uaacauaguaaaguaccuuuuagu

SEQ ID NO: 27594 - RNA, 17 nt, Homo sapiens
aggggaaggagguaggg

SEQ ID NO: 27595 - RNA, 22 nt, Homo sapiens
gaaggagaagaaacaaaagaau

SEQ ID NO: 27596 - RNA, 16 nt, Homo sapiens
gggaggaggggguggu

SEQ ID NO: 27597 - RNA, 18 nt, Homo sapiens
gggaggagugaggggaag

SEQ ID NO: 27598 - RNA, 19 nt, Homo sapiens
ggggaggagugaggggaag

SEQ ID NO: 27599 - RNA, 22 nt, Homo sapiens
ggggaggagugaggggaaggag

SEQ ID NO: 27600 - RNA, 17 nt, Homo sapiens
uggggaggagggggugg

SEQ ID NO: 27601 - RNA, 18 nt, Homo sapiens
aaggggaaagagccuggu

SEQ ID NO: 27602 - RNA, 22 nt, Homo sapiens
caggaggagcaggccagcgagg

SEQ ID NO: 27603 - RNA, 21 nt, Homo sapiens
gaacagaugugccugauuuca

SEQ ID NO: 27604 - RNA, 24 nt, Homo sapiens
gaacagaugugccugauuucaggg

SEQ ID NO: 27605 - RNA, 16 nt, Homo sapiens
ggggguugccugcuuu

SEQ ID NO: 27606 - RNA, 19 nt, Homo sapiens
uacauauauuuauauauag

SEQ ID NO: 27607 - RNA, 20 nt, Homo sapiens
ucagcagaacaauugugugu

SEQ ID NO: 27608 - RNA, 22 nt, Homo sapiens
ugauuucagggcugaauuuuug

SEQ ID NO: 27609 - RNA, 16 nt, Homo sapiens
ugcugccguccccucc

SEQ ID NO: 27610 - RNA, 24 nt, Homo sapiens
uguuauuuccuggagcuaauuguu

SEQ ID NO: 27611 - RNA, 20 nt, Homo sapiens
uuucauggaauccacugcua

SEQ ID NO: 27612 - RNA, 18 nt, Homo sapiens
aagggaagggggagggga

SEQ ID NO: 27613 - RNA, 23 nt, Homo sapiens
aagggggaggggaggguuagagg

SEQ ID NO: 27614 - RNA, 20 nt, Homo sapiens
accuccaguucccuccuccc

SEQ ID NO: 27615 - RNA, 22 nt, Homo sapiens
aggcaguaauaaaggaccugga

SEQ ID NO: 27616 - RNA, 22 nt, Homo sapiens
agggaagggggaggggaggguu

SEQ ID NO: 27617 - RNA, 15 nt, Homo sapiens
gcagugauucacagc

SEQ ID NO: 27618 - RNA, 18 nt, Homo sapiens
gcucaacaguccagcuca

SEQ ID NO: 27619 - RNA, 21 nt, Homo sapiens
gggacuggcuguggggaggag

SEQ ID NO: 27620 - RNA, 20 nt, Homo sapiens
uaaagaagagaagagagaca

SEQ ID NO: 27621 - RNA, 19 nt, Homo sapiens
uaggacaguaggaaucagg

SEQ ID NO: 27622 - RNA, 19 nt, Homo sapiens
uggcuguggggaggagaac

SEQ ID NO: 27623 - RNA, 18 nt, Homo sapiens
ugggaaacucgaggucuu

SEQ ID NO: 27624 - RNA, 19 nt, Homo sapiens
uggggaggagaaccugggg

SEQ ID NO: 27625 - RNA, 18 nt, Homo sapiens
uugguuucuuuuccuccu

SEQ ID NO: 27626 - RNA, 18 nt, Homo sapiens
aaguguccgggcccccag

SEQ ID NO: 27627 - RNA, 18 nt, Homo sapiens
uggcauuuguccagaugc

SEQ ID NO: 27628 - RNA, 20 nt, Homo sapiens
cagugucuccuccacgcgcg

SEQ ID NO: 27629 - RNA, 15 nt, Homo sapiens
acacagccacgggga

SEQ ID NO: 27630 - RNA, 20 nt, Homo sapiens
aguggugguaacggggggcc

SEQ ID NO: 27631 - RNA, 20 nt, Homo sapiens
cacaaugggcaggcgccaca

SEQ ID NO: 27632 - RNA, 17 nt, Homo sapiens
cagcauagagcaggguu

SEQ ID NO: 27633 - RNA, 19 nt, Homo sapiens
cagggcgggaggcgccgcc

SEQ ID NO: 27634 - RNA, 17 nt, Homo sapiens
ccaggagggauuuggag

SEQ ID NO: 27635 - RNA, 20 nt, Homo sapiens
cccggcacacagccacgggg

SEQ ID NO: 27636 - RNA, 17 nt, Homo sapiens
cuucccauugucuccac

SEQ ID NO: 27637 - RNA, 18 nt, Homo sapiens
gacagggagggggucugc

SEQ ID NO: 27638 - RNA, 19 nt, Homo sapiens
gagcaggguugcagacugg

SEQ ID NO: 27639 - RNA, 17 nt, Homo sapiens
ggauuuggaggaggcug

SEQ ID NO: 27640 - RNA, 20 nt, Homo sapiens
guggcuucauggcagccaca

SEQ ID NO: 27641 - RNA, 24 nt, Homo sapiens
ucagugaauuaaugaguuuggggc

SEQ ID NO: 27642 - RNA, 22 nt, Homo sapiens
uccacgcucggggcuaccuugg

SEQ ID NO: 27643 - RNA, 16 nt, Homo sapiens
ucugggcacccugacc

SEQ ID NO: 27644 - RNA, 20 nt, Homo sapiens
ucugggcacccugacccuug

SEQ ID NO: 27645 - RNA, 19 nt, Homo sapiens
uucaaggaggcuucugggu

SEQ ID NO: 27646 - RNA, 20 nt, Homo sapiens
aggcgucgggggcugcggcc

SEQ ID NO: 27647 - RNA, 17 nt, Homo sapiens
ccccagcucccuccccc

SEQ ID NO: 27648 - RNA, 21 nt, Homo sapiens
ccccagcucccucccccuccc

SEQ ID NO: 27649 - RNA, 18 nt, Homo sapiens
ccgcccgcgcuccucccg

SEQ ID NO: 27650 - RNA, 15 nt, Homo sapiens
ccgcccggcggcccc

SEQ ID NO: 27651 - RNA, 18 nt, Homo sapiens
ccucggcccgcgcggcgc

SEQ ID NO: 27652 - RNA, 20 nt, Homo sapiens
cggcggcggcggcgcuggcc

SEQ ID NO: 27653 - RNA, 17 nt, Homo sapiens
gcccggcggcccccgcc

SEQ ID NO: 27654 - RNA, 17 nt, Homo sapiens
gcggcggcggacggugc

SEQ ID NO: 27655 - RNA, 18 nt, Homo sapiens
gcuugcucgcuccgggau

SEQ ID NO: 27656 - RNA, 21 nt, Homo sapiens
ggagaggagggggcuaagggc

SEQ ID NO: 27657 - RNA, 18 nt, Homo sapiens
ggcaggcaggcgcaccca

SEQ ID NO: 27658 - RNA, 17 nt, Homo sapiens
ggcuguugcugcccggc

SEQ ID NO: 27659 - RNA, 21 nt, Homo sapiens
ggcuuccagggaaggggcgcc

SEQ ID NO: 27660 - RNA, 18 nt, Homo sapiens
gggcuggcggagcuggag

SEQ ID NO: 27661 - RNA, 19 nt, Homo sapiens
uccaaauuuuuuuucuuuu

SEQ ID NO: 27662 - RNA, 19 nt, Homo sapiens
ucgcucgcuugcucgcucc

SEQ ID NO: 27663 - RNA, 16 nt, Homo sapiens
ugcaaucgcugcugca

SEQ ID NO: 27664 - RNA, 15 nt, Homo sapiens
ugcgagaggcggcgg

SEQ ID NO: 27665 - RNA, 24 nt, Homo sapiens
ugcgggaagggcaaucaagacuaa

SEQ ID NO: 27666 - RNA, 22 nt, Homo sapiens
uuuuucuuuuuuucauucuuuu

SEQ ID NO: 27667 - RNA, 19 nt, Homo sapiens
aagaggcuguguugccaca

SEQ ID NO: 27668 - RNA, 20 nt, Homo sapiens
cagugguguagcaggaggac

SEQ ID NO: 27669 - RNA, 20 nt, Homo sapiens
uaccuguuguggugccauca

SEQ ID NO: 27670 - RNA, 18 nt, Homo sapiens
ugcuuugaccuccugccu

SEQ ID NO: 27671 - RNA, 21 nt, Homo sapiens
uggaagccauauguaagaggc

SEQ ID NO: 27672 - RNA, 19 nt, Homo sapiens
agaugaaauacaggacacc

SEQ ID NO: 27673 - RNA, 23 nt, Homo sapiens
caggagaauggcgucaacccagg

SEQ ID NO: 27674 - RNA, 18 nt, Homo sapiens
cauacuuaaccuuauaga

SEQ ID NO: 27675 - RNA, 21 nt, Homo sapiens
ccuauuccuugaccaaagcac

SEQ ID NO: 27676 - RNA, 21 nt, Homo sapiens
gcagugagccgagaucgugcc

SEQ ID NO: 27677 - RNA, 21 nt, Homo sapiens
gcgugaacccgggaggcggag

SEQ ID NO: 27678 - RNA, 23 nt, Homo sapiens
gggcgugagcaagcugagcugug

SEQ ID NO: 27679 - RNA, 22 nt, Homo sapiens
gggugugguggcgagcuccugu

SEQ ID NO: 27680 - RNA, 20 nt, Homo sapiens
guggaucaccaggucaggag

SEQ ID NO: 27681 - RNA, 21 nt, Homo sapiens
uagauuuauuucauuuaucua

SEQ ID NO: 27682 - RNA, 21 nt, Homo sapiens
uauagaacauucccccuggcu

SEQ ID NO: 27683 - RNA, 21 nt, Homo sapiens
ugagucgagaucgcgccacug

SEQ ID NO: 27684 - RNA, 16 nt, Homo sapiens
uuccuuguccuuaaca

SEQ ID NO: 27685 - RNA, 18 nt, Homo sapiens
uuccuuguccuuaacaua

SEQ ID NO: 27686 - RNA, 17 nt, Homo sapiens
uugggaggccgaggugg

SEQ ID NO: 27687 - RNA, 21 nt, Homo sapiens
ccgccgccagggccgggucca

SEQ ID NO: 27688 - RNA, 20 nt, Homo sapiens
gauacuucagcaggguccug

SEQ ID NO: 27689 - RNA, 18 nt, Homo sapiens
gcggggcguagggguggg

SEQ ID NO: 27690 - RNA, 22 nt, Homo sapiens
ggggcguaggggugggucagug

SEQ ID NO: 27691 - RNA, 18 nt, Homo sapiens
ugaggacgcuguucuggg

SEQ ID NO: 27692 - RNA, 22 nt, Homo sapiens
ccuccgagccgcggaggcaggg

SEQ ID NO: 27693 - RNA, 19 nt, Homo sapiens
ucucaaaguccugaaguuu

SEQ ID NO: 27694 - RNA, 19 nt, Homo sapiens
aaugcaaaugucugucaau

SEQ ID NO: 27695 - RNA, 21 nt, Homo sapiens
accccuugagugugugugggg

SEQ ID NO: 27696 - RNA, 18 nt, Homo sapiens
agcaagagugacgguacc

SEQ ID NO: 27697 - RNA, 21 nt, Homo sapiens
aggaagggacgaggucuucuc

SEQ ID NO: 27698 - RNA, 18 nt, Homo sapiens
caggagcugcucagacag

SEQ ID NO: 27699 - RNA, 19 nt, Homo sapiens
cugcacugccgggggccgg

SEQ ID NO: 27700 - RNA, 17 nt, Homo sapiens
gcaguucccaccggagc

SEQ ID NO: 27701 - RNA, 15 nt, Homo sapiens
ggaaacaaaacacug

SEQ ID NO: 27702 - RNA, 16 nt, Homo sapiens
ucuguggaugcaccag

SEQ ID NO: 27703 - RNA, 20 nt, Homo sapiens
uuaaaauaguuauuuuaagu

SEQ ID NO: 27704 - RNA, 16 nt, Homo sapiens
cauuucucuccuugca

SEQ ID NO: 27705 - RNA, 18 nt, Homo sapiens
gacuggagcccauguaug

SEQ ID NO: 27706 - RNA, 15 nt, Homo sapiens
guccaguaugauugg

SEQ ID NO: 27707 - RNA, 23 nt, Homo sapiens
uaaaaaaauacccaacuuaacau

SEQ ID NO: 27708 - RNA, 21 nt, Homo sapiens
ugauugguuggugucaaaugu

SEQ ID NO: 27709 - RNA, 21 nt, Homo sapiens
ugguuggugucaaauguuguc

SEQ ID NO: 27710 - RNA, 22 nt, Homo sapiens
aagcauuagauguguuuaaaaa

SEQ ID NO: 27711 - RNA, 20 nt, Homo sapiens
agagaaaacggguaaaacag

SEQ ID NO: 27712 - RNA, 19 nt, Homo sapiens
caaccuuggucugcucuuc

SEQ ID NO: 27713 - RNA, 17 nt, Homo sapiens
caacaugacaccaacac

SEQ ID NO: 27714 - RNA, 15 nt, Homo sapiens
cccgccgcugccgcc

SEQ ID NO: 27715 - RNA, 22 nt, Homo sapiens
ccgccgccgcucuucggccgga

SEQ ID NO: 27716 - RNA, 15 nt, Homo sapiens
ucccgccgcugccgc

SEQ ID NO: 27717 - RNA, 26 nt, Homo sapiens
uuaauaaaauuucucaaacuauauca

SEQ ID NO: 27718 - RNA, 17 nt, Homo sapiens
uuuugccucaaacuauu

SEQ ID NO: 27719 - RNA, 25 nt, Homo sapiens
aguuccaguggugugcacuuaggau

SEQ ID NO: 27720 - RNA, 21 nt, Homo sapiens
uccugaggcugcuuucuaaca

SEQ ID NO: 27721 - RNA, 17 nt, Homo sapiens
uuuaaaggauacugcaa

SEQ ID NO: 27722 - RNA, 16 nt, Homo sapiens
acugagucugucaguu

SEQ ID NO: 27723 - RNA, 18 nt, Homo sapiens
cacaguagggagagaaca

SEQ ID NO: 27724 - RNA, 21 nt, Homo sapiens
ccgcccccuccugccugacuc

SEQ ID NO: 27725 - RNA, 20 nt, Homo sapiens
cgggagcuccggggucugcg

SEQ ID NO: 27726 - RNA, 19 nt, Homo sapiens
gagguaaggcuaaaauagg

SEQ ID NO: 27727 - RNA, 22 nt, Homo sapiens
uagcacaaaucaccaucaauau

SEQ ID NO: 27728 - RNA, 18 nt, Homo sapiens
uccccgcccccuccugcc

SEQ ID NO: 27729 - RNA, 20 nt, Homo sapiens
ugccucgggagcuccggggu

SEQ ID NO: 27730 - RNA, 15 nt, Homo sapiens
uggaguagacagaua

SEQ ID NO: 27731 - RNA, 18 nt, Homo sapiens
uuuguguuuacugcccug

SEQ ID NO: 27732 - RNA, 19 nt, Homo sapiens
ccgcuccgcguucccaacc

SEQ ID NO: 27733 - RNA, 15 nt, Homo sapiens
gcucgccgcgguccc

SEQ ID NO: 27734 - RNA, 19 nt, Homo sapiens
uccgugcugcucgccgcgg

SEQ ID NO: 27735 - RNA, 19 nt, Homo sapiens
aggucccgcgcacgccgcc

SEQ ID NO: 27736 - RNA, 19 nt, Homo sapiens
auauauauauauauauaua

SEQ ID NO: 27737 - RNA, 20 nt, Homo sapiens
auauauauauauauauauau

SEQ ID NO: 27738 - RNA, 15 nt, Homo sapiens
cccgccgcgcccgcc

SEQ ID NO: 27739 - RNA, 18 nt, Homo sapiens
ccgccgcggagcuccggc

SEQ ID NO: 27740 - RNA, 18 nt, Homo sapiens
cucgacgaucgcugcccc

SEQ ID NO: 27741 - RNA, 18 nt, Homo sapiens
gaucucuuuuuucuugga

SEQ ID NO: 27742 - RNA, 16 nt, Homo sapiens
gccgcagucccgccgc

SEQ ID NO: 27743 - RNA, 19 nt, Homo sapiens
gggaaggcagccuggaaac

SEQ ID NO: 27744 - RNA, 21 nt, Homo sapiens
gggggagcggggccgcucccg

SEQ ID NO: 27745 - RNA, 25 nt, Homo sapiens
uaaaauauauauauauauauauaua

SEQ ID NO: 27746 - RNA, 19 nt, Homo sapiens
uauauauauauauauauau

SEQ ID NO: 27747 - RNA, 21 nt, Homo sapiens
ugugagaaauuugauuccaua

SEQ ID NO: 27748 - RNA, 22 nt, Homo sapiens
uucauaagcaaucagagagggg

SEQ ID NO: 27749 - RNA, 21 nt, Homo sapiens
uuucuccaccugauucagcuu

SEQ ID NO: 27750 - RNA, 24 nt, Homo sapiens
ugcuguugguaggaugccuuaggc

SEQ ID NO: 27751 - RNA, 22 nt, Homo sapiens
aagcggacggcgcugcuggugg

SEQ ID NO: 27752 - RNA, 17 nt, Homo sapiens
cgugugugcgugcccgc

SEQ ID NO: 27753 - RNA, 21 nt, Homo sapiens
ggacucgagcugccgcggcgg

SEQ ID NO: 27754 - RNA, 16 nt, Homo sapiens
ggaggcgugcuuccgg

SEQ ID NO: 27755 - RNA, 20 nt, Homo sapiens
uccugugccuucuggagucu

SEQ ID NO: 27756 - RNA, 20 nt, Homo sapiens
aggagggaaugaggggcuug

SEQ ID NO: 27757 - RNA, 18 nt, Homo sapiens
agggcgcagaccguggcc

SEQ ID NO: 27758 - RNA, 19 nt, Homo sapiens
cacuggaugggagcagggg

SEQ ID NO: 27759 - RNA, 20 nt, Homo sapiens
ccagggcgcagaccguggcc

SEQ ID NO: 27760 - RNA, 21 nt, Homo sapiens
cgcgguugggaacgugcggcg

SEQ ID NO: 27761 - RNA, 21 nt, Homo sapiens
ugccagccuccccacccuauc

SEQ ID NO: 27762 - RNA, 22 nt, Homo sapiens
uggggucuuuggcucccggggg

SEQ ID NO: 27763 - RNA, 19 nt, Homo sapiens
ccuugggaacugcgggaga

SEQ ID NO: 27764 - RNA, 21 nt, Homo sapiens
cgggagaggugguucuugugu

SEQ ID NO: 27765 - RNA, 17 nt, Homo sapiens
acccugcucuggguacc

SEQ ID NO: 27766 - RNA, 23 nt, Homo sapiens
acuccagccccuccaggggucuc

SEQ ID NO: 27767 - RNA, 18 nt, Homo sapiens
ccgugcccggguggccca

SEQ ID NO: 27768 - RNA, 23 nt, Homo sapiens
cggcacaguuggguccgugaaga

SEQ ID NO: 27769 - RNA, 19 nt, Homo sapiens
ggagcguggccgugcccgg

SEQ ID NO: 27770 - RNA, 19 nt, Homo sapiens
ucagggagguuguggaguc

SEQ ID NO: 27771 - RNA, 19 nt, Homo sapiens
ugucacgugacccgggagc

SEQ ID NO: 27772 - RNA, 20 nt, Homo sapiens
aacaacacacacuggggcuu

SEQ ID NO: 27773 - RNA, 18 nt, Homo sapiens
aggagaacugagucucca

SEQ ID NO: 27774 - RNA, 19 nt, Homo sapiens
cagagcaguauacacacuc

SEQ ID NO: 27775 - RNA, 22 nt, Homo sapiens
ccuguauggaaauggaugccug

SEQ ID NO: 27776 - RNA, 18 nt, Homo sapiens
cuggcugggguucaguga

SEQ ID NO: 27777 - RNA, 18 nt, Homo sapiens
gggcuggcugggguucag

SEQ ID NO: 27778 - RNA, 15 nt, Homo sapiens
guaacaaagcugcag

SEQ ID NO: 27779 - RNA, 18 nt, Homo sapiens
guuugugugugugugugu

SEQ ID NO: 27780 - RNA, 25 nt, Homo sapiens
uaugcaaguuugugugugugugugu

SEQ ID NO: 27781 - RNA, 20 nt, Homo sapiens
ucuugagcaaagggaagaag

SEQ ID NO: 27782 - RNA, 23 nt, Homo sapiens
ugcugacaguuuucuuucaccuc

SEQ ID NO: 27783 - RNA, 17 nt, Homo sapiens
ugguccgggcaagguuu

SEQ ID NO: 27784 - RNA, 17 nt, Homo sapiens
uugucugacuucuguuu

SEQ ID NO: 27785 - RNA, 19 nt, Homo sapiens
ccaugccagcggccccucc

SEQ ID NO: 27786 - RNA, 18 nt, Homo sapiens
cuuggugucaggauuucu

SEQ ID NO: 27787 - RNA, 19 nt, Homo sapiens
ggacccauggccaagggcg

SEQ ID NO: 27788 - RNA, 17 nt, Homo sapiens
ggagggagguccugguc

SEQ ID NO: 27789 - RNA, 19 nt, Homo sapiens
gucaugucuugucccucug

SEQ ID NO: 27790 - RNA, 19 nt, Homo sapiens
ugaggaucugcuuugugcu

SEQ ID NO: 27791 - RNA, 21 nt, Homo sapiens
aggaaguggcaugcugguaag

SEQ ID NO: 27792 - RNA, 16 nt, Homo sapiens
auuucauauagcagag

SEQ ID NO: 27793 - RNA, 15 nt, Homo sapiens
uacaugacagccucc

SEQ ID NO: 27794 - RNA, 19 nt, Homo sapiens
ucagcggguaauaugucau

SEQ ID NO: 27795 - RNA, 17 nt, Homo sapiens
ccaggcccccuuccugg

SEQ ID NO: 27796 - RNA, 16 nt, Homo sapiens
ggccaggaaauccgag

SEQ ID NO: 27797 - RNA, 21 nt, Homo sapiens
ggucugcaaaggggucgcggc

SEQ ID NO: 27798 - RNA, 15 nt, Homo sapiens
ugccuguguggggcc

SEQ ID NO: 27799 - RNA, 18 nt, Homo sapiens
gcccucggugcauggcag

SEQ ID NO: 27800 - RNA, 18 nt, Homo sapiens
caucuuugagucagguga

SEQ ID NO: 27801 - RNA, 20 nt, Homo sapiens
gagucuccuucugcugagug

SEQ ID NO: 27802 - RNA, 19 nt, Homo sapiens
uuguugagaagucuguugc

SEQ ID NO: 27803 - RNA, 21 nt, Homo sapiens
gagguugcagugagcccagau

SEQ ID NO: 27804 - RNA, 15 nt, Homo sapiens
uccuccggggccguc

SEQ ID NO: 27805 - RNA, 20 nt, Homo sapiens
caggagaauggugcgaaccc

SEQ ID NO: 27806 - RNA, 23 nt, Homo sapiens
cccggggagggcagagcuugcag

SEQ ID NO: 27807 - RNA, 20 nt, Homo sapiens
ccgggguuuucgcgcuugga

SEQ ID NO: 27808 - RNA, 22 nt, Homo sapiens
ugagcuacauauucaagucaaa

SEQ ID NO: 27809 - RNA, 23 nt, Homo sapiens
ugccuguaaucccagcacuuugg

SEQ ID NO: 27810 - RNA, 17 nt, Homo sapiens
uugggaggccgaggugg

SEQ ID NO: 27811 - RNA, 23 nt, Homo sapiens
aggggucgcggccgccccucggg

SEQ ID NO: 27812 - RNA, 18 nt, Homo sapiens
ucggcuucuugcuccauc

SEQ ID NO: 27813 - RNA, 20 nt, Homo sapiens
aagacuguugguuugggaaa

SEQ ID NO: 27814 - RNA, 20 nt, Homo sapiens
agauggaucuucucggaggu

SEQ ID NO: 27815 - RNA, 18 nt, Homo sapiens
cccgggcuggacgcacgg

SEQ ID NO: 27816 - RNA, 25 nt, Homo sapiens
ccgccuguccacccucccauuucug

SEQ ID NO: 27817 - RNA, 16 nt, Homo sapiens
ccgggggagcggugga

SEQ ID NO: 27818 - RNA, 21 nt, Homo sapiens
cgcgagggucuggcugggucg

SEQ ID NO: 27819 - RNA, 18 nt, Homo sapiens
cggggcuggcgagcagcc

SEQ ID NO: 27820 - RNA, 17 nt, Homo sapiens
gcgaccucgcccagccc

SEQ ID NO: 27821 - RNA, 14 nt, Homo sapiens
gcgcggggggcugc

SEQ ID NO: 27822 - RNA, 20 nt, Homo sapiens
ggcugaacucgugaagccac

SEQ ID NO: 27823 - RNA, 20 nt, Homo sapiens
gggaggauugcuugagccca

SEQ ID NO: 27824 - RNA, 15 nt, Homo sapiens
gggaggcuccggggg

SEQ ID NO: 27825 - RNA, 18 nt, Homo sapiens
gggguggugguggcaggu

SEQ ID NO: 27826 - RNA, 19 nt, Homo sapiens
ggugcaggcggggugcgcg

SEQ ID NO: 27827 - RNA, 22 nt, Homo sapiens
guucaugcuuguaauucuaaca

SEQ ID NO: 27828 - RNA, 17 nt, Homo sapiens
uagcugggugugguggu

SEQ ID NO: 27829 - RNA, 15 nt, Homo sapiens
uaugaucgcaccagu

SEQ ID NO: 27830 - RNA, 20 nt, Homo sapiens
uauuuacgccuuuccauugg

SEQ ID NO: 27831 - RNA, 17 nt, Homo sapiens
ugaaacgggauauuguc

SEQ ID NO: 27832 - RNA, 14 nt, Homo sapiens
ugccugggaggcuc

SEQ ID NO: 27833 - RNA, 23 nt, Homo sapiens
ugcuuguaauucuaacacuuugg

SEQ ID NO: 27834 - RNA, 15 nt, Homo sapiens
uggcaccaccgugcc

SEQ ID NO: 27835 - RNA, 19 nt, Homo sapiens
ugguuugggaaacggugug

SEQ ID NO: 27836 - RNA, 17 nt, Homo sapiens
uugggaggccgaggcgg

SEQ ID NO: 27837 - RNA, 17 nt, Homo sapiens
uugggaggcuaaggcgg

SEQ ID NO: 27838 - RNA, 21 nt, Homo sapiens
aauauuuucucuuuucuugcu

SEQ ID NO: 27839 - RNA, 15 nt, Homo sapiens
gacaggcgcgacauu

SEQ ID NO: 27840 - RNA, 20 nt, Homo sapiens
ggagggggcaccccagcggg

SEQ ID NO: 27841 - RNA, 17 nt, Homo sapiens
ucccugguccugcgugg

SEQ ID NO: 27842 - RNA, 14 nt, Homo sapiens
ugcuccuugguucu

SEQ ID NO: 27843 - RNA, 25 nt, Homo sapiens
uucucuuuucuugcucuuccauaca

SEQ ID NO: 27844 - RNA, 20 nt, Homo sapiens
aggggggcgggcggggcggg

SEQ ID NO: 27845 - RNA, 15 nt, Homo sapiens
cccgccgccgccgcc

SEQ ID NO: 27846 - RNA, 18 nt, Homo sapiens
gcccgcccgcagggaccc

SEQ ID NO: 27847 - RNA, 21 nt, Homo sapiens
gcccgcccgcccgcagggacc

SEQ ID NO: 27848 - RNA, 21 nt, Homo sapiens
gcuggcguccggguccccggc

SEQ ID NO: 27849 - RNA, 19 nt, Homo sapiens
ggaaauuccaguggcaccc

SEQ ID NO: 27850 - RNA, 22 nt, Homo sapiens
ggcacuugcagguccgggggcc

SEQ ID NO: 27851 - RNA, 19 nt, Homo sapiens
ggcguccggguccccggcc

SEQ ID NO: 27852 - RNA, 23 nt, Homo sapiens
gggcggggcggggggccuucggg

SEQ ID NO: 27853 - RNA, 16 nt, Homo sapiens
ggggcgggcggggcgg

SEQ ID NO: 27854 - RNA, 20 nt, Homo sapiens
ggggcgggcggggcgggggg

SEQ ID NO: 27855 - RNA, 20 nt, Homo sapiens
ccgccgccugcgccgccgcc

SEQ ID NO: 27856 - RNA, 17 nt, Homo sapiens
ccgccugcgccgccgcc

SEQ ID NO: 27857 - RNA, 16 nt, Homo sapiens
cgccgccugcgccgcc

SEQ ID NO: 27858 - RNA, 17 nt, Homo sapiens
gaguaacggcacggcgu

SEQ ID NO: 27859 - RNA, 18 nt, Homo sapiens
gcaagagguaaguaaaag

SEQ ID NO: 27860 - RNA, 23 nt, Homo sapiens
ggagcgaggguggcugcaccagc

SEQ ID NO: 27861 - RNA, 18 nt, Homo sapiens
guguguguggacagaagg

SEQ ID NO: 27862 - RNA, 22 nt, Homo sapiens
uauccuucacccauuuuucugc

SEQ ID NO: 27863 - RNA, 21 nt, Homo sapiens
ucuagaggggggaaaaaggag

SEQ ID NO: 27864 - RNA, 18 nt, Homo sapiens
uguguagcuugaucuuua

SEQ ID NO: 27865 - RNA, 22 nt, Homo sapiens
uucuucuagaggggggaaaaag

SEQ ID NO: 27866 - RNA, 22 nt, Homo sapiens
ggcauacggagcagagcuggag

SEQ ID NO: 27867 - RNA, 18 nt, Homo sapiens
agcuaagaguggccccug

SEQ ID NO: 27868 - RNA, 19 nt, Homo sapiens
agcuuugcaguuuucccug

SEQ ID NO: 27869 - RNA, 16 nt, Homo sapiens
caccucaggcuacccc

SEQ ID NO: 27870 - RNA, 18 nt, Homo sapiens
ccgaccgccagggagccg

SEQ ID NO: 27871 - RNA, 18 nt, Homo sapiens
ccgaucgccgagcuaggu

SEQ ID NO: 27872 - RNA, 18 nt, Homo sapiens
ccgcccgcucgcccgacc

SEQ ID NO: 27873 - RNA, 19 nt, Homo sapiens
ccgucggggggcgcucgga

SEQ ID NO: 27874 - RNA, 18 nt, Homo sapiens
gagccgggagcagcugcu

SEQ ID NO: 27875 - RNA, 18 nt, Homo sapiens
gcacaguuuuuuccccau

SEQ ID NO: 27876 - RNA, 19 nt, Homo sapiens
gcccgcucgcccgaccgcc

SEQ ID NO: 27877 - RNA, 16 nt, Homo sapiens
ggcggcggagccgcgg

SEQ ID NO: 27878 - RNA, 19 nt, Homo sapiens
gggcuggcuggggcgcggc

SEQ ID NO: 27879 - RNA, 20 nt, Homo sapiens
ggguuugugggggaaaaaau

SEQ ID NO: 27880 - RNA, 25 nt, Homo sapiens
guuacaaaaaaaauuuuaaugaaaa

SEQ ID NO: 27881 - RNA, 20 nt, Homo sapiens
uaagaguggccccugcccuu

SEQ ID NO: 27882 - RNA, 22 nt, Homo sapiens
ugccggguaaaagacauauaca

SEQ ID NO: 27883 - RNA, 18 nt, Homo sapiens
uggcgggaggccggcugg

SEQ ID NO: 27884 - RNA, 18 nt, Homo sapiens
uuaucuaagcuccuugcu

SEQ ID NO: 27885 - RNA, 20 nt, Homo sapiens
uuuaggagaagaaaaaauga

SEQ ID NO: 27886 - RNA, 17 nt, Homo sapiens
gcagcagcugccaggcc

SEQ ID NO: 27887 - RNA, 22 nt, Homo sapiens
uccaaaaaaaaaaaaaaaugcu

SEQ ID NO: 27888 - RNA, 21 nt, Homo sapiens
gacuguccggugcagagaggg

SEQ ID NO: 27889 - RNA, 20 nt, Homo sapiens
uacuacugguccccuccucc

SEQ ID NO: 27890 - RNA, 20 nt, Homo sapiens
ucugaauaccuguucugccc

SEQ ID NO: 27891 - RNA, 17 nt, Homo sapiens
ugcagugcccuuagcag

SEQ ID NO: 27892 - RNA, 15 nt, Homo sapiens
aaggacgcccaugga

SEQ ID NO: 27893 - RNA, 18 nt, Homo sapiens
agucccuugguccgcagu

SEQ ID NO: 27894 - RNA, 21 nt, Homo sapiens
aguguguugugccacgccacc

SEQ ID NO: 27895 - RNA, 14 nt, Homo sapiens
cccuugguccgcag

SEQ ID NO: 27896 - RNA, 18 nt, Homo sapiens
cugcugaauccugagaga

SEQ ID NO: 27897 - RNA, 19 nt, Homo sapiens
gcccauggaggggaggccc

SEQ ID NO: 27898 - RNA, 19 nt, Homo sapiens
gcuuccugacucuacccau

SEQ ID NO: 27899 - RNA, 22 nt, Homo sapiens
ggaggcggcggcagggcaagag

SEQ ID NO: 27900 - RNA, 21 nt, Homo sapiens
ggccaggcccaagacucucca

SEQ ID NO: 27901 - RNA, 16 nt, Homo sapiens
ugagacccgggaggcg

SEQ ID NO: 27902 - RNA, 15 nt, Homo sapiens
gggccuauggguggg

SEQ ID NO: 27903 - RNA, 18 nt, Homo sapiens
gggugaccaugguccacu

SEQ ID NO: 27904 - RNA, 16 nt, Homo sapiens
cagcuggcaccauccc

SEQ ID NO: 27905 - RNA, 18 nt, Homo sapiens
ggcuuucugcuucugcag

SEQ ID NO: 27906 - RNA, 17 nt, Homo sapiens
uguuuuugcuuucccca

SEQ ID NO: 27907 - RNA, 15 nt, Homo sapiens
uuuugcuuuccccag

SEQ ID NO: 27908 - RNA, 19 nt, Homo sapiens
auauauauauaaauauaua

SEQ ID NO: 27909 - RNA, 23 nt, Homo sapiens
auauauauauauauauauauauu

SEQ ID NO: 27910 - RNA, 16 nt, Homo sapiens
cauuucaccagagcuc

SEQ ID NO: 27911 - RNA, 21 nt, Homo sapiens
ggaggccagcagggcggggga

SEQ ID NO: 27912 - RNA, 20 nt, Homo sapiens
ugccugacguuucacagacc

SEQ ID NO: 27913 - RNA, 19 nt, Homo sapiens
guuaaaguuuucgaaguuc

SEQ ID NO: 27914 - RNA, 21 nt, Homo sapiens
ucuaaaauuuucuuuucucua

SEQ ID NO: 27915 - RNA, 22 nt, Homo sapiens
ucucugcugcuuguguguucuc

SEQ ID NO: 27916 - RNA, 17 nt, Homo sapiens
ugguucauucuaucuau

SEQ ID NO: 27917 - RNA, 17 nt, Homo sapiens
guuaacagcauuaaaaa

SEQ ID NO: 27918 - RNA, 16 nt, Homo sapiens
aaaacaaaauccugau

SEQ ID NO: 27919 - RNA, 20 nt, Homo sapiens
aacacccaguguccuauauu

SEQ ID NO: 27920 - RNA, 18 nt, Homo sapiens
agagggagaaggaacaag

SEQ ID NO: 27921 - RNA, 15 nt, Homo sapiens
aggaggaggaggaag

SEQ ID NO: 27922 - RNA, 18 nt, Homo sapiens
ggaagggcagcagcagga

SEQ ID NO: 27923 - RNA, 25 nt, Homo sapiens
uagaguuuguauauagaggccacac

SEQ ID NO: 27924 - RNA, 19 nt, Homo sapiens
ugaggaggaggaggaaggg

SEQ ID NO: 27925 - RNA, 19 nt, Homo sapiens
uguuaacaguuuugauguu

SEQ ID NO: 27926 - RNA, 19 nt, Homo sapiens
uucuuuuucuuucucucca

SEQ ID NO: 27927 - RNA, 24 nt, Homo sapiens
uuugaacaaucaacaggaaaagua

SEQ ID NO: 27928 - RNA, 23 nt, Homo sapiens
aaauggguaaaaggucuuaucua

SEQ ID NO: 27929 - RNA, 17 nt, Homo sapiens
aauaccaaguccugguc

SEQ ID NO: 27930 - RNA, 20 nt, Homo sapiens
agauuugggaaacagugcuu

SEQ ID NO: 27931 - RNA, 20 nt, Homo sapiens
cuguuaguagaguuacuugc

SEQ ID NO: 27932 - RNA, 18 nt, Homo sapiens
gccacgcacagggugagc

SEQ ID NO: 27933 - RNA, 22 nt, Homo sapiens
gcgugaacccugggaaccccgg

SEQ ID NO: 27934 - RNA, 15 nt, Homo sapiens
ggcagauucagugcc

SEQ ID NO: 27935 - RNA, 19 nt, Homo sapiens
ucauaaauucaaaagcuau

SEQ ID NO: 27936 - RNA, 25 nt, Homo sapiens
ugaaagaacauuuaaauaggauuaa

SEQ ID NO: 27937 - RNA, 22 nt, Homo sapiens
ugaaagcugauuucauaauagc

SEQ ID NO: 27938 - RNA, 19 nt, Homo sapiens
ugcaaagaucauuuguaaa

SEQ ID NO: 27939 - RNA, 18 nt, Homo sapiens
uuagccagguguaguggc

SEQ ID NO: 27940 - RNA, 20 nt, Homo sapiens
caucgcuuccuagcagcccg

SEQ ID NO: 27941 - RNA, 20 nt, Homo sapiens
gcccaggggucauccugggu

SEQ ID NO: 27942 - RNA, 18 nt, Homo sapiens
gcuuccuagcagcccggg

SEQ ID NO: 27943 - RNA, 22 nt, Homo sapiens
ggaaagugcagggugggggucc

SEQ ID NO: 27944 - RNA, 16 nt, Homo sapiens
ucucggcucccaggca

SEQ ID NO: 27945 - RNA, 18 nt, Homo sapiens
uuuggggacaggaagggg

SEQ ID NO: 27946 - RNA, 17 nt, Homo sapiens
gguugcuaaauucaaag

SEQ ID NO: 27947 - RNA, 21 nt, Homo sapiens
ugagccaagagaaucuguugu

SEQ ID NO: 27948 - RNA, 22 nt, Homo sapiens
aauugcacaacuuugccacuuu

SEQ ID NO: 27949 - RNA, 17 nt, Homo sapiens
aguuuagaugcuuauag

SEQ ID NO: 27950 - RNA, 18 nt, Homo sapiens
auaggaguuuauauaaug

SEQ ID NO: 27951 - RNA, 17 nt, Homo sapiens
cuuugcuccuuucccag

SEQ ID NO: 27952 - RNA, 17 nt, Homo sapiens
guaauugcacaacuuug

SEQ ID NO: 27953 - RNA, 17 nt, Homo sapiens
ugaaagcuauuguaggg

SEQ ID NO: 27954 - RNA, 20 nt, Homo sapiens
ugaccacagagguuuacaaa

SEQ ID NO: 27955 - RNA, 18 nt, Homo sapiens
ugcacaacuaucccuaua

SEQ ID NO: 27956 - RNA, 22 nt, Homo sapiens
uuaauagaaguuguuuaucagg

SEQ ID NO: 27957 - RNA, 20 nt, Homo sapiens
uuggugaaucaugcacuagu

SEQ ID NO: 27958 - RNA, 18 nt, Homo sapiens
cacaaacacccccaacau

SEQ ID NO: 27959 - RNA, 21 nt, Homo sapiens
gcauugcuacccaccuaaguc

SEQ ID NO: 27960 - RNA, 19 nt, Homo sapiens
aagagucagggcccaucag

SEQ ID NO: 27961 - RNA, 19 nt, Homo sapiens
aaggggaaaguggagccgg

SEQ ID NO: 27962 - RNA, 21 nt, Homo sapiens
ccgguggcaugggggguggug

SEQ ID NO: 27963 - RNA, 17 nt, Homo sapiens
ccugccacagagaccuc

SEQ ID NO: 27964 - RNA, 17 nt, Homo sapiens
gaguggcugccuggggu

SEQ ID NO: 27965 - RNA, 22 nt, Homo sapiens
ugauuaucugggugaauguauu

SEQ ID NO: 27966 - RNA, 19 nt, Homo sapiens
uggcacaugguaugugcuc

SEQ ID NO: 27967 - RNA, 19 nt, Homo sapiens
ugucaagguguguggcaca

SEQ ID NO: 27968 - RNA, 17 nt, Homo sapiens
aggggcagaccuggacc

SEQ ID NO: 27969 - RNA, 14 nt, Homo sapiens
cagcggccagcgcg

SEQ ID NO: 27970 - RNA, 22 nt, Homo sapiens
caucauguuuuuacauggggca

SEQ ID NO: 27971 - RNA, 15 nt, Homo sapiens
ccggaacgggcggaa

SEQ ID NO: 27972 - RNA, 15 nt, Homo sapiens
ugccgcccccucggg

SEQ ID NO: 27973 - RNA, 22 nt, Homo sapiens
uuucucuguucuuccucuuugc

SEQ ID NO: 27974 - RNA, 22 nt, Homo sapiens
cccaagggaggaaaagcuggca

SEQ ID NO: 27975 - RNA, 20 nt, Homo sapiens
ccugaaagggcgacaagccc

SEQ ID NO: 27976 - RNA, 17 nt, Homo sapiens
cgcccuguggcccaggc

SEQ ID NO: 27977 - RNA, 20 nt, Homo sapiens
gagacggagucucgcccugu

SEQ ID NO: 27978 - RNA, 21 nt, Homo sapiens
gagacuacuacaagaaggagu

SEQ ID NO: 27979 - RNA, 21 nt, Homo sapiens
gagugcgugggaugagaaagg

SEQ ID NO: 27980 - RNA, 18 nt, Homo sapiens
uaaaaagccauugaagau

SEQ ID NO: 27981 - RNA, 17 nt, Homo sapiens
uaaauucuuauugcacc

SEQ ID NO: 27982 - RNA, 20 nt, Homo sapiens
ucuccgcaaaggguggagcc

SEQ ID NO: 27983 - RNA, 21 nt, Homo sapiens
ugcggcaauaucagaacccaa

SEQ ID NO: 27984 - RNA, 24 nt, Homo sapiens
uguaagcaccaagaagggaaaggg

SEQ ID NO: 27985 - RNA, 18 nt, Homo sapiens
cguggagcacgggugggg

SEQ ID NO: 27986 - RNA, 18 nt, Homo sapiens
cuggaguggggugugugg

SEQ ID NO: 27987 - RNA, 18 nt, Homo sapiens
gcagcccagcacgggugc

SEQ ID NO: 27988 - RNA, 20 nt, Homo sapiens
ggccaguccccaugcagccc

SEQ ID NO: 27989 - RNA, 17 nt, Homo sapiens
ggcccugccccuccggc

SEQ ID NO: 27990 - RNA, 23 nt, Homo sapiens
ccaagccuuuugaggcugagguc

SEQ ID NO: 27991 - RNA, 17 nt, Homo sapiens
aaggguuagggccugag

SEQ ID NO: 27992 - RNA, 19 nt, Homo sapiens
agacaguaaugaguuacau

SEQ ID NO: 27993 - RNA, 14 nt, Homo sapiens
aggcuccucaaagc

SEQ ID NO: 27994 - RNA, 21 nt, Homo sapiens
aggcugggggcaggggcuggg

SEQ ID NO: 27995 - RNA, 20 nt, Homo sapiens
aggugacgcuggugggcugg

SEQ ID NO: 27996 - RNA, 16 nt, Homo sapiens
cacugggaggcaaggg

SEQ ID NO: 27997 - RNA, 16 nt, Homo sapiens
caggggcugggcgggg

SEQ ID NO: 27998 - RNA, 19 nt, Homo sapiens
cagguccugggauagaggg

SEQ ID NO: 27999 - RNA, 16 nt, Homo sapiens
cauagguggcaugggc

SEQ ID NO: 28000 - RNA, 18 nt, Homo sapiens
cccccggccgccgccgcc

SEQ ID NO: 28001 - RNA, 21 nt, Homo sapiens
ccgccucggccgccucccccg

SEQ ID NO: 28002 - RNA, 17 nt, Homo sapiens
cugggaagcccagggag

SEQ ID NO: 28003 - RNA, 20 nt, Homo sapiens
gaggugggcaaggaacaggg

SEQ ID NO: 28004 - RNA, 20 nt, Homo sapiens
ggagccaaggguuagggccu

SEQ ID NO: 28005 - RNA, 15 nt, Homo sapiens
ggaggugacgcuggu

SEQ ID NO: 28006 - RNA, 22 nt, Homo sapiens
ggaguggggcugacugagcagg

SEQ ID NO: 28007 - RNA, 18 nt, Homo sapiens
ggcugcagaacaggaaaa

SEQ ID NO: 28008 - RNA, 18 nt, Homo sapiens
gggagggaggggcggggg

SEQ ID NO: 28009 - RNA, 20 nt, Homo sapiens
gggcaggggcugggcggggg

SEQ ID NO: 28010 - RNA, 22 nt, Homo sapiens
ggggcaggggcugggcgggggg

SEQ ID NO: 28011 - RNA, 22 nt, Homo sapiens
gggggcaggggcugggcggggg

SEQ ID NO: 28012 - RNA, 17 nt, Homo sapiens
guggaggaggacugggg

SEQ ID NO: 28013 - RNA, 18 nt, Homo sapiens
guuguaguggaggaggac

SEQ ID NO: 28014 - RNA, 18 nt, Homo sapiens
uacugagauaaauaacag

SEQ ID NO: 28015 - RNA, 16 nt, Homo sapiens
uagcccuuaggcacug

SEQ ID NO: 28016 - RNA, 20 nt, Homo sapiens
uggcauagguggcaugggca

SEQ ID NO: 28017 - RNA, 22 nt, Homo sapiens
ugucccaaggugugcgguccag

SEQ ID NO: 28018 - RNA, 19 nt, Homo sapiens
acuccgccccugucccucc

SEQ ID NO: 28019 - RNA, 20 nt, Homo sapiens
agucguugccgaggaacuug

SEQ ID NO: 28020 - RNA, 20 nt, Homo sapiens
guauguugugcggcucuccc

SEQ ID NO: 28021 - RNA, 23 nt, Homo sapiens
uauguugugcggcucucccuggc

SEQ ID NO: 28022 - RNA, 18 nt, Homo sapiens
ugggcucagcguuugugc

SEQ ID NO: 28023 - RNA, 19 nt, Homo sapiens
acccggccgcaucgccccc

SEQ ID NO: 28024 - RNA, 23 nt, Homo sapiens
aggcgcgugcguugccacccggc

SEQ ID NO: 28025 - RNA, 23 nt, Homo sapiens
agggggguguggggaggccggag

SEQ ID NO: 28026 - RNA, 15 nt, Homo sapiens
agggggugggcccca

SEQ ID NO: 28027 - RNA, 18 nt, Homo sapiens
agggguccggaggacucu

SEQ ID NO: 28028 - RNA, 18 nt, Homo sapiens
aggugaaguggcucucug

SEQ ID NO: 28029 - RNA, 22 nt, Homo sapiens
aucggagggggcuggcugcugg

SEQ ID NO: 28030 - RNA, 23 nt, Homo sapiens
cacuggccaagucgauggucucu

SEQ ID NO: 28031 - RNA, 16 nt, Homo sapiens
ccaggagggggcaggc

SEQ ID NO: 28032 - RNA, 19 nt, Homo sapiens
ccauuaaggcagcgacgcc

SEQ ID NO: 28033 - RNA, 21 nt, Homo sapiens
ccgcggcucggcccggccccc

SEQ ID NO: 28034 - RNA, 17 nt, Homo sapiens
ccugcugugggugccag

SEQ ID NO: 28035 - RNA, 22 nt, Homo sapiens
cgggcccaacggacggcggggg

SEQ ID NO: 28036 - RNA, 20 nt, Homo sapiens
cggugcgcucagggaggagc

SEQ ID NO: 28037 - RNA, 15 nt, Homo sapiens
cuccggggauaaaag

SEQ ID NO: 28038 - RNA, 17 nt, Homo sapiens
cuggucccuacagggau

SEQ ID NO: 28039 - RNA, 19 nt, Homo sapiens
gaggggcggggcggggcag

SEQ ID NO: 28040 - RNA, 23 nt, Homo sapiens
gagggggcgacguggggaggggc

SEQ ID NO: 28041 - RNA, 19 nt, Homo sapiens
gcgugcgcgccccgcugac

SEQ ID NO: 28042 - RNA, 19 nt, Homo sapiens
gcguggggcagagaccugc

SEQ ID NO: 28043 - RNA, 18 nt, Homo sapiens
ggaagggcguggucucag

SEQ ID NO: 28044 - RNA, 23 nt, Homo sapiens
ggaggggugucagagggacaaag

SEQ ID NO: 28045 - RNA, 22 nt, Homo sapiens
ggaucgcucuacacucgccccc

SEQ ID NO: 28046 - RNA, 22 nt, Homo sapiens
ggcugugcaggagggggcgacg

SEQ ID NO: 28047 - RNA, 23 nt, Homo sapiens
gggaagggaggggcgcaggaggc

SEQ ID NO: 28048 - RNA, 19 nt, Homo sapiens
gggaagggguggggguugg

SEQ ID NO: 28049 - RNA, 18 nt, Homo sapiens
ggggaggccggaggggcg

SEQ ID NO: 28050 - RNA, 21 nt, Homo sapiens
ggggugggccccagcggaggg

SEQ ID NO: 28051 - RNA, 25 nt, Homo sapiens
ggggugggccccagcggaggggcgg

SEQ ID NO: 28052 - RNA, 22 nt, Homo sapiens
ggggugucagagggacaaagga

SEQ ID NO: 28053 - RNA, 22 nt, Homo sapiens
gggguguggggaggccggaggg

SEQ ID NO: 28054 - RNA, 21 nt, Homo sapiens
ggugacaggaagggccggugc

SEQ ID NO: 28055 - RNA, 25 nt, Homo sapiens
gucucaggcgggcucggcgcgcccc

SEQ ID NO: 28056 - RNA, 20 nt, Homo sapiens
uaaaaaaaaaaaaaaaaaaa

SEQ ID NO: 28057 - RNA, 21 nt, Homo sapiens
ucacaugacguuuuuuuuuuc

SEQ ID NO: 28058 - RNA, 18 nt, Homo sapiens
ucaccucaaacuucauuu

SEQ ID NO: 28059 - RNA, 16 nt, Homo sapiens
ucccggaucaaaggau

SEQ ID NO: 28060 - RNA, 20 nt, Homo sapiens
ucggggaagggguggggguu

SEQ ID NO: 28061 - RNA, 17 nt, Homo sapiens
ucuuuggucauucaguu

SEQ ID NO: 28062 - RNA, 20 nt, Homo sapiens
ugcuccucccauuaaggcag

SEQ ID NO: 28063 - RNA, 21 nt, Homo sapiens
ugucggggaaggggugggggu

SEQ ID NO: 28064 - RNA, 23 nt, Homo sapiens
uugcaagauguuuauuaggaaua

SEQ ID NO: 28065 - RNA, 22 nt, Homo sapiens
aggcagaaggcgagugcccucg

SEQ ID NO: 28066 - RNA, 22 nt, Homo sapiens
aguggcagcuggaguuacaggg

SEQ ID NO: 28067 - RNA, 18 nt, Homo sapiens
cccccagggccugcuuca

SEQ ID NO: 28068 - RNA, 23 nt, Homo sapiens
ccugcuccugugcuccgcucucc

SEQ ID NO: 28069 - RNA, 21 nt, Homo sapiens
cuccuuguggccagaggcugc

SEQ ID NO: 28070 - RNA, 19 nt, Homo sapiens
gcgggggugggagaggggg

SEQ ID NO: 28071 - RNA, 18 nt, Homo sapiens
ggcgguggcuguccccga

SEQ ID NO: 28072 - RNA, 16 nt, Homo sapiens
ggggguggggagggag

SEQ ID NO: 28073 - RNA, 18 nt, Homo sapiens
ucccugucgacugucccu

SEQ ID NO: 28074 - RNA, 19 nt, Homo sapiens
ucccugucgacugucccug

SEQ ID NO: 28075 - RNA, 19 nt, Homo sapiens
uccuuguggccagaggcug

SEQ ID NO: 28076 - RNA, 20 nt, Homo sapiens
uggaagccauugagagcagc

SEQ ID NO: 28077 - RNA, 17 nt, Homo sapiens
ugggagaggggguuacc

SEQ ID NO: 28078 - RNA, 15 nt, Homo sapiens
accucaauuuuauca

SEQ ID NO: 28079 - RNA, 18 nt, Homo sapiens
ccaaccacuguaaauacc

SEQ ID NO: 28080 - RNA, 23 nt, Homo sapiens
uagagacuuucuuuuguggaaaa

SEQ ID NO: 28081 - RNA, 21 nt, Homo sapiens
uaguaagaacugggaaucuca

SEQ ID NO: 28082 - RNA, 16 nt, Homo sapiens
cccggucaagugauuc

SEQ ID NO: 28083 - RNA, 16 nt, Homo sapiens
guaaaucaccccauuc

SEQ ID NO: 28084 - RNA, 19 nt, Homo sapiens
uccagagucacucggggaa

SEQ ID NO: 28085 - RNA, 18 nt, Homo sapiens
ggaaguggcagaggcuga

SEQ ID NO: 28086 - RNA, 17 nt, Homo sapiens
ggucugggaaguggcag

SEQ ID NO: 28087 - RNA, 19 nt, Homo sapiens
cugaagaaaaagaccugag

SEQ ID NO: 28088 - RNA, 18 nt, Homo sapiens
gcgcaaacuccggcucag

SEQ ID NO: 28089 - RNA, 18 nt, Homo sapiens
uacaguggaagaaauacc

SEQ ID NO: 28090 - RNA, 15 nt, Homo sapiens
uuuuacauuucccag

SEQ ID NO: 28091 - RNA, 19 nt, Homo sapiens
uuuuuagccugacguucaa

SEQ ID NO: 28092 - RNA, 24 nt, Homo sapiens
aguaaccauugcucccaggcuaca

SEQ ID NO: 28093 - RNA, 16 nt, Homo sapiens
ccuuccagccuucuuc

SEQ ID NO: 28094 - RNA, 21 nt, Homo sapiens
uccccgacuccuccuguuacc

SEQ ID NO: 28095 - RNA, 22 nt, Homo sapiens
uguagcaacuugguucuccgag

SEQ ID NO: 28096 - RNA, 17 nt, Homo sapiens
caaaauucuuuuggaau

SEQ ID NO: 28097 - RNA, 15 nt, Homo sapiens
uccaaaguaauucag

SEQ ID NO: 28098 - RNA, 17 nt, Homo sapiens
auaaggucgggggcuga

SEQ ID NO: 28099 - RNA, 17 nt, Homo sapiens
ccgugcccuagguuuca

SEQ ID NO: 28100 - RNA, 23 nt, Homo sapiens
cgggcggaucacuugagaccagg

SEQ ID NO: 28101 - RNA, 20 nt, Homo sapiens
gcccaugggaggggggcacu

SEQ ID NO: 28102 - RNA, 17 nt, Homo sapiens
ggaggagccgggcaggg

SEQ ID NO: 28103 - RNA, 23 nt, Homo sapiens
ggccacacgcagcuucggaggcc

SEQ ID NO: 28104 - RNA, 19 nt, Homo sapiens
gggggcacugcgccugccu

SEQ ID NO: 28105 - RNA, 24 nt, Homo sapiens
ucucuucagggaaggguuuuccag

SEQ ID NO: 28106 - RNA, 16 nt, Homo sapiens
uggggaggcagacggc

SEQ ID NO: 28107 - RNA, 17 nt, Homo sapiens
uugggaggccgaggcgg

SEQ ID NO: 28108 - RNA, 19 nt, Homo sapiens
auuauucguuggaagggcg

SEQ ID NO: 28109 - RNA, 17 nt, Homo sapiens
cagagccggcuacagcc

SEQ ID NO: 28110 - RNA, 20 nt, Homo sapiens
cauauucccaaagcaggguu

SEQ ID NO: 28111 - RNA, 22 nt, Homo sapiens
ccuccagccuucuugcuuuccc

SEQ ID NO: 28112 - RNA, 18 nt, Homo sapiens
cugcuuuuuuuccauugu

SEQ ID NO: 28113 - RNA, 18 nt, Homo sapiens
gaaggaacacccaaacca

SEQ ID NO: 28114 - RNA, 16 nt, Homo sapiens
ugcguuauuucacguu

SEQ ID NO: 28115 - RNA, 18 nt, Homo sapiens
uggcaagauacgcuggau

SEQ ID NO: 28116 - RNA, 21 nt, Homo sapiens
cacaccacuuuauuucaaccu

SEQ ID NO: 28117 - RNA, 17 nt, Homo sapiens
aacggaaucaacagaau

SEQ ID NO: 28118 - RNA, 18 nt, Homo sapiens
ccugcuucaaaagggcag

SEQ ID NO: 28119 - RNA, 19 nt, Homo sapiens
gaaacaugauaucuuuuug

SEQ ID NO: 28120 - RNA, 17 nt, Homo sapiens
gcggggugcuggucucg

SEQ ID NO: 28121 - RNA, 18 nt, Homo sapiens
gcgugccgcgagcccggc

SEQ ID NO: 28122 - RNA, 17 nt, Homo sapiens
uaaagcuuguccuugcu

SEQ ID NO: 28123 - RNA, 19 nt, Homo sapiens
uagcacgcgaccacagugg

SEQ ID NO: 28124 - RNA, 22 nt, Homo sapiens
ucaccagacccaucaucacagg

SEQ ID NO: 28125 - RNA, 19 nt, Homo sapiens
ucagagcaggacaacggcc

SEQ ID NO: 28126 - RNA, 15 nt, Homo sapiens
ucagggcgaccuggc

SEQ ID NO: 28127 - RNA, 15 nt, Homo sapiens
ucuggagccaagccc

SEQ ID NO: 28128 - RNA, 18 nt, Homo sapiens
ugagcccaaccugccuca

SEQ ID NO: 28129 - RNA, 18 nt, Homo sapiens
agaaaacucaaacuuuau

SEQ ID NO: 28130 - RNA, 22 nt, Homo sapiens
acaugcuagucaggugcuuuua

SEQ ID NO: 28131 - RNA, 17 nt, Homo sapiens
ccucuguuuuuuuugac

SEQ ID NO: 28132 - RNA, 15 nt, Homo sapiens
cugauaaacaucaac

SEQ ID NO: 28133 - RNA, 18 nt, Homo sapiens
cuuuuuaaaucacacagg

SEQ ID NO: 28134 - RNA, 21 nt, Homo sapiens
ugugcagacacgguuuaucug

SEQ ID NO: 28135 - RNA, 17 nt, Homo sapiens
uuugaccccuuacacau

SEQ ID NO: 28136 - RNA, 18 nt, Homo sapiens
aaggggaaagaccuaggc

SEQ ID NO: 28137 - RNA, 23 nt, Homo sapiens
acuauguacaagugauuuauaaa

SEQ ID NO: 28138 - RNA, 15 nt, Homo sapiens
ggggaaaaaaaugca

SEQ ID NO: 28139 - RNA, 24 nt, Homo sapiens
uauaaaaacauuggcauuaauggu

SEQ ID NO: 28140 - RNA, 19 nt, Homo sapiens
uguggauaaccucugccuc

SEQ ID NO: 28141 - RNA, 15 nt, Homo sapiens
agagagagaaugaau

SEQ ID NO: 28142 - RNA, 17 nt, Homo sapiens
cacaugguacaugguga

SEQ ID NO: 28143 - RNA, 20 nt, Homo sapiens
ccagcacagacauggaccac

SEQ ID NO: 28144 - RNA, 16 nt, Homo sapiens
ccgggggucgggaacg

SEQ ID NO: 28145 - RNA, 18 nt, Homo sapiens
cugccgccuccgcuccgu

SEQ ID NO: 28146 - RNA, 21 nt, Homo sapiens
gcccucugaccccucacgcca

SEQ ID NO: 28147 - RNA, 19 nt, Homo sapiens
gcgucggcgcgcccucuga

SEQ ID NO: 28148 - RNA, 20 nt, Homo sapiens
gggggucgggaacggagagc

SEQ ID NO: 28149 - RNA, 23 nt, Homo sapiens
ugcugagcagcaagaagcugccc

SEQ ID NO: 28150 - RNA, 18 nt, Homo sapiens
uuuauaggugaaccuaca

SEQ ID NO: 28151 - RNA, 17 nt, Homo sapiens
agaaagcauucaauauu

SEQ ID NO: 28152 - RNA, 19 nt, Homo sapiens
agaaagcauucaauauuuu

SEQ ID NO: 28153 - RNA, 23 nt, Homo sapiens
agugaaaccuacucgucccaguc

SEQ ID NO: 28154 - RNA, 21 nt, Homo sapiens
gucucagucugagguuugcua

SEQ ID NO: 28155 - RNA, 21 nt, Homo sapiens
guuuuguuagaaagcauucaa

SEQ ID NO: 28156 - RNA, 19 nt, Homo sapiens
uacgguaucugcauaagua

SEQ ID NO: 28157 - RNA, 24 nt, Homo sapiens
uauuuuauuuucucauuuucuuca

SEQ ID NO: 28158 - RNA, 20 nt, Homo sapiens
aagaggcucgugcacugguc

SEQ ID NO: 28159 - RNA, 18 nt, Homo sapiens
agggguugcggcaauggg

SEQ ID NO: 28160 - RNA, 20 nt, Homo sapiens
ccccggcccgcgugcgcccg

SEQ ID NO: 28161 - RNA, 25 nt, Homo sapiens
cggcgggagcgcucccccggcggcc

SEQ ID NO: 28162 - RNA, 24 nt, Homo sapiens
gccccggcccgcgugcgcccgucc

SEQ ID NO: 28163 - RNA, 18 nt, Homo sapiens
gcccggcggcgggagcgc

SEQ ID NO: 28164 - RNA, 22 nt, Homo sapiens
gccgccccauacccucuccucu

SEQ ID NO: 28165 - RNA, 23 nt, Homo sapiens
ggaugcaucuuccgaagaggcuc

SEQ ID NO: 28166 - RNA, 18 nt, Homo sapiens
ggcugcggcgguggcugc

SEQ ID NO: 28167 - RNA, 17 nt, Homo sapiens
ucuccucuucccccuua

SEQ ID NO: 28168 - RNA, 21 nt, Homo sapiens
ugggugggccgugcugccuug

SEQ ID NO: 28169 - RNA, 19 nt, Homo sapiens
uuucuccucugcggccaag

SEQ ID NO: 28170 - RNA, 18 nt, Homo sapiens
aaaagcauggaauagugg

SEQ ID NO: 28171 - RNA, 25 nt, Homo sapiens
aacccguguauguauuuaagugacu

SEQ ID NO: 28172 - RNA, 21 nt, Homo sapiens
aauucuuuuauauuaaaaaca

SEQ ID NO: 28173 - RNA, 21 nt, Homo sapiens
acaagggggagacaguucugc

SEQ ID NO: 28174 - RNA, 24 nt, Homo sapiens
agagagaaaguaguugugaaaaua

SEQ ID NO: 28175 - RNA, 18 nt, Homo sapiens
caauaggcacauuuggca

SEQ ID NO: 28176 - RNA, 17 nt, Homo sapiens
caccacugucacgugaa

SEQ ID NO: 28177 - RNA, 19 nt, Homo sapiens
ccacugucacgugaagcag

SEQ ID NO: 28178 - RNA, 17 nt, Homo sapiens
ccuccuguucaccacga

SEQ ID NO: 28179 - RNA, 17 nt, Homo sapiens
gaauguguuggacauga

SEQ ID NO: 28180 - RNA, 18 nt, Homo sapiens
gcgcugcccgcggggagg

SEQ ID NO: 28181 - RNA, 18 nt, Homo sapiens
gcugcgcgacugggacuu

SEQ ID NO: 28182 - RNA, 19 nt, Homo sapiens
uaaauuuccaacacaagga

SEQ ID NO: 28183 - RNA, 22 nt, Homo sapiens
uaauucuuuuauauuaaaaaca

SEQ ID NO: 28184 - RNA, 17 nt, Homo sapiens
uaguaagagaagcagag

SEQ ID NO: 28185 - RNA, 16 nt, Homo sapiens
ugacaagggggagaca

SEQ ID NO: 28186 - RNA, 18 nt, Homo sapiens
ugacaagggggagacagu

SEQ ID NO: 28187 - RNA, 20 nt, Homo sapiens
ugcuuuccaguugggaaaaa

SEQ ID NO: 28188 - RNA, 25 nt, Homo sapiens
gcuccgcgcgcgggcuacgcggccg

SEQ ID NO: 28189 - RNA, 18 nt, Homo sapiens
ucccuguaaugaaacuga

SEQ ID NO: 28190 - RNA, 16 nt, Homo sapiens
cacggugcgaaggugg

SEQ ID NO: 28191 - RNA, 21 nt, Homo sapiens
cagggucccugcccgggccgc

SEQ ID NO: 28192 - RNA, 14 nt, Homo sapiens
ccagaagauugggc

SEQ ID NO: 28193 - RNA, 21 nt, Homo sapiens
gccaggguucccccucuggga

SEQ ID NO: 28194 - RNA, 19 nt, Homo sapiens
uguugguguugggacaggg

SEQ ID NO: 28195 - RNA, 19 nt, Homo sapiens
uuacagugucuugaaagug

SEQ ID NO: 28196 - RNA, 17 nt, Homo sapiens
uuauuuccuggguccua

SEQ ID NO: 28197 - RNA, 20 nt, Homo sapiens
acaggugugagccaccacgc

SEQ ID NO: 28198 - RNA, 23 nt, Homo sapiens
caauguauaguuaucauaaauca

SEQ ID NO: 28199 - RNA, 20 nt, Homo sapiens
gagacggagucucacucugu

SEQ ID NO: 28200 - RNA, 17 nt, Homo sapiens
aagaggaaaaaagaugg

SEQ ID NO: 28201 - RNA, 19 nt, Homo sapiens
acguaccuugugguauggc

SEQ ID NO: 28202 - RNA, 17 nt, Homo sapiens
ccacccaccccuagccc

SEQ ID NO: 28203 - RNA, 18 nt, Homo sapiens
gaggggguggggaaggug

SEQ ID NO: 28204 - RNA, 19 nt, Homo sapiens
ggggaggggguggggaagg

SEQ ID NO: 28205 - RNA, 18 nt, Homo sapiens
ucugccugcggggagggg

SEQ ID NO: 28206 - RNA, 19 nt, Homo sapiens
ucugccugcggggaggggg

SEQ ID NO: 28207 - RNA, 23 nt, Homo sapiens
ugccuguaaucccagcacuuugg

SEQ ID NO: 28208 - RNA, 17 nt, Homo sapiens
uugggaggccgaggcgg

SEQ ID NO: 28209 - RNA, 23 nt, Homo sapiens
ugccuguaaucccagcacuuugg

SEQ ID NO: 28210 - RNA, 18 nt, Homo sapiens
acugcuggaagcuagggg

SEQ ID NO: 28211 - RNA, 15 nt, Homo sapiens
cacuggucugugccu

SEQ ID NO: 28212 - RNA, 17 nt, Homo sapiens
cacuggucugugccucc

SEQ ID NO: 28213 - RNA, 17 nt, Homo sapiens
cagccaccuucauaucc

SEQ ID NO: 28214 - RNA, 18 nt, Homo sapiens
ccagagcaccauuuacag

SEQ ID NO: 28215 - RNA, 19 nt, Homo sapiens
gaaaguuuuuuaugaagau

SEQ ID NO: 28216 - RNA, 21 nt, Homo sapiens
gaagaauaaagucaacuugcc

SEQ ID NO: 28217 - RNA, 20 nt, Homo sapiens
gaaguggagaagaugcuggg

SEQ ID NO: 28218 - RNA, 16 nt, Homo sapiens
gcuauguaucuagagg

SEQ ID NO: 28219 - RNA, 17 nt, Homo sapiens
ggaaagaggcuggaagc

SEQ ID NO: 28220 - RNA, 20 nt, Homo sapiens
gggggcgcggggcaggacgg

SEQ ID NO: 28221 - RNA, 19 nt, Homo sapiens
uaucuagaggcaguuauug

SEQ ID NO: 28222 - RNA, 21 nt, Homo sapiens
ucacuuuaauuucuuuauuca

SEQ ID NO: 28223 - RNA, 21 nt, Homo sapiens
ugagaucaaaucuggucaucu

SEQ ID NO: 28224 - RNA, 20 nt, Homo sapiens
ccucuuccuccucucccucc

SEQ ID NO: 28225 - RNA, 17 nt, Homo sapiens
gccggagccuccgcugc

SEQ ID NO: 28226 - RNA, 18 nt, Homo sapiens
ggggaggaguggaauagg

SEQ ID NO: 28227 - RNA, 14 nt, Homo sapiens
ggguagcagcugcu

SEQ ID NO: 28228 - RNA, 22 nt, Homo sapiens
uacaucaggagggacagucaca

SEQ ID NO: 28229 - RNA, 20 nt, Homo sapiens
ugagaggaggcgugaggggc

SEQ ID NO: 28230 - RNA, 15 nt, Homo sapiens
aaaugcugaugaaga

SEQ ID NO: 28231 - RNA, 22 nt, Homo sapiens
agagguagacucgauuaucuaa

SEQ ID NO: 28232 - RNA, 19 nt, Homo sapiens
aguuguauuuuuauaacuc

SEQ ID NO: 28233 - RNA, 20 nt, Homo sapiens
caacugauuuccaucuacaa

SEQ ID NO: 28234 - RNA, 20 nt, Homo sapiens
ccuggaggaggaagggccgc

SEQ ID NO: 28235 - RNA, 16 nt, Homo sapiens
cucgcggcuccgcggc

SEQ ID NO: 28236 - RNA, 14 nt, Homo sapiens
gagggcccgggcgc

SEQ ID NO: 28237 - RNA, 15 nt, Homo sapiens
gaggggacuacuguc

SEQ ID NO: 28238 - RNA, 18 nt, Homo sapiens
gcggggcugcagguuguc

SEQ ID NO: 28239 - RNA, 18 nt, Homo sapiens
gcucaggcucgcggcucc

SEQ ID NO: 28240 - RNA, 17 nt, Homo sapiens
ggcagcgcgugugagag

SEQ ID NO: 28241 - RNA, 21 nt, Homo sapiens
ggcucgcggcuccgcggcgcc

SEQ ID NO: 28242 - RNA, 20 nt, Homo sapiens
gggcggggaggguccgcggg

SEQ ID NO: 28243 - RNA, 19 nt, Homo sapiens
ggguggggucaccuggagg

SEQ ID NO: 28244 - RNA, 23 nt, Homo sapiens
gguaccuggaggaggaagggccg

SEQ ID NO: 28245 - RNA, 20 nt, Homo sapiens
guggggucaccuggagggag

SEQ ID NO: 28246 - RNA, 19 nt, Homo sapiens
uaccuauaggggacggggc

SEQ ID NO: 28247 - RNA, 22 nt, Homo sapiens
uacugucaauccacaaaaggcc

SEQ ID NO: 28248 - RNA, 14 nt, Homo sapiens
ucugggcuuuucga

SEQ ID NO: 28249 - RNA, 18 nt, Homo sapiens
cccagggccauuugggac

SEQ ID NO: 28250 - RNA, 16 nt, Homo sapiens
gggcacaaguucuggc

SEQ ID NO: 28251 - RNA, 18 nt, Homo sapiens
gguggauuagagacugcc

SEQ ID NO: 28252 - RNA, 14 nt, Homo sapiens
uccagggcaguggc

SEQ ID NO: 28253 - RNA, 21 nt, Homo sapiens
ucacgcugucaccuucauagc

SEQ ID NO: 28254 - RNA, 23 nt, Homo sapiens
cuguuccuccugcccuccaucug

SEQ ID NO: 28255 - RNA, 18 nt, Homo sapiens
ggggguggggguuucaug

SEQ ID NO: 28256 - RNA, 17 nt, Homo sapiens
guggggguuucaugcug

SEQ ID NO: 28257 - RNA, 16 nt, Homo sapiens
ucgcagagaguggggg

SEQ ID NO: 28258 - RNA, 20 nt, Homo sapiens
ucgcagagaguggggguggg

SEQ ID NO: 28259 - RNA, 15 nt, Homo sapiens
ugugcagucagcugu

SEQ ID NO: 28260 - RNA, 17 nt, Homo sapiens
aaaagaaaaaguggcau

SEQ ID NO: 28261 - RNA, 18 nt, Homo sapiens
acauucauuuuaaaacuc

SEQ ID NO: 28262 - RNA, 19 nt, Homo sapiens
aggcacauuuuguuuuuuc

SEQ ID NO: 28263 - RNA, 18 nt, Homo sapiens
agguugcagaaagaaaac

SEQ ID NO: 28264 - RNA, 18 nt, Homo sapiens
auauauaaguauuucuag

SEQ ID NO: 28265 - RNA, 18 nt, Homo sapiens
ccccuggagauugacugc

SEQ ID NO: 28266 - RNA, 18 nt, Homo sapiens
cuuuuccauuuuuuccuc

SEQ ID NO: 28267 - RNA, 19 nt, Homo sapiens
gggaucuucaaaaguagcc

SEQ ID NO: 28268 - RNA, 19 nt, Homo sapiens
uagcauaucaaucuuuaaa

SEQ ID NO: 28269 - RNA, 19 nt, Homo sapiens
ucaagaccuuuaaaauuac

SEQ ID NO: 28270 - RNA, 15 nt, Homo sapiens
uuaguuuacaggaag

SEQ ID NO: 28271 - RNA, 17 nt, Homo sapiens
cauuccuccuccuggca

SEQ ID NO: 28272 - RNA, 27 nt, Homo sapiens
ucuuucccgaugaacugcgguuagauc

SEQ ID NO: 28273 - RNA, 19 nt, Homo sapiens
aagaugcuuaugaaacaaa

SEQ ID NO: 28274 - RNA, 20 nt, Homo sapiens
aggcgcgggcuggggccggg

SEQ ID NO: 28275 - RNA, 19 nt, Homo sapiens
caggggcaaaaaugaacuc

SEQ ID NO: 28276 - RNA, 19 nt, Homo sapiens
cggggucccugcccugggc

SEQ ID NO: 28277 - RNA, 18 nt, Homo sapiens
gaaaguugcauucugcug

SEQ ID NO: 28278 - RNA, 17 nt, Homo sapiens
gccguggcggggucccu

SEQ ID NO: 28279 - RNA, 16 nt, Homo sapiens
gcgcggagaggcgcgg

SEQ ID NO: 28280 - RNA, 17 nt, Homo sapiens
gcggagcgcggggcggc

SEQ ID NO: 28281 - RNA, 21 nt, Homo sapiens
gcggggcggcgcggagaggcg

SEQ ID NO: 28282 - RNA, 20 nt, Homo sapiens
ggcaaaaaugaacucugcac

SEQ ID NO: 28283 - RNA, 20 nt, Homo sapiens
gggagagaaaagaguguaca

SEQ ID NO: 28284 - RNA, 21 nt, Homo sapiens
gggcgcggugcggagcgcggg

SEQ ID NO: 28285 - RNA, 19 nt, Homo sapiens
gggcuggggccgggccggg

SEQ ID NO: 28286 - RNA, 18 nt, Homo sapiens
gggucccugcccugggcc

SEQ ID NO: 28287 - RNA, 18 nt, Homo sapiens
ucaaaacacacauccaca

SEQ ID NO: 28288 - RNA, 16 nt, Homo sapiens
aggccugugguggggg

SEQ ID NO: 28289 - RNA, 16 nt, Homo sapiens
ccuguggugggggggg

SEQ ID NO: 28290 - RNA, 18 nt, Homo sapiens
gcugauuuucucacaugc

SEQ ID NO: 28291 - RNA, 14 nt, Homo sapiens
ggaggggauggaag

SEQ ID NO: 28292 - RNA, 15 nt, Homo sapiens
ugcccucccaggggc

SEQ ID NO: 28293 - RNA, 25 nt, Homo sapiens
auuaaaacugccauuugcaguaggg

SEQ ID NO: 28294 - RNA, 19 nt, Homo sapiens
caucauucuuuuuccccaa

SEQ ID NO: 28295 - RNA, 15 nt, Homo sapiens
gggaccaccuuugaa

SEQ ID NO: 28296 - RNA, 19 nt, Homo sapiens
uaaacacacaagguggcac

SEQ ID NO: 28297 - RNA, 15 nt, Homo sapiens
ugcaguaggggcagc

SEQ ID NO: 28298 - RNA, 18 nt, Homo sapiens
aacacugaguuuuuuagu

SEQ ID NO: 28299 - RNA, 20 nt, Homo sapiens
acaggaccgcugucccucgu

SEQ ID NO: 28300 - RNA, 19 nt, Homo sapiens
auaaagcauuucuaaauaa

SEQ ID NO: 28301 - RNA, 19 nt, Homo sapiens
caggaggaggguaaggcca

SEQ ID NO: 28302 - RNA, 25 nt, Homo sapiens
caggaggaggguaaggccagugagg

SEQ ID NO: 28303 - RNA, 21 nt, Homo sapiens
ccagaauucuaaaaagaugga

SEQ ID NO: 28304 - RNA, 19 nt, Homo sapiens
ccuuuaaauuuugugaccg

SEQ ID NO: 28305 - RNA, 17 nt, Homo sapiens
uaucucaguuagaauau

SEQ ID NO: 28306 - RNA, 18 nt, Homo sapiens
uucaucuuuuauuuuucc

SEQ ID NO: 28307 - RNA, 22 nt, Homo sapiens
aaaaggguagucucugggaugg

SEQ ID NO: 28308 - RNA, 16 nt, Homo sapiens
agaaaauggagugucu

SEQ ID NO: 28309 - RNA, 20 nt, Homo sapiens
caguauagcauuucaaaguc

SEQ ID NO: 28310 - RNA, 16 nt, Homo sapiens
ccaguugcuugacaua

SEQ ID NO: 28311 - RNA, 14 nt, Homo sapiens
ccugaagcagaggc

SEQ ID NO: 28312 - RNA, 21 nt, Homo sapiens
cuugacauacuauucuuggaa

SEQ ID NO: 28313 - RNA, 17 nt, Homo sapiens
cuugcggggcauggcag

SEQ ID NO: 28314 - RNA, 19 nt, Homo sapiens
uaacuaaggaaaauucugc

SEQ ID NO: 28315 - RNA, 18 nt, Homo sapiens
uaauaggaguaguguuua

SEQ ID NO: 28316 - RNA, 16 nt, Homo sapiens
uaauugugucacgggc

SEQ ID NO: 28317 - RNA, 22 nt, Homo sapiens
uagaaacaaaaaucacaaaucu

SEQ ID NO: 28318 - RNA, 21 nt, Homo sapiens
ugcaaggaaaaaagcugaggc

SEQ ID NO: 28319 - RNA, 18 nt, Homo sapiens
ugcaggguuaaaauacaa

SEQ ID NO: 28320 - RNA, 25 nt, Homo sapiens
uggagugucugugcuggguaccaag

SEQ ID NO: 28321 - RNA, 18 nt, Homo sapiens
uguacaagcaggacagua

SEQ ID NO: 28322 - RNA, 20 nt, Homo sapiens
ccucggcgcuucgggcggcg

SEQ ID NO: 28323 - RNA, 19 nt, Homo sapiens
uccacccucuuccaugaca

SEQ ID NO: 28324 - RNA, 24 nt, Homo sapiens
ugcugaguggcucagccuccucgg

SEQ ID NO: 28325 - RNA, 20 nt, Homo sapiens
ccuuauguaucaacucuugu

SEQ ID NO: 28326 - RNA, 23 nt, Homo sapiens
uacccuucccaaauguuuuauua

SEQ ID NO: 28327 - RNA, 18 nt, Homo sapiens
uuuguauucuuucaccac

SEQ ID NO: 28328 - RNA, 19 nt, Homo sapiens
aagcugcagacguuugcgg

SEQ ID NO: 28329 - RNA, 19 nt, Homo sapiens
agacugcagggaaacucaa

SEQ ID NO: 28330 - RNA, 19 nt, Homo sapiens
gccacugcuggcuccggcc

SEQ ID NO: 28331 - RNA, 20 nt, Homo sapiens
uguuccuucugauguucgga

SEQ ID NO: 28332 - RNA, 21 nt, Homo sapiens
aaggccacacacacaggaaaa

SEQ ID NO: 28333 - RNA, 16 nt, Homo sapiens
aaguggaaggagugga

SEQ ID NO: 28334 - RNA, 18 nt, Homo sapiens
acuugcuccucagaacca

SEQ ID NO: 28335 - RNA, 20 nt, Homo sapiens
aggauggugcagagcuuuau

SEQ ID NO: 28336 - RNA, 21 nt, Homo sapiens
aggcuggagggcugcaguggg

SEQ ID NO: 28337 - RNA, 16 nt, Homo sapiens
aggcuuggcuggaaga

SEQ ID NO: 28338 - RNA, 24 nt, Homo sapiens
cauauauauauauauuuauuuaua

SEQ ID NO: 28339 - RNA, 21 nt, Homo sapiens
cggggucgggaguggggggac

SEQ ID NO: 28340 - RNA, 18 nt, Homo sapiens
gcuggagggcugcagugg

SEQ ID NO: 28341 - RNA, 16 nt, Homo sapiens
gggcugcagugggcau

SEQ ID NO: 28342 - RNA, 20 nt, Homo sapiens
uauguacauauauauauaua

SEQ ID NO: 28343 - RNA, 21 nt, Homo sapiens
uauguacauauauauauauau

SEQ ID NO: 28344 - RNA, 18 nt, Homo sapiens
ucagggccugaaucuucu

SEQ ID NO: 28345 - RNA, 25 nt, Homo sapiens
ugccuaaagcuuugggucugaaggg

SEQ ID NO: 28346 - RNA, 18 nt, Homo sapiens
uggaaggaguggagaggc

SEQ ID NO: 28347 - RNA, 16 nt, Homo sapiens
agauggaucaacaugc

SEQ ID NO: 28348 - RNA, 23 nt, Homo sapiens
aggagucuuaauauuaguuguag

SEQ ID NO: 28349 - RNA, 20 nt, Homo sapiens
auguuuauauaaaaagcuga

SEQ ID NO: 28350 - RNA, 20 nt, Homo sapiens
ccuuaaguuuuuaguacuug

SEQ ID NO: 28351 - RNA, 18 nt, Homo sapiens
cuccagaucuaugguggu

SEQ ID NO: 28352 - RNA, 18 nt, Homo sapiens
cugcucugcucaaucaau

SEQ ID NO: 28353 - RNA, 25 nt, Homo sapiens
cuuaauauuaguuguagaugaccau

SEQ ID NO: 28354 - RNA, 25 nt, Homo sapiens
cuuuuccauauuucuguuuuuaauc

SEQ ID NO: 28355 - RNA, 22 nt, Homo sapiens
guuaaaguuaaccucauucgug

SEQ ID NO: 28356 - RNA, 16 nt, Homo sapiens
uauaguucauggucua

SEQ ID NO: 28357 - RNA, 18 nt, Homo sapiens
ucaguaucuucuuauauu

SEQ ID NO: 28358 - RNA, 26 nt, Homo sapiens
uccaauauuuacaacuuaauuuuucu

SEQ ID NO: 28359 - RNA, 19 nt, Homo sapiens
ucccaaggucauaugcauu

SEQ ID NO: 28360 - RNA, 18 nt, Homo sapiens
uccucacucccauuccua

SEQ ID NO: 28361 - RNA, 19 nt, Homo sapiens
uuuaugaggaaacuuuuaa

SEQ ID NO: 28362 - RNA, 23 nt, Homo sapiens
uuucucaaauuguuccaaggaau

SEQ ID NO: 28363 - RNA, 25 nt, Homo sapiens
uuucuguucccacuuuuagugaaaa

SEQ ID NO: 28364 - RNA, 23 nt, Homo sapiens
ugcugagcaauauuuacaucucc

SEQ ID NO: 28365 - RNA, 18 nt, Homo sapiens
auucccaaucacuucagc

SEQ ID NO: 28366 - RNA, 16 nt, Homo sapiens
guggagauggaaaggg

SEQ ID NO: 28367 - RNA, 24 nt, Homo sapiens
uaugcauauauauacauacauaga

SEQ ID NO: 28368 - RNA, 16 nt, Homo sapiens
uguugacuccuggugu

SEQ ID NO: 28369 - RNA, 18 nt, Homo sapiens
uucccaggagccagaagc

SEQ ID NO: 28370 - RNA, 20 nt, Homo sapiens
uuuaaucuuggauuuucaga

SEQ ID NO: 28371 - RNA, 20 nt, Homo sapiens
aaggacacagacccaagaga

SEQ ID NO: 28372 - RNA, 19 nt, Homo sapiens
caccucaucagugcucccc

SEQ ID NO: 28373 - RNA, 19 nt, Homo sapiens
caggggagaaaggaugugu

SEQ ID NO: 28374 - RNA, 14 nt, Homo sapiens
caucacccuccccc

SEQ ID NO: 28375 - RNA, 20 nt, Homo sapiens
cccuggcaucacccuccccc

SEQ ID NO: 28376 - RNA, 23 nt, Homo sapiens
cuuaacuuuccuacaauccaggg

SEQ ID NO: 28377 - RNA, 18 nt, Homo sapiens
uccagggucaucggggaa

SEQ ID NO: 28378 - RNA, 16 nt, Homo sapiens
ugagccagguggggag

SEQ ID NO: 28379 - RNA, 22 nt, Homo sapiens
cagugucauuucugaacguguc

SEQ ID NO: 28380 - RNA, 20 nt, Homo sapiens
uaagcuaucauuuuugaaca

SEQ ID NO: 28381 - RNA, 21 nt, Homo sapiens
ucuguagacucaacacaggga

SEQ ID NO: 28382 - RNA, 18 nt, Homo sapiens
ucuuuuaguaugaacucu

SEQ ID NO: 28383 - RNA, 22 nt, Homo sapiens
uggagacuuauauuucaugaaa

SEQ ID NO: 28384 - RNA, 21 nt, Homo sapiens
uuucagaagaaauacucuugu

SEQ ID NO: 28385 - RNA, 18 nt, Homo sapiens
gaaggcaaagcccacugc

SEQ ID NO: 28386 - RNA, 18 nt, Homo sapiens
aaggaaaagaaugcaacu

SEQ ID NO: 28387 - RNA, 19 nt, Homo sapiens
aauggugugcuuuguggau

SEQ ID NO: 28388 - RNA, 18 nt, Homo sapiens
cagaucaaguguuguguc

SEQ ID NO: 28389 - RNA, 21 nt, Homo sapiens
gcagugaucuaagcagcagca

SEQ ID NO: 28390 - RNA, 22 nt, Homo sapiens
gugcauucauuuuuuuuguuuu

SEQ ID NO: 28391 - RNA, 19 nt, Homo sapiens
ugcagugaucuaagcagca

SEQ ID NO: 28392 - RNA, 22 nt, Homo sapiens
ugcagugaucuaagcagcagca

SEQ ID NO: 28393 - RNA, 21 nt, Homo sapiens
uugcugauucuucuuuuucag

SEQ ID NO: 28394 - RNA, 15 nt, Homo sapiens
uuuucacuuacacag

SEQ ID NO: 28395 - RNA, 17 nt, Homo sapiens
caguaaaaucaaaagca

SEQ ID NO: 28396 - RNA, 22 nt, Homo sapiens
ccuggggaucuggacggcgugc

SEQ ID NO: 28397 - RNA, 19 nt, Homo sapiens
gaccagccuggccaaugug

SEQ ID NO: 28398 - RNA, 18 nt, Homo sapiens
gagccaagauagugccag

SEQ ID NO: 28399 - RNA, 21 nt, Homo sapiens
gaugaggcuuauuucgcagaa

SEQ ID NO: 28400 - RNA, 21 nt, Homo sapiens
gucucuuauccuggggaucug

SEQ ID NO: 28401 - RNA, 18 nt, Homo sapiens
ucuggaauggugacuaca

SEQ ID NO: 28402 - RNA, 16 nt, Homo sapiens
ugccccuggccccucc

SEQ ID NO: 28403 - RNA, 19 nt, Homo sapiens
cugggagacaccagagccc

SEQ ID NO: 28404 - RNA, 22 nt, Homo sapiens
ugcugggggagggagcagcuuc

SEQ ID NO: 28405 - RNA, 18 nt, Homo sapiens
caaagaagagaagaaaaa

SEQ ID NO: 28406 - RNA, 16 nt, Homo sapiens
cgcagcggcgcagggg

SEQ ID NO: 28407 - RNA, 20 nt, Homo sapiens
cgcugggucuugguugcggc

SEQ ID NO: 28408 - RNA, 21 nt, Homo sapiens
gcgcucggccgcuuccggugc

SEQ ID NO: 28409 - RNA, 20 nt, Homo sapiens
aaggaagaagauggccaagg

SEQ ID NO: 28410 - RNA, 17 nt, Homo sapiens
agaaaagaaauuaaaga

SEQ ID NO: 28411 - RNA, 21 nt, Homo sapiens
cccuuggucacagcugcucug

SEQ ID NO: 28412 - RNA, 20 nt, Homo sapiens
cucuuagccuggacaacaua

SEQ ID NO: 28413 - RNA, 15 nt, Homo sapiens
gcaguggcagcagca

SEQ ID NO: 28414 - RNA, 14 nt, Homo sapiens
gccugcuccauauc

SEQ ID NO: 28415 - RNA, 18 nt, Homo sapiens
gccuuuuggauacacaca

SEQ ID NO: 28416 - RNA, 17 nt, Homo sapiens
gggaaaaaggggaaggc

SEQ ID NO: 28417 - RNA, 21 nt, Homo sapiens
gggaaggcuggaaaagggagc

SEQ ID NO: 28418 - RNA, 17 nt, Homo sapiens
uaaguuucauaguucac

SEQ ID NO: 28419 - RNA, 21 nt, Homo sapiens
ucagcucaaaucccaccucuu

SEQ ID NO: 28420 - RNA, 18 nt, Homo sapiens
agggaggggugagggagg

SEQ ID NO: 28421 - RNA, 16 nt, Homo sapiens
ggcaacaggaaaagaa

SEQ ID NO: 28422 - RNA, 18 nt, Homo sapiens
gggagggagggaggaaag

SEQ ID NO: 28423 - RNA, 16 nt, Homo sapiens
gggcaauccgguggca

SEQ ID NO: 28424 - RNA, 25 nt, Homo sapiens
ucgucguugucuuuuccuccgagga

SEQ ID NO: 28425 - RNA, 19 nt, Homo sapiens
uuagauguucagaggcagu

SEQ ID NO: 28426 - RNA, 22 nt, Homo sapiens
gaggggugcagagccauaccug

SEQ ID NO: 28427 - RNA, 21 nt, Homo sapiens
gcaggccuggagcagcuucuc

SEQ ID NO: 28428 - RNA, 23 nt, Homo sapiens
uggcuuugauuagcaaauaaggu

SEQ ID NO: 28429 - RNA, 21 nt, Homo sapiens
acgacauucuugagggcaagg

SEQ ID NO: 28430 - RNA, 20 nt, Homo sapiens
agaggcaagcccucagcucu

SEQ ID NO: 28431 - RNA, 19 nt, Homo sapiens
aggcgcgcagacggcagac

SEQ ID NO: 28432 - RNA, 17 nt, Homo sapiens
agggcgccugggcugac

SEQ ID NO: 28433 - RNA, 19 nt, Homo sapiens
caggacacuccccguccag

SEQ ID NO: 28434 - RNA, 16 nt, Homo sapiens
cggcgccgacuggagc

SEQ ID NO: 28435 - RNA, 22 nt, Homo sapiens
cuggcuacagugugggggcacg

SEQ ID NO: 28436 - RNA, 17 nt, Homo sapiens
gaggggcgggggggcgg

SEQ ID NO: 28437 - RNA, 22 nt, Homo sapiens
gcaagcgggccccggguaacaa

SEQ ID NO: 28438 - RNA, 16 nt, Homo sapiens
gccggacccgaccggc

SEQ ID NO: 28439 - RNA, 19 nt, Homo sapiens
gcgcgcagacggcagaccg

SEQ ID NO: 28440 - RNA, 17 nt, Homo sapiens
gcggcuacuggacacga

SEQ ID NO: 28441 - RNA, 17 nt, Homo sapiens
ggagcgaggggcggggg

SEQ ID NO: 28442 - RNA, 18 nt, Homo sapiens
ggcggcagagcgcggcgc

SEQ ID NO: 28443 - RNA, 18 nt, Homo sapiens
gggggcggcagagcgcgg

SEQ ID NO: 28444 - RNA, 19 nt, Homo sapiens
ugggcugacuucaggaugu

SEQ ID NO: 28445 - RNA, 24 nt, Homo sapiens
ugaccaugauauucuuuuuauuga

SEQ ID NO: 28446 - RNA, 18 nt, Homo sapiens
aaaaccaaaacaaaacaa

SEQ ID NO: 28447 - RNA, 16 nt, Homo sapiens
cagcgccgccgcuccc

SEQ ID NO: 28448 - RNA, 22 nt, Homo sapiens
ccccugcucgggcccccgccca

SEQ ID NO: 28449 - RNA, 18 nt, Homo sapiens
ccucagcgccgccgcucc

SEQ ID NO: 28450 - RNA, 19 nt, Homo sapiens
ccucuuaguucuuuuguua

SEQ ID NO: 28451 - RNA, 20 nt, Homo sapiens
cgggcccccgcccaugcccg

SEQ ID NO: 28452 - RNA, 21 nt, Homo sapiens
cugucuugcagagagacuauu

SEQ ID NO: 28453 - RNA, 19 nt, Homo sapiens
cuuggagcgcccagguggc

SEQ ID NO: 28454 - RNA, 20 nt, Homo sapiens
gacuauuggugaaggccgga

SEQ ID NO: 28455 - RNA, 16 nt, Homo sapiens
ggcgcgucuggagcgg

SEQ ID NO: 28456 - RNA, 24 nt, Homo sapiens
ggcuggcggcgcgggcacaccgag

SEQ ID NO: 28457 - RNA, 24 nt, Homo sapiens
gggccccggguccugugcggccgc

SEQ ID NO: 28458 - RNA, 15 nt, Homo sapiens
gggggccgcggcgga

SEQ ID NO: 28459 - RNA, 15 nt, Homo sapiens
ggugggcccugggga

SEQ ID NO: 28460 - RNA, 21 nt, Homo sapiens
ucccggcgcagcggcccggcg

SEQ ID NO: 28461 - RNA, 18 nt, Homo sapiens
ucuuaguucuuuuguuag

SEQ ID NO: 28462 - RNA, 19 nt, Homo sapiens
ugggcccuggggauggcuc

SEQ ID NO: 28463 - RNA, 17 nt, Homo sapiens
uguggaaaucauuuguu

SEQ ID NO: 28464 - RNA, 20 nt, Homo sapiens
uuauguauuucucuuuugcu

SEQ ID NO: 28465 - RNA, 20 nt, Homo sapiens
aagcaucaacucugugccag

SEQ ID NO: 28466 - RNA, 17 nt, Homo sapiens
acagcuucugccuggcc

SEQ ID NO: 28467 - RNA, 22 nt, Homo sapiens
aggcagguuuuucuuuuucauu

SEQ ID NO: 28468 - RNA, 24 nt, Homo sapiens
aggggugguaugugcccgggaugg

SEQ ID NO: 28469 - RNA, 21 nt, Homo sapiens
auccaugcccaaaacaugugg

SEQ ID NO: 28470 - RNA, 14 nt, Homo sapiens
caacuagagcacug

SEQ ID NO: 28471 - RNA, 19 nt, Homo sapiens
caagggccagacagcugcu

SEQ ID NO: 28472 - RNA, 20 nt, Homo sapiens
cacaucaagccuucucucac

SEQ ID NO: 28473 - RNA, 19 nt, Homo sapiens
cacgccccauggccugugc

SEQ ID NO: 28474 - RNA, 18 nt, Homo sapiens
caggaacugcuacacaug

SEQ ID NO: 28475 - RNA, 21 nt, Homo sapiens
caucaagccuucucucacugg

SEQ ID NO: 28476 - RNA, 22 nt, Homo sapiens
ccauugcucgccucggucgccg

SEQ ID NO: 28477 - RNA, 18 nt, Homo sapiens
cccacgccuccccugcgc

SEQ ID NO: 28478 - RNA, 25 nt, Homo sapiens
cccccgccucccuuugaccguuugg

SEQ ID NO: 28479 - RNA, 21 nt, Homo sapiens
ccuggggccgcccaggaggac

SEQ ID NO: 28480 - RNA, 18 nt, Homo sapiens
cuccggacugcagcacag

SEQ ID NO: 28481 - RNA, 18 nt, Homo sapiens
cuuggaggggcuaugugg

SEQ ID NO: 28482 - RNA, 19 nt, Homo sapiens
gacugggccuucuucuggc

SEQ ID NO: 28483 - RNA, 16 nt, Homo sapiens
gcacaucguucugcag

SEQ ID NO: 28484 - RNA, 23 nt, Homo sapiens
guggcugcgcaccuagacggucc

SEQ ID NO: 28485 - RNA, 19 nt, Homo sapiens
ucaacccuugcaugcacua

SEQ ID NO: 28486 - RNA, 21 nt, Homo sapiens
ucccccgcgggccgagcuggg

SEQ ID NO: 28487 - RNA, 19 nt, Homo sapiens
ugaggagcagugggcgucc

SEQ ID NO: 28488 - RNA, 22 nt, Homo sapiens
ugaguacuuggaaagaugccuu

SEQ ID NO: 28489 - RNA, 25 nt, Homo sapiens
ugccaggcacguuacuagcugcuac

SEQ ID NO: 28490 - RNA, 15 nt, Homo sapiens
aacauaauagagcuu

SEQ ID NO: 28491 - RNA, 19 nt, Homo sapiens
aaggaaacugaugggcacc

SEQ ID NO: 28492 - RNA, 18 nt, Homo sapiens
aucauccugaaacacacu

SEQ ID NO: 28493 - RNA, 24 nt, Homo sapiens
cccugugucugcuuugggaacgcc

SEQ ID NO: 28494 - RNA, 23 nt, Homo sapiens
cuguacauucucuugcccccaga

SEQ ID NO: 28495 - RNA, 18 nt, Homo sapiens
gccauccuaacugccacu

SEQ ID NO: 28496 - RNA, 18 nt, Homo sapiens
gcugcuuuuuuccccucc

SEQ ID NO: 28497 - RNA, 23 nt, Homo sapiens
ggcaggggaaagaggaaagaaaa

SEQ ID NO: 28498 - RNA, 19 nt, Homo sapiens
uaagugguuaacauacaca

SEQ ID NO: 28499 - RNA, 20 nt, Homo sapiens
uacacuuuauauauauauau

SEQ ID NO: 28500 - RNA, 22 nt, Homo sapiens
uagaacccgggagaacgcccag

SEQ ID NO: 28501 - RNA, 16 nt, Homo sapiens
ucaacacuguuuuagu

SEQ ID NO: 28502 - RNA, 22 nt, Homo sapiens
ucugccucuaaagccauuccgc

SEQ ID NO: 28503 - RNA, 15 nt, Homo sapiens
ucuuaagcuuuucuc

SEQ ID NO: 28504 - RNA, 18 nt, Homo sapiens
uuuguccuuuuggaucca

SEQ ID NO: 28505 - RNA, 19 nt, Homo sapiens
agagggaggagaggaaaga

SEQ ID NO: 28506 - RNA, 18 nt, Homo sapiens
agggcgccgcgggccugc

SEQ ID NO: 28507 - RNA, 22 nt, Homo sapiens
gggaggcggggaucuugggagc

SEQ ID NO: 28508 - RNA, 18 nt, Homo sapiens
uugcuuuuauuguuuuua

SEQ ID NO: 28509 - RNA, 22 nt, Homo sapiens
agcgauggccgagagggcggcg

SEQ ID NO: 28510 - RNA, 19 nt, Homo sapiens
ccgccccugcccuccuucc

SEQ ID NO: 28511 - RNA, 15 nt, Homo sapiens
ccgcggccgggggcg

SEQ ID NO: 28512 - RNA, 16 nt, Homo sapiens
cgggggcuaaggcggg

SEQ ID NO: 28513 - RNA, 24 nt, Homo sapiens
gcgcggggcagggcccggggccgc

SEQ ID NO: 28514 - RNA, 18 nt, Homo sapiens
uucccaguuaaguugcag

SEQ ID NO: 28515 - RNA, 18 nt, Homo sapiens
aaaagaaaaaaaaaaagc

SEQ ID NO: 28516 - RNA, 19 nt, Homo sapiens
caguaaaucagacaucuug

SEQ ID NO: 28517 - RNA, 18 nt, Homo sapiens
gccccaaaacguuuucaa

SEQ ID NO: 28518 - RNA, 30 nt, Homo sapiens
uucacauuuuuggugcaguauuuauuucau

SEQ ID NO: 28519 - RNA, 21 nt, Homo sapiens
uuuaaaaaaguuaacaguagu

SEQ ID NO: 28520 - RNA, 20 nt, Homo sapiens
uggagagacccuuggagcug

SEQ ID NO: 28521 - RNA, 16 nt, Homo sapiens
uggcugcaucuuccug

SEQ ID NO: 28522 - RNA, 19 nt, Homo sapiens
gccgugccgggagcuccuc

SEQ ID NO: 28523 - RNA, 19 nt, Homo sapiens
ugaaggaaguuaucuucuu

SEQ ID NO: 28524 - RNA, 22 nt, Homo sapiens
caccaccugcggcggcggcccc

SEQ ID NO: 28525 - RNA, 16 nt, Homo sapiens
caucaaaaaccugcag

SEQ ID NO: 28526 - RNA, 24 nt, Homo sapiens
ccgcggccauggcccgcucggccg

SEQ ID NO: 28527 - RNA, 18 nt, Homo sapiens
ccggagggggcgccgcgc

SEQ ID NO: 28528 - RNA, 20 nt, Homo sapiens
ccucaccgcgcgccaccacc

SEQ ID NO: 28529 - RNA, 23 nt, Homo sapiens
cggccauggcccgcucggccggg

SEQ ID NO: 28530 - RNA, 23 nt, Homo sapiens
cguuccauccgccccggaggggg

SEQ ID NO: 28531 - RNA, 22 nt, Homo sapiens
gcggcggcggcccccgcggcca

SEQ ID NO: 28532 - RNA, 18 nt, Homo sapiens
agcagggggggaugggaa

SEQ ID NO: 28533 - RNA, 20 nt, Homo sapiens
cuguuccccucacacccgcc

SEQ ID NO: 28534 - RNA, 18 nt, Homo sapiens
gaggaaaaaauuguccca

SEQ ID NO: 28535 - RNA, 17 nt, Homo sapiens
gcuggaaaaugaggagg

SEQ ID NO: 28536 - RNA, 15 nt, Homo sapiens
ggggggaugggaagg

SEQ ID NO: 28537 - RNA, 16 nt, Homo sapiens
gguucgcugggccgaa

SEQ ID NO: 28538 - RNA, 18 nt, Homo sapiens
uaagcggcuguuaaaaga

SEQ ID NO: 28539 - RNA, 21 nt, Homo sapiens
uacaggugugagccaccaggc

SEQ ID NO: 28540 - RNA, 18 nt, Homo sapiens
uggaaaaugaggaggggg

SEQ ID NO: 28541 - RNA, 19 nt, Homo sapiens
aaaaaaucagaagauauca

SEQ ID NO: 28542 - RNA, 18 nt, Homo sapiens
cacgugaaggaggucaga

SEQ ID NO: 28543 - RNA, 18 nt, Homo sapiens
cccagcccaagccugccu

SEQ ID NO: 28544 - RNA, 19 nt, Homo sapiens
gcauggggcaggcgcucgc

SEQ ID NO: 28545 - RNA, 22 nt, Homo sapiens
gccaccuacgccagcugcaugg

SEQ ID NO: 28546 - RNA, 20 nt, Homo sapiens
gcuggcuguucccccucugu

SEQ ID NO: 28547 - RNA, 15 nt, Homo sapiens
ggccuguagguacag

SEQ ID NO: 28548 - RNA, 23 nt, Homo sapiens
gggggugaugagagguuguccug

SEQ ID NO: 28549 - RNA, 18 nt, Homo sapiens
uaagaauccagcauucua

SEQ ID NO: 28550 - RNA, 20 nt, Homo sapiens
uggcaacaaccagcuagagc

SEQ ID NO: 28551 - RNA, 16 nt, Homo sapiens
uggcccagcccaagcc

SEQ ID NO: 28552 - RNA, 20 nt, Homo sapiens
ugguuucugaaguccuaacc

SEQ ID NO: 28553 - RNA, 19 nt, Homo sapiens
uucgaaaaaucagaagauc

SEQ ID NO: 28554 - RNA, 18 nt, Homo sapiens
aaaaccugggaaacaaga

SEQ ID NO: 28555 - RNA, 20 nt, Homo sapiens
aaaucuuggcaauguguagg

SEQ ID NO: 28556 - RNA, 18 nt, Homo sapiens
aaggcugcuggaguuggg

SEQ ID NO: 28557 - RNA, 20 nt, Homo sapiens
agaggagguacugcuguggc

SEQ ID NO: 28558 - RNA, 19 nt, Homo sapiens
aggauuccuggggccccca

SEQ ID NO: 28559 - RNA, 22 nt, Homo sapiens
auguguaggaaucagugagugc

SEQ ID NO: 28560 - RNA, 22 nt, Homo sapiens
cauggagggcagccuggcccac

SEQ ID NO: 28561 - RNA, 18 nt, Homo sapiens
ccugggcuggggcccagc

SEQ ID NO: 28562 - RNA, 20 nt, Homo sapiens
cuccccgcuucagcuaagga

SEQ ID NO: 28563 - RNA, 21 nt, Homo sapiens
cucuuggccagguggggcccc

SEQ ID NO: 28564 - RNA, 19 nt, Homo sapiens
cugcugccucccgagcagu

SEQ ID NO: 28565 - RNA, 19 nt, Homo sapiens
gcagaccugggcuggggcc

SEQ ID NO: 28566 - RNA, 19 nt, Homo sapiens
ggccugagucucccucccu

SEQ ID NO: 28567 - RNA, 22 nt, Homo sapiens
ggcugcuggaguuggggaggag

SEQ ID NO: 28568 - RNA, 20 nt, Homo sapiens
gggagaggaggcaaaucuuc

SEQ ID NO: 28569 - RNA, 18 nt, Homo sapiens
uaaaaagggaauuggaac

SEQ ID NO: 28570 - RNA, 15 nt, Homo sapiens
ucacaaaggucacag

SEQ ID NO: 28571 - RNA, 16 nt, Homo sapiens
ugccaagucugggugu

SEQ ID NO: 28572 - RNA, 18 nt, Homo sapiens
uuacugcucccagcacua

SEQ ID NO: 28573 - RNA, 15 nt, Homo sapiens
aacagaugggggugc

SEQ ID NO: 28574 - RNA, 20 nt, Homo sapiens
agaugggggugcugggggug

SEQ ID NO: 28575 - RNA, 22 nt, Homo sapiens
agaugggggugcuggggguggg

SEQ ID NO: 28576 - RNA, 20 nt, Homo sapiens
ggguggggagggcugcaggg

SEQ ID NO: 28577 - RNA, 16 nt, Homo sapiens
gagagagucagaacau

SEQ ID NO: 28578 - RNA, 18 nt, Homo sapiens
ccugggcucuccucguua

SEQ ID NO: 28579 - RNA, 19 nt, Homo sapiens
gauuacagcgaugcgcuac

SEQ ID NO: 28580 - RNA, 20 nt, Homo sapiens
ucugucuuagggauuuucug

SEQ ID NO: 28581 - RNA, 20 nt, Homo sapiens
accccagccugcacucucuc

SEQ ID NO: 28582 - RNA, 24 nt, Homo sapiens
agggagaagcccccacccaguccc

SEQ ID NO: 28583 - RNA, 22 nt, Homo sapiens
cagguaggucggaagaaucagg

SEQ ID NO: 28584 - RNA, 18 nt, Homo sapiens
ccgccgccuuccgcaggc

SEQ ID NO: 28585 - RNA, 20 nt, Homo sapiens
gauugagccugggaguuucu

SEQ ID NO: 28586 - RNA, 18 nt, Homo sapiens
gcaccagccuuagggugu

SEQ ID NO: 28587 - RNA, 22 nt, Homo sapiens
gcagguaggucggaagaaucag

SEQ ID NO: 28588 - RNA, 17 nt, Homo sapiens
gccggggcagggggugc

SEQ ID NO: 28589 - RNA, 21 nt, Homo sapiens
ggcgcauggcgggccccgugg

SEQ ID NO: 28590 - RNA, 23 nt, Homo sapiens
ggguagagggagaagcccccacc

SEQ ID NO: 28591 - RNA, 20 nt, Homo sapiens
uuacuguaagggagggggug

SEQ ID NO: 28592 - RNA, 18 nt, Homo sapiens
agcuagugaaugauauua

SEQ ID NO: 28593 - RNA, 19 nt, Homo sapiens
aggcaaagcuagugaauga

SEQ ID NO: 28594 - RNA, 20 nt, Homo sapiens
aggcugagagaaagaagcca

SEQ ID NO: 28595 - RNA, 18 nt, Homo sapiens
aguuuucaguuuauccug

SEQ ID NO: 28596 - RNA, 19 nt, Homo sapiens
caacaucuucuuuucccuu

SEQ ID NO: 28597 - RNA, 20 nt, Homo sapiens
caacaucuucuuuucccuuu

SEQ ID NO: 28598 - RNA, 17 nt, Homo sapiens
cauaacuccccaaggca

SEQ ID NO: 28599 - RNA, 23 nt, Homo sapiens
gaagaaucucagcaucagucaaa

SEQ ID NO: 28600 - RNA, 18 nt, Homo sapiens
ggaagugcuccucuuuug

SEQ ID NO: 28601 - RNA, 19 nt, Homo sapiens
gugacuuauaauucuagaa

SEQ ID NO: 28602 - RNA, 19 nt, Homo sapiens
uaugagaaacagaaauaaa

SEQ ID NO: 28603 - RNA, 19 nt, Homo sapiens
uauuucuguaacuuuuuuu

SEQ ID NO: 28604 - RNA, 24 nt, Homo sapiens
ucuugguucacaacuguuuauuuu

SEQ ID NO: 28605 - RNA, 22 nt, Homo sapiens
ugauuagaaauccuggucuacc

SEQ ID NO: 28606 - RNA, 19 nt, Homo sapiens
ugcugagccgacacauccc

SEQ ID NO: 28607 - RNA, 17 nt, Homo sapiens
ugugauggugcccucuc

SEQ ID NO: 28608 - RNA, 19 nt, Homo sapiens
uguuaggaaaaauaagaau

SEQ ID NO: 28609 - RNA, 22 nt, Homo sapiens
acggggccggguggcaguggcg

SEQ ID NO: 28610 - RNA, 19 nt, Homo sapiens
caacaucuucuuuucccuu

SEQ ID NO: 28611 - RNA, 18 nt, Homo sapiens
cacuucuaaaguuagaca

SEQ ID NO: 28612 - RNA, 18 nt, Homo sapiens
uaaggcugagagaaagaa

SEQ ID NO: 28613 - RNA, 16 nt, Homo sapiens
uaaguuagagacagcu

SEQ ID NO: 28614 - RNA, 19 nt, Homo sapiens
uauuucuguaacuuuuuuu

SEQ ID NO: 28615 - RNA, 24 nt, Homo sapiens
uuagaaauuaagcauuauguacac

SEQ ID NO: 28616 - RNA, 21 nt, Homo sapiens
uucaacaucuucuuuucccuu

SEQ ID NO: 28617 - RNA, 21 nt, Homo sapiens
uuucaucagcucccaacccuu

SEQ ID NO: 28618 - RNA, 18 nt, Homo sapiens
aaguucacugguauuuga

SEQ ID NO: 28619 - RNA, 22 nt, Homo sapiens
acacagcuguaccauccauucc

SEQ ID NO: 28620 - RNA, 18 nt, Homo sapiens
agugucccccucaaggca

SEQ ID NO: 28621 - RNA, 19 nt, Homo sapiens
cacgagcugacucuggggc

SEQ ID NO: 28622 - RNA, 16 nt, Homo sapiens
cauuaucaacuggcuu

SEQ ID NO: 28623 - RNA, 16 nt, Homo sapiens
ccaauugcauggaagc

SEQ ID NO: 28624 - RNA, 22 nt, Homo sapiens
ccccacagccuggugcgggguc

SEQ ID NO: 28625 - RNA, 15 nt, Homo sapiens
ccugacuggcauuug

SEQ ID NO: 28626 - RNA, 18 nt, Homo sapiens
ccuggaaaggccacuuug

SEQ ID NO: 28627 - RNA, 22 nt, Homo sapiens
ccuggguguuuguauuugcagu

SEQ ID NO: 28628 - RNA, 22 nt, Homo sapiens
cugaaaucagauauggagagaa

SEQ ID NO: 28629 - RNA, 16 nt, Homo sapiens
cugagcauggcaguuu

SEQ ID NO: 28630 - RNA, 17 nt, Homo sapiens
cugugcuuccagcccua

SEQ ID NO: 28631 - RNA, 16 nt, Homo sapiens
cuguuuuugccuuccc

SEQ ID NO: 28632 - RNA, 20 nt, Homo sapiens
cuuccauugaccacaucucc

SEQ ID NO: 28633 - RNA, 19 nt, Homo sapiens
gaaacagaacuacccugau

SEQ ID NO: 28634 - RNA, 17 nt, Homo sapiens
gagcuccucuugagaug

SEQ ID NO: 28635 - RNA, 19 nt, Homo sapiens
gccuauucuuuuuaggugc

SEQ ID NO: 28636 - RNA, 17 nt, Homo sapiens
ggggcuagggaagaccu

SEQ ID NO: 28637 - RNA, 19 nt, Homo sapiens
gguggcguuuaaaugguuu

SEQ ID NO: 28638 - RNA, 18 nt, Homo sapiens
uaaaaugucacucugaga

SEQ ID NO: 28639 - RNA, 21 nt, Homo sapiens
uaaguuaucugaaaucagaua

SEQ ID NO: 28640 - RNA, 22 nt, Homo sapiens
uaaguucucuucugaggacucu

SEQ ID NO: 28641 - RNA, 16 nt, Homo sapiens
uaauaccugccucaga

SEQ ID NO: 28642 - RNA, 17 nt, Homo sapiens
uacauccgucucagaaa

SEQ ID NO: 28643 - RNA, 19 nt, Homo sapiens
uauucacuacuuuucugug

SEQ ID NO: 28644 - RNA, 14 nt, Homo sapiens
uccuucaccacaga

SEQ ID NO: 28645 - RNA, 17 nt, Homo sapiens
uccuugauuuucuuccu

SEQ ID NO: 28646 - RNA, 23 nt, Homo sapiens
ucgaacuccugaccuccagugau

SEQ ID NO: 28647 - RNA, 25 nt, Homo sapiens
ucuaauaccugccucagaauuuccu

SEQ ID NO: 28648 - RNA, 25 nt, Homo sapiens
ucucuugaggccaagccacucugug

SEQ ID NO: 28649 - RNA, 22 nt, Homo sapiens
ucuggaacuccugaccucauga

SEQ ID NO: 28650 - RNA, 17 nt, Homo sapiens
ugaaaccuugaauguau

SEQ ID NO: 28651 - RNA, 21 nt, Homo sapiens
ugacauugaauguuccucaaa

SEQ ID NO: 28652 - RNA, 21 nt, Homo sapiens
ugagcuggcaugaguauuugu

SEQ ID NO: 28653 - RNA, 17 nt, Homo sapiens
uggacaccugugccaag

SEQ ID NO: 28654 - RNA, 18 nt, Homo sapiens
uggcccagacucuuccag

SEQ ID NO: 28655 - RNA, 19 nt, Homo sapiens
uggcugugggggaucuggg

SEQ ID NO: 28656 - RNA, 21 nt, Homo sapiens
ugggaaaaaguggugguauac

SEQ ID NO: 28657 - RNA, 18 nt, Homo sapiens
uucuaccuaguucugcuu

SEQ ID NO: 28658 - RNA, 16 nt, Homo sapiens
guacaaucaagucuuc

SEQ ID NO: 28659 - RNA, 19 nt, Homo sapiens
guugcacauuccucuucug

SEQ ID NO: 28660 - RNA, 20 nt, Homo sapiens
uguaggguuaauguuccauu

SEQ ID NO: 28661 - RNA, 21 nt, Homo sapiens
uuaacaucguagauugaagcc

SEQ ID NO: 28662 - RNA, 15 nt, Homo sapiens
aaaccacagagcaua

SEQ ID NO: 28663 - RNA, 20 nt, Homo sapiens
aaaggaauuaucugugggcu

SEQ ID NO: 28664 - RNA, 17 nt, Homo sapiens
aaaucuaaauaaacgua

SEQ ID NO: 28665 - RNA, 20 nt, Homo sapiens
auauaaaguauuuguauaaa

SEQ ID NO: 28666 - RNA, 15 nt, Homo sapiens
auauauacagagggg

SEQ ID NO: 28667 - RNA, 17 nt, Homo sapiens
caagggagaaagaagca

SEQ ID NO: 28668 - RNA, 16 nt, Homo sapiens
cacaagaaacuggaag

SEQ ID NO: 28669 - RNA, 16 nt, Homo sapiens
caggagacuccauucc

SEQ ID NO: 28670 - RNA, 18 nt, Homo sapiens
caguauuuucuaacauaa

SEQ ID NO: 28671 - RNA, 19 nt, Homo sapiens
cugccuccuguaaaaagaa

SEQ ID NO: 28672 - RNA, 21 nt, Homo sapiens
gagauucacuguuagaaaagu

SEQ ID NO: 28673 - RNA, 18 nt, Homo sapiens
gcagccacaagaaacugg

SEQ ID NO: 28674 - RNA, 23 nt, Homo sapiens
ggcuuccuaaaagacauagccac

SEQ ID NO: 28675 - RNA, 16 nt, Homo sapiens
guaauguuaggauggg

SEQ ID NO: 28676 - RNA, 16 nt, Homo sapiens
guuacugcuauguccc

SEQ ID NO: 28677 - RNA, 17 nt, Homo sapiens
uacuuuuuuuggugaua

SEQ ID NO: 28678 - RNA, 22 nt, Homo sapiens
uagaaccuguuuucccugcuag

SEQ ID NO: 28679 - RNA, 18 nt, Homo sapiens
uaucuuaacuuuauugaa

SEQ ID NO: 28680 - RNA, 20 nt, Homo sapiens
ucaccucucccuuuagguga

SEQ ID NO: 28681 - RNA, 17 nt, Homo sapiens
uccuggaguaaucuggg

SEQ ID NO: 28682 - RNA, 23 nt, Homo sapiens
uccuugucauauaguggcaaaaa

SEQ ID NO: 28683 - RNA, 23 nt, Homo sapiens
ugggccuaaaagggacagagaca

SEQ ID NO: 28684 - RNA, 20 nt, Homo sapiens
ugucacuauauacuuuuuuu

SEQ ID NO: 28685 - RNA, 18 nt, Homo sapiens
ugugaaaaguugaauaaa

SEQ ID NO: 28686 - RNA, 25 nt, Homo sapiens
uguguauguguguuuucagaucgga

SEQ ID NO: 28687 - RNA, 23 nt, Homo sapiens
ugugugcaugugugugcauuugu

SEQ ID NO: 28688 - RNA, 19 nt, Homo sapiens
ugugugcauuuguguaugu

SEQ ID NO: 28689 - RNA, 23 nt, Homo sapiens
uguuacccuuuuugauuuuucua

SEQ ID NO: 28690 - RNA, 19 nt, Homo sapiens
uguuucacugguucucaga

SEQ ID NO: 28691 - RNA, 18 nt, Homo sapiens
ccaguguuaguaaagaag

SEQ ID NO: 28692 - RNA, 23 nt, Homo sapiens
gccgaggugugcuuuguccggcg

SEQ ID NO: 28693 - RNA, 21 nt, Homo sapiens
uaccaggcugggugagagagc

SEQ ID NO: 28694 - RNA, 20 nt, Homo sapiens
ucagggcgcaggccucggcc

SEQ ID NO: 28695 - RNA, 23 nt, Homo sapiens
ucagggcgcaggccucggccgag

SEQ ID NO: 28696 - RNA, 18 nt, Homo sapiens
ugcaggaugaacucguuc

SEQ ID NO: 28697 - RNA, 19 nt, Homo sapiens
uggcugcgggaggggucug

SEQ ID NO: 28698 - RNA, 22 nt, Homo sapiens
acgcuccgggaagggcacugcc

SEQ ID NO: 28699 - RNA, 18 nt, Homo sapiens
acacagaggcagggcuuu

SEQ ID NO: 28700 - RNA, 18 nt, Homo sapiens
agcccgcaugugcugcag

SEQ ID NO: 28701 - RNA, 21 nt, Homo sapiens
aggagugggggaggggaaggg

SEQ ID NO: 28702 - RNA, 21 nt, Homo sapiens
aggggaagggcccuucagggc

SEQ ID NO: 28703 - RNA, 19 nt, Homo sapiens
caccccacuagccacugcc

SEQ ID NO: 28704 - RNA, 20 nt, Homo sapiens
cccccgccccgccgccgccu

SEQ ID NO: 28705 - RNA, 16 nt, Homo sapiens
cccgccgcccgcgccc

SEQ ID NO: 28706 - RNA, 23 nt, Homo sapiens
ccgcccagggcggccgcgucucc

SEQ ID NO: 28707 - RNA, 15 nt, Homo sapiens
ccgccgcccgccgcc

SEQ ID NO: 28708 - RNA, 20 nt, Homo sapiens
ccgccgcccgcgcccgccca

SEQ ID NO: 28709 - RNA, 19 nt, Homo sapiens
ccgcuggccgggacgcgcc

SEQ ID NO: 28710 - RNA, 22 nt, Homo sapiens
ccgggcccggcucaggcccggc

SEQ ID NO: 28711 - RNA, 16 nt, Homo sapiens
cgggggaccugggugg

SEQ ID NO: 28712 - RNA, 18 nt, Homo sapiens
cugugaaauacgugaggc

SEQ ID NO: 28713 - RNA, 18 nt, Homo sapiens
gcccggcccccgggcgcc

SEQ ID NO: 28714 - RNA, 19 nt, Homo sapiens
gcccucaccgccgcccgcc

SEQ ID NO: 28715 - RNA, 17 nt, Homo sapiens
gcccuugcagaccugcc

SEQ ID NO: 28716 - RNA, 20 nt, Homo sapiens
gcgagugcaccccaccccgg

SEQ ID NO: 28717 - RNA, 18 nt, Homo sapiens
gggcuggcggguccuggc

SEQ ID NO: 28718 - RNA, 19 nt, Homo sapiens
ggggaaagaggugaugugc

SEQ ID NO: 28719 - RNA, 21 nt, Homo sapiens
ugacagugaccugccacccuu

SEQ ID NO: 28720 - RNA, 16 nt, Homo sapiens
ugggcccuugcagacc

SEQ ID NO: 28721 - RNA, 20 nt, Homo sapiens
accccuggucacauuccucc

SEQ ID NO: 28722 - RNA, 19 nt, Homo sapiens
cagcccaggcccuggcccu

SEQ ID NO: 28723 - RNA, 20 nt, Homo sapiens
cccagcccaggcccuggccc

SEQ ID NO: 28724 - RNA, 23 nt, Homo sapiens
cccgcgcccccgccgaccccugg

SEQ ID NO: 28725 - RNA, 21 nt, Homo sapiens
cccuggcccugagcggcuggg

SEQ ID NO: 28726 - RNA, 20 nt, Homo sapiens
ccuccucggcuccggccucg

SEQ ID NO: 28727 - RNA, 20 nt, Homo sapiens
uccgcacccggccuccucac

SEQ ID NO: 28728 - RNA, 16 nt, Homo sapiens
cagcaguauguaaaag

SEQ ID NO: 28729 - RNA, 21 nt, Homo sapiens
gguguaucuggauguuuuuca

SEQ ID NO: 28730 - RNA, 15 nt, Homo sapiens
acagggaccuaggag

SEQ ID NO: 28731 - RNA, 17 nt, Homo sapiens
aggagugccuaucucca

SEQ ID NO: 28732 - RNA, 18 nt, Homo sapiens
cccggccaccccgugccc

SEQ ID NO: 28733 - RNA, 19 nt, Homo sapiens
caaaaauuugaaaaggcgg

SEQ ID NO: 28734 - RNA, 25 nt, Homo sapiens
aagcaaccucagguucagacuggcc

SEQ ID NO: 28735 - RNA, 16 nt, Homo sapiens
aaugcuuucuugaaaa

SEQ ID NO: 28736 - RNA, 19 nt, Homo sapiens
acagcagggcugacagcac

SEQ ID NO: 28737 - RNA, 21 nt, Homo sapiens
ccgccgcggcucguagcucag

SEQ ID NO: 28738 - RNA, 15 nt, Homo sapiens
cuuuguccuccccag

SEQ ID NO: 28739 - RNA, 17 nt, Homo sapiens
gcuguagaaaaagacug

SEQ ID NO: 28740 - RNA, 21 nt, Homo sapiens
gggcauacaucucauuugcug

SEQ ID NO: 28741 - RNA, 24 nt, Homo sapiens
ucuccacuggcuguugcugaggcu

SEQ ID NO: 28742 - RNA, 21 nt, Homo sapiens
ugcuugugugggagagaagaa

SEQ ID NO: 28743 - RNA, 16 nt, Homo sapiens
ugguuguguuccaguc

SEQ ID NO: 28744 - RNA, 18 nt, Homo sapiens
uugcaggcucccagauua

SEQ ID NO: 28745 - RNA, 18 nt, Homo sapiens
aaauguauggguacccau

SEQ ID NO: 28746 - RNA, 22 nt, Homo sapiens
accuggggugggaaacaaguag

SEQ ID NO: 28747 - RNA, 18 nt, Homo sapiens
agagcugugccugcucaa

SEQ ID NO: 28748 - RNA, 25 nt, Homo sapiens
aggcacauuuugcaccuguuuuuca

SEQ ID NO: 28749 - RNA, 22 nt, Homo sapiens
aggcauugcuggacucauuuuu

SEQ ID NO: 28750 - RNA, 22 nt, Homo sapiens
agggaccucgacagagcugugc

SEQ ID NO: 28751 - RNA, 21 nt, Homo sapiens
caacagucaaguggagacugu

SEQ ID NO: 28752 - RNA, 16 nt, Homo sapiens
caagcuggcucuuggc

SEQ ID NO: 28753 - RNA, 21 nt, Homo sapiens
cagggguggccuccugggacg

SEQ ID NO: 28754 - RNA, 19 nt, Homo sapiens
ccccgcuucauucccuuug

SEQ ID NO: 28755 - RNA, 16 nt, Homo sapiens
ccgccuccuccccggu

SEQ ID NO: 28756 - RNA, 18 nt, Homo sapiens
cgagcuggcagcuggagc

SEQ ID NO: 28757 - RNA, 22 nt, Homo sapiens
gcaccuguuuuucaaaacagcc

SEQ ID NO: 28758 - RNA, 18 nt, Homo sapiens
gcagcauccccggcagcc

SEQ ID NO: 28759 - RNA, 18 nt, Homo sapiens
gccgacucagccagggac

SEQ ID NO: 28760 - RNA, 22 nt, Homo sapiens
gcgucggcacuauugguugagu

SEQ ID NO: 28761 - RNA, 15 nt, Homo sapiens
ggaggcugaccccgu

SEQ ID NO: 28762 - RNA, 22 nt, Homo sapiens
gggagggggguuuggggggcgg

SEQ ID NO: 28763 - RNA, 19 nt, Homo sapiens
ggggcucuuucuccucaag

SEQ ID NO: 28764 - RNA, 16 nt, Homo sapiens
gguggcggagaagcca

SEQ ID NO: 28765 - RNA, 20 nt, Homo sapiens
uagugugccgucaucggugg

SEQ ID NO: 28766 - RNA, 16 nt, Homo sapiens
ucggcagcuucggaag

SEQ ID NO: 28767 - RNA, 15 nt, Homo sapiens
ucucucgggagggcc

SEQ ID NO: 28768 - RNA, 23 nt, Homo sapiens
ucucucgggagggccucugguuc

SEQ ID NO: 28769 - RNA, 27 nt, Homo sapiens
ucuucagaggcauugcuggacucauuu

SEQ ID NO: 28770 - RNA, 20 nt, Homo sapiens
ugcaagcuggcucuuggcca

SEQ ID NO: 28771 - RNA, 19 nt, Homo sapiens
ugcugcgggcacugccccc

SEQ ID NO: 28772 - RNA, 19 nt, Homo sapiens
ugggaaggguguggguggc

SEQ ID NO: 28773 - RNA, 17 nt, Homo sapiens
ugggggcugggggcagg

SEQ ID NO: 28774 - RNA, 17 nt, Homo sapiens
uggggugggggcgggug

SEQ ID NO: 28775 - RNA, 21 nt, Homo sapiens
uggggugggggcgggugggcg

SEQ ID NO: 28776 - RNA, 19 nt, Homo sapiens
uugugagacugccuguucu

SEQ ID NO: 28777 - RNA, 18 nt, Homo sapiens
ccuggugugcagccgggc

SEQ ID NO: 28778 - RNA, 18 nt, Homo sapiens
gagccagugugugagggu

SEQ ID NO: 28779 - RNA, 17 nt, Homo sapiens
ggagggggguuuggggg

SEQ ID NO: 28780 - RNA, 18 nt, Homo sapiens
ucugagcagcccccggcc

SEQ ID NO: 28781 - RNA, 21 nt, Homo sapiens
uugaagcagccacguuuucgg

SEQ ID NO: 28782 - RNA, 22 nt, Homo sapiens
aggcgggagugggggugacagg

SEQ ID NO: 28783 - RNA, 15 nt, Homo sapiens
agggauguggcccca

SEQ ID NO: 28784 - RNA, 17 nt, Homo sapiens
ccaaaacccugaggcgg

SEQ ID NO: 28785 - RNA, 21 nt, Homo sapiens
ccuuauagugugugugggggg

SEQ ID NO: 28786 - RNA, 20 nt, Homo sapiens
gccaaccccccagcucgggg

SEQ ID NO: 28787 - RNA, 18 nt, Homo sapiens
gcgcgggggcgguggccg

SEQ ID NO: 28788 - RNA, 18 nt, Homo sapiens
gcguggggugcgcggggg

SEQ ID NO: 28789 - RNA, 21 nt, Homo sapiens
gcucccggcuggccagggccc

SEQ ID NO: 28790 - RNA, 19 nt, Homo sapiens
ggcguggggugcgcggggg

SEQ ID NO: 28791 - RNA, 22 nt, Homo sapiens
ggcguggggugcgcgggggcgg

SEQ ID NO: 28792 - RNA, 16 nt, Homo sapiens
gggcagacggggcugc

SEQ ID NO: 28793 - RNA, 18 nt, Homo sapiens
uauggcccaacugucagc

SEQ ID NO: 28794 - RNA, 18 nt, Homo sapiens
uggccagcccccucuucc

SEQ ID NO: 28795 - RNA, 18 nt, Homo sapiens
uggccgugugaccggugc

SEQ ID NO: 28796 - RNA, 19 nt, Homo sapiens
ugggggugacaggcguggc

SEQ ID NO: 28797 - RNA, 21 nt, Homo sapiens
uggggugggcccugggaccug

SEQ ID NO: 28798 - RNA, 18 nt, Homo sapiens
ugucagggacuguacucu

SEQ ID NO: 28799 - RNA, 16 nt, Homo sapiens
uuuuuuuuucuggaua

SEQ ID NO: 28800 - RNA, 18 nt, Homo sapiens
acauggugccacccauag

SEQ ID NO: 28801 - RNA, 23 nt, Homo sapiens
agaggauaaaagaugguuuacuu

SEQ ID NO: 28802 - RNA, 21 nt, Homo sapiens
cagcugcucaccacgcgcgcg

SEQ ID NO: 28803 - RNA, 19 nt, Homo sapiens
gaugauggagaaaaucaga

SEQ ID NO: 28804 - RNA, 20 nt, Homo sapiens
gcaggaagguggagguaacc

SEQ ID NO: 28805 - RNA, 21 nt, Homo sapiens
gcggaagcccuggagaacuuc

SEQ ID NO: 28806 - RNA, 17 nt, Homo sapiens
guacugacauuugcauu

SEQ ID NO: 28807 - RNA, 17 nt, Homo sapiens
uacuagauggaauacag

SEQ ID NO: 28808 - RNA, 20 nt, Homo sapiens
ugauuuuccacccuuucugu

SEQ ID NO: 28809 - RNA, 19 nt, Homo sapiens
uguuggggacagcaagaag

SEQ ID NO: 28810 - RNA, 22 nt, Homo sapiens
gccugcaguccuagcuacuugg

SEQ ID NO: 28811 - RNA, 26 nt, Homo sapiens
uuaaaacacauuguuucacauacaug

SEQ ID NO: 28812 - RNA, 18 nt, Homo sapiens
acacagcagguccuggcu

SEQ ID NO: 28813 - RNA, 22 nt, Homo sapiens
accauuuuccaccuccagcucc

SEQ ID NO: 28814 - RNA, 23 nt, Homo sapiens
agggaccaccaccugcuuggggc

SEQ ID NO: 28815 - RNA, 18 nt, Homo sapiens
auccacagaguaggagga

SEQ ID NO: 28816 - RNA, 18 nt, Homo sapiens
cacacuuagcugugcagg

SEQ ID NO: 28817 - RNA, 18 nt, Homo sapiens
cagaugagguugucccag

SEQ ID NO: 28818 - RNA, 19 nt, Homo sapiens
cagcaccccagagcagggc

SEQ ID NO: 28819 - RNA, 20 nt, Homo sapiens
cagcaugcccugggaaaagu

SEQ ID NO: 28820 - RNA, 17 nt, Homo sapiens
cagguccaguuucaggg

SEQ ID NO: 28821 - RNA, 22 nt, Homo sapiens
caugcccugggaaaagugaggg

SEQ ID NO: 28822 - RNA, 20 nt, Homo sapiens
ccuccagcuccaggacgguc

SEQ ID NO: 28823 - RNA, 20 nt, Homo sapiens
ccugcugccuccuucuuccc

SEQ ID NO: 28824 - RNA, 17 nt, Homo sapiens
cuccagcuggggccugg

SEQ ID NO: 28825 - RNA, 19 nt, Homo sapiens
cugcaccucacucucucua

SEQ ID NO: 28826 - RNA, 21 nt, Homo sapiens
cugcagauggggugagucugg

SEQ ID NO: 28827 - RNA, 21 nt, Homo sapiens
gcaccucggugggcccagcug

SEQ ID NO: 28828 - RNA, 21 nt, Homo sapiens
gcagcuggaugcugggaccag

SEQ ID NO: 28829 - RNA, 19 nt, Homo sapiens
ggagcuccuuuggguggcc

SEQ ID NO: 28830 - RNA, 18 nt, Homo sapiens
ggauggaguuuguggcuu

SEQ ID NO: 28831 - RNA, 22 nt, Homo sapiens
ggccacuugcagucccuggggc

SEQ ID NO: 28832 - RNA, 18 nt, Homo sapiens
ggccuggggaccagagga

SEQ ID NO: 28833 - RNA, 20 nt, Homo sapiens
gggccuggggcugagggcug

SEQ ID NO: 28834 - RNA, 22 nt, Homo sapiens
gggccuggggcugagggcuggg

SEQ ID NO: 28835 - RNA, 17 nt, Homo sapiens
guagaccucccggacuc

SEQ ID NO: 28836 - RNA, 22 nt, Homo sapiens
gucuucuggaacauaggucucc

SEQ ID NO: 28837 - RNA, 18 nt, Homo sapiens
gugguggguggucaccag

SEQ ID NO: 28838 - RNA, 19 nt, Homo sapiens
uccccagguccccaagucu

SEQ ID NO: 28839 - RNA, 24 nt, Homo sapiens
ugagaccauuguggaaggggguuc

SEQ ID NO: 28840 - RNA, 17 nt, Homo sapiens
ugcagauggggugaguc

SEQ ID NO: 28841 - RNA, 14 nt, Homo sapiens
uucaugcgccaugu

SEQ ID NO: 28842 - RNA, 19 nt, Homo sapiens
uuccugaugcugacaaagc

SEQ ID NO: 28843 - RNA, 16 nt, Homo sapiens
agcaggccauguuugg

SEQ ID NO: 28844 - RNA, 20 nt, Homo sapiens
aggcggagcuccuuugggug

SEQ ID NO: 28845 - RNA, 18 nt, Homo sapiens
cuugcagucccuggggcu

SEQ ID NO: 28846 - RNA, 19 nt, Homo sapiens
gacuaauuuugccauacug

SEQ ID NO: 28847 - RNA, 27 nt, Homo sapiens
gagggcuggggcggagccucagggcug

SEQ ID NO: 28848 - RNA, 23 nt, Homo sapiens
gcucaggcuguuuugcggacgcc

SEQ ID NO: 28849 - RNA, 18 nt, Homo sapiens
gugguggguggucaccag

SEQ ID NO: 28850 - RNA, 16 nt, Homo sapiens
ucaccucgauuuccag

SEQ ID NO: 28851 - RNA, 21 nt, Homo sapiens
uccaugcuggggccagcgcug

SEQ ID NO: 28852 - RNA, 16 nt, Homo sapiens
ucgcuaugcacugagc

SEQ ID NO: 28853 - RNA, 25 nt, Homo sapiens
ugacuugcuguuguuagcagcccua

SEQ ID NO: 28854 - RNA, 16 nt, Homo sapiens
uuugccauaguagaca

SEQ ID NO: 28855 - RNA, 22 nt, Homo sapiens
ccauauuauucugggcuugucu

SEQ ID NO: 28856 - RNA, 19 nt, Homo sapiens
acacaauccuuuguaguuu

SEQ ID NO: 28857 - RNA, 18 nt, Homo sapiens
acuguggcguguggcuca

SEQ ID NO: 28858 - RNA, 18 nt, Homo sapiens
caaaacccugguuauaca

SEQ ID NO: 28859 - RNA, 19 nt, Homo sapiens
cagcuaccugguaggcuau

SEQ ID NO: 28860 - RNA, 17 nt, Homo sapiens
cuucgugaacuagacac

SEQ ID NO: 28861 - RNA, 17 nt, Homo sapiens
gcaauggaacggccgcu

SEQ ID NO: 28862 - RNA, 20 nt, Homo sapiens
gcucccggccaugcaccucc

SEQ ID NO: 28863 - RNA, 17 nt, Homo sapiens
gcugacuguggcgugug

SEQ ID NO: 28864 - RNA, 17 nt, Homo sapiens
gggccagguucccagag

SEQ ID NO: 28865 - RNA, 19 nt, Homo sapiens
gugcuucuucaugugcacc

SEQ ID NO: 28866 - RNA, 22 nt, Homo sapiens
uacauauguauuuauauauaga

SEQ ID NO: 28867 - RNA, 20 nt, Homo sapiens
ucugcaauuauguaacccug

SEQ ID NO: 28868 - RNA, 19 nt, Homo sapiens
ugcccuuucaaaauaacag

SEQ ID NO: 28869 - RNA, 15 nt, Homo sapiens
uggcccgagagagag

SEQ ID NO: 28870 - RNA, 22 nt, Homo sapiens
uguggacagcugaauccuuauu

SEQ ID NO: 28871 - RNA, 19 nt, Homo sapiens
uucaucuuuuauuuauagu

SEQ ID NO: 28872 - RNA, 18 nt, Homo sapiens
uucaugugcagcuucaug

SEQ ID NO: 28873 - RNA, 19 nt, Homo sapiens
ccgccucucgccgcccacu

SEQ ID NO: 28874 - RNA, 23 nt, Homo sapiens
cgccgcccacuugcuuccgcgcu

SEQ ID NO: 28875 - RNA, 20 nt, Homo sapiens
auccugcugucaagaguaga

SEQ ID NO: 28876 - RNA, 16 nt, Homo sapiens
caacauccaauccugc

SEQ ID NO: 28877 - RNA, 20 nt, Homo sapiens
aagcgagaaaacgcaggagg

SEQ ID NO: 28878 - RNA, 19 nt, Homo sapiens
agugggaguggaggauggc

SEQ ID NO: 28879 - RNA, 18 nt, Homo sapiens
cuuuagaaagcccaggag

SEQ ID NO: 28880 - RNA, 20 nt, Homo sapiens
gaggauggcuucccgcagcc

SEQ ID NO: 28881 - RNA, 21 nt, Homo sapiens
ugcgcagaccgacucggcggc

SEQ ID NO: 28882 - RNA, 22 nt, Homo sapiens
agaggcagccuuggggauaucu

SEQ ID NO: 28883 - RNA, 20 nt, Homo sapiens
agugggacaaacauaggaug

SEQ ID NO: 28884 - RNA, 19 nt, Homo sapiens
ccuguuuuuguuuguuucc

SEQ ID NO: 28885 - RNA, 20 nt, Homo sapiens
uaggauggauauuacuauuc

SEQ ID NO: 28886 - RNA, 19 nt, Homo sapiens
ugggguugcacucucacug

SEQ ID NO: 28887 - RNA, 18 nt, Homo sapiens
uuggagaaucaugcaugu

SEQ ID NO: 28888 - RNA, 17 nt, Homo sapiens
cuuuccuuuuccccuca

SEQ ID NO: 28889 - RNA, 20 nt, Homo sapiens
gucuuucuuaaugguacgag

SEQ ID NO: 28890 - RNA, 20 nt, Homo sapiens
uaacauauuauauaauauau

SEQ ID NO: 28891 - RNA, 19 nt, Homo sapiens
cagcauggaguaacaucca

SEQ ID NO: 28892 - RNA, 19 nt, Homo sapiens
ccauccuccucgcucgccc

SEQ ID NO: 28893 - RNA, 20 nt, Homo sapiens
gucaaucaaugauucauuag

SEQ ID NO: 28894 - RNA, 19 nt, Homo sapiens
gugcauuuaguucagcagc

SEQ ID NO: 28895 - RNA, 20 nt, Homo sapiens
guuaguuuuguggaucugca

SEQ ID NO: 28896 - RNA, 18 nt, Homo sapiens
uaugauauaauaaauaca

SEQ ID NO: 28897 - RNA, 23 nt, Homo sapiens
ucacuuugccaguuuuuuuuuuc

SEQ ID NO: 28898 - RNA, 20 nt, Homo sapiens
ucugcaacuuucaggaauga

SEQ ID NO: 28899 - RNA, 25 nt, Homo sapiens
uucacuuugccaguuuuuuuuuuca

SEQ ID NO: 28900 - RNA, 18 nt, Homo sapiens
uuguauauacauauauag

SEQ ID NO: 28901 - RNA, 18 nt, Homo sapiens
uuuuguggaucugcaacu

SEQ ID NO: 28902 - RNA, 19 nt, Homo sapiens
gggguggggcgggaaacgg

SEQ ID NO: 28903 - RNA, 18 nt, Homo sapiens
ucaccaccagccugcaug

SEQ ID NO: 28904 - RNA, 21 nt, Homo sapiens
auuauuuaaaucaguuuuauu

SEQ ID NO: 28905 - RNA, 19 nt, Homo sapiens
caccaccaagucucugcac

SEQ ID NO: 28906 - RNA, 29 nt, Homo sapiens
uaaaauuccuuuagcucuuccuuuuucua

SEQ ID NO: 28907 - RNA, 16 nt, Homo sapiens
ucaccaaagccacagg

SEQ ID NO: 28908 - RNA, 18 nt, Homo sapiens
auauacauauauauauau

SEQ ID NO: 28909 - RNA, 14 nt, Homo sapiens
ccgguccagacguc

SEQ ID NO: 28910 - RNA, 19 nt, Homo sapiens
cucccgcccgccgccucgg

SEQ ID NO: 28911 - RNA, 23 nt, Homo sapiens
gacagcuaggugggcaguggugc

SEQ ID NO: 28912 - RNA, 20 nt, Homo sapiens
gacuugugauucauuuucuu

SEQ ID NO: 28913 - RNA, 17 nt, Homo sapiens
gagggccggcugcgcug

SEQ ID NO: 28914 - RNA, 21 nt, Homo sapiens
gccgccucggcgucccggcug

SEQ ID NO: 28915 - RNA, 17 nt, Homo sapiens
ggaaauaaaaaauaaca

SEQ ID NO: 28916 - RNA, 18 nt, Homo sapiens
ggccggcugcgcuggugc

SEQ ID NO: 28917 - RNA, 21 nt, Homo sapiens
gggguccuggcugucaggcgc

SEQ ID NO: 28918 - RNA, 21 nt, Homo sapiens
uacaaaaugugcaguaccagg

SEQ ID NO: 28919 - RNA, 17 nt, Homo sapiens
uagaaaagucgguucag

SEQ ID NO: 28920 - RNA, 22 nt, Homo sapiens
uauagauauacauauauauaua

SEQ ID NO: 28921 - RNA, 23 nt, Homo sapiens
uauagauauacauauauauauau

SEQ ID NO: 28922 - RNA, 18 nt, Homo sapiens
ucaauucugaaaaguagc

SEQ ID NO: 28923 - RNA, 18 nt, Homo sapiens
ugaaaaccggcacgaaaa

SEQ ID NO: 28924 - RNA, 17 nt, Homo sapiens
ugcuagcggcgcgccgg

SEQ ID NO: 28925 - RNA, 18 nt, Homo sapiens
uggaaauaaaaaauaaca

SEQ ID NO: 28926 - RNA, 18 nt, Homo sapiens
ucacaaggagcugugaau

SEQ ID NO: 28927 - RNA, 20 nt, Homo sapiens
gcggcucuuccucuccucuc

SEQ ID NO: 28928 - RNA, 21 nt, Homo sapiens
gcgguggggccuggggggagg

SEQ ID NO: 28929 - RNA, 16 nt, Homo sapiens
ucucucacaguccugg

SEQ ID NO: 28930 - RNA, 21 nt, Homo sapiens
uguagagaugggggggggggc

SEQ ID NO: 28931 - RNA, 20 nt, Homo sapiens
cagugccugggucccugcua

SEQ ID NO: 28932 - RNA, 21 nt, Homo sapiens
cuggcuaaaccccuccacgua

SEQ ID NO: 28933 - RNA, 18 nt, Homo sapiens
cuugaaagauuucacaca

SEQ ID NO: 28934 - RNA, 19 nt, Homo sapiens
aaaguggaagacuccaugg

SEQ ID NO: 28935 - RNA, 17 nt, Homo sapiens
caguaccccgccauccc

SEQ ID NO: 28936 - RNA, 21 nt, Homo sapiens
cgaggcuacagagccauggcc

SEQ ID NO: 28937 - RNA, 18 nt, Homo sapiens
gccuuuagccucccuccc

SEQ ID NO: 28938 - RNA, 19 nt, Homo sapiens
ggugagcgcggagacgggc

SEQ ID NO: 28939 - RNA, 22 nt, Homo sapiens
uagcguagugucccaaggucac

SEQ ID NO: 28940 - RNA, 20 nt, Homo sapiens
ucccacuggccugcucaucu

SEQ ID NO: 28941 - RNA, 18 nt, Homo sapiens
ucccagcugcuucccugu

SEQ ID NO: 28942 - RNA, 19 nt, Homo sapiens
aagaccauuacacacagcu

SEQ ID NO: 28943 - RNA, 18 nt, Homo sapiens
agaccacuguggggguca

SEQ ID NO: 28944 - RNA, 21 nt, Homo sapiens
cauuccaugggauaucgaggg

SEQ ID NO: 28945 - RNA, 19 nt, Homo sapiens
ccacccagaggaaucccag

SEQ ID NO: 28946 - RNA, 15 nt, Homo sapiens
ccaccccccacagag

SEQ ID NO: 28947 - RNA, 18 nt, Homo sapiens
cuggaugccuccaccugc

SEQ ID NO: 28948 - RNA, 17 nt, Homo sapiens
cuguucccuuuccuggc

SEQ ID NO: 28949 - RNA, 23 nt, Homo sapiens
gcagcaagagagguggggugguc

SEQ ID NO: 28950 - RNA, 18 nt, Homo sapiens
gcaggccugagcuuccuc

SEQ ID NO: 28951 - RNA, 17 nt, Homo sapiens
gcugaaaaccucucuga

SEQ ID NO: 28952 - RNA, 18 nt, Homo sapiens
ggcuucuuagcagagaug

SEQ ID NO: 28953 - RNA, 18 nt, Homo sapiens
ggugguccuggcacgugg

SEQ ID NO: 28954 - RNA, 16 nt, Homo sapiens
ucaccaaagccacugg

SEQ ID NO: 28955 - RNA, 20 nt, Homo sapiens
uccacaucaggugugggcug

SEQ ID NO: 28956 - RNA, 21 nt, Homo sapiens
ugggccaaauggagauauugu

SEQ ID NO: 28957 - RNA, 19 nt, Homo sapiens
acggagccggaggcggagg

SEQ ID NO: 28958 - RNA, 18 nt, Homo sapiens
agcuagcucuuccuccag

SEQ ID NO: 28959 - RNA, 24 nt, Homo sapiens
cacaugggccuugaaggaugcggc

SEQ ID NO: 28960 - RNA, 16 nt, Homo sapiens
ccucagggccaagagg

SEQ ID NO: 28961 - RNA, 18 nt, Homo sapiens
gagggggccacagggcac

SEQ ID NO: 28962 - RNA, 17 nt, Homo sapiens
ggccgggggcggagggg

SEQ ID NO: 28963 - RNA, 19 nt, Homo sapiens
ggccuugaaggaugcggcc

SEQ ID NO: 28964 - RNA, 19 nt, Homo sapiens
ggguccugcacagugggcc

SEQ ID NO: 28965 - RNA, 21 nt, Homo sapiens
ggucugagaaacgcacagccc

SEQ ID NO: 28966 - RNA, 19 nt, Homo sapiens
acagcuuauuuuuuuuucu

SEQ ID NO: 28967 - RNA, 16 nt, Homo sapiens
acugguuagaacaaca

SEQ ID NO: 28968 - RNA, 28 nt, Homo sapiens
cauaguaacaacauuuguuagcacggcc

SEQ ID NO: 28969 - RNA, 19 nt, Homo sapiens
ccaccagaaaauaagaaaa

SEQ ID NO: 28970 - RNA, 26 nt, Homo sapiens
cucccuacacgucccucucugccugu

SEQ ID NO: 28971 - RNA, 19 nt, Homo sapiens
gauggcccgggaaauucuc

SEQ ID NO: 28972 - RNA, 18 nt, Homo sapiens
gcacagcaauuguagcac

SEQ ID NO: 28973 - RNA, 18 nt, Homo sapiens
gcgggcuucgcugggggc

SEQ ID NO: 28974 - RNA, 22 nt, Homo sapiens
uaaagcaccaacagggcucuuc

SEQ ID NO: 28975 - RNA, 19 nt, Homo sapiens
uaucccagguccuugggcu

SEQ ID NO: 28976 - RNA, 17 nt, Homo sapiens
ucaaguuucauacagcc

SEQ ID NO: 28977 - RNA, 16 nt, Homo sapiens
ugaccuugaacacaga

SEQ ID NO: 28978 - RNA, 18 nt, Homo sapiens
ugagaaagcuccuggcau

SEQ ID NO: 28979 - RNA, 21 nt, Homo sapiens
uuuagcuaccuuaaaguuugg

SEQ ID NO: 28980 - RNA, 19 nt, Homo sapiens
agccccggguagggcugcu

SEQ ID NO: 28981 - RNA, 19 nt, Homo sapiens
aguggcggccagcaggggc

SEQ ID NO: 28982 - RNA, 22 nt, Homo sapiens
ccagccccaugggccgcgugcc

SEQ ID NO: 28983 - RNA, 26 nt, Homo sapiens
cggguagggcugcuggccggaggcug

SEQ ID NO: 28984 - RNA, 20 nt, Homo sapiens
gccccggguagggcugcugg

SEQ ID NO: 28985 - RNA, 22 nt, Homo sapiens
uccagcagcagcacgacguggc

SEQ ID NO: 28986 - RNA, 20 nt, Homo sapiens
uugaaaggagagcccggaga

SEQ ID NO: 28987 - RNA, 19 nt, Homo sapiens
aaaaugaggugccaugcua

SEQ ID NO: 28988 - RNA, 23 nt, Homo sapiens
cauagucucugaguuuuuuuucu

SEQ ID NO: 28989 - RNA, 24 nt, Homo sapiens
ccuuuuuaaaguugucauuugaca

SEQ ID NO: 28990 - RNA, 18 nt, Homo sapiens
uucauagucucugaguuu

SEQ ID NO: 28991 - RNA, 22 nt, Homo sapiens
acaggguuucaccagguuggcc

SEQ ID NO: 28992 - RNA, 20 nt, Homo sapiens
acaggugugcgccaccaugc

SEQ ID NO: 28993 - RNA, 16 nt, Homo sapiens
ccugagccaccaagcc

SEQ ID NO: 28994 - RNA, 16 nt, Homo sapiens
cuuugauucucuuggc

SEQ ID NO: 28995 - RNA, 22 nt, Homo sapiens
gaagaaagaaaggcugggaaua

SEQ ID NO: 28996 - RNA, 19 nt, Homo sapiens
gauuacaggugugcgccac

SEQ ID NO: 28997 - RNA, 18 nt, Homo sapiens
uagcuugcucuaaguucc

SEQ ID NO: 28998 - RNA, 21 nt, Homo sapiens
auuugauuucacagaaauuuu

SEQ ID NO: 28999 - RNA, 18 nt, Homo sapiens
uaagacauagcucucuau

SEQ ID NO: 29000 - RNA, 20 nt, Homo sapiens
uacugaguauguacuaaugu

SEQ ID NO: 29001 - RNA, 18 nt, Homo sapiens
uauguaugcauagauaua

SEQ ID NO: 29002 - RNA, 22 nt, Homo sapiens
uuaaacuacaacauaaucccag

SEQ ID NO: 29003 - RNA, 17 nt, Homo sapiens
aaaugugugacuaugua

SEQ ID NO: 29004 - RNA, 20 nt, Homo sapiens
agaaugcauuguagaaguag

SEQ ID NO: 29005 - RNA, 21 nt, Homo sapiens
caucaagugcaguacauuaga

SEQ ID NO: 29006 - RNA, 22 nt, Homo sapiens
cauuccauagcaguaucuuuac

SEQ ID NO: 29007 - RNA, 18 nt, Homo sapiens
gagauugguuaaaaagua

SEQ ID NO: 29008 - RNA, 21 nt, Homo sapiens
gcauuguagaaguaggcaggc

SEQ ID NO: 29009 - RNA, 21 nt, Homo sapiens
gcgugaaccugggaggcggag

SEQ ID NO: 29010 - RNA, 20 nt, Homo sapiens
ggggaaaaaagaucaaugca

SEQ ID NO: 29011 - RNA, 22 nt, Homo sapiens
uaacugguuuccuaucuacuga

SEQ ID NO: 29012 - RNA, 21 nt, Homo sapiens
uaacuguaaaaucucuguucu

SEQ ID NO: 29013 - RNA, 20 nt, Homo sapiens
uccuuggucaacuucuccua

SEQ ID NO: 29014 - RNA, 20 nt, Homo sapiens
ugcagaaaauacaauguauc

SEQ ID NO: 29015 - RNA, 24 nt, Homo sapiens
uguaaaauuauuaaagucuuagug

SEQ ID NO: 29016 - RNA, 20 nt, Homo sapiens
uucaaauccaauucuaaagu

SEQ ID NO: 29017 - RNA, 17 nt, Homo sapiens
uugggaggccgaggcgg

SEQ ID NO: 29018 - RNA, 17 nt, Homo sapiens
uuuugguaagcacaaaa

SEQ ID NO: 29019 - RNA, 15 nt, Homo sapiens
aagccgagaaggugg

SEQ ID NO: 29020 - RNA, 15 nt, Homo sapiens
agcccagcaggaaga

SEQ ID NO: 29021 - RNA, 20 nt, Homo sapiens
agcuucaagauauauagaaa

SEQ ID NO: 29022 - RNA, 20 nt, Homo sapiens
cagagccacgggaacaagcc

SEQ ID NO: 29023 - RNA, 25 nt, Homo sapiens
caggagcccaggaucaugucugguu

SEQ ID NO: 29024 - RNA, 19 nt, Homo sapiens
ccugaauuugagccaguag

SEQ ID NO: 29025 - RNA, 17 nt, Homo sapiens
ccugcucccucugcggc

SEQ ID NO: 29026 - RNA, 24 nt, Homo sapiens
cggggccgcggggcgcagggccga

SEQ ID NO: 29027 - RNA, 16 nt, Homo sapiens
cggucgggcagaucuu

SEQ ID NO: 29028 - RNA, 18 nt, Homo sapiens
ggagaaagugcguuacgg

SEQ ID NO: 29029 - RNA, 21 nt, Homo sapiens
ggaggccgcgcggaggcugcg

SEQ ID NO: 29030 - RNA, 20 nt, Homo sapiens
ggccuggaugcaggagucug

SEQ ID NO: 29031 - RNA, 19 nt, Homo sapiens
ggggaggcgacgcggaggg

SEQ ID NO: 29032 - RNA, 21 nt, Homo sapiens
guaggaauucacaauuaguga

SEQ ID NO: 29033 - RNA, 18 nt, Homo sapiens
guccuacaauucuuggga

SEQ ID NO: 29034 - RNA, 18 nt, Homo sapiens
uaugaagauuuccuacaa

SEQ ID NO: 29035 - RNA, 19 nt, Homo sapiens
ucaaaugguuuaccagugc

SEQ ID NO: 29036 - RNA, 18 nt, Homo sapiens
ucccugccgugaccuuuc

SEQ ID NO: 29037 - RNA, 19 nt, Homo sapiens
uccggggaaaguggcgggg

SEQ ID NO: 29038 - RNA, 21 nt, Homo sapiens
ucgcugcugugaccaggccuc

SEQ ID NO: 29039 - RNA, 24 nt, Homo sapiens
ugaaagaaaaaaaacuagaaacau

SEQ ID NO: 29040 - RNA, 17 nt, Homo sapiens
uuuccacagccagcguu

SEQ ID NO: 29041 - RNA, 19 nt, Homo sapiens
accacccacccauccagcc

SEQ ID NO: 29042 - RNA, 18 nt, Homo sapiens
cgcccggccgucgccgcc

SEQ ID NO: 29043 - RNA, 22 nt, Homo sapiens
cagauggauucuuccucauuuc

SEQ ID NO: 29044 - RNA, 15 nt, Homo sapiens
ccucuccccucaacu

SEQ ID NO: 29045 - RNA, 19 nt, Homo sapiens
ggagagggagcuugggggc

SEQ ID NO: 29046 - RNA, 17 nt, Homo sapiens
uaagaaaagaagaauac

SEQ ID NO: 29047 - RNA, 20 nt, Homo sapiens
ugauagggagguaaugaacu

SEQ ID NO: 29048 - RNA, 21 nt, Homo sapiens
uucucuuuucuguuuccuaca

SEQ ID NO: 29049 - RNA, 16 nt, Homo sapiens
agaaggcggaggccgg

SEQ ID NO: 29050 - RNA, 21 nt, Homo sapiens
ggggccuguggcucugguucc

SEQ ID NO: 29051 - RNA, 19 nt, Homo sapiens
cggcugucucggcuccggc

SEQ ID NO: 29052 - RNA, 18 nt, Homo sapiens
gaggcggcggaggcugag

SEQ ID NO: 29053 - RNA, 26 nt, Homo sapiens
gggccugacucccgggguuggcgccg

SEQ ID NO: 29054 - RNA, 22 nt, Homo sapiens
agugaagacccauauaaaaggc

SEQ ID NO: 29055 - RNA, 18 nt, Homo sapiens
cacuggugcaguugguga

SEQ ID NO: 29056 - RNA, 21 nt, Homo sapiens
ucccuguuguuaucagcacca

SEQ ID NO: 29057 - RNA, 21 nt, Homo sapiens
cuacuccuacaguguuucugg

SEQ ID NO: 29058 - RNA, 18 nt, Homo sapiens
gagcuccuggcgugagug

SEQ ID NO: 29059 - RNA, 19 nt, Homo sapiens
guguauuuaucucugcuuu

SEQ ID NO: 29060 - RNA, 15 nt, Homo sapiens
uccaggggaaggagg

SEQ ID NO: 29061 - RNA, 22 nt, Homo sapiens
ucucugcuuuucuugcugucuc

SEQ ID NO: 29062 - RNA, 19 nt, Homo sapiens
ucugcuuuucuugcugucu

SEQ ID NO: 29063 - RNA, 21 nt, Homo sapiens
ugaucaaaaauauacaacuuc

SEQ ID NO: 29064 - RNA, 18 nt, Homo sapiens
uuaaagucagaaacuuua

SEQ ID NO: 29065 - RNA, 19 nt, Homo sapiens
uaaaaugcuacaaaacuau

SEQ ID NO: 29066 - RNA, 28 nt, Homo sapiens
aaugauacugugugucucaaagaauacg

SEQ ID NO: 29067 - RNA, 17 nt, Homo sapiens
acauuaugaacaccagg

SEQ ID NO: 29068 - RNA, 19 nt, Homo sapiens
agaaggagaaacaugaaga

SEQ ID NO: 29069 - RNA, 21 nt, Homo sapiens
augcauuauggaaaaaguagu

SEQ ID NO: 29070 - RNA, 18 nt, Homo sapiens
cgacguccgcuccucccg

SEQ ID NO: 29071 - RNA, 20 nt, Homo sapiens
gaaguuugaaaagcuuuggg

SEQ ID NO: 29072 - RNA, 19 nt, Homo sapiens
uacauauuuuauaugugcu

SEQ ID NO: 29073 - RNA, 18 nt, Homo sapiens
uagugaccucauuagaag

SEQ ID NO: 29074 - RNA, 19 nt, Homo sapiens
ucccucucaaauaguauau

SEQ ID NO: 29075 - RNA, 23 nt, Homo sapiens
ugacaagauaaugagaaauauuu

SEQ ID NO: 29076 - RNA, 17 nt, Homo sapiens
agggcugcugggagagc

SEQ ID NO: 29077 - RNA, 19 nt, Homo sapiens
gauuacaggagugugccac

SEQ ID NO: 29078 - RNA, 22 nt, Homo sapiens
gcugcuucugcugcagccucag

SEQ ID NO: 29079 - RNA, 23 nt, Homo sapiens
ggagcuuucguuccucuccuggu

SEQ ID NO: 29080 - RNA, 20 nt, Homo sapiens
aacggccugcgugggcacac

SEQ ID NO: 29081 - RNA, 19 nt, Homo sapiens
cggcuccggguccauuggc

SEQ ID NO: 29082 - RNA, 18 nt, Homo sapiens
gugggcacacgugccacu

SEQ ID NO: 29083 - RNA, 23 nt, Homo sapiens
acaccggggcccgagguggugga

SEQ ID NO: 29084 - RNA, 20 nt, Homo sapiens
acaggaguggggaccuggga

SEQ ID NO: 29085 - RNA, 19 nt, Homo sapiens
aggagaugguagaggugga

SEQ ID NO: 29086 - RNA, 16 nt, Homo sapiens
ccccgcuccccggccc

SEQ ID NO: 29087 - RNA, 14 nt, Homo sapiens
cccguccccgcucc

SEQ ID NO: 29088 - RNA, 21 nt, Homo sapiens
ccgccuccgccuccuccugcc

SEQ ID NO: 29089 - RNA, 19 nt, Homo sapiens
ccgccuccuccugccugcc

SEQ ID NO: 29090 - RNA, 18 nt, Homo sapiens
ccuccgccuccuccugcc

SEQ ID NO: 29091 - RNA, 16 nt, Homo sapiens
cgcuggggcgggcgcc

SEQ ID NO: 29092 - RNA, 15 nt, Homo sapiens
cuggggcuguuggga

SEQ ID NO: 29093 - RNA, 16 nt, Homo sapiens
gagaaguuucagggac

SEQ ID NO: 29094 - RNA, 21 nt, Homo sapiens
gcccgaggugguggagaaaga

SEQ ID NO: 29095 - RNA, 16 nt, Homo sapiens
ggacaccggggcccga

SEQ ID NO: 29096 - RNA, 16 nt, Homo sapiens
gggaccugggagcugg

SEQ ID NO: 29097 - RNA, 17 nt, Homo sapiens
uagccaacaaugcaugu

SEQ ID NO: 29098 - RNA, 17 nt, Homo sapiens
ucgucccccccgccucg

SEQ ID NO: 29099 - RNA, 24 nt, Homo sapiens
uuuggaggaauauuuuuaguuugu

SEQ ID NO: 29100 - RNA, 18 nt, Homo sapiens
cccugcccugccuccucc

SEQ ID NO: 29101 - RNA, 16 nt, Homo sapiens
gccggagccgcacugc

SEQ ID NO: 29102 - RNA, 17 nt, Homo sapiens
ggaagcugagagaagac

SEQ ID NO: 29103 - RNA, 22 nt, Homo sapiens
uaggcacucccuuucaauccag

SEQ ID NO: 29104 - RNA, 21 nt, Homo sapiens
agcuggcgggcgggccggggc

SEQ ID NO: 29105 - RNA, 17 nt, Homo sapiens
auggauuuagggcugug

SEQ ID NO: 29106 - RNA, 21 nt, Homo sapiens
cgacgcgccgccgcagcuggc

SEQ ID NO: 29107 - RNA, 16 nt, Homo sapiens
cggacgaguggaagga

SEQ ID NO: 29108 - RNA, 20 nt, Homo sapiens
gaggaaggagacgaaaggga

SEQ ID NO: 29109 - RNA, 21 nt, Homo sapiens
gagggcgccgugcaaaauaaa

SEQ ID NO: 29110 - RNA, 17 nt, Homo sapiens
ggaggcaggaggcugcg

SEQ ID NO: 29111 - RNA, 22 nt, Homo sapiens
ugucuuuuuauuccuccccaga

SEQ ID NO: 29112 - RNA, 23 nt, Homo sapiens
aagaggauuuucccuggaaauuc

SEQ ID NO: 29113 - RNA, 23 nt, Homo sapiens
caugugguuaugcagagauuaua

SEQ ID NO: 29114 - RNA, 20 nt, Homo sapiens
ccaugaguggauacugcuga

SEQ ID NO: 29115 - RNA, 16 nt, Homo sapiens
gcaacaauguucaccu

SEQ ID NO: 29116 - RNA, 21 nt, Homo sapiens
gguucugaaaagaagcuccuc

SEQ ID NO: 29117 - RNA, 17 nt, Homo sapiens
gucccuaacauuuaaaa

SEQ ID NO: 29118 - RNA, 20 nt, Homo sapiens
uguuuugguuuguguccaaa

SEQ ID NO: 29119 - RNA, 25 nt, Homo sapiens
uuccaagucaugugguuaugacugc

SEQ ID NO: 29120 - RNA, 19 nt, Homo sapiens
ccuuuaguaaaaauguguu

SEQ ID NO: 29121 - RNA, 16 nt, Homo sapiens
gcuuugauuugauugu

SEQ ID NO: 29122 - RNA, 24 nt, Homo sapiens
uggaaaccuauuaacaugccuucc

SEQ ID NO: 29123 - RNA, 18 nt, Homo sapiens
aacacugccucccuucug

SEQ ID NO: 29124 - RNA, 17 nt, Homo sapiens
auccuucuauaauacca

SEQ ID NO: 29125 - RNA, 19 nt, Homo sapiens
ccgcgcuccgcccgcaucc

SEQ ID NO: 29126 - RNA, 21 nt, Homo sapiens
cgcggagggcgccaacgcggc

SEQ ID NO: 29127 - RNA, 21 nt, Homo sapiens
cuucuuggauauuauaacaua

SEQ ID NO: 29128 - RNA, 20 nt, Homo sapiens
gcuccggggacggcggcggc

SEQ ID NO: 29129 - RNA, 18 nt, Homo sapiens
uaaaaaaaauucggagau

SEQ ID NO: 29130 - RNA, 19 nt, Homo sapiens
uaacauauacuuuacagua

SEQ ID NO: 29131 - RNA, 19 nt, Homo sapiens
uguucagggauccccggcg

SEQ ID NO: 29132 - RNA, 18 nt, Homo sapiens
cacaaccgccgcaagccc

SEQ ID NO: 29133 - RNA, 19 nt, Homo sapiens
gacccggaaggaagacgcg

SEQ ID NO: 29134 - RNA, 18 nt, Homo sapiens
ggccugggugcgggggcg

SEQ ID NO: 29135 - RNA, 16 nt, Homo sapiens
ugggugcgggggcggc

SEQ ID NO: 29136 - RNA, 21 nt, Homo sapiens
ccggaagcggcgacggggacg

SEQ ID NO: 29137 - RNA, 19 nt, Homo sapiens
ccuggacccggaagcggcg

SEQ ID NO: 29138 - RNA, 18 nt, Homo sapiens
cgacggggacggcggcgg

SEQ ID NO: 29139 - RNA, 19 nt, Homo sapiens
cgggcaggcggccuaaagg

SEQ ID NO: 29140 - RNA, 16 nt, Homo sapiens
ggcggcccgaggggcc

SEQ ID NO: 29141 - RNA, 19 nt, Homo sapiens
caaaggggacgcuucuguc

SEQ ID NO: 29142 - RNA, 21 nt, Homo sapiens
ccccucuaauuuccucuccca

SEQ ID NO: 29143 - RNA, 22 nt, Homo sapiens
cggcagccccugcccgcgcggc

SEQ ID NO: 29144 - RNA, 16 nt, Homo sapiens
gacagguaaguggagg

SEQ ID NO: 29145 - RNA, 18 nt, Homo sapiens
gagggagaagaaaugaga

SEQ ID NO: 29146 - RNA, 19 nt, Homo sapiens
gccugcccgcgcggcgcag

SEQ ID NO: 29147 - RNA, 22 nt, Homo sapiens
gcgcugggguggggggcgccgc

SEQ ID NO: 29148 - RNA, 20 nt, Homo sapiens
ggagaaggauguagcaggag

SEQ ID NO: 29149 - RNA, 15 nt, Homo sapiens
agaugggcagugcug

SEQ ID NO: 29150 - RNA, 23 nt, Homo sapiens
caugacaugcacacaggaaacug

SEQ ID NO: 29151 - RNA, 23 nt, Homo sapiens
ccguggggcuggcauggaggacc

SEQ ID NO: 29152 - RNA, 16 nt, Homo sapiens
cuuaaccuccuugagc

SEQ ID NO: 29153 - RNA, 18 nt, Homo sapiens
gcuggccggagccaccug

SEQ ID NO: 29154 - RNA, 20 nt, Homo sapiens
ucucacugaucccuggaucu

SEQ ID NO: 29155 - RNA, 23 nt, Homo sapiens
uggggcuggcauggaggaccucu

SEQ ID NO: 29156 - RNA, 19 nt, Homo sapiens
ugugagggugggcccaagg

SEQ ID NO: 29157 - RNA, 19 nt, Homo sapiens
cccgggccgaggccgaggg

SEQ ID NO: 29158 - RNA, 17 nt, Homo sapiens
gaugcggcgacgagggg

SEQ ID NO: 29159 - RNA, 19 nt, Homo sapiens
ggccagcaucggggguagc

SEQ ID NO: 29160 - RNA, 21 nt, Homo sapiens
gggcagcggccggcucuccag

SEQ ID NO: 29161 - RNA, 20 nt, Homo sapiens
aaagaguugacauuacauuu

SEQ ID NO: 29162 - RNA, 17 nt, Homo sapiens
cauaugccauuucuaaa

SEQ ID NO: 29163 - RNA, 23 nt, Homo sapiens
gagcgagcgucacccucgagucg

SEQ ID NO: 29164 - RNA, 18 nt, Homo sapiens
aagcuugcugccaacacc

SEQ ID NO: 29165 - RNA, 18 nt, Homo sapiens
agagauuucuggcuggug

SEQ ID NO: 29166 - RNA, 20 nt, Homo sapiens
agagggauaaaaaguuuaga

SEQ ID NO: 29167 - RNA, 18 nt, Homo sapiens
aggcagacaggcaggcag

SEQ ID NO: 29168 - RNA, 18 nt, Homo sapiens
aggcaggcaggcaggcag

SEQ ID NO: 29169 - RNA, 26 nt, Homo sapiens
aggcaggcaggcaggcaggcaggccg

SEQ ID NO: 29170 - RNA, 22 nt, Homo sapiens
aggggaaggaaaaagaugcacu

SEQ ID NO: 29171 - RNA, 18 nt, Homo sapiens
aguaagguggggcagaaa

SEQ ID NO: 29172 - RNA, 17 nt, Homo sapiens
aguuuagaaacuaaagu

SEQ ID NO: 29173 - RNA, 22 nt, Homo sapiens
caauggauuuuaaccaucuuga

SEQ ID NO: 29174 - RNA, 17 nt, Homo sapiens
cagagaacaaaucaggu

SEQ ID NO: 29175 - RNA, 17 nt, Homo sapiens
cagggaggagaaguaag

SEQ ID NO: 29176 - RNA, 21 nt, Homo sapiens
ccgcucgcgccgccgcccccg

SEQ ID NO: 29177 - RNA, 18 nt, Homo sapiens
cuuggcugcccaucuuga

SEQ ID NO: 29178 - RNA, 20 nt, Homo sapiens
cuuuauaaaacacagaauug

SEQ ID NO: 29179 - RNA, 18 nt, Homo sapiens
gccagcuaacagugggau

SEQ ID NO: 29180 - RNA, 22 nt, Homo sapiens
gggcaggggggaugcuugcuuc

SEQ ID NO: 29181 - RNA, 16 nt, Homo sapiens
gucugucuugcuggcc

SEQ ID NO: 29182 - RNA, 23 nt, Homo sapiens
uccaaauuuuggcaauacacuca

SEQ ID NO: 29183 - RNA, 22 nt, Homo sapiens
uccccucccuuucuuggaugcc

SEQ ID NO: 29184 - RNA, 18 nt, Homo sapiens
uccuugcuuccucuggau

SEQ ID NO: 29185 - RNA, 21 nt, Homo sapiens
ucucgcugcucgggaucccgg

SEQ ID NO: 29186 - RNA, 21 nt, Homo sapiens
ugaguagaguaagggagagca

SEQ ID NO: 29187 - RNA, 21 nt, Homo sapiens
ugagucacaugagacaccugu

SEQ ID NO: 29188 - RNA, 16 nt, Homo sapiens
uggaaaggccaggggc

SEQ ID NO: 29189 - RNA, 17 nt, Homo sapiens
uggggucagggccagau

SEQ ID NO: 29190 - RNA, 20 nt, Homo sapiens
uuugugcuacguuuugugag

SEQ ID NO: 29191 - RNA, 19 nt, Homo sapiens
cagugcagccgccgacccg

SEQ ID NO: 29192 - RNA, 15 nt, Homo sapiens
cugacaauaccaggg

SEQ ID NO: 29193 - RNA, 17 nt, Homo sapiens
ugucaagcucuauucca

SEQ ID NO: 29194 - RNA, 19 nt, Homo sapiens
caacacuaccuggacuggu

SEQ ID NO: 29195 - RNA, 22 nt, Homo sapiens
cagugugugugugugugugugu

SEQ ID NO: 29196 - RNA, 19 nt, Homo sapiens
cccagcugcagccaggccg

SEQ ID NO: 29197 - RNA, 19 nt, Homo sapiens
ccuggagugugcagauugg

SEQ ID NO: 29198 - RNA, 16 nt, Homo sapiens
cgggagccccaggggc

SEQ ID NO: 29199 - RNA, 16 nt, Homo sapiens
gcagcggcggcggggg

SEQ ID NO: 29200 - RNA, 18 nt, Homo sapiens
gggaaggaugggaggcag

SEQ ID NO: 29201 - RNA, 19 nt, Homo sapiens
gucaccaucaagcccuugc

SEQ ID NO: 29202 - RNA, 18 nt, Homo sapiens
gugugugugugugugugu

SEQ ID NO: 29203 - RNA, 17 nt, Homo sapiens
guuucucuggaggaugg

SEQ ID NO: 29204 - RNA, 21 nt, Homo sapiens
ucgguggggccacaggccugg

SEQ ID NO: 29205 - RNA, 17 nt, Homo sapiens
ucguacuaugcacaggg

SEQ ID NO: 29206 - RNA, 21 nt, Homo sapiens
ugagggaggccuuggcguggg

SEQ ID NO: 29207 - RNA, 20 nt, Homo sapiens
ugggggaaugugugaguugc

SEQ ID NO: 29208 - RNA, 18 nt, Homo sapiens
ugugugugugugugugug

SEQ ID NO: 29209 - RNA, 19 nt, Homo sapiens
aaggguccuguccucguuc

SEQ ID NO: 29210 - RNA, 17 nt, Homo sapiens
agacucucucccuguau

SEQ ID NO: 29211 - RNA, 18 nt, Homo sapiens
cagggacccgaaugcccg

SEQ ID NO: 29212 - RNA, 18 nt, Homo sapiens
cccccggccgcugccacc

SEQ ID NO: 29213 - RNA, 20 nt, Homo sapiens
ccggcuccuuccccuccccc

SEQ ID NO: 29214 - RNA, 21 nt, Homo sapiens
ccuccggcuccuuccccuccc

SEQ ID NO: 29215 - RNA, 18 nt, Homo sapiens
ccuucccccuccuucucg

SEQ ID NO: 29216 - RNA, 21 nt, Homo sapiens
ccuuccccucccccucugucc

SEQ ID NO: 29217 - RNA, 19 nt, Homo sapiens
ucaauuguaggcuuuugcc

SEQ ID NO: 29218 - RNA, 19 nt, Homo sapiens
ucccgauaaucuuaggucu

SEQ ID NO: 29219 - RNA, 16 nt, Homo sapiens
ugacagauguuaucuu

SEQ ID NO: 29220 - RNA, 18 nt, Homo sapiens
aggccgccgcccgccuuc

SEQ ID NO: 29221 - RNA, 22 nt, Homo sapiens
gggcgcugggcucucgucugcc

SEQ ID NO: 29222 - RNA, 19 nt, Homo sapiens
agagguagccuucaaagcc

SEQ ID NO: 29223 - RNA, 18 nt, Homo sapiens
gggagaggggaaggccuc

SEQ ID NO: 29224 - RNA, 22 nt, Homo sapiens
acaggguuuugccauguuggcc

SEQ ID NO: 29225 - RNA, 19 nt, Homo sapiens
aggucccugccaccacgcc

SEQ ID NO: 29226 - RNA, 19 nt, Homo sapiens
ugcaguggcgugaccucgg

SEQ ID NO: 29227 - RNA, 20 nt, Homo sapiens
aguacagauacacaaaacca

SEQ ID NO: 29228 - RNA, 20 nt, Homo sapiens
auggaagaaaauauacaaug

SEQ ID NO: 29229 - RNA, 14 nt, Homo sapiens
cacugauugugccc

SEQ ID NO: 29230 - RNA, 15 nt, Homo sapiens
gcccccucccucccc

SEQ ID NO: 29231 - RNA, 16 nt, Homo sapiens
gcuuacagagcccucu

SEQ ID NO: 29232 - RNA, 19 nt, Homo sapiens
ggaaaaguuggaccuugga

SEQ ID NO: 29233 - RNA, 18 nt, Homo sapiens
uaaugcauguucuguagu

SEQ ID NO: 29234 - RNA, 19 nt, Homo sapiens
uaucacagauaagaaggag

SEQ ID NO: 29235 - RNA, 22 nt, Homo sapiens
ucccuuucuuuucugggggcuu

SEQ ID NO: 29236 - RNA, 20 nt, Homo sapiens
uuuuaauacccuaacauaca

SEQ ID NO: 29237 - RNA, 19 nt, Homo sapiens
aggaguggggagagagggg

SEQ ID NO: 29238 - RNA, 22 nt, Homo sapiens
ccgcagcaggcacgagguacag

SEQ ID NO: 29239 - RNA, 19 nt, Homo sapiens
cggagaagaggagugggga

SEQ ID NO: 29240 - RNA, 23 nt, Homo sapiens
cggcggcccgggcuugcccaggu

SEQ ID NO: 29241 - RNA, 18 nt, Homo sapiens
gaaggcaaagcccacugc

SEQ ID NO: 29242 - RNA, 18 nt, Homo sapiens
ggagcgcggcgccgggcg

SEQ ID NO: 29243 - RNA, 19 nt, Homo sapiens
ggcgggcgggcggcggcca

SEQ ID NO: 29244 - RNA, 20 nt, Homo sapiens
gggcgguguggagcgcggcg

SEQ ID NO: 29245 - RNA, 18 nt, Homo sapiens
ggggagggcgguguggag

SEQ ID NO: 29246 - RNA, 19 nt, Homo sapiens
uauuccgcagguccuggcc

SEQ ID NO: 29247 - RNA, 18 nt, Homo sapiens
ucaguccccaccaggccg

SEQ ID NO: 29248 - RNA, 16 nt, Homo sapiens
ucugaacgaaggagga

SEQ ID NO: 29249 - RNA, 18 nt, Homo sapiens
aggcaucaagagcugaua

SEQ ID NO: 29250 - RNA, 19 nt, Homo sapiens
uguaagaguggagggaagg

SEQ ID NO: 29251 - RNA, 18 nt, Homo sapiens
aagaaucaaaaguuuagc

SEQ ID NO: 29252 - RNA, 26 nt, Homo sapiens
augagccaauauagacauuacuacau

SEQ ID NO: 29253 - RNA, 23 nt, Homo sapiens
cagauuuugaguacuucaaacca

SEQ ID NO: 29254 - RNA, 18 nt, Homo sapiens
gcccuccucccucgccuc

SEQ ID NO: 29255 - RNA, 23 nt, Homo sapiens
ugaacguaaauacaauaauccug

SEQ ID NO: 29256 - RNA, 18 nt, Homo sapiens
uguggaaaagaucaaugc

SEQ ID NO: 29257 - RNA, 18 nt, Homo sapiens
cacucaguucacauauuc

SEQ ID NO: 29258 - RNA, 23 nt, Homo sapiens
ccccggccccgccuccgccuccc

SEQ ID NO: 29259 - RNA, 16 nt, Homo sapiens
cccgcccgcggcgccc

SEQ ID NO: 29260 - RNA, 20 nt, Homo sapiens
ccgcccccggcgccccgccc

SEQ ID NO: 29261 - RNA, 20 nt, Homo sapiens
ccgcgcaguccgaggagucc

SEQ ID NO: 29262 - RNA, 18 nt, Homo sapiens
ucccuguuccagguucug

SEQ ID NO: 29263 - RNA, 19 nt, Homo sapiens
uugagaaggcauuuacauu

SEQ ID NO: 29264 - RNA, 15 nt, Homo sapiens
cauuucuccucugcg

SEQ ID NO: 29265 - RNA, 17 nt, Homo sapiens
gguuuuuaccccuugac

SEQ ID NO: 29266 - RNA, 18 nt, Homo sapiens
ugugauuuuauuuuccac

SEQ ID NO: 29267 - RNA, 18 nt, Homo sapiens
ugugcaaaaaucagaaua

SEQ ID NO: 29268 - RNA, 19 nt, Homo sapiens
aauaggcagugcagcaccu

SEQ ID NO: 29269 - RNA, 19 nt, Homo sapiens
ccuggguccccaggaaacc

SEQ ID NO: 29270 - RNA, 23 nt, Homo sapiens
uaaaugggguaaaggguuaugcu

SEQ ID NO: 29271 - RNA, 22 nt, Homo sapiens
ucagaaaauaagcuaguauuuu

SEQ ID NO: 29272 - RNA, 16 nt, Homo sapiens
ucauuccaagagaucc

SEQ ID NO: 29273 - RNA, 18 nt, Homo sapiens
ucuagaauuaaauggggu

SEQ ID NO: 29274 - RNA, 20 nt, Homo sapiens
uuuucauagcaucuauuaua

SEQ ID NO: 29275 - RNA, 17 nt, Homo sapiens
cagcgccgccggcuccc

SEQ ID NO: 29276 - RNA, 16 nt, Homo sapiens
cgccguagccaccgcc

SEQ ID NO: 29277 - RNA, 22 nt, Homo sapiens
cggcucccgucgccguagccac

SEQ ID NO: 29278 - RNA, 19 nt, Homo sapiens
cuggcuaccaucuagcaca

SEQ ID NO: 29279 - RNA, 17 nt, Homo sapiens
agguaggauaaaagggg

SEQ ID NO: 29280 - RNA, 19 nt, Homo sapiens
cagaagcuuuuuggcuucu

SEQ ID NO: 29281 - RNA, 19 nt, Homo sapiens
cagcaggaguggcugggaa

SEQ ID NO: 29282 - RNA, 18 nt, Homo sapiens
caucuccccucuccucca

SEQ ID NO: 29283 - RNA, 18 nt, Homo sapiens
ccaggggagacauacauu

SEQ ID NO: 29284 - RNA, 19 nt, Homo sapiens
cccuggugaacagauaggg

SEQ ID NO: 29285 - RNA, 18 nt, Homo sapiens
ccggccccaucccucugg

SEQ ID NO: 29286 - RNA, 19 nt, Homo sapiens
cgguguugcucuagaucug

SEQ ID NO: 29287 - RNA, 17 nt, Homo sapiens
gaaggaggggaggaagu

SEQ ID NO: 29288 - RNA, 17 nt, Homo sapiens
gcacgguggggcggugg

SEQ ID NO: 29289 - RNA, 19 nt, Homo sapiens
gcuggguuucugcaaucug

SEQ ID NO: 29290 - RNA, 19 nt, Homo sapiens
gcuuccgccuuucccaggu

SEQ ID NO: 29291 - RNA, 18 nt, Homo sapiens
ggagggggaaagcacccu

SEQ ID NO: 29292 - RNA, 18 nt, Homo sapiens
gggcuggaugcaggaggc

SEQ ID NO: 29293 - RNA, 22 nt, Homo sapiens
ggggaggggcaggaaagagggc

SEQ ID NO: 29294 - RNA, 16 nt, Homo sapiens
gggugggugcagguau

SEQ ID NO: 29295 - RNA, 15 nt, Homo sapiens
ggugggcaagcuggc

SEQ ID NO: 29296 - RNA, 22 nt, Homo sapiens
uaaaaaaggcaagcagauaaaa

SEQ ID NO: 29297 - RNA, 17 nt, Homo sapiens
ugcagggcccacagcaa

SEQ ID NO: 29298 - RNA, 19 nt, Homo sapiens
uuacaaaaaaauaauugaa

SEQ ID NO: 29299 - RNA, 21 nt, Homo sapiens
aaaauugaauaaagaauuuga

SEQ ID NO: 29300 - RNA, 18 nt, Homo sapiens
agauuuaucaacaauauu

SEQ ID NO: 29301 - RNA, 22 nt, Homo sapiens
aggcuugcucugccucucccag

SEQ ID NO: 29302 - RNA, 18 nt, Homo sapiens
ccuagaaagggcagccgg

SEQ ID NO: 29303 - RNA, 19 nt, Homo sapiens
gaacaaauauccccccaaa

SEQ ID NO: 29304 - RNA, 22 nt, Homo sapiens
gagagacgucauuaacagagac

SEQ ID NO: 29305 - RNA, 26 nt, Homo sapiens
ugcuucuaauuuuuuucauuuugcaa

SEQ ID NO: 29306 - RNA, 15 nt, Homo sapiens
ccgccgcugccgccc

SEQ ID NO: 29307 - RNA, 18 nt, Homo sapiens
cugaggagagaaagagaa

SEQ ID NO: 29308 - RNA, 17 nt, Homo sapiens
gcgcgguagcgcggcgc

SEQ ID NO: 29309 - RNA, 22 nt, Homo sapiens
ggucagcgcgguagcgcggcgc

SEQ ID NO: 29310 - RNA, 17 nt, Homo sapiens
uagcuaaaacugaaggg

SEQ ID NO: 29311 - RNA, 22 nt, Homo sapiens
ugaggagagaaagagaagauga

SEQ ID NO: 29312 - RNA, 23 nt, Homo sapiens
uuaaaaaaagagcaugucugugu

SEQ ID NO: 29313 - RNA, 25 nt, Homo sapiens
uuagcuucacagaaaggacuagcca

SEQ ID NO: 29314 - RNA, 25 nt, Homo sapiens
aaacuuacuaucaggugguuguuuu

SEQ ID NO: 29315 - RNA, 17 nt, Homo sapiens
uacaguguggaggcucu

SEQ ID NO: 29316 - RNA, 24 nt, Homo sapiens
ugacuugaacaguacaguguggag

SEQ ID NO: 29317 - RNA, 19 nt, Homo sapiens
aaaauguccaucaguguca

SEQ ID NO: 29318 - RNA, 21 nt, Homo sapiens
aagacagggucaaauuuuagu

SEQ ID NO: 29319 - RNA, 25 nt, Homo sapiens
aauauauauauauauguauauauau

SEQ ID NO: 29320 - RNA, 18 nt, Homo sapiens
acaguaagcaagucaucu

SEQ ID NO: 29321 - RNA, 19 nt, Homo sapiens
aguuaggagcuuuuagaag

SEQ ID NO: 29322 - RNA, 21 nt, Homo sapiens
auauauauauauauguauaua

SEQ ID NO: 29323 - RNA, 25 nt, Homo sapiens
auauauauauauauguauauauaua

SEQ ID NO: 29324 - RNA, 23 nt, Homo sapiens
auauauauauauauguauauauu

SEQ ID NO: 29325 - RNA, 22 nt, Homo sapiens
auauauauauauguauauauau

SEQ ID NO: 29326 - RNA, 16 nt, Homo sapiens
cacuucaacaucagaa

SEQ ID NO: 29327 - RNA, 21 nt, Homo sapiens
ccaguuagaugauuuacacgg

SEQ ID NO: 29328 - RNA, 19 nt, Homo sapiens
ccuucucgccucuccaguc

SEQ ID NO: 29329 - RNA, 20 nt, Homo sapiens
gaaucaacugaauggagugg

SEQ ID NO: 29330 - RNA, 23 nt, Homo sapiens
gcccgccucccucucuuccuucc

SEQ ID NO: 29331 - RNA, 19 nt, Homo sapiens
gcccgccugcuugcccgcc

SEQ ID NO: 29332 - RNA, 20 nt, Homo sapiens
gcccgccugcuugcccgccu

SEQ ID NO: 29333 - RNA, 18 nt, Homo sapiens
gcggggggcggggagcgg

SEQ ID NO: 29334 - RNA, 15 nt, Homo sapiens
ggggggcggggagcg

SEQ ID NO: 29335 - RNA, 20 nt, Homo sapiens
uaaaaucauuagaaaccaau

SEQ ID NO: 29336 - RNA, 24 nt, Homo sapiens
uacagcuuuacaaauaacccaugg

SEQ ID NO: 29337 - RNA, 20 nt, Homo sapiens
uaccugacucucaauagaaa

SEQ ID NO: 29338 - RNA, 22 nt, Homo sapiens
uauauauauauauguauauaua

SEQ ID NO: 29339 - RNA, 17 nt, Homo sapiens
uauguuaaagauguuuc

SEQ ID NO: 29340 - RNA, 17 nt, Homo sapiens
ucagaagcacccaauau

SEQ ID NO: 29341 - RNA, 22 nt, Homo sapiens
ucaugguuaguugaaaaaaugc

SEQ ID NO: 29342 - RNA, 22 nt, Homo sapiens
ugagggaaaaaaaaggcacugu

SEQ ID NO: 29343 - RNA, 19 nt, Homo sapiens
guauguacauucaugaaaa

SEQ ID NO: 29344 - RNA, 22 nt, Homo sapiens
uuacguaucuucugcuuuagug

SEQ ID NO: 29345 - RNA, 20 nt, Homo sapiens
aaucccaggggcugugaucc

SEQ ID NO: 29346 - RNA, 16 nt, Homo sapiens
acauugugggagggga

SEQ ID NO: 29347 - RNA, 16 nt, Homo sapiens
agagugauuguccgcc

SEQ ID NO: 29348 - RNA, 17 nt, Homo sapiens
ccuccaaggaugccuca

SEQ ID NO: 29349 - RNA, 19 nt, Homo sapiens
cuauugcugcauaacaagu

SEQ ID NO: 29350 - RNA, 16 nt, Homo sapiens
cuccgaucucugccuu

SEQ ID NO: 29351 - RNA, 18 nt, Homo sapiens
gaaggggguggggcuggg

SEQ ID NO: 29352 - RNA, 16 nt, Homo sapiens
gaggaccguggacuga

SEQ ID NO: 29353 - RNA, 22 nt, Homo sapiens
gauuuugauuguaucuuggguu

SEQ ID NO: 29354 - RNA, 16 nt, Homo sapiens
ggauuaaagggaaggg

SEQ ID NO: 29355 - RNA, 17 nt, Homo sapiens
gugcccacuaagucaga

SEQ ID NO: 29356 - RNA, 23 nt, Homo sapiens
uaagucucuuuauaggccugcuc

SEQ ID NO: 29357 - RNA, 24 nt, Homo sapiens
uagggaggggcccugaaacuugcc

SEQ ID NO: 29358 - RNA, 17 nt, Homo sapiens
ucuccuccacucacccc

SEQ ID NO: 29359 - RNA, 21 nt, Homo sapiens
ucugacaucaccaccuccuca

SEQ ID NO: 29360 - RNA, 19 nt, Homo sapiens
ugagggaagagauaggaaa

SEQ ID NO: 29361 - RNA, 22 nt, Homo sapiens
uggcaggauuaaagggaagggg

SEQ ID NO: 29362 - RNA, 18 nt, Homo sapiens
gccaacaauauccuggua

SEQ ID NO: 29363 - RNA, 16 nt, Homo sapiens
agaaacgugguccaga

SEQ ID NO: 29364 - RNA, 20 nt, Homo sapiens
cagccgccgccgccguggcg

SEQ ID NO: 29365 - RNA, 20 nt, Homo sapiens
gaugauugauccugugauau

SEQ ID NO: 29366 - RNA, 16 nt, Homo sapiens
ggaaucaaaagacaua

SEQ ID NO: 29367 - RNA, 24 nt, Homo sapiens
uauguaauaaucuucaucauagcc

SEQ ID NO: 29368 - RNA, 17 nt, Homo sapiens
uccaaguagcccuuccc

SEQ ID NO: 29369 - RNA, 19 nt, Homo sapiens
ugaaauaaccuaacugcau

SEQ ID NO: 29370 - RNA, 21 nt, Homo sapiens
aaggcaacuggaagcuggacu

SEQ ID NO: 29371 - RNA, 19 nt, Homo sapiens
cacugggaugaaaacuggg

SEQ ID NO: 29372 - RNA, 22 nt, Homo sapiens
gagagggagggaaaagaugucu

SEQ ID NO: 29373 - RNA, 18 nt, Homo sapiens
ggccugcaacccguuggc

SEQ ID NO: 29374 - RNA, 15 nt, Homo sapiens
ggggguggaaggugg

SEQ ID NO: 29375 - RNA, 18 nt, Homo sapiens
gggguagggguggaaggu

SEQ ID NO: 29376 - RNA, 23 nt, Homo sapiens
ugaaaacuggggaggcaagaaaa

SEQ ID NO: 29377 - RNA, 19 nt, Homo sapiens
ugccaaguguuggacgugu

SEQ ID NO: 29378 - RNA, 22 nt, Homo sapiens
uggggugauacacccaguaaug

SEQ ID NO: 29379 - RNA, 20 nt, Homo sapiens
ccucuuuuaguggccuugcu

SEQ ID NO: 29380 - RNA, 18 nt, Homo sapiens
gcagaaguggagcuggaa

SEQ ID NO: 29381 - RNA, 19 nt, Homo sapiens
guguccuugucaucuccac

SEQ ID NO: 29382 - RNA, 16 nt, Homo sapiens
uccacuuugguuugcu

SEQ ID NO: 29383 - RNA, 19 nt, Homo sapiens
ugcccagccugugccuguc

SEQ ID NO: 29384 - RNA, 17 nt, Homo sapiens
aauuucuuuagccauuu

SEQ ID NO: 29385 - RNA, 18 nt, Homo sapiens
agagucaucucuucaagc

SEQ ID NO: 29386 - RNA, 17 nt, Homo sapiens
aguauuuucuuuguauu

SEQ ID NO: 29387 - RNA, 22 nt, Homo sapiens
ccacaggauuuuaaagccuacg

SEQ ID NO: 29388 - RNA, 19 nt, Homo sapiens
gcccuuggaauuccuuagc

SEQ ID NO: 29389 - RNA, 21 nt, Homo sapiens
guuucacaauuucucuaaaca

SEQ ID NO: 29390 - RNA, 26 nt, Homo sapiens
ugauugcuagugguuaagcauguuuu

SEQ ID NO: 29391 - RNA, 23 nt, Homo sapiens
ugcccagcuucaucaagaccauc

SEQ ID NO: 29392 - RNA, 20 nt, Homo sapiens
uucauuguacaguugaggaa

SEQ ID NO: 29393 - RNA, 19 nt, Homo sapiens
uuuucucuuuucuccacac

SEQ ID NO: 29394 - RNA, 16 nt, Homo sapiens
cagugggagggggugc

SEQ ID NO: 29395 - RNA, 18 nt, Homo sapiens
caucugucucugccagcu

SEQ ID NO: 29396 - RNA, 18 nt, Homo sapiens
ccgccgccgccggguccc

SEQ ID NO: 29397 - RNA, 24 nt, Homo sapiens
ccgccgccggguccccauccgccc

SEQ ID NO: 29398 - RNA, 19 nt, Homo sapiens
ccuccggccuggagagguc

SEQ ID NO: 29399 - RNA, 18 nt, Homo sapiens
ccugcuuaaguacaucuu

SEQ ID NO: 29400 - RNA, 19 nt, Homo sapiens
cgccuccuucggcugcccc

SEQ ID NO: 29401 - RNA, 20 nt, Homo sapiens
cgucaugcccgccgucuccc

SEQ ID NO: 29402 - RNA, 16 nt, Homo sapiens
gagggggugcugcguc

SEQ ID NO: 29403 - RNA, 18 nt, Homo sapiens
gccggcgggcgcagcgcc

SEQ ID NO: 29404 - RNA, 19 nt, Homo sapiens
gcgcugagccgggcaggcc

SEQ ID NO: 29405 - RNA, 18 nt, Homo sapiens
gcugagcuguuuccccag

SEQ ID NO: 29406 - RNA, 20 nt, Homo sapiens
gcugccccugcgcgcccgcg

SEQ ID NO: 29407 - RNA, 20 nt, Homo sapiens
ggagagcacugugauucuga

SEQ ID NO: 29408 - RNA, 18 nt, Homo sapiens
ggccggcgggcgcagcgc

SEQ ID NO: 29409 - RNA, 19 nt, Homo sapiens
ggccuuggggggggggcgu

SEQ ID NO: 29410 - RNA, 17 nt, Homo sapiens
gggccugugugcgaggg

SEQ ID NO: 29411 - RNA, 18 nt, Homo sapiens
gguccccauccgcccgcc

SEQ ID NO: 29412 - RNA, 18 nt, Homo sapiens
ucggcugccccugcgcgc

SEQ ID NO: 29413 - RNA, 22 nt, Homo sapiens
ucggugcuuacauacgcugcuu

SEQ ID NO: 29414 - RNA, 20 nt, Homo sapiens
ucuuugguggaaaacacgca

SEQ ID NO: 29415 - RNA, 18 nt, Homo sapiens
ugagaagaaaauaaauga

SEQ ID NO: 29416 - RNA, 18 nt, Homo sapiens
ugcgagggaaagggcggc

SEQ ID NO: 29417 - RNA, 15 nt, Homo sapiens
uggcaaaagaggaug

SEQ ID NO: 29418 - RNA, 19 nt, Homo sapiens
ugugcaaggcgagggauca

SEQ ID NO: 29419 - RNA, 24 nt, Homo sapiens
uuccaagggucugguugugacugc

SEQ ID NO: 29420 - RNA, 19 nt, Homo sapiens
aaagagagagggggaacaa

SEQ ID NO: 29421 - RNA, 16 nt, Homo sapiens
aagugcaaaaagcucu

SEQ ID NO: 29422 - RNA, 23 nt, Homo sapiens
agagacacuucuuuccuccacau

SEQ ID NO: 29423 - RNA, 17 nt, Homo sapiens
agaggaaaggagggaga

SEQ ID NO: 29424 - RNA, 22 nt, Homo sapiens
aggcagaaugaagacacaugga

SEQ ID NO: 29425 - RNA, 18 nt, Homo sapiens
aggcggggcggggugggg

SEQ ID NO: 29426 - RNA, 21 nt, Homo sapiens
ccaaaaaacaaacauaaaaac

SEQ ID NO: 29427 - RNA, 22 nt, Homo sapiens
ccacauggaccaacccucaccu

SEQ ID NO: 29428 - RNA, 15 nt, Homo sapiens
gaggcaaaagagaga

SEQ ID NO: 29429 - RNA, 19 nt, Homo sapiens
gagggcaggcucuccuggc

SEQ ID NO: 29430 - RNA, 18 nt, Homo sapiens
gcggggcggggugggggg

SEQ ID NO: 29431 - RNA, 18 nt, Homo sapiens
gcgggguggggggaagag

SEQ ID NO: 29432 - RNA, 23 nt, Homo sapiens
gcugggaggcagguuggggcuug

SEQ ID NO: 29433 - RNA, 23 nt, Homo sapiens
ggcagucagugggaggcaaaaga

SEQ ID NO: 29434 - RNA, 21 nt, Homo sapiens
gggaagaucgguuuccuguug

SEQ ID NO: 29435 - RNA, 21 nt, Homo sapiens
gggaccauggauggggaggag

SEQ ID NO: 29436 - RNA, 20 nt, Homo sapiens
gggcgggguggggggaagag

SEQ ID NO: 29437 - RNA, 20 nt, Homo sapiens
ggggaggaggggcacagggc

SEQ ID NO: 29438 - RNA, 19 nt, Homo sapiens
ggggcgggguggggggaag

SEQ ID NO: 29439 - RNA, 21 nt, Homo sapiens
ggggcgggguggggggaagag

SEQ ID NO: 29440 - RNA, 19 nt, Homo sapiens
gugcauccugggaaagccu

SEQ ID NO: 29441 - RNA, 20 nt, Homo sapiens
ucgguggggagucaggggaa

SEQ ID NO: 29442 - RNA, 19 nt, Homo sapiens
ugacgcuggccucagagcc

SEQ ID NO: 29443 - RNA, 17 nt, Homo sapiens
uggcccaguccucugcc

SEQ ID NO: 29444 - RNA, 22 nt, Homo sapiens
uggcgucucucuucucaguggc

SEQ ID NO: 29445 - RNA, 23 nt, Homo sapiens
aaagacuguggaauguagaacaa

SEQ ID NO: 29446 - RNA, 25 nt, Homo sapiens
aauacagcauggauuagaaaucaaa

SEQ ID NO: 29447 - RNA, 25 nt, Homo sapiens
acaagcuggugggauuccuagacac

SEQ ID NO: 29448 - RNA, 25 nt, Homo sapiens
accaucuucccuggccuccgagagc

SEQ ID NO: 29449 - RNA, 17 nt, Homo sapiens
aucacaaauaauucacu

SEQ ID NO: 29450 - RNA, 18 nt, Homo sapiens
cacaacucucacagggca

SEQ ID NO: 29451 - RNA, 17 nt, Homo sapiens
cagggccuugcuggggu

SEQ ID NO: 29452 - RNA, 18 nt, Homo sapiens
caugugguuugcuuguca

SEQ ID NO: 29453 - RNA, 16 nt, Homo sapiens
ccagaggagacgcugu

SEQ ID NO: 29454 - RNA, 16 nt, Homo sapiens
cgggcaguccugucug

SEQ ID NO: 29455 - RNA, 20 nt, Homo sapiens
cugcaaaagguuuuggaaca

SEQ ID NO: 29456 - RNA, 21 nt, Homo sapiens
cuggugggugggcuggcaggg

SEQ ID NO: 29457 - RNA, 23 nt, Homo sapiens
gaagucugagaaacaaguuugga

SEQ ID NO: 29458 - RNA, 19 nt, Homo sapiens
gcugugcccgcccagcucc

SEQ ID NO: 29459 - RNA, 19 nt, Homo sapiens
ggaauguagaacaaguuac

SEQ ID NO: 29460 - RNA, 24 nt, Homo sapiens
ggagaaagugcaaauuacaggagc

SEQ ID NO: 29461 - RNA, 19 nt, Homo sapiens
ggagugggguugaugcuca

SEQ ID NO: 29462 - RNA, 17 nt, Homo sapiens
ggaugcaaaccacagga

SEQ ID NO: 29463 - RNA, 19 nt, Homo sapiens
ggcuggcagggccuugcug

SEQ ID NO: 29464 - RNA, 19 nt, Homo sapiens
gggugccaagguuugggag

SEQ ID NO: 29465 - RNA, 14 nt, Homo sapiens
gucacccagccacu

SEQ ID NO: 29466 - RNA, 23 nt, Homo sapiens
guucauucuagagcuguuccaga

SEQ ID NO: 29467 - RNA, 22 nt, Homo sapiens
uacguugugcauugauaugggc

SEQ ID NO: 29468 - RNA, 19 nt, Homo sapiens
uagugcaauaguauauuua

SEQ ID NO: 29469 - RNA, 22 nt, Homo sapiens
ucccugaguuugcuggugcagg

SEQ ID NO: 29470 - RNA, 20 nt, Homo sapiens
ucuaaaaagaauaaaagcac

SEQ ID NO: 29471 - RNA, 17 nt, Homo sapiens
ucugcaacacacaguac

SEQ ID NO: 29472 - RNA, 20 nt, Homo sapiens
ugacauuaagaagaaaggaa

SEQ ID NO: 29473 - RNA, 22 nt, Homo sapiens
uggaugggugcucauggcagac

SEQ ID NO: 29474 - RNA, 16 nt, Homo sapiens
ugggugggcuggcagg

SEQ ID NO: 29475 - RNA, 24 nt, Homo sapiens
uguguucauucuagagcuguucca

SEQ ID NO: 29476 - RNA, 16 nt, Homo sapiens
uuccuagacacccaga

SEQ ID NO: 29477 - RNA, 18 nt, Homo sapiens
uucuuugccaauagacac

SEQ ID NO: 29478 - RNA, 20 nt, Homo sapiens
aggaguguguuuucucucca

SEQ ID NO: 29479 - RNA, 16 nt, Homo sapiens
cagcugcugguacaug

SEQ ID NO: 29480 - RNA, 23 nt, Homo sapiens
ucucagaagggcgagugauuucu

SEQ ID NO: 29481 - RNA, 21 nt, Homo sapiens
uguacaugcugguaucuguug

SEQ ID NO: 29482 - RNA, 21 nt, Homo sapiens
ugugauugcagccucagguag

SEQ ID NO: 29483 - RNA, 20 nt, Homo sapiens
aggaguguguuuucucucca

SEQ ID NO: 29484 - RNA, 16 nt, Homo sapiens
cagcugcugguacaug

SEQ ID NO: 29485 - RNA, 18 nt, Homo sapiens
ucucagaagggcgaguga

SEQ ID NO: 29486 - RNA, 21 nt, Homo sapiens
uguacaugcugguaucuguug

SEQ ID NO: 29487 - RNA, 24 nt, Homo sapiens
acggagaaaugaagagagagagca

SEQ ID NO: 29488 - RNA, 19 nt, Homo sapiens
gccaggcacaccgcgcccc

SEQ ID NO: 29489 - RNA, 19 nt, Homo sapiens
gcggguagguaaggggacc

SEQ ID NO: 29490 - RNA, 18 nt, Homo sapiens
ggagagcaguggcuccug

SEQ ID NO: 29491 - RNA, 18 nt, Homo sapiens
ggauguggugaguggaug

SEQ ID NO: 29492 - RNA, 17 nt, Homo sapiens
gggcugcggggaggggg

SEQ ID NO: 29493 - RNA, 15 nt, Homo sapiens
guagaaaacuaacca

SEQ ID NO: 29494 - RNA, 18 nt, Homo sapiens
aaagaugagugugacaca

SEQ ID NO: 29495 - RNA, 19 nt, Homo sapiens
cacgugguccucauucucu

SEQ ID NO: 29496 - RNA, 19 nt, Homo sapiens
caggaggacaggugcccag

SEQ ID NO: 29497 - RNA, 17 nt, Homo sapiens
ccacccagagggcacag

SEQ ID NO: 29498 - RNA, 18 nt, Homo sapiens
ccagccuggccaugcugc

SEQ ID NO: 29499 - RNA, 19 nt, Homo sapiens
ccaugcugccgagugcggg

SEQ ID NO: 29500 - RNA, 23 nt, Homo sapiens
ccgcuccggccuccugcgcugcc

SEQ ID NO: 29501 - RNA, 20 nt, Homo sapiens
cgcggacggcugacagaggc

SEQ ID NO: 29502 - RNA, 21 nt, Homo sapiens
gcggcuggccucggacgggag

SEQ ID NO: 29503 - RNA, 18 nt, Homo sapiens
gcggggcggccaggccgc

SEQ ID NO: 29504 - RNA, 18 nt, Homo sapiens
gcugggcaggaggaugga

SEQ ID NO: 29505 - RNA, 18 nt, Homo sapiens
ugcgcugccuccuucucc

SEQ ID NO: 29506 - RNA, 19 nt, Homo sapiens
ugcugugggcgcacuggac

SEQ ID NO: 29507 - RNA, 18 nt, Homo sapiens
aaccgggcgcccgggagc

SEQ ID NO: 29508 - RNA, 17 nt, Homo sapiens
accauguuguccaggcu

SEQ ID NO: 29509 - RNA, 14 nt, Homo sapiens
accugggcacagag

SEQ ID NO: 29510 - RNA, 21 nt, Homo sapiens
cagaaggugcccucugggcug

SEQ ID NO: 29511 - RNA, 24 nt, Homo sapiens
ccaggcccaaccagaggugggggc

SEQ ID NO: 29512 - RNA, 20 nt, Homo sapiens
cccagggucauucgguccca

SEQ ID NO: 29513 - RNA, 25 nt, Homo sapiens
cccagggucauucggucccaguuug

SEQ ID NO: 29514 - RNA, 18 nt, Homo sapiens
cggcgcgcucacacacgc

SEQ ID NO: 29515 - RNA, 20 nt, Homo sapiens
ggagggagcugaggccggag

SEQ ID NO: 29516 - RNA, 24 nt, Homo sapiens
uccuuggacucccaaagugcuggg

SEQ ID NO: 29517 - RNA, 17 nt, Homo sapiens
uggacaguguuggggga

SEQ ID NO: 29518 - RNA, 18 nt, Homo sapiens
uuuggagggcauauuggc

SEQ ID NO: 29519 - RNA, 23 nt, Homo sapiens
caacgaugccucuugcuuuuuag

SEQ ID NO: 29520 - RNA, 21 nt, Homo sapiens
ccggcuccgguuccgucuucg

SEQ ID NO: 29521 - RNA, 15 nt, Homo sapiens
gagacacauuuugca

SEQ ID NO: 29522 - RNA, 18 nt, Homo sapiens
gcccgcaaccggcuccgg

SEQ ID NO: 29523 - RNA, 23 nt, Homo sapiens
gcccgcaaccggcuccgguuccg

SEQ ID NO: 29524 - RNA, 18 nt, Homo sapiens
gcuacaagguaaaagcuc

SEQ ID NO: 29525 - RNA, 18 nt, Homo sapiens
gcuccgguuccgucuucg

SEQ ID NO: 29526 - RNA, 25 nt, Homo sapiens
uuauuggaaaaggagugaaacgucu

SEQ ID NO: 29527 - RNA, 23 nt, Homo sapiens
cagcacccugggaaguguugggc

SEQ ID NO: 29528 - RNA, 16 nt, Homo sapiens
ccaucccucacaugcc

SEQ ID NO: 29529 - RNA, 23 nt, Homo sapiens
ccaugcccccaagccccccucgc

SEQ ID NO: 29530 - RNA, 17 nt, Homo sapiens
cggcuccggggcggagg

SEQ ID NO: 29531 - RNA, 21 nt, Homo sapiens
cgggggcgcugcggcagaggc

SEQ ID NO: 29532 - RNA, 17 nt, Homo sapiens
gacagguggcgggggcg

SEQ ID NO: 29533 - RNA, 16 nt, Homo sapiens
gcuggagggaguggcg

SEQ ID NO: 29534 - RNA, 18 nt, Homo sapiens
gcuggagggaguggcugg

SEQ ID NO: 29535 - RNA, 17 nt, Homo sapiens
gggcagggggccuuggg

SEQ ID NO: 29536 - RNA, 21 nt, Homo sapiens
gggcagggggccuuggguggg

SEQ ID NO: 29537 - RNA, 21 nt, Homo sapiens
ggggguggggagggcaggugg

SEQ ID NO: 29538 - RNA, 22 nt, Homo sapiens
ggggguggggagggcagguggg

SEQ ID NO: 29539 - RNA, 20 nt, Homo sapiens
gugaguccuaccccagcccc

SEQ ID NO: 29540 - RNA, 23 nt, Homo sapiens
ugaggccgccgcggucuccggcu

SEQ ID NO: 29541 - RNA, 18 nt, Homo sapiens
ugccccccucccuuuccc

SEQ ID NO: 29542 - RNA, 17 nt, Homo sapiens
ugggguccaggcagagu

SEQ ID NO: 29543 - RNA, 20 nt, Homo sapiens
uguguggugaaccaggcugc

SEQ ID NO: 29544 - RNA, 22 nt, Homo sapiens
acaggcauaugcucuccucugg

SEQ ID NO: 29545 - RNA, 20 nt, Homo sapiens
agaaaaaaaaagaagcuccu

SEQ ID NO: 29546 - RNA, 18 nt, Homo sapiens
caaacugauuucugacuc

SEQ ID NO: 29547 - RNA, 14 nt, Homo sapiens
ccaaaggcuacagc

SEQ ID NO: 29548 - RNA, 18 nt, Homo sapiens
guaaagggucauuuuaug

SEQ ID NO: 29549 - RNA, 22 nt, Homo sapiens
uaccaagcacuuucuacuuuug

SEQ ID NO: 29550 - RNA, 23 nt, Homo sapiens
ucaagauauuuugcccauuagaa

SEQ ID NO: 29551 - RNA, 23 nt, Homo sapiens
ucugacucuuuuaaauuguauuu

SEQ ID NO: 29552 - RNA, 21 nt, Homo sapiens
ugaaaaaaaaaaagugaagga

SEQ ID NO: 29553 - RNA, 19 nt, Homo sapiens
ugucaauucggaauuccaa

SEQ ID NO: 29554 - RNA, 21 nt, Homo sapiens
uucaugccugcaaaaccuaga

SEQ ID NO: 29555 - RNA, 17 nt, Homo sapiens
uucuggagcuuaucccg

SEQ ID NO: 29556 - RNA, 21 nt, Homo sapiens
uugcugcaggugcucucaaca

SEQ ID NO: 29557 - RNA, 26 nt, Homo sapiens
uuugcccauuagaauuuguuuacaaa

SEQ ID NO: 29558 - RNA, 18 nt, Homo sapiens
auuucguuaaguuuucaa

SEQ ID NO: 29559 - RNA, 23 nt, Homo sapiens
cauauggaguauaauguggaaau

SEQ ID NO: 29560 - RNA, 24 nt, Homo sapiens
ccgaccuagcgcuccuccuucccc

SEQ ID NO: 29561 - RNA, 23 nt, Homo sapiens
ucacagaugucauagaacaugca

SEQ ID NO: 29562 - RNA, 23 nt, Homo sapiens
ugagguaucagucaaucucuaga

SEQ ID NO: 29563 - RNA, 19 nt, Homo sapiens
uggcaauauuucguuaagu

SEQ ID NO: 29564 - RNA, 23 nt, Homo sapiens
ugguaagaaugcaguagaaauua

SEQ ID NO: 29565 - RNA, 22 nt, Homo sapiens
caacacaaaaguuacccauaga

SEQ ID NO: 29566 - RNA, 19 nt, Homo sapiens
cagacuguauuaagcaaca

SEQ ID NO: 29567 - RNA, 22 nt, Homo sapiens
acgaacaggcaagcacguacac

SEQ ID NO: 29568 - RNA, 18 nt, Homo sapiens
agcaaagacaggugggcu

SEQ ID NO: 29569 - RNA, 19 nt, Homo sapiens
ccagaggguggugcguuca

SEQ ID NO: 29570 - RNA, 21 nt, Homo sapiens
cgcggaagucagcgccgccgc

SEQ ID NO: 29571 - RNA, 18 nt, Homo sapiens
gcgugguuccuccccucc

SEQ ID NO: 29572 - RNA, 16 nt, Homo sapiens
gcugcccgcagcacuc

SEQ ID NO: 29573 - RNA, 21 nt, Homo sapiens
ggaaaggcaguucccuucagu

SEQ ID NO: 29574 - RNA, 22 nt, Homo sapiens
gggaaaucagguugggagguua

SEQ ID NO: 29575 - RNA, 16 nt, Homo sapiens
gguuccuccccuccuu

SEQ ID NO: 29576 - RNA, 23 nt, Homo sapiens
uccccuccuuuuuuaaggcaugu

SEQ ID NO: 29577 - RNA, 25 nt, Homo sapiens
uccuuuuuuaaggcauguguccucu

SEQ ID NO: 29578 - RNA, 18 nt, Homo sapiens
uguguacaccauuacaca

SEQ ID NO: 29579 - RNA, 16 nt, Homo sapiens
cagcaauuauggaugc

SEQ ID NO: 29580 - RNA, 23 nt, Homo sapiens
ccucagggcugaugauuagggac

SEQ ID NO: 29581 - RNA, 20 nt, Homo sapiens
gaggagcucaggaugccagc

SEQ ID NO: 29582 - RNA, 23 nt, Homo sapiens
gagguagcuggcaggauguuagc

SEQ ID NO: 29583 - RNA, 22 nt, Homo sapiens
ucagccacacgcccugacuccg

SEQ ID NO: 29584 - RNA, 20 nt, Homo sapiens
ugggaugcccauuugauucg

SEQ ID NO: 29585 - RNA, 17 nt, Homo sapiens
ccggggacggcgcgccu

SEQ ID NO: 29586 - RNA, 20 nt, Homo sapiens
gcgcagggcgggaaggcugc

SEQ ID NO: 29587 - RNA, 19 nt, Homo sapiens
gcgcgccuggcgcagcggg

SEQ ID NO: 29588 - RNA, 19 nt, Homo sapiens
ggacgcacgccggguccgg

SEQ ID NO: 29589 - RNA, 23 nt, Homo sapiens
gggcuggcggaggcggcucgagc

SEQ ID NO: 29590 - RNA, 18 nt, Homo sapiens
ggggcuggcggaggcggc

SEQ ID NO: 29591 - RNA, 16 nt, Homo sapiens
guccuggacgcgcccg

SEQ ID NO: 29592 - RNA, 16 nt, Homo sapiens
aucagcuuucuuaccu

SEQ ID NO: 29593 - RNA, 24 nt, Homo sapiens
cauagaauauuuacaaauauugac

SEQ ID NO: 29594 - RNA, 20 nt, Homo sapiens
uaugguggguacaaggcugg

SEQ ID NO: 29595 - RNA, 22 nt, Homo sapiens
uauguaagucgugcuaguaggu

SEQ ID NO: 29596 - RNA, 19 nt, Homo sapiens
ucaugaacuucaauaauca

SEQ ID NO: 29597 - RNA, 25 nt, Homo sapiens
uuagcugaaucaauccuuuuaaaag

SEQ ID NO: 29598 - RNA, 18 nt, Homo sapiens
aagccacacccaugaggc

SEQ ID NO: 29599 - RNA, 20 nt, Homo sapiens
cacaggauagcauaacaagu

SEQ ID NO: 29600 - RNA, 21 nt, Homo sapiens
cucacaaucuaacagcgagac

SEQ ID NO: 29601 - RNA, 19 nt, Homo sapiens
gaggccgccgccgccucuc

SEQ ID NO: 29602 - RNA, 19 nt, Homo sapiens
gccuuggugguuagcaugg

SEQ ID NO: 29603 - RNA, 26 nt, Homo sapiens
uaacaaaugugacagggaccgggcug

SEQ ID NO: 29604 - RNA, 21 nt, Homo sapiens
uccaacugccuuucccgcccu

SEQ ID NO: 29605 - RNA, 24 nt, Homo sapiens
uccaacugccuuucccgcccuuuc

SEQ ID NO: 29606 - RNA, 16 nt, Homo sapiens
ugagccugggccaggc

SEQ ID NO: 29607 - RNA, 17 nt, Homo sapiens
uguuuugauacaugccu

SEQ ID NO: 29608 - RNA, 20 nt, Homo sapiens
uuuuuuauacuccuggauaa

SEQ ID NO: 29609 - RNA, 17 nt, Homo sapiens
augcuaauggccaaacc

SEQ ID NO: 29610 - RNA, 17 nt, Homo sapiens
cagcgccuccuccacac

SEQ ID NO: 29611 - RNA, 19 nt, Homo sapiens
ccccugagcugggcauguc

SEQ ID NO: 29612 - RNA, 18 nt, Homo sapiens
cuccgcgcccaccgcccc

SEQ ID NO: 29613 - RNA, 18 nt, Homo sapiens
gccgugagccccaccgcc

SEQ ID NO: 29614 - RNA, 21 nt, Homo sapiens
ugaggugguggguagcaugaa

SEQ ID NO: 29615 - RNA, 16 nt, Homo sapiens
uggcacaaagccaggg

SEQ ID NO: 29616 - RNA, 17 nt, Homo sapiens
ugggggaaaagugugca

SEQ ID NO: 29617 - RNA, 17 nt, Homo sapiens
uucugcccuccucccag

SEQ ID NO: 29618 - RNA, 21 nt, Homo sapiens
aagcauaagucaauuaaguag

SEQ ID NO: 29619 - RNA, 16 nt, Homo sapiens
auagaggaggauuacu

SEQ ID NO: 29620 - RNA, 24 nt, Homo sapiens
augugaucuuguuaaaaacuggag

SEQ ID NO: 29621 - RNA, 19 nt, Homo sapiens
cacaauaucuguuggggaa

SEQ ID NO: 29622 - RNA, 19 nt, Homo sapiens
gauuugccacaauaucugu

SEQ ID NO: 29623 - RNA, 23 nt, Homo sapiens
ucaauacauacuacaacagauga

SEQ ID NO: 29624 - RNA, 18 nt, Homo sapiens
aagugcuauauuuccaac

SEQ ID NO: 29625 - RNA, 23 nt, Homo sapiens
aguuguuagaaaaacauuaaaau

SEQ ID NO: 29626 - RNA, 18 nt, Homo sapiens
uauguacauauauacaca

SEQ ID NO: 29627 - RNA, 17 nt, Homo sapiens
ucuucaucaauguguuu

SEQ ID NO: 29628 - RNA, 20 nt, Homo sapiens
ugcaggacaugugggaaaac

SEQ ID NO: 29629 - RNA, 21 nt, Homo sapiens
uggaacaccaaaaaauuuuga

SEQ ID NO: 29630 - RNA, 21 nt, Homo sapiens
caaacaccaccucugagggcu

SEQ ID NO: 29631 - RNA, 16 nt, Homo sapiens
caggguccccagugcc

SEQ ID NO: 29632 - RNA, 17 nt, Homo sapiens
ccuggagccacaagacc

SEQ ID NO: 29633 - RNA, 16 nt, Homo sapiens
gagcuccuucuugguu

SEQ ID NO: 29634 - RNA, 21 nt, Homo sapiens
ggagggggugaggaaggacaa

SEQ ID NO: 29635 - RNA, 20 nt, Homo sapiens
gggaaaacaggggaaacaga

SEQ ID NO: 29636 - RNA, 19 nt, Homo sapiens
gggagagguggggcagggg

SEQ ID NO: 29637 - RNA, 21 nt, Homo sapiens
gggggugaggaaggacaaggg

SEQ ID NO: 29638 - RNA, 19 nt, Homo sapiens
ucacauggccagacugugc

SEQ ID NO: 29639 - RNA, 15 nt, Homo sapiens
ucuggagaaaccugu

SEQ ID NO: 29640 - RNA, 20 nt, Homo sapiens
ugaauugagcaccuaguaug

SEQ ID NO: 29641 - RNA, 16 nt, Homo sapiens
ugagguggggaugcca

SEQ ID NO: 29642 - RNA, 19 nt, Homo sapiens
uucuugguucugguguugc

SEQ ID NO: 29643 - RNA, 23 nt, Homo sapiens
acaaaaaggggugggguggucuu

SEQ ID NO: 29644 - RNA, 17 nt, Homo sapiens
accuagggcauggaggc

SEQ ID NO: 29645 - RNA, 20 nt, Homo sapiens
cggccggagggagcuggggc

SEQ ID NO: 29646 - RNA, 20 nt, Homo sapiens
gagggagcuggggcuggggc

SEQ ID NO: 29647 - RNA, 20 nt, Homo sapiens
gcuggugcgugggcggaggc

SEQ ID NO: 29648 - RNA, 18 nt, Homo sapiens
ggggcuggggcuggugcu

SEQ ID NO: 29649 - RNA, 14 nt, Homo sapiens
uccaggggagggug

SEQ ID NO: 29650 - RNA, 19 nt, Homo sapiens
ugaccuuugacguggggcc

SEQ ID NO: 29651 - RNA, 19 nt, Homo sapiens
agggugggcaagcccaacu

SEQ ID NO: 29652 - RNA, 20 nt, Homo sapiens
gacuagcgggcggcggcgcc

SEQ ID NO: 29653 - RNA, 18 nt, Homo sapiens
gccacgcacagggcaggc

SEQ ID NO: 29654 - RNA, 19 nt, Homo sapiens
ggauuacaggcgugcccgg

SEQ ID NO: 29655 - RNA, 22 nt, Homo sapiens
ggccacggucacacaaagccac

SEQ ID NO: 29656 - RNA, 19 nt, Homo sapiens
ggcuccucacaggccgcgu

SEQ ID NO: 29657 - RNA, 21 nt, Homo sapiens
ggggcagcagaguggugcucu

SEQ ID NO: 29658 - RNA, 20 nt, Homo sapiens
gguccccuuggccuggggcc

SEQ ID NO: 29659 - RNA, 22 nt, Homo sapiens
uagaaauaagucauauuucuga

SEQ ID NO: 29660 - RNA, 21 nt, Homo sapiens
uauaugcucaaaucccuuugg

SEQ ID NO: 29661 - RNA, 20 nt, Homo sapiens
uggugcucuggccccgcgcc

SEQ ID NO: 29662 - RNA, 17 nt, Homo sapiens
ugucccaggcugcacag

SEQ ID NO: 29663 - RNA, 17 nt, Homo sapiens
uucccagcaugacagag

SEQ ID NO: 29664 - RNA, 22 nt, Homo sapiens
auuaaauaauguuauuuugagu

SEQ ID NO: 29665 - RNA, 19 nt, Homo sapiens
uaaacuuccaaguggccag

SEQ ID NO: 29666 - RNA, 19 nt, Homo sapiens
uuagagacucuucuguaag

SEQ ID NO: 29667 - RNA, 22 nt, Homo sapiens
aggcgccccaagccagcaggcc

SEQ ID NO: 29668 - RNA, 18 nt, Homo sapiens
cagcaggcuccgggggca

SEQ ID NO: 29669 - RNA, 21 nt, Homo sapiens
ccgccgaggugugauggggac

SEQ ID NO: 29670 - RNA, 25 nt, Homo sapiens
ccgccgaggugugauggggacugga

SEQ ID NO: 29671 - RNA, 17 nt, Homo sapiens
gcucccaggcuccgucc

SEQ ID NO: 29672 - RNA, 21 nt, Homo sapiens
ggggagggaggguggaggggc

SEQ ID NO: 29673 - RNA, 23 nt, Homo sapiens
ucgcccccuugcgcggcggcccc

SEQ ID NO: 29674 - RNA, 16 nt, Homo sapiens
aaccaaagacacauaa

SEQ ID NO: 29675 - RNA, 15 nt, Homo sapiens
agcuacauuccuuuu

SEQ ID NO: 29676 - RNA, 19 nt, Homo sapiens
cugaccaucucuccauacu

SEQ ID NO: 29677 - RNA, 20 nt, Homo sapiens
agcccucccacccugggacc

SEQ ID NO: 29678 - RNA, 22 nt, Homo sapiens
ugacauuuaaaugguuacauga

SEQ ID NO: 29679 - RNA, 22 nt, Homo sapiens
augguguggauauccaacggau

SEQ ID NO: 29680 - RNA, 20 nt, Homo sapiens
ggaaugggggacucagguuc

SEQ ID NO: 29681 - RNA, 19 nt, Homo sapiens
ucugguuagauucuagagc

SEQ ID NO: 29682 - RNA, 17 nt, Homo sapiens
cucaacaucucugggaa

SEQ ID NO: 29683 - RNA, 23 nt, Homo sapiens
ucggcacugcgcugagacccagg

SEQ ID NO: 29684 - RNA, 17 nt, Homo sapiens
uggagguggagaaggga

SEQ ID NO: 29685 - RNA, 16 nt, Homo sapiens
acgaacaaaacacagc

SEQ ID NO: 29686 - RNA, 20 nt, Homo sapiens
cauagaacaggcugggcaca

SEQ ID NO: 29687 - RNA, 19 nt, Homo sapiens
gcccgacagcccgaagccc

SEQ ID NO: 29688 - RNA, 17 nt, Homo sapiens
gcccggccgcuucgcau

SEQ ID NO: 29689 - RNA, 17 nt, Homo sapiens
uagauuuaaaccaggau

SEQ ID NO: 29690 - RNA, 20 nt, Homo sapiens
ucaguaccugagaauuauca

SEQ ID NO: 29691 - RNA, 21 nt, Homo sapiens
ucgaacuccugaucucaugau

SEQ ID NO: 29692 - RNA, 21 nt, Homo sapiens
ugacccugaagccagggaggg

SEQ ID NO: 29693 - RNA, 20 nt, Homo sapiens
gcaauggccaccaugucugc

SEQ ID NO: 29694 - RNA, 18 nt, Homo sapiens
gccugcuuuccuccucuc

SEQ ID NO: 29695 - RNA, 20 nt, Homo sapiens
ggcuugguccccuuccuccc

SEQ ID NO: 29696 - RNA, 19 nt, Homo sapiens
uuccggaauggugugucca

SEQ ID NO: 29697 - RNA, 21 nt, Homo sapiens
gcagcuggggaacaguacuug

SEQ ID NO: 29698 - RNA, 17 nt, Homo sapiens
gugaaaggaagcaagag

SEQ ID NO: 29699 - RNA, 19 nt, Homo sapiens
aaaauauuaucuaaaggua

SEQ ID NO: 29700 - RNA, 21 nt, Homo sapiens
auucugaauucuacccucgcu

SEQ ID NO: 29701 - RNA, 24 nt, Homo sapiens
ccuuaaauaccugaaaaugugacu

SEQ ID NO: 29702 - RNA, 18 nt, Homo sapiens
gaucguggcgacgacucg

SEQ ID NO: 29703 - RNA, 19 nt, Homo sapiens
uaaaaucuaccuguagaac

SEQ ID NO: 29704 - RNA, 14 nt, Homo sapiens
uacaugccugcuuc

SEQ ID NO: 29705 - RNA, 19 nt, Homo sapiens
ucguggcgacgacucggcc

SEQ ID NO: 29706 - RNA, 19 nt, Homo sapiens
cagaauuaagaauauaaua

SEQ ID NO: 29707 - RNA, 22 nt, Homo sapiens
cugcgcccuuggggcguggcug

SEQ ID NO: 29708 - RNA, 16 nt, Homo sapiens
gcccuuggggcguggc

SEQ ID NO: 29709 - RNA, 17 nt, Homo sapiens
ucccgcgcuuucugagc

SEQ ID NO: 29710 - RNA, 20 nt, Homo sapiens
acgggacacgggggccccua

SEQ ID NO: 29711 - RNA, 18 nt, Homo sapiens
cacaggagcccccgacac

SEQ ID NO: 29712 - RNA, 22 nt, Homo sapiens
cgcggccggcagcggucggguc

SEQ ID NO: 29713 - RNA, 23 nt, Homo sapiens
cgggggcggcgggggcugccgcu

SEQ ID NO: 29714 - RNA, 18 nt, Homo sapiens
ggcaggagcagcgggagc

SEQ ID NO: 29715 - RNA, 16 nt, Homo sapiens
ugcugcacggccuggc

SEQ ID NO: 29716 - RNA, 20 nt, Homo sapiens
acacacacaaacacauacuc

SEQ ID NO: 29717 - RNA, 17 nt, Homo sapiens
ccggccgccgacucucc

SEQ ID NO: 29718 - RNA, 23 nt, Homo sapiens
cgcggcugcuccggcccagcugu

SEQ ID NO: 29719 - RNA, 23 nt, Homo sapiens
cuccucccgccggggcccgcggg

SEQ ID NO: 29720 - RNA, 17 nt, Homo sapiens
gcccgcucgcucccucc

SEQ ID NO: 29721 - RNA, 19 nt, Homo sapiens
gcucggccccucgggcgcc

SEQ ID NO: 29722 - RNA, 15 nt, Homo sapiens
ggggcccgcgggggc

SEQ ID NO: 29723 - RNA, 19 nt, Homo sapiens
acccucgcuguuucuacaa

SEQ ID NO: 29724 - RNA, 21 nt, Homo sapiens
ccucggaccccgcucugccgg

SEQ ID NO: 29725 - RNA, 16 nt, Homo sapiens
gauacuggcagcuccu

SEQ ID NO: 29726 - RNA, 25 nt, Homo sapiens
ucucccaccugggcucgcuguuggu

SEQ ID NO: 29727 - RNA, 21 nt, Homo sapiens
cuccucuccucucuaccauuc

SEQ ID NO: 29728 - RNA, 20 nt, Homo sapiens
gugaggaugugcugccacaa

SEQ ID NO: 29729 - RNA, 19 nt, Homo sapiens
guguuguucaucugguugg

SEQ ID NO: 29730 - RNA, 20 nt, Homo sapiens
aagagaaaaaugaaagagac

SEQ ID NO: 29731 - RNA, 19 nt, Homo sapiens
acccaauuguauucaaugu

SEQ ID NO: 29732 - RNA, 23 nt, Homo sapiens
agaaguuggcuaggggcccacgg

SEQ ID NO: 29733 - RNA, 18 nt, Homo sapiens
caaacucaucuaaaugua

SEQ ID NO: 29734 - RNA, 24 nt, Homo sapiens
cacccggaggcuccucggcgggac

SEQ ID NO: 29735 - RNA, 18 nt, Homo sapiens
cuccccacccggaggcuc

SEQ ID NO: 29736 - RNA, 21 nt, Homo sapiens
cuguuugaucaugugcaggaa

SEQ ID NO: 29737 - RNA, 19 nt, Homo sapiens
gaagacucccauuucacau

SEQ ID NO: 29738 - RNA, 18 nt, Homo sapiens
gaugccgccgggacagua

SEQ ID NO: 29739 - RNA, 21 nt, Homo sapiens
ggcccacgggugggcggaggg

SEQ ID NO: 29740 - RNA, 15 nt, Homo sapiens
ugaaagagaccuuuc

SEQ ID NO: 29741 - RNA, 23 nt, Homo sapiens
uggaaauggauuuucuucauaga

SEQ ID NO: 29742 - RNA, 18 nt, Homo sapiens
uguguuuugaaaaaauga

SEQ ID NO: 29743 - RNA, 24 nt, Homo sapiens
accgucgugagacagguuaguuuu

SEQ ID NO: 29744 - RNA, 23 nt, Homo sapiens
agaggaaccgcagguucagacau

SEQ ID NO: 29745 - RNA, 19 nt, Homo sapiens
aucauccucuacacuucuc

SEQ ID NO: 29746 - RNA, 21 nt, Homo sapiens
auuauuuaaaaauuauuccaa

SEQ ID NO: 29747 - RNA, 16 nt, Homo sapiens
cccaacauggacagaa

SEQ ID NO: 29748 - RNA, 18 nt, Homo sapiens
ccuaaucuuuaacacuuu

SEQ ID NO: 29749 - RNA, 21 nt, Homo sapiens
cgaggcaaccgggaagcagcc

SEQ ID NO: 29750 - RNA, 19 nt, Homo sapiens
cuucucaaagucaaugaau

SEQ ID NO: 29751 - RNA, 19 nt, Homo sapiens
gagaggaaccgcagguuca

SEQ ID NO: 29752 - RNA, 16 nt, Homo sapiens
gaugucaaggagucca

SEQ ID NO: 29753 - RNA, 25 nt, Homo sapiens
ggcagagagaaagaaaaugauucca

SEQ ID NO: 29754 - RNA, 18 nt, Homo sapiens
ggcgcccccugucuucuu

SEQ ID NO: 29755 - RNA, 25 nt, Homo sapiens
uccaacauaaauacucuuuuaaagc

SEQ ID NO: 29756 - RNA, 19 nt, Homo sapiens
uccggccgggacucggugg

SEQ ID NO: 29757 - RNA, 17 nt, Homo sapiens
ucgugagacagguuagu

SEQ ID NO: 29758 - RNA, 20 nt, Homo sapiens
ugaauucuguuugcaaguug

SEQ ID NO: 29759 - RNA, 18 nt, Homo sapiens
ugguuacacagggcugcu

SEQ ID NO: 29760 - RNA, 18 nt, Homo sapiens
uuucaaggugcuauuguu

SEQ ID NO: 29761 - RNA, 17 nt, Homo sapiens
aaaaaggcaaauaauaa

SEQ ID NO: 29762 - RNA, 20 nt, Homo sapiens
aaccacaagcugacaauucu

SEQ ID NO: 29763 - RNA, 22 nt, Homo sapiens
aagcaaaaagguuaagcaccca

SEQ ID NO: 29764 - RNA, 20 nt, Homo sapiens
agaaggagggaggaaggaag

SEQ ID NO: 29765 - RNA, 21 nt, Homo sapiens
auccugagccaagugguuuuu

SEQ ID NO: 29766 - RNA, 18 nt, Homo sapiens
cacucuccuuucuggggg

SEQ ID NO: 29767 - RNA, 25 nt, Homo sapiens
cgaaaguuccucauuucucuuacuu

SEQ ID NO: 29768 - RNA, 16 nt, Homo sapiens
gcaaaguggcaccugg

SEQ ID NO: 29769 - RNA, 24 nt, Homo sapiens
guggggaggggaaaaucaaggagg

SEQ ID NO: 29770 - RNA, 19 nt, Homo sapiens
uaccuuggcuuccccuuug

SEQ ID NO: 29771 - RNA, 21 nt, Homo sapiens
ugggugagaaaagcaaagcaa

SEQ ID NO: 29772 - RNA, 18 nt, Homo sapiens
uguggaaaagaauuuguu

SEQ ID NO: 29773 - RNA, 18 nt, Homo sapiens
uguucucccagcucucua

SEQ ID NO: 29774 - RNA, 28 nt, Homo sapiens
aaaaagaaaaaaaaaaucaaaggcauua

SEQ ID NO: 29775 - RNA, 22 nt, Homo sapiens
aggggcugggguccgauggaga

SEQ ID NO: 29776 - RNA, 21 nt, Homo sapiens
gggcuggguuucccgaaggag

SEQ ID NO: 29777 - RNA, 20 nt, Homo sapiens
ucaaaggcauuucaucucca

SEQ ID NO: 29778 - RNA, 21 nt, Homo sapiens
cagugagagacacacacacuc

SEQ ID NO: 29779 - RNA, 18 nt, Homo sapiens
cuugucauuguuuuccuu

SEQ ID NO: 29780 - RNA, 18 nt, Homo sapiens
ggaagaguguguggcugc

SEQ ID NO: 29781 - RNA, 20 nt, Homo sapiens
aauuccaguaaaucauuucc

SEQ ID NO: 29782 - RNA, 15 nt, Homo sapiens
acagaugagauagaa

SEQ ID NO: 29783 - RNA, 15 nt, Homo sapiens
acagcuucugcaccc

SEQ ID NO: 29784 - RNA, 18 nt, Homo sapiens
acccugcccccccccucc

SEQ ID NO: 29785 - RNA, 19 nt, Homo sapiens
aggaccgacccacagagcg

SEQ ID NO: 29786 - RNA, 14 nt, Homo sapiens
aggagggggccucc

SEQ ID NO: 29787 - RNA, 18 nt, Homo sapiens
agggagcugcagcagcuu

SEQ ID NO: 29788 - RNA, 19 nt, Homo sapiens
auuuuggcaaaaaugucaa

SEQ ID NO: 29789 - RNA, 18 nt, Homo sapiens
caaaagcaucugucaguu

SEQ ID NO: 29790 - RNA, 20 nt, Homo sapiens
cacccgacccccaacucaug

SEQ ID NO: 29791 - RNA, 19 nt, Homo sapiens
cccucccuuucccuccccc

SEQ ID NO: 29792 - RNA, 21 nt, Homo sapiens
cccucuccguuuucagcccuc

SEQ ID NO: 29793 - RNA, 19 nt, Homo sapiens
cgggcgcgaggcggcugcg

SEQ ID NO: 29794 - RNA, 22 nt, Homo sapiens
gcgagcagcugaggcggcggcu

SEQ ID NO: 29795 - RNA, 15 nt, Homo sapiens
gcgcgaggcggcugc

SEQ ID NO: 29796 - RNA, 22 nt, Homo sapiens
ggcggcugcgcggaggaggcgg

SEQ ID NO: 29797 - RNA, 23 nt, Homo sapiens
ggcggcugcgcggaggaggcggc

SEQ ID NO: 29798 - RNA, 18 nt, Homo sapiens
uaaguuuucuuuucaucu

SEQ ID NO: 29799 - RNA, 19 nt, Homo sapiens
ucagguucuaagucuguca

SEQ ID NO: 29800 - RNA, 23 nt, Homo sapiens
uccuaugcuuuuuucauuaaaaa

SEQ ID NO: 29801 - RNA, 18 nt, Homo sapiens
ugacaaacaccagacauu

SEQ ID NO: 29802 - RNA, 17 nt, Homo sapiens
ugcccccccccuccccc

SEQ ID NO: 29803 - RNA, 15 nt, Homo sapiens
acguucccgggaucu

SEQ ID NO: 29804 - RNA, 19 nt, Homo sapiens
agaucuuguucucucacca

SEQ ID NO: 29805 - RNA, 23 nt, Homo sapiens
agcagggugcagggggcaggaag

SEQ ID NO: 29806 - RNA, 14 nt, Homo sapiens
ucaucucccccgug

SEQ ID NO: 29807 - RNA, 18 nt, Homo sapiens
agccaagguguuuuagcc

SEQ ID NO: 29808 - RNA, 19 nt, Homo sapiens
uaaaaugucaaaagacacu

SEQ ID NO: 29809 - RNA, 19 nt, Homo sapiens
uuaaaggccaauccacaga

SEQ ID NO: 29810 - RNA, 21 nt, Homo sapiens
cacacucuuugcgcaucucag

SEQ ID NO: 29811 - RNA, 20 nt, Homo sapiens
gcacuagaguguaaaacuau

SEQ ID NO: 29812 - RNA, 21 nt, Homo sapiens
gucucagguuccuucagcucc

SEQ ID NO: 29813 - RNA, 19 nt, Homo sapiens
gcucagcguccugggugcg

SEQ ID NO: 29814 - RNA, 21 nt, Homo sapiens
agaccagccuagacaacauag

SEQ ID NO: 29815 - RNA, 14 nt, Homo sapiens
aggcgccuccccug

SEQ ID NO: 29816 - RNA, 18 nt, Homo sapiens
ccccggagggagcccggc

SEQ ID NO: 29817 - RNA, 22 nt, Homo sapiens
ccggccuguggcgcccuucccc

SEQ ID NO: 29818 - RNA, 16 nt, Homo sapiens
cggcggcugcaccccg

SEQ ID NO: 29819 - RNA, 20 nt, Homo sapiens
cugguucuaucccuuuugcc

SEQ ID NO: 29820 - RNA, 18 nt, Homo sapiens
gacaagacugggagacuc

SEQ ID NO: 29821 - RNA, 21 nt, Homo sapiens
gacacaaagggaggaggucuu

SEQ ID NO: 29822 - RNA, 18 nt, Homo sapiens
gccuggcaugugcgcaca

SEQ ID NO: 29823 - RNA, 16 nt, Homo sapiens
ggcgcccuucccccga

SEQ ID NO: 29824 - RNA, 18 nt, Homo sapiens
gggaaaaugcuuuagaaa

SEQ ID NO: 29825 - RNA, 22 nt, Homo sapiens
uaaaaccugauguguguuguua

SEQ ID NO: 29826 - RNA, 18 nt, Homo sapiens
uaagccuguaaacuagcu

SEQ ID NO: 29827 - RNA, 19 nt, Homo sapiens
uauaauacaaaaaaauaca

SEQ ID NO: 29828 - RNA, 21 nt, Homo sapiens
ucucucugagcugucaaccau

SEQ ID NO: 29829 - RNA, 19 nt, Homo sapiens
ugggggggccugcuaaauc

SEQ ID NO: 29830 - RNA, 17 nt, Homo sapiens
uugggaggccaaggcgg

SEQ ID NO: 29831 - RNA, 22 nt, Homo sapiens
aaagaugaaagcaaaauguuua

SEQ ID NO: 29832 - RNA, 16 nt, Homo sapiens
aacuguuuuguucugu

SEQ ID NO: 29833 - RNA, 22 nt, Homo sapiens
acaauguggugggaaaaagaaa

SEQ ID NO: 29834 - RNA, 15 nt, Homo sapiens
acacuuuuaaaggga

SEQ ID NO: 29835 - RNA, 21 nt, Homo sapiens
acuucaggcuacaguuacuau

SEQ ID NO: 29836 - RNA, 19 nt, Homo sapiens
agauguuguccucccuggu

SEQ ID NO: 29837 - RNA, 22 nt, Homo sapiens
agggagauuaaaacauauaagu

SEQ ID NO: 29838 - RNA, 17 nt, Homo sapiens
auuggccagugagcaug

SEQ ID NO: 29839 - RNA, 18 nt, Homo sapiens
cacuuuucaaaagcugcg

SEQ ID NO: 29840 - RNA, 17 nt, Homo sapiens
cagaggaugugugaugc

SEQ ID NO: 29841 - RNA, 19 nt, Homo sapiens
caggaucuugcucuguugc

SEQ ID NO: 29842 - RNA, 19 nt, Homo sapiens
caucaagcucuuuauuggc

SEQ ID NO: 29843 - RNA, 20 nt, Homo sapiens
cccaugcagcuggaauggua

SEQ ID NO: 29844 - RNA, 27 nt, Homo sapiens
cccuguuugugugugugugugugugua

SEQ ID NO: 29845 - RNA, 16 nt, Homo sapiens
ccugguggggaaggaa

SEQ ID NO: 29846 - RNA, 18 nt, Homo sapiens
ccuugccgcccuguuuug

SEQ ID NO: 29847 - RNA, 16 nt, Homo sapiens
cgggccauuucuuguu

SEQ ID NO: 29848 - RNA, 18 nt, Homo sapiens
gcaggugaggcuguaaca

SEQ ID NO: 29849 - RNA, 18 nt, Homo sapiens
gcauuauuucucacaggg

SEQ ID NO: 29850 - RNA, 21 nt, Homo sapiens
gccauuucuuguuuuacccau

SEQ ID NO: 29851 - RNA, 18 nt, Homo sapiens
gccuggcuaauuuuuuaa

SEQ ID NO: 29852 - RNA, 19 nt, Homo sapiens
gcuuucuauccuggugcag

SEQ ID NO: 29853 - RNA, 23 nt, Homo sapiens
ggcguaucacugugucuucuagc

SEQ ID NO: 29854 - RNA, 21 nt, Homo sapiens
uaaauuauguguuuucugaag

SEQ ID NO: 29855 - RNA, 21 nt, Homo sapiens
ucaauauaauucuucccuuua

SEQ ID NO: 29856 - RNA, 22 nt, Homo sapiens
ucuauagcccuucucuaucuaa

SEQ ID NO: 29857 - RNA, 23 nt, Homo sapiens
ucuggaacuccugggcuaaauga

SEQ ID NO: 29858 - RNA, 19 nt, Homo sapiens
ucuguacagugacauuuac

SEQ ID NO: 29859 - RNA, 18 nt, Homo sapiens
ugaaauaauuaaagcuaa

SEQ ID NO: 29860 - RNA, 21 nt, Homo sapiens
ugacuaugccucuuccuuuuc

SEQ ID NO: 29861 - RNA, 21 nt, Homo sapiens
ugauaggugcuaguagaaaau

SEQ ID NO: 29862 - RNA, 18 nt, Homo sapiens
ugauuugugugaaaugac

SEQ ID NO: 29863 - RNA, 19 nt, Homo sapiens
ugcacaugacugucuccau

SEQ ID NO: 29864 - RNA, 17 nt, Homo sapiens
ugccauguuguacacaa

SEQ ID NO: 29865 - RNA, 22 nt, Homo sapiens
ugugauucaaccugauauauga

SEQ ID NO: 29866 - RNA, 18 nt, Homo sapiens
ugugugugugugugugug

SEQ ID NO: 29867 - RNA, 17 nt, Homo sapiens
uguugcaauggccuugc

SEQ ID NO: 29868 - RNA, 18 nt, Homo sapiens
uguuugugugugugugug

SEQ ID NO: 29869 - RNA, 20 nt, Homo sapiens
uuucauggguuguccugcua

SEQ ID NO: 29870 - RNA, 23 nt, Homo sapiens
uuuccauuuguuacacaaggaaa

SEQ ID NO: 29871 - RNA, 23 nt, Homo sapiens
uuugugugugugugugugugugu

SEQ ID NO: 29872 - RNA, 19 nt, Homo sapiens
aagccuagcugucuggggu

SEQ ID NO: 29873 - RNA, 20 nt, Homo sapiens
agcgggcucagcacccgcgc

SEQ ID NO: 29874 - RNA, 15 nt, Homo sapiens
caaguauuuauugag

SEQ ID NO: 29875 - RNA, 16 nt, Homo sapiens
ucaccgcaccucugug

SEQ ID NO: 29876 - RNA, 22 nt, Homo sapiens
ucuggggugcuguggugguggu

SEQ ID NO: 29877 - RNA, 18 nt, Homo sapiens
aacagggggaaauuguua

SEQ ID NO: 29878 - RNA, 22 nt, Homo sapiens
aagggauaagcaggguuggggc

SEQ ID NO: 29879 - RNA, 19 nt, Homo sapiens
auuggugcauuuuacagag

SEQ ID NO: 29880 - RNA, 19 nt, Homo sapiens
auuggugcguuuuacagag

SEQ ID NO: 29881 - RNA, 20 nt, Homo sapiens
auugguguguuuuacagagc

SEQ ID NO: 29882 - RNA, 29 nt, Homo sapiens
caggaggguggguguggggccucgcugag

SEQ ID NO: 29883 - RNA, 21 nt, Homo sapiens
cgcuguccgcccugugggugc

SEQ ID NO: 29884 - RNA, 19 nt, Homo sapiens
cggcuugggucacagcccg

SEQ ID NO: 29885 - RNA, 17 nt, Homo sapiens
cucaaugucugaaaagu

SEQ ID NO: 29886 - RNA, 18 nt, Homo sapiens
cugaaguuccugugacgc

SEQ ID NO: 29887 - RNA, 18 nt, Homo sapiens
gaauccugcugauuggug

SEQ ID NO: 29888 - RNA, 19 nt, Homo sapiens
gaggguggguguggggcgg

SEQ ID NO: 29889 - RNA, 18 nt, Homo sapiens
gcgcgcgggagucaaguc

SEQ ID NO: 29890 - RNA, 22 nt, Homo sapiens
gcgcgcgggagucaagucucca

SEQ ID NO: 29891 - RNA, 23 nt, Homo sapiens
uauugcuagcuacagagcgcuga

SEQ ID NO: 29892 - RNA, 18 nt, Homo sapiens
uggaucuaaucuaguuua

SEQ ID NO: 29893 - RNA, 18 nt, Homo sapiens
caaagugggagcaggguu

SEQ ID NO: 29894 - RNA, 16 nt, Homo sapiens
cagggccuuggggagc

SEQ ID NO: 29895 - RNA, 19 nt, Homo sapiens
ccugugguguggcuauggu

SEQ ID NO: 29896 - RNA, 17 nt, Homo sapiens
cgaggcaagguccugau

SEQ ID NO: 29897 - RNA, 22 nt, Homo sapiens
cuacugcauuguaaacuuucag

SEQ ID NO: 29898 - RNA, 17 nt, Homo sapiens
ggagguggggaggagac

SEQ ID NO: 29899 - RNA, 16 nt, Homo sapiens
ggguggggcugggggg

SEQ ID NO: 29900 - RNA, 20 nt, Homo sapiens
gucuggucuggucugucccu

SEQ ID NO: 29901 - RNA, 24 nt, Homo sapiens
guuaaucucaucucuuuuugugua

SEQ ID NO: 29902 - RNA, 18 nt, Homo sapiens
uacuguaccuccucccca

SEQ ID NO: 29903 - RNA, 28 nt, Homo sapiens
ucacguagagacagggauuagcuugugc

SEQ ID NO: 29904 - RNA, 16 nt, Homo sapiens
ucuccuggcucaacag

SEQ ID NO: 29905 - RNA, 23 nt, Homo sapiens
ugggucuggucuggucugucccu

SEQ ID NO: 29906 - RNA, 16 nt, Homo sapiens
uuucucuucugguuua

SEQ ID NO: 29907 - RNA, 16 nt, Homo sapiens
acuaugacaaacaagu

SEQ ID NO: 29908 - RNA, 22 nt, Homo sapiens
cuccuccuccuccuucuuggag

SEQ ID NO: 29909 - RNA, 21 nt, Homo sapiens
gagcgccccggcgccgcccuc

SEQ ID NO: 29910 - RNA, 15 nt, Homo sapiens
cuguguguuuccauc

SEQ ID NO: 29911 - RNA, 18 nt, Homo sapiens
guacccaucuacacgggu

SEQ ID NO: 29912 - RNA, 16 nt, Homo sapiens
uccuaucuuuuauuag

SEQ ID NO: 29913 - RNA, 20 nt, Homo sapiens
aauaucaacuccaagaguau

SEQ ID NO: 29914 - RNA, 22 nt, Homo sapiens
aauuauuuacccuguuauucca

SEQ ID NO: 29915 - RNA, 17 nt, Homo sapiens
agcccccgcgaccugga

SEQ ID NO: 29916 - RNA, 18 nt, Homo sapiens
cagggcacacuuccucac

SEQ ID NO: 29917 - RNA, 17 nt, Homo sapiens
gagggauaucugacaaa

SEQ ID NO: 29918 - RNA, 18 nt, Homo sapiens
uaagccaaguuauuucac

SEQ ID NO: 29919 - RNA, 16 nt, Homo sapiens
aggguauucuacaguc

SEQ ID NO: 29920 - RNA, 18 nt, Homo sapiens
ggcuggguggucuggcag

SEQ ID NO: 29921 - RNA, 18 nt, Homo sapiens
ugggacagggaaagaggu

SEQ ID NO: 29922 - RNA, 16 nt, Homo sapiens
uguugaggaauagaga

SEQ ID NO: 29923 - RNA, 22 nt, Homo sapiens
acaagaucauccugguugcugg

SEQ ID NO: 29924 - RNA, 24 nt, Homo sapiens
agacuauccaaaauuuuaaaaaua

SEQ ID NO: 29925 - RNA, 17 nt, Homo sapiens
caaguucugaaaaauga

SEQ ID NO: 29926 - RNA, 23 nt, Homo sapiens
cucaguuucccaaaugggcaagg

SEQ ID NO: 29927 - RNA, 18 nt, Homo sapiens
gcucccuuggcugccugg

SEQ ID NO: 29928 - RNA, 17 nt, Homo sapiens
ggaguuaggaggggcau

SEQ ID NO: 29929 - RNA, 18 nt, Homo sapiens
uccuacucuucgucggcu

SEQ ID NO: 29930 - RNA, 24 nt, Homo sapiens
ucucucucuuaugcaccaagcaga

SEQ ID NO: 29931 - RNA, 16 nt, Homo sapiens
uggucuuccuuauggu

SEQ ID NO: 29932 - RNA, 18 nt, Homo sapiens
ugucuugugaguguggag

SEQ ID NO: 29933 - RNA, 23 nt, Homo sapiens
uuaguguuguaauaaaaaauaug

SEQ ID NO: 29934 - RNA, 19 nt, Homo sapiens
cacuuuucacuauauauca

SEQ ID NO: 29935 - RNA, 21 nt, Homo sapiens
ccacuaguguuagcauuccau

SEQ ID NO: 29936 - RNA, 19 nt, Homo sapiens
ucucugauucaggucugag

SEQ ID NO: 29937 - RNA, 18 nt, Homo sapiens
agccgccgaccaggagga

SEQ ID NO: 29938 - RNA, 16 nt, Homo sapiens
caggauccccggccgc

SEQ ID NO: 29939 - RNA, 14 nt, Homo sapiens
cccgacuccccgcc

SEQ ID NO: 29940 - RNA, 23 nt, Homo sapiens
cccuugguccccucccacccagg

SEQ ID NO: 29941 - RNA, 18 nt, Homo sapiens
ccucuggauuggggcccc

SEQ ID NO: 29942 - RNA, 17 nt, Homo sapiens
gccccgguccguugccc

SEQ ID NO: 29943 - RNA, 22 nt, Homo sapiens
gggauugccaggggcugaccgg

SEQ ID NO: 29944 - RNA, 20 nt, Homo sapiens
gguccccucccacccaggcc

SEQ ID NO: 29945 - RNA, 22 nt, Homo sapiens
aaaaaagaaaaaaauccacauu

SEQ ID NO: 29946 - RNA, 20 nt, Homo sapiens
aaagaaauacuggcuucaaa

SEQ ID NO: 29947 - RNA, 18 nt, Homo sapiens
acauaauaggauuuacua

SEQ ID NO: 29948 - RNA, 22 nt, Homo sapiens
auauauauauauauauauauau

SEQ ID NO: 29949 - RNA, 15 nt, Homo sapiens
cacagcuuacauuuu

SEQ ID NO: 29950 - RNA, 22 nt, Homo sapiens
ccugacaauugucaugcauccu

SEQ ID NO: 29951 - RNA, 16 nt, Homo sapiens
cuauggaaccuguggu

SEQ ID NO: 29952 - RNA, 15 nt, Homo sapiens
cuucauggaacugcu

SEQ ID NO: 29953 - RNA, 17 nt, Homo sapiens
gaauuuucauacaauga

SEQ ID NO: 29954 - RNA, 15 nt, Homo sapiens
gagagagagagagag

SEQ ID NO: 29955 - RNA, 18 nt, Homo sapiens
guguacugcacauuuaaa

SEQ ID NO: 29956 - RNA, 19 nt, Homo sapiens
uaaaauaccugcauuuaac

SEQ ID NO: 29957 - RNA, 20 nt, Homo sapiens
uaccacggcaugaaggcaau

SEQ ID NO: 29958 - RNA, 18 nt, Homo sapiens
uagagaacacaugugguc

SEQ ID NO: 29959 - RNA, 16 nt, Homo sapiens
uagcugcauuggccug

SEQ ID NO: 29960 - RNA, 18 nt, Homo sapiens
uauauauauauauauaua

SEQ ID NO: 29961 - RNA, 22 nt, Homo sapiens
uauauauauauauauauauaua

SEQ ID NO: 29962 - RNA, 23 nt, Homo sapiens
uauauauauauauauauauauau

SEQ ID NO: 29963 - RNA, 25 nt, Homo sapiens
uauauauauauauauauauauauau

SEQ ID NO: 29964 - RNA, 22 nt, Homo sapiens
uauauauauauauauauauauu

SEQ ID NO: 29965 - RNA, 18 nt, Homo sapiens
uaugauaucuguagugcu

SEQ ID NO: 29966 - RNA, 19 nt, Homo sapiens
uccagggcaaaaaggagaa

SEQ ID NO: 29967 - RNA, 18 nt, Homo sapiens
uccaguguauaaaacuuc

SEQ ID NO: 29968 - RNA, 18 nt, Homo sapiens
gggaaggaggggcggagc

SEQ ID NO: 29969 - RNA, 19 nt, Homo sapiens
ggggcuggggcuggggcag

SEQ ID NO: 29970 - RNA, 19 nt, Homo sapiens
ggguggggcuggggcuggg

SEQ ID NO: 29971 - RNA, 18 nt, Homo sapiens
gugaagagcugggauggu

SEQ ID NO: 29972 - RNA, 22 nt, Homo sapiens
uggugguuauggauuacaugug

SEQ ID NO: 29973 - RNA, 19 nt, Homo sapiens
cuaaagauuaguuggggcu

SEQ ID NO: 29974 - RNA, 20 nt, Homo sapiens
uaauauuuuacuaugauuuu

SEQ ID NO: 29975 - RNA, 21 nt, Homo sapiens
aggggguagggauccucgggu

SEQ ID NO: 29976 - RNA, 23 nt, Homo sapiens
gcuggcggggagcaguccuggug

SEQ ID NO: 29977 - RNA, 15 nt, Homo sapiens
ggguagggauccucg

SEQ ID NO: 29978 - RNA, 18 nt, Homo sapiens
agcugaggcuggagggag

SEQ ID NO: 29979 - RNA, 23 nt, Homo sapiens
cacugggagccgggcagacacug

SEQ ID NO: 29980 - RNA, 21 nt, Homo sapiens
gcagcuucuguccccacccag

SEQ ID NO: 29981 - RNA, 20 nt, Homo sapiens
gcuccugcuuaaaauggggc

SEQ ID NO: 29982 - RNA, 15 nt, Homo sapiens
ggcacggccgcagca

SEQ ID NO: 29983 - RNA, 19 nt, Homo sapiens
gggcaguggugagguagaa

SEQ ID NO: 29984 - RNA, 17 nt, Homo sapiens
acaccguggauaagggg

SEQ ID NO: 29985 - RNA, 18 nt, Homo sapiens
agacgggguauccccaug

SEQ ID NO: 29986 - RNA, 22 nt, Homo sapiens
aggggggcggggcaggggcggg

SEQ ID NO: 29987 - RNA, 18 nt, Homo sapiens
aguucaagugauuuuccu

SEQ ID NO: 29988 - RNA, 18 nt, Homo sapiens
caggggggcggggcaggg

SEQ ID NO: 29989 - RNA, 18 nt, Homo sapiens
ccaaaccaagcucugcgg

SEQ ID NO: 29990 - RNA, 18 nt, Homo sapiens
ccuccggucacaugguuc

SEQ ID NO: 29991 - RNA, 20 nt, Homo sapiens
ccugccugagccugggcucc

SEQ ID NO: 29992 - RNA, 21 nt, Homo sapiens
cggggagcaucuacggccugg

SEQ ID NO: 29993 - RNA, 15 nt, Homo sapiens
gagagagagagagag

SEQ ID NO: 29994 - RNA, 17 nt, Homo sapiens
gagccugcugaccagca

SEQ ID NO: 29995 - RNA, 19 nt, Homo sapiens
gauuacaggcaugcgccac

SEQ ID NO: 29996 - RNA, 15 nt, Homo sapiens
gcucucugucuacag

SEQ ID NO: 29997 - RNA, 24 nt, Homo sapiens
ggacguggggaacacagggacggu

SEQ ID NO: 29998 - RNA, 19 nt, Homo sapiens
ggaucccuacagggaugcc

SEQ ID NO: 29999 - RNA, 17 nt, Homo sapiens
ggcccccuccuggaagc

SEQ ID NO: 30000 - RNA, 27 nt, Homo sapiens
gggaaaacuugggaacuguuugaagaa

SEQ ID NO: 30001 - RNA, 15 nt, Homo sapiens
uaagugacugaccgg

SEQ ID NO: 30002 - RNA, 19 nt, Homo sapiens
ucacagcagucguuuggcg

SEQ ID NO: 30003 - RNA, 22 nt, Homo sapiens
ucaggaauguuaaucagguaaa

SEQ ID NO: 30004 - RNA, 18 nt, Homo sapiens
ugcacagacaugcuccug

SEQ ID NO: 30005 - RNA, 21 nt, Homo sapiens
uggacguggggaacacaggga

SEQ ID NO: 30006 - RNA, 18 nt, Homo sapiens
guguucaggcaucuccac

SEQ ID NO: 30007 - RNA, 17 nt, Homo sapiens
uaugaaugcaguccuga

SEQ ID NO: 30008 - RNA, 18 nt, Homo sapiens
aggcggacggccggcggc

SEQ ID NO: 30009 - RNA, 19 nt, Homo sapiens
aguggggucgugcucgcgc

SEQ ID NO: 30010 - RNA, 14 nt, Homo sapiens
caccgccucucccc

SEQ ID NO: 30011 - RNA, 19 nt, Homo sapiens
ccccaggucugacagguuc

SEQ ID NO: 30012 - RNA, 21 nt, Homo sapiens
ccgccucuccccgcccugccc

SEQ ID NO: 30013 - RNA, 15 nt, Homo sapiens
cgagggcagugccgc

SEQ ID NO: 30014 - RNA, 16 nt, Homo sapiens
cggccgcaggagagug

SEQ ID NO: 30015 - RNA, 24 nt, Homo sapiens
cucgagggcagugccgcgcguccc

SEQ ID NO: 30016 - RNA, 15 nt, Homo sapiens
gcccgccgcgcccgc

SEQ ID NO: 30017 - RNA, 21 nt, Homo sapiens
gcgcugcuccacccgcggccg

SEQ ID NO: 30018 - RNA, 18 nt, Homo sapiens
gggggaggcggacggccg

SEQ ID NO: 30019 - RNA, 18 nt, Homo sapiens
ugacugcaggauaaauaa

SEQ ID NO: 30020 - RNA, 16 nt, Homo sapiens
aacauguggcaggguu

SEQ ID NO: 30021 - RNA, 19 nt, Homo sapiens
ccgggggucccuagagccg

SEQ ID NO: 30022 - RNA, 17 nt, Homo sapiens
ggcaggguuggaaagaa

SEQ ID NO: 30023 - RNA, 17 nt, Homo sapiens
gggucccuagagccgcc

SEQ ID NO: 30024 - RNA, 15 nt, Homo sapiens
guucacuccugauaa

SEQ ID NO: 30025 - RNA, 18 nt, Homo sapiens
ucccagaaggggaagggg

SEQ ID NO: 30026 - RNA, 21 nt, Homo sapiens
ccagcuggggcugaugucccc

SEQ ID NO: 30027 - RNA, 19 nt, Homo sapiens
uccccucucccaugccuug

SEQ ID NO: 30028 - RNA, 19 nt, Homo sapiens
ucucuccucucaugugcag

SEQ ID NO: 30029 - RNA, 19 nt, Homo sapiens
ggaccccgggggcggucgc

SEQ ID NO: 30030 - RNA, 18 nt, Homo sapiens
ggcggcugcggcugcggc

SEQ ID NO: 30031 - RNA, 22 nt, Homo sapiens
ugcgcgguggagcccggcccgg

SEQ ID NO: 30032 - RNA, 18 nt, Homo sapiens
agggaggggaagaaaaca

SEQ ID NO: 30033 - RNA, 17 nt, Homo sapiens
ccgccggccgcugcucg

SEQ ID NO: 30034 - RNA, 20 nt, Homo sapiens
gcacuguucacauuuucaca

SEQ ID NO: 30035 - RNA, 20 nt, Homo sapiens
auauuaauaaaacccaauuc

SEQ ID NO: 30036 - RNA, 20 nt, Homo sapiens
gcuaucauuuuuugccaugu

SEQ ID NO: 30037 - RNA, 20 nt, Homo sapiens
gcucccagccgaggcuucgu

SEQ ID NO: 30038 - RNA, 27 nt, Homo sapiens
uauaacgguuuuccauauaaggaaaau

SEQ ID NO: 30039 - RNA, 18 nt, Homo sapiens
ucuuugguaugaaaauca

SEQ ID NO: 30040 - RNA, 19 nt, Homo sapiens
uucauaauagaaaauauuu

SEQ ID NO: 30041 - RNA, 22 nt, Homo sapiens
uacaggaaaggaggacagauga

SEQ ID NO: 30042 - RNA, 19 nt, Homo sapiens
agacaagauuguaacaccu

SEQ ID NO: 30043 - RNA, 16 nt, Homo sapiens
cggcgcucggcugccc

SEQ ID NO: 30044 - RNA, 16 nt, Homo sapiens
ucggcugcccgcgcgc

SEQ ID NO: 30045 - RNA, 17 nt, Homo sapiens
cagccccucgcuggggc

SEQ ID NO: 30046 - RNA, 19 nt, Homo sapiens
ccccccagucacuggguuc

SEQ ID NO: 30047 - RNA, 19 nt, Homo sapiens
gggccugagguccuggccc

SEQ ID NO: 30048 - RNA, 19 nt, Homo sapiens
gggcggggccggagcagga

SEQ ID NO: 30049 - RNA, 17 nt, Homo sapiens
gucaccccccagucacu

SEQ ID NO: 30050 - RNA, 18 nt, Homo sapiens
uggaggaggccuaagcug

SEQ ID NO: 30051 - RNA, 24 nt, Homo sapiens
uggggguguaggcgucacccccca

SEQ ID NO: 30052 - RNA, 18 nt, Homo sapiens
ugggguuggggcugggcc

SEQ ID NO: 30053 - RNA, 18 nt, Homo sapiens
uguaggcgucacccccca

SEQ ID NO: 30054 - RNA, 17 nt, Homo sapiens
caccaggcuaugggggc

SEQ ID NO: 30055 - RNA, 20 nt, Homo sapiens
gaggggcgaggagcugcggg

SEQ ID NO: 30056 - RNA, 15 nt, Homo sapiens
gcucaggguccccgg

SEQ ID NO: 30057 - RNA, 17 nt, Homo sapiens
gcugggggauugggguu

SEQ ID NO: 30058 - RNA, 19 nt, Homo sapiens
ggaggacugggccauggaa

SEQ ID NO: 30059 - RNA, 24 nt, Homo sapiens
ggagugaggggugggguuugggga

SEQ ID NO: 30060 - RNA, 16 nt, Homo sapiens
ggagugggguucaggg

SEQ ID NO: 30061 - RNA, 20 nt, Homo sapiens
ggcgugucccgcgggggcgg

SEQ ID NO: 30062 - RNA, 22 nt, Homo sapiens
ggcugcugccacggcuccgggu

SEQ ID NO: 30063 - RNA, 15 nt, Homo sapiens
gggaggggcgaggag

SEQ ID NO: 30064 - RNA, 17 nt, Homo sapiens
gggaggggcgggggcgg

SEQ ID NO: 30065 - RNA, 18 nt, Homo sapiens
gggccauggaacgaggga

SEQ ID NO: 30066 - RNA, 20 nt, Homo sapiens
gggcgaggagcugcgggggg

SEQ ID NO: 30067 - RNA, 16 nt, Homo sapiens
gggcugcugccacggc

SEQ ID NO: 30068 - RNA, 18 nt, Homo sapiens
ggggaggggcgggggcgg

SEQ ID NO: 30069 - RNA, 21 nt, Homo sapiens
ggggaggggcgggggcggggc

SEQ ID NO: 30070 - RNA, 20 nt, Homo sapiens
ggggcggggaggggcggggg

SEQ ID NO: 30071 - RNA, 15 nt, Homo sapiens
gggggcggggagggg

SEQ ID NO: 30072 - RNA, 17 nt, Homo sapiens
gggggcggggaggggcg

SEQ ID NO: 30073 - RNA, 19 nt, Homo sapiens
gggggcggggaggggcggg

SEQ ID NO: 30074 - RNA, 21 nt, Homo sapiens
ugggguuuggggaccucagug

SEQ ID NO: 30075 - RNA, 18 nt, Homo sapiens
uggguucaagguuccagu

SEQ ID NO: 30076 - RNA, 17 nt, Homo sapiens
aaacacacacacuaugu

SEQ ID NO: 30077 - RNA, 20 nt, Homo sapiens
acaugcugggugcaccugga

SEQ ID NO: 30078 - RNA, 17 nt, Homo sapiens
accugagggacaaagca

SEQ ID NO: 30079 - RNA, 16 nt, Homo sapiens
aggagauucugguccc

SEQ ID NO: 30080 - RNA, 20 nt, Homo sapiens
aggaggaggaggaaaggagg

SEQ ID NO: 30081 - RNA, 18 nt, Homo sapiens
cacaccagccucucccag

SEQ ID NO: 30082 - RNA, 18 nt, Homo sapiens
cauuucuccucuguucac

SEQ ID NO: 30083 - RNA, 18 nt, Homo sapiens
cccaggagggcacaaaaa

SEQ ID NO: 30084 - RNA, 18 nt, Homo sapiens
ccucuguucacuuggguu

SEQ ID NO: 30085 - RNA, 18 nt, Homo sapiens
cguuuguauacaugcauc

SEQ ID NO: 30086 - RNA, 20 nt, Homo sapiens
cucucccacccucaaaauuc

SEQ ID NO: 30087 - RNA, 16 nt, Homo sapiens
gccaggaggcagcugg

SEQ ID NO: 30088 - RNA, 18 nt, Homo sapiens
uaguguugaggaaauucu

SEQ ID NO: 30089 - RNA, 19 nt, Homo sapiens
ucagcuucuuucccuuuuc

SEQ ID NO: 30090 - RNA, 19 nt, Homo sapiens
ugagcagauugcaacggcc

SEQ ID NO: 30091 - RNA, 21 nt, Homo sapiens
ugagccggggugagguggguu

SEQ ID NO: 30092 - RNA, 20 nt, Homo sapiens
ugaggaggaggaggaaagga

SEQ ID NO: 30093 - RNA, 18 nt, Homo sapiens
ugcugggugcaccuggau

SEQ ID NO: 30094 - RNA, 18 nt, Homo sapiens
uggauugugaggaggagg

SEQ ID NO: 30095 - RNA, 21 nt, Homo sapiens
uuagaaauguuaaccuuuaag

SEQ ID NO: 30096 - RNA, 24 nt, Homo sapiens
uucgacgcguggcgcugagugcgg

SEQ ID NO: 30097 - RNA, 18 nt, Homo sapiens
uugcugguucugaauguc

SEQ ID NO: 30098 - RNA, 18 nt, Homo sapiens
uuuagcuaacuugcuugg

SEQ ID NO: 30099 - RNA, 22 nt, Homo sapiens
agaauuuuuuuaacucucugga

SEQ ID NO: 30100 - RNA, 18 nt, Homo sapiens
auaaugcccauccuaggu

SEQ ID NO: 30101 - RNA, 19 nt, Homo sapiens
augaauucaguggugauag

SEQ ID NO: 30102 - RNA, 18 nt, Homo sapiens
auguucaucaugucaagg

SEQ ID NO: 30103 - RNA, 18 nt, Homo sapiens
cacaacuacuaagagauu

SEQ ID NO: 30104 - RNA, 17 nt, Homo sapiens
ccucuuuuucuucuucu

SEQ ID NO: 30105 - RNA, 22 nt, Homo sapiens
cuacuaauuuaaaauaauucua

SEQ ID NO: 30106 - RNA, 16 nt, Homo sapiens
cucgcuuaauggagga

SEQ ID NO: 30107 - RNA, 18 nt, Homo sapiens
gaaaaauauguagaacaa

SEQ ID NO: 30108 - RNA, 22 nt, Homo sapiens
gcugcucuucucggcccccucc

SEQ ID NO: 30109 - RNA, 16 nt, Homo sapiens
guaugacuaauaggua

SEQ ID NO: 30110 - RNA, 22 nt, Homo sapiens
uacaugugcaguguacaacaua

SEQ ID NO: 30111 - RNA, 17 nt, Homo sapiens
uaucauuucugauaaau

SEQ ID NO: 30112 - RNA, 19 nt, Homo sapiens
ugaauuguuuguuuauaag

SEQ ID NO: 30113 - RNA, 21 nt, Homo sapiens
ugagaauaucauuucuguuuu

SEQ ID NO: 30114 - RNA, 19 nt, Homo sapiens
ugguaacuggauuuuauca

SEQ ID NO: 30115 - RNA, 17 nt, Homo sapiens
ugguaccacuauacugu

SEQ ID NO: 30116 - RNA, 24 nt, Homo sapiens
uguaacacauauucacacacaaca

SEQ ID NO: 30117 - RNA, 20 nt, Homo sapiens
acuccuccuccaggccaggc

SEQ ID NO: 30118 - RNA, 17 nt, Homo sapiens
agagagcgccuucagag

SEQ ID NO: 30119 - RNA, 18 nt, Homo sapiens
agaggcagagcugggacu

SEQ ID NO: 30120 - RNA, 19 nt, Homo sapiens
agauaucccugaaaaggaa

SEQ ID NO: 30121 - RNA, 26 nt, Homo sapiens
agucagccugggcuccgcaaauaacg

SEQ ID NO: 30122 - RNA, 16 nt, Homo sapiens
cacaggcugacaagaa

SEQ ID NO: 30123 - RNA, 17 nt, Homo sapiens
ccccugaccccuagccc

SEQ ID NO: 30124 - RNA, 19 nt, Homo sapiens
ccgggcugcccuuuaucac

SEQ ID NO: 30125 - RNA, 22 nt, Homo sapiens
gagaggggaagggaguagacua

SEQ ID NO: 30126 - RNA, 14 nt, Homo sapiens
gcucccgggguucu

SEQ ID NO: 30127 - RNA, 19 nt, Homo sapiens
gcuguucgggcuggcccgg

SEQ ID NO: 30128 - RNA, 14 nt, Homo sapiens
gggccugugugagg

SEQ ID NO: 30129 - RNA, 21 nt, Homo sapiens
ggggugggaggugggucucca

SEQ ID NO: 30130 - RNA, 22 nt, Homo sapiens
ucaccaccucgcaaggcagcua

SEQ ID NO: 30131 - RNA, 16 nt, Homo sapiens
ucccaucugucuggga

SEQ ID NO: 30132 - RNA, 20 nt, Homo sapiens
uccugagcucugccuucccc

SEQ ID NO: 30133 - RNA, 16 nt, Homo sapiens
ucgggcuggcccggca

SEQ ID NO: 30134 - RNA, 24 nt, Homo sapiens
ucuccaggugcugcaggcgauggg

SEQ ID NO: 30135 - RNA, 16 nt, Homo sapiens
ugaggaccagagaggg

SEQ ID NO: 30136 - RNA, 20 nt, Homo sapiens
ugugagggggugagaagugu

SEQ ID NO: 30137 - RNA, 17 nt, Homo sapiens
acugcccgcaccgcggc

SEQ ID NO: 30138 - RNA, 22 nt, Homo sapiens
aggcaaccucagcuguggaccc

SEQ ID NO: 30139 - RNA, 21 nt, Homo sapiens
cauagccaagccuuuucacua

SEQ ID NO: 30140 - RNA, 20 nt, Homo sapiens
cggcacccaggacaugccgc

SEQ ID NO: 30141 - RNA, 20 nt, Homo sapiens
cucugcucuagagauggcag

SEQ ID NO: 30142 - RNA, 17 nt, Homo sapiens
gccccgucgccgccggg

SEQ ID NO: 30143 - RNA, 19 nt, Homo sapiens
uacuacccaagucuuccuu

SEQ ID NO: 30144 - RNA, 19 nt, Homo sapiens
ucugcucuagagauggcag

SEQ ID NO: 30145 - RNA, 17 nt, Homo sapiens
ugaggggaggaggagaa

SEQ ID NO: 30146 - RNA, 17 nt, Homo sapiens
aacccuuacaaguaauu

SEQ ID NO: 30147 - RNA, 26 nt, Homo sapiens
aagcugcaaaaauggucggccaucgg

SEQ ID NO: 30148 - RNA, 23 nt, Homo sapiens
aaguaagagugacucauuccugc

SEQ ID NO: 30149 - RNA, 18 nt, Homo sapiens
acacuuuaugcgucgggg

SEQ ID NO: 30150 - RNA, 18 nt, Homo sapiens
acccuuggccaucccucc

SEQ ID NO: 30151 - RNA, 19 nt, Homo sapiens
cagacuuuugcugcaggaa

SEQ ID NO: 30152 - RNA, 18 nt, Homo sapiens
ggaaagggaagcugggca

SEQ ID NO: 30153 - RNA, 22 nt, Homo sapiens
uaagugaauaaaaauagcacau

SEQ ID NO: 30154 - RNA, 18 nt, Homo sapiens
ucggggguuuagaacaac

SEQ ID NO: 30155 - RNA, 18 nt, Homo sapiens
uguacucauugccagugu

SEQ ID NO: 30156 - RNA, 21 nt, Homo sapiens
ugugauucaccagcaggagac

SEQ ID NO: 30157 - RNA, 21 nt, Homo sapiens
uuuacauaucuucuccaaauc

SEQ ID NO: 30158 - RNA, 20 nt, Homo sapiens
uuucugggauuuuccuggca

SEQ ID NO: 30159 - RNA, 22 nt, Homo sapiens
aggggaggggaaaggaugaugc

SEQ ID NO: 30160 - RNA, 19 nt, Homo sapiens
gcucggguuccggggcccc

SEQ ID NO: 30161 - RNA, 16 nt, Homo sapiens
gggggaagggacagga

SEQ ID NO: 30162 - RNA, 19 nt, Homo sapiens
ucagggccuggcccgagug

SEQ ID NO: 30163 - RNA, 19 nt, Homo sapiens
aaggagcuaaugaccauua

SEQ ID NO: 30164 - RNA, 20 nt, Homo sapiens
agagcagggguggaaagccu

SEQ ID NO: 30165 - RNA, 19 nt, Homo sapiens
augaguggccucacccagc

SEQ ID NO: 30166 - RNA, 22 nt, Homo sapiens
augaguggccucacccagcccc

SEQ ID NO: 30167 - RNA, 21 nt, Homo sapiens
gagagagaaagagagagagag

SEQ ID NO: 30168 - RNA, 15 nt, Homo sapiens
gagagagagagaaag

SEQ ID NO: 30169 - RNA, 14 nt, Homo sapiens
guugcuauguugcc

SEQ ID NO: 30170 - RNA, 20 nt, Homo sapiens
ucagagcagggguggaaagc

SEQ ID NO: 30171 - RNA, 23 nt, Homo sapiens
ucucuuuuugguuaaaaagagag

SEQ ID NO: 30172 - RNA, 20 nt, Homo sapiens
ucugugcguggugcucucag

SEQ ID NO: 30173 - RNA, 16 nt, Homo sapiens
agcagacgggaguggc

SEQ ID NO: 30174 - RNA, 19 nt, Homo sapiens
agggagggaggcaccgugg

SEQ ID NO: 30175 - RNA, 19 nt, Homo sapiens
acagccauauuacagcguu

SEQ ID NO: 30176 - RNA, 17 nt, Homo sapiens
caaagcccucugauaca

SEQ ID NO: 30177 - RNA, 18 nt, Homo sapiens
aaaaaaagaaaaaaaaaa

SEQ ID NO: 30178 - RNA, 19 nt, Homo sapiens
cacagcaccaauacuacac

SEQ ID NO: 30179 - RNA, 19 nt, Homo sapiens
cagaccagcaguuuaauaa

SEQ ID NO: 30180 - RNA, 20 nt, Homo sapiens
ccuuuugaaaggcagaggag

SEQ ID NO: 30181 - RNA, 17 nt, Homo sapiens
cggcccccuaccucugg

SEQ ID NO: 30182 - RNA, 15 nt, Homo sapiens
cuucgcgaggagggg

SEQ ID NO: 30183 - RNA, 18 nt, Homo sapiens
cuuucaucccaggauguc

SEQ ID NO: 30184 - RNA, 20 nt, Homo sapiens
uauggagcguggauguagaa

SEQ ID NO: 30185 - RNA, 18 nt, Homo sapiens
ucucggcccccuggggcc

SEQ ID NO: 30186 - RNA, 17 nt, Homo sapiens
agaaauaauauuguguc

SEQ ID NO: 30187 - RNA, 21 nt, Homo sapiens
caggaagcagauaucuuucug

SEQ ID NO: 30188 - RNA, 15 nt, Homo sapiens
cccuucccccucccc

SEQ ID NO: 30189 - RNA, 26 nt, Homo sapiens
cgccgcggggugaugagcaguguugc

SEQ ID NO: 30190 - RNA, 18 nt, Homo sapiens
guggagaugguuuuuuga

SEQ ID NO: 30191 - RNA, 21 nt, Homo sapiens
uggcauaaccaacuuccuuuu

SEQ ID NO: 30192 - RNA, 24 nt, Homo sapiens
uggcauaaccaacuuccuuuuuca

SEQ ID NO: 30193 - RNA, 18 nt, Homo sapiens
uuuguccuagguccccug

SEQ ID NO: 30194 - RNA, 17 nt, Homo sapiens
aagaggaaaaaagaugg

SEQ ID NO: 30195 - RNA, 19 nt, Homo sapiens
acguaccuugugguauggc

SEQ ID NO: 30196 - RNA, 17 nt, Homo sapiens
ccacccaccccuagccc

SEQ ID NO: 30197 - RNA, 19 nt, Homo sapiens
ggggaggggguggggaagg

SEQ ID NO: 30198 - RNA, 18 nt, Homo sapiens
ucugccuggggggagggg

SEQ ID NO: 30199 - RNA, 17 nt, Homo sapiens
uugggaggccgaggcgg

SEQ ID NO: 30200 - RNA, 17 nt, Homo sapiens
ccagccacccugcgucu

SEQ ID NO: 30201 - RNA, 15 nt, Homo sapiens
gggcguaccugaggg

SEQ ID NO: 30202 - RNA, 18 nt, Homo sapiens
uucaugugugugucuaug

SEQ ID NO: 30203 - RNA, 20 nt, Homo sapiens
aggccagggaggcaccuggc

SEQ ID NO: 30204 - RNA, 21 nt, Homo sapiens
aaagugaaagcugccggaugg

SEQ ID NO: 30205 - RNA, 19 nt, Homo sapiens
aaauauauauuauauaugg

SEQ ID NO: 30206 - RNA, 19 nt, Homo sapiens
aaggguugcggugggguca

SEQ ID NO: 30207 - RNA, 16 nt, Homo sapiens
aggcggggcuggcccg

SEQ ID NO: 30208 - RNA, 18 nt, Homo sapiens
cagccgccgaucagggcc

SEQ ID NO: 30209 - RNA, 22 nt, Homo sapiens
cagguuugugacucccaguaua

SEQ ID NO: 30210 - RNA, 22 nt, Homo sapiens
ccaccgaggccaauuuggggac

SEQ ID NO: 30211 - RNA, 24 nt, Homo sapiens
ccgggguuugcccagggcggugga

SEQ ID NO: 30212 - RNA, 17 nt, Homo sapiens
cgggcagggcaucgggg

SEQ ID NO: 30213 - RNA, 16 nt, Homo sapiens
cuccuccucccucccu

SEQ ID NO: 30214 - RNA, 25 nt, Homo sapiens
cugcggggugcuggguguggagaag

SEQ ID NO: 30215 - RNA, 19 nt, Homo sapiens
gaguaggcguucagcaggu

SEQ ID NO: 30216 - RNA, 29 nt, Homo sapiens
gcccuggcacucuguaaagcuucuccggg

SEQ ID NO: 30217 - RNA, 22 nt, Homo sapiens
gcgcuccaagugccccggcggc

SEQ ID NO: 30218 - RNA, 24 nt, Homo sapiens
gcucccggcgccgcgagaacuucc

SEQ ID NO: 30219 - RNA, 18 nt, Homo sapiens
gcuuggccucccuggucc

SEQ ID NO: 30220 - RNA, 21 nt, Homo sapiens
ggagcaggcucugcgcggaca

SEQ ID NO: 30221 - RNA, 15 nt, Homo sapiens
ggcaucgggguuguc

SEQ ID NO: 30222 - RNA, 20 nt, Homo sapiens
gggcccggguauggaggcgg

SEQ ID NO: 30223 - RNA, 23 nt, Homo sapiens
gggccgcguccucuugcauagcc

SEQ ID NO: 30224 - RNA, 16 nt, Homo sapiens
gggcgccugagcugcg

SEQ ID NO: 30225 - RNA, 23 nt, Homo sapiens
ggggacuggaacuuccucugcug

SEQ ID NO: 30226 - RNA, 17 nt, Homo sapiens
guugaaugccaaguucc

SEQ ID NO: 30227 - RNA, 19 nt, Homo sapiens
ucccacucccauggggucu

SEQ ID NO: 30228 - RNA, 23 nt, Homo sapiens
uccuauguaaaaauauggcuucu

SEQ ID NO: 30229 - RNA, 19 nt, Homo sapiens
ucuccacgccuuccggggg

SEQ ID NO: 30230 - RNA, 19 nt, Homo sapiens
ugaggucgugggcgccgca

SEQ ID NO: 30231 - RNA, 22 nt, Homo sapiens
uggagaaggacgagcaaagagg

SEQ ID NO: 30232 - RNA, 19 nt, Homo sapiens
uggguucccagcuccagcc

SEQ ID NO: 30233 - RNA, 17 nt, Homo sapiens
ugugaggcacugccuuu

SEQ ID NO: 30234 - RNA, 19 nt, Homo sapiens
uugcugcaguguggggaca

SEQ ID NO: 30235 - RNA, 17 nt, Homo sapiens
agaagcauggguuucca

SEQ ID NO: 30236 - RNA, 23 nt, Homo sapiens
auaagugguguauauuuugacag

SEQ ID NO: 30237 - RNA, 19 nt, Homo sapiens
uauuuugugauaaaaacau

SEQ ID NO: 30238 - RNA, 16 nt, Homo sapiens
acggcacagcccagag

SEQ ID NO: 30239 - RNA, 17 nt, Homo sapiens
cagcgcgcucccgaagc

SEQ ID NO: 30240 - RNA, 21 nt, Homo sapiens
gccucuucgcgccgcugcccg

SEQ ID NO: 30241 - RNA, 17 nt, Homo sapiens
gcucuucucaaaggcag

SEQ ID NO: 30242 - RNA, 19 nt, Homo sapiens
uguccaggugggugcggcc

SEQ ID NO: 30243 - RNA, 21 nt, Homo sapiens
ccaaguuuaggagcuucagcc

SEQ ID NO: 30244 - RNA, 18 nt, Homo sapiens
gccuggaggcuccagcgc

SEQ ID NO: 30245 - RNA, 23 nt, Homo sapiens
ggaggcgggagggcgcuuuggag

SEQ ID NO: 30246 - RNA, 22 nt, Homo sapiens
ggggagcgccgggaggcgggag

SEQ ID NO: 30247 - RNA, 19 nt, Homo sapiens
uccagcugcagggcugagg

SEQ ID NO: 30248 - RNA, 17 nt, Homo sapiens
ugagguccgcgaagugc

SEQ ID NO: 30249 - RNA, 20 nt, Homo sapiens
aacaacauaugcugcugcuc

SEQ ID NO: 30250 - RNA, 16 nt, Homo sapiens
agucuaaaaauuaucg

SEQ ID NO: 30251 - RNA, 22 nt, Homo sapiens
cagcagcccgcgccccggcagc

SEQ ID NO: 30252 - RNA, 18 nt, Homo sapiens
cccgccgcccuuccgccc

SEQ ID NO: 30253 - RNA, 17 nt, Homo sapiens
ccgcccgccgcccuucc

SEQ ID NO: 30254 - RNA, 18 nt, Homo sapiens
ccuccuccccucccgccc

SEQ ID NO: 30255 - RNA, 18 nt, Homo sapiens
ccuucgcagcagccucuc

SEQ ID NO: 30256 - RNA, 19 nt, Homo sapiens
cucccgcccgcgaccuccg

SEQ ID NO: 30257 - RNA, 17 nt, Homo sapiens
gccgccgccgccgccgg

SEQ ID NO: 30258 - RNA, 22 nt, Homo sapiens
uccuccccucccgcccgcgacc

SEQ ID NO: 30259 - RNA, 23 nt, Homo sapiens
ugcugcugcucuuagaauuuugg

SEQ ID NO: 30260 - RNA, 18 nt, Homo sapiens
ugcuucuaauacuaagca

SEQ ID NO: 30261 - RNA, 17 nt, Homo sapiens
acaggaggaggagcagu

SEQ ID NO: 30262 - RNA, 23 nt, Homo sapiens
acccugcauuuuuucuuuuuaaa

SEQ ID NO: 30263 - RNA, 23 nt, Homo sapiens
agagaggaggagacggaggaggc

SEQ ID NO: 30264 - RNA, 15 nt, Homo sapiens
agcaggguggugaca

SEQ ID NO: 30265 - RNA, 21 nt, Homo sapiens
caacgggguggauggcggagg

SEQ ID NO: 30266 - RNA, 23 nt, Homo sapiens
ccgccgcggcccgggcgcccccg

SEQ ID NO: 30267 - RNA, 21 nt, Homo sapiens
gacugugcaagaguugggaga

SEQ ID NO: 30268 - RNA, 19 nt, Homo sapiens
ggagaugguggcagcggcg

SEQ ID NO: 30269 - RNA, 20 nt, Homo sapiens
ggccgcgggcgcgccggcuu

SEQ ID NO: 30270 - RNA, 21 nt, Homo sapiens
uaaaagaaagacgguggagga

SEQ ID NO: 30271 - RNA, 24 nt, Homo sapiens
uaacucagcuuagaagaacuuuaa

SEQ ID NO: 30272 - RNA, 19 nt, Homo sapiens
uauggaaauauauaguugc

SEQ ID NO: 30273 - RNA, 17 nt, Homo sapiens
ucacaugauuguauguu

SEQ ID NO: 30274 - RNA, 23 nt, Homo sapiens
ugcgagagccuggugccggcgcg

SEQ ID NO: 30275 - RNA, 25 nt, Homo sapiens
uuuguaaaaacaaaccauuuaacau

SEQ ID NO: 30276 - RNA, 18 nt, Homo sapiens
caagauacagaaaugcug

SEQ ID NO: 30277 - RNA, 19 nt, Homo sapiens
ccagagccggcaggccugg

SEQ ID NO: 30278 - RNA, 17 nt, Homo sapiens
gagacaauguuacauua

SEQ ID NO: 30279 - RNA, 23 nt, Homo sapiens
ggcgcagggccaccguagcgggu

SEQ ID NO: 30280 - RNA, 21 nt, Homo sapiens
uacaguguuccuucagucugc

SEQ ID NO: 30281 - RNA, 19 nt, Homo sapiens
ccagagcccaccagggcag

SEQ ID NO: 30282 - RNA, 15 nt, Homo sapiens
uaaauuggacaucug

SEQ ID NO: 30283 - RNA, 19 nt, Homo sapiens
uaauauuuuuagauguaca

SEQ ID NO: 30284 - RNA, 22 nt, Homo sapiens
uuuuuuuuuuuuuucauuuuuu

SEQ ID NO: 30285 - RNA, 20 nt, Homo sapiens
aauggccuguguguuucagc

SEQ ID NO: 30286 - RNA, 19 nt, Homo sapiens
acgcuuuuuuuuuuuccuu

SEQ ID NO: 30287 - RNA, 16 nt, Homo sapiens
acuugucauuuggugg

SEQ ID NO: 30288 - RNA, 18 nt, Homo sapiens
aggcggggaccggaucgg

SEQ ID NO: 30289 - RNA, 19 nt, Homo sapiens
cucaacacgcuuuuuuuuu

SEQ ID NO: 30290 - RNA, 18 nt, Homo sapiens
gcgggggcagcuagucgg

SEQ ID NO: 30291 - RNA, 22 nt, Homo sapiens
gcguuuugaaaaacaguuuucc

SEQ ID NO: 30292 - RNA, 19 nt, Homo sapiens
gggagggugugacuuguca

SEQ ID NO: 30293 - RNA, 21 nt, Homo sapiens
uacuucauauauaaauaagau

SEQ ID NO: 30294 - RNA, 22 nt, Homo sapiens
uauguugguagaaguauuuuau

SEQ ID NO: 30295 - RNA, 22 nt, Homo sapiens
uccagcugcuuccucguucucg

SEQ ID NO: 30296 - RNA, 21 nt, Homo sapiens
ugccugaccgccucuggagcu

SEQ ID NO: 30297 - RNA, 15 nt, Homo sapiens
aagguugguguugga

SEQ ID NO: 30298 - RNA, 20 nt, Homo sapiens
acaaggaaugcuccaccuca

SEQ ID NO: 30299 - RNA, 21 nt, Homo sapiens
agcacuuuucuacagcugcac

SEQ ID NO: 30300 - RNA, 19 nt, Homo sapiens
agggaagcaaaagggcagg

SEQ ID NO: 30301 - RNA, 19 nt, Homo sapiens
aggggcugccccaggaccu

SEQ ID NO: 30302 - RNA, 19 nt, Homo sapiens
caaggucaaaaaucagggu

SEQ ID NO: 30303 - RNA, 22 nt, Homo sapiens
cagcaguaguugucccugagga

SEQ ID NO: 30304 - RNA, 25 nt, Homo sapiens
ccccaccucccuugcgaccguuugg

SEQ ID NO: 30305 - RNA, 22 nt, Homo sapiens
ccggccccauugcuacuuggcc

SEQ ID NO: 30306 - RNA, 15 nt, Homo sapiens
cucugaagggagggg

SEQ ID NO: 30307 - RNA, 17 nt, Homo sapiens
cuuuucuacagcugcac

SEQ ID NO: 30308 - RNA, 18 nt, Homo sapiens
gagaagagagggaguucc

SEQ ID NO: 30309 - RNA, 19 nt, Homo sapiens
gcugggaccacccagcucc

SEQ ID NO: 30310 - RNA, 19 nt, Homo sapiens
ggggugggaggugggaaaa

SEQ ID NO: 30311 - RNA, 18 nt, Homo sapiens
gugacuccccaccucccu

SEQ ID NO: 30312 - RNA, 18 nt, Homo sapiens
guuucacacauucacuag

SEQ ID NO: 30313 - RNA, 24 nt, Homo sapiens
uagcaaauaaaacagaaaagaaaa

SEQ ID NO: 30314 - RNA, 19 nt, Homo sapiens
uaucaaacaauacaggguc

SEQ ID NO: 30315 - RNA, 15 nt, Homo sapiens
ucccugagccucaag

SEQ ID NO: 30316 - RNA, 18 nt, Homo sapiens
uggauccucccaaacugu

SEQ ID NO: 30317 - RNA, 18 nt, Homo sapiens
ugguaagcuggugauggu

SEQ ID NO: 30318 - RNA, 18 nt, Homo sapiens
uguaggaauaagaggaug

SEQ ID NO: 30319 - RNA, 19 nt, Homo sapiens
uuccacccucuccucuucc

SEQ ID NO: 30320 - RNA, 16 nt, Homo sapiens
acaccuuuuucgggaa

SEQ ID NO: 30321 - RNA, 22 nt, Homo sapiens
agguggaucacaaggucaggag

SEQ ID NO: 30322 - RNA, 20 nt, Homo sapiens
cauuauguaugugccuugca

SEQ ID NO: 30323 - RNA, 22 nt, Homo sapiens
ggcaggcacuaccaagauuaag

SEQ ID NO: 30324 - RNA, 21 nt, Homo sapiens
uagcacaucaguguaaacagu

SEQ ID NO: 30325 - RNA, 23 nt, Homo sapiens
ugccuguaaucccagcacuuugg

SEQ ID NO: 30326 - RNA, 17 nt, Homo sapiens
acaccgcgcaugaaggg

SEQ ID NO: 30327 - RNA, 19 nt, Homo sapiens
uggcaacagagugagagcu

SEQ ID NO: 30328 - RNA, 18 nt, Homo sapiens
uguuuugauuccuagugu

SEQ ID NO: 30329 - RNA, 19 nt, Homo sapiens
uugauuccuaguguccucu

SEQ ID NO: 30330 - RNA, 22 nt, Homo sapiens
cguccagaagcuggggaggggg

SEQ ID NO: 30331 - RNA, 22 nt, Homo sapiens
cuccacgccuucuuucuccgga

SEQ ID NO: 30332 - RNA, 17 nt, Homo sapiens
gccggaaucgaggccgc

SEQ ID NO: 30333 - RNA, 17 nt, Homo sapiens
gcuucccguccgcuccc

SEQ ID NO: 30334 - RNA, 21 nt, Homo sapiens
gggguggagguuggggggagg

SEQ ID NO: 30335 - RNA, 18 nt, Homo sapiens
gcccggugucucuccucc

SEQ ID NO: 30336 - RNA, 29 nt, Homo sapiens
ugcccugggcccggugucucuccuccggg

SEQ ID NO: 30337 - RNA, 17 nt, Homo sapiens
ucaaaccugacgagacc

SEQ ID NO: 30338 - RNA, 25 nt, Homo sapiens
cagcagcggcggcaggagaggcugu

SEQ ID NO: 30339 - RNA, 22 nt, Homo sapiens
ccaaaccaucccgggcucguca

SEQ ID NO: 30340 - RNA, 20 nt, Homo sapiens
ccgccgcucagcuccuggcc

SEQ ID NO: 30341 - RNA, 19 nt, Homo sapiens
cggcgcccucgcaacccga

SEQ ID NO: 30342 - RNA, 19 nt, Homo sapiens
gcucccaucguccggcagc

SEQ ID NO: 30343 - RNA, 20 nt, Homo sapiens
ggauguggucauuguauaaa

SEQ ID NO: 30344 - RNA, 15 nt, Homo sapiens
gucccgccgcuggcg

SEQ ID NO: 30345 - RNA, 18 nt, Homo sapiens
guucucaugcgacaggca

SEQ ID NO: 30346 - RNA, 16 nt, Homo sapiens
uacgcggacggcucuc

SEQ ID NO: 30347 - RNA, 22 nt, Homo sapiens
uagaaugauuuuuauuuuauca

SEQ ID NO: 30348 - RNA, 18 nt, Homo sapiens
ucgagcaucugaagcugg

SEQ ID NO: 30349 - RNA, 17 nt, Homo sapiens
ugaaaagagcaaaaaac

SEQ ID NO: 30350 - RNA, 18 nt, Homo sapiens
uggcggcucgcguccugg

SEQ ID NO: 30351 - RNA, 20 nt, Homo sapiens
ugggucccgccgcuggcggc

SEQ ID NO: 30352 - RNA, 19 nt, Homo sapiens
uuagaucugguaagacaca

SEQ ID NO: 30353 - RNA, 20 nt, Homo sapiens
agcucauauacuacgauggg

SEQ ID NO: 30354 - RNA, 18 nt, Homo sapiens
aguugguggagaagggag

SEQ ID NO: 30355 - RNA, 19 nt, Homo sapiens
cggcuggggccccaccccc

SEQ ID NO: 30356 - RNA, 15 nt, Homo sapiens
uccaaccgcucggau

SEQ ID NO: 30357 - RNA, 24 nt, Homo sapiens
uccccucccccaauauugaggcuc

SEQ ID NO: 30358 - RNA, 19 nt, Homo sapiens
uccugucgcgcugugaucu

SEQ ID NO: 30359 - RNA, 17 nt, Homo sapiens
ggccagcagcugaguga

SEQ ID NO: 30360 - RNA, 15 nt, Homo sapiens
uggccugagggagag

SEQ ID NO: 30361 - RNA, 18 nt, Homo sapiens
agaaaauaaaaauauuuu

SEQ ID NO: 30362 - RNA, 15 nt, Homo sapiens
agcccuccaccggca

SEQ ID NO: 30363 - RNA, 19 nt, Homo sapiens
ccgcucagccgccgccgcc

SEQ ID NO: 30364 - RNA, 23 nt, Homo sapiens
cgggcggggcggaggggcgcgcg

SEQ ID NO: 30365 - RNA, 15 nt, Homo sapiens
gcccuccaccggcag

SEQ ID NO: 30366 - RNA, 19 nt, Homo sapiens
gcggaggggcgcgcggcgg

SEQ ID NO: 30367 - RNA, 18 nt, Homo sapiens
ggcgggcggggcggaggg

SEQ ID NO: 30368 - RNA, 20 nt, Homo sapiens
ggcaggcggcaagcgggccg

SEQ ID NO: 30369 - RNA, 18 nt, Homo sapiens
agugaaagggauccagga

SEQ ID NO: 30370 - RNA, 21 nt, Homo sapiens
caauacagguagaacaaaaga

SEQ ID NO: 30371 - RNA, 20 nt, Homo sapiens
gccucccaccagcggucucc

SEQ ID NO: 30372 - RNA, 18 nt, Homo sapiens
gcgcgcgcgcgugugugu

SEQ ID NO: 30373 - RNA, 17 nt, Homo sapiens
gugcgcgcgcgcgcgug

SEQ ID NO: 30374 - RNA, 23 nt, Homo sapiens
gugcucugguauuugugucaucc

SEQ ID NO: 30375 - RNA, 14 nt, Homo sapiens
ucucuucugcguag

SEQ ID NO: 30376 - RNA, 21 nt, Homo sapiens
ucuuucuaaaguugcaaauca

SEQ ID NO: 30377 - RNA, 19 nt, Homo sapiens
ugcgcgcgcgcgcccccgg

SEQ ID NO: 30378 - RNA, 25 nt, Homo sapiens
ugcgcgcgcgcgcgugcccccgcgg

SEQ ID NO: 30379 - RNA, 25 nt, Homo sapiens
ugcgcgcgcgcgcgugugcccccgg

SEQ ID NO: 30380 - RNA, 16 nt, Homo sapiens
uggacaaacugaaagg

SEQ ID NO: 30381 - RNA, 18 nt, Homo sapiens
ugugcgcgcgcgcgcgcc

SEQ ID NO: 30382 - RNA, 18 nt, Homo sapiens
uuacaguggagccaaaug

SEQ ID NO: 30383 - RNA, 18 nt, Homo sapiens
uugaaaagagaauuagaa

SEQ ID NO: 30384 - RNA, 18 nt, Homo sapiens
augucuguguguguguau

SEQ ID NO: 30385 - RNA, 18 nt, Homo sapiens
gaaaaauuacaucuauau

SEQ ID NO: 30386 - RNA, 24 nt, Homo sapiens
gcucuuggcucaccgcaaccucug

SEQ ID NO: 30387 - RNA, 22 nt, Homo sapiens
uaaagacugaucucaaaaugcu

SEQ ID NO: 30388 - RNA, 19 nt, Homo sapiens
uauaacucaguuauauggu

SEQ ID NO: 30389 - RNA, 31 nt, Homo sapiens
uauauaugugugcauauauauauauauauga

SEQ ID NO: 30390 - RNA, 19 nt, Homo sapiens
ucuaaauuuuaaaaagcuu

SEQ ID NO: 30391 - RNA, 17 nt, Homo sapiens
ugauguguuaacuacca

SEQ ID NO: 30392 - RNA, 20 nt, Homo sapiens
aaccacuuauuucuauuuua

SEQ ID NO: 30393 - RNA, 24 nt, Homo sapiens
cucugguuccuccgagcgcacgcu

SEQ ID NO: 30394 - RNA, 18 nt, Homo sapiens
aggaggccuggcugaccu

SEQ ID NO: 30395 - RNA, 21 nt, Homo sapiens
cagcugguuccaaagcuccuc

SEQ ID NO: 30396 - RNA, 16 nt, Homo sapiens
ccuuagucauuuuucc

SEQ ID NO: 30397 - RNA, 17 nt, Homo sapiens
gauugggguggggguag

SEQ ID NO: 30398 - RNA, 22 nt, Homo sapiens
gauugggguggggguaguuggg

SEQ ID NO: 30399 - RNA, 21 nt, Homo sapiens
gcugguguugggagacagagc

SEQ ID NO: 30400 - RNA, 17 nt, Homo sapiens
gggguggggaggugggg

SEQ ID NO: 30401 - RNA, 18 nt, Homo sapiens
gugaaggugggauugggg

SEQ ID NO: 30402 - RNA, 20 nt, Homo sapiens
uaggaggaggcauggguggc

SEQ ID NO: 30403 - RNA, 20 nt, Homo sapiens
uggauuuaaaaggaguagcu

SEQ ID NO: 30404 - RNA, 17 nt, Homo sapiens
ugggguggggagguggg

SEQ ID NO: 30405 - RNA, 19 nt, Homo sapiens
ugggguggggguaguuggg

SEQ ID NO: 30406 - RNA, 17 nt, Homo sapiens
ugucauggguucauucu

SEQ ID NO: 30407 - RNA, 15 nt, Homo sapiens
cgggaguggcccugc

SEQ ID NO: 30408 - RNA, 17 nt, Homo sapiens
ugacagugaaguacagu

SEQ ID NO: 30409 - RNA, 21 nt, Homo sapiens
ugugauuuuucagcucccagc

SEQ ID NO: 30410 - RNA, 22 nt, Homo sapiens
uuaauauugcauuuauaucagg

SEQ ID NO: 30411 - RNA, 19 nt, Homo sapiens
ccccgcucccgccaugccg

SEQ ID NO: 30412 - RNA, 22 nt, Homo sapiens
gaucugggauuucucucaccaa

SEQ ID NO: 30413 - RNA, 22 nt, Homo sapiens
gcagccccgcucccgccaugcc

SEQ ID NO: 30414 - RNA, 15 nt, Homo sapiens
gggcgccggcgcugc

SEQ ID NO: 30415 - RNA, 18 nt, Homo sapiens
aguguuuucgguugcauu

SEQ ID NO: 30416 - RNA, 16 nt, Homo sapiens
ggagugggguggggag

SEQ ID NO: 30417 - RNA, 28 nt, Homo sapiens
ugaauuacaugucgauaauauuuucaaa

SEQ ID NO: 30418 - RNA, 17 nt, Homo sapiens
gaaagugucucuucugc

SEQ ID NO: 30419 - RNA, 18 nt, Homo sapiens
uugguuagagaagguugu

SEQ ID NO: 30420 - RNA, 19 nt, Homo sapiens
agacuguucauuaacucug

SEQ ID NO: 30421 - RNA, 18 nt, Homo sapiens
gagguuacagauacucau

SEQ ID NO: 30422 - RNA, 17 nt, Homo sapiens
gcauaggaacagaucca

SEQ ID NO: 30423 - RNA, 16 nt, Homo sapiens
uaaaauguaagccacu

SEQ ID NO: 30424 - RNA, 17 nt, Homo sapiens
ucuuggaguuucaaguu

SEQ ID NO: 30425 - RNA, 16 nt, Homo sapiens
cacuaaguuuuagaca

SEQ ID NO: 30426 - RNA, 17 nt, Homo sapiens
gcacaaccaccuccuuc

SEQ ID NO: 30427 - RNA, 18 nt, Homo sapiens
uacuauaacuaccuggaa

SEQ ID NO: 30428 - RNA, 17 nt, Homo sapiens
uagcuuauuacugaacu

SEQ ID NO: 30429 - RNA, 23 nt, Homo sapiens
uuaaacuacagaggguuuuccag

SEQ ID NO: 30430 - RNA, 17 nt, Homo sapiens
ucaaaguuuuuggaaca

SEQ ID NO: 30431 - RNA, 20 nt, Homo sapiens
aagcaucuccugcaacacuc

SEQ ID NO: 30432 - RNA, 24 nt, Homo sapiens
acggguggaucacuugaggucagg

SEQ ID NO: 30433 - RNA, 17 nt, Homo sapiens
auguucuaugacaauga

SEQ ID NO: 30434 - RNA, 15 nt, Homo sapiens
caugggaggugggag

SEQ ID NO: 30435 - RNA, 21 nt, Homo sapiens
cuaguaacauuuauaauggca

SEQ ID NO: 30436 - RNA, 20 nt, Homo sapiens
gacuaggaaaagggccacau

SEQ ID NO: 30437 - RNA, 20 nt, Homo sapiens
gcaaaucuuaaaggaaaaga

SEQ ID NO: 30438 - RNA, 19 nt, Homo sapiens
ggguaauccagcccaaagg

SEQ ID NO: 30439 - RNA, 16 nt, Homo sapiens
uaaguagcuccuugga

SEQ ID NO: 30440 - RNA, 18 nt, Homo sapiens
uacaaugagccgagaugg

SEQ ID NO: 30441 - RNA, 23 nt, Homo sapiens
ugagcugacacaacacaucucug

SEQ ID NO: 30442 - RNA, 19 nt, Homo sapiens
aaguggaaggggguacaag

SEQ ID NO: 30443 - RNA, 15 nt, Homo sapiens
aggggucagggcagg

SEQ ID NO: 30444 - RNA, 19 nt, Homo sapiens
cugccugggacugaugggg

SEQ ID NO: 30445 - RNA, 21 nt, Homo sapiens
gcuugccacgccugccauggc

SEQ ID NO: 30446 - RNA, 22 nt, Homo sapiens
ggaagucaauuagagauguggg

SEQ ID NO: 30447 - RNA, 18 nt, Homo sapiens
gguagaaguagggcugcu

SEQ ID NO: 30448 - RNA, 18 nt, Homo sapiens
uaaaauauuuuacagcuc

SEQ ID NO: 30449 - RNA, 21 nt, Homo sapiens
uaagcaucacagcuucugcac

SEQ ID NO: 30450 - RNA, 15 nt, Homo sapiens
ucuaagcaucacagc

SEQ ID NO: 30451 - RNA, 17 nt, Homo sapiens
aaagaaguauggaauaa

SEQ ID NO: 30452 - RNA, 17 nt, Homo sapiens
aaauguuucauaugaaa

SEQ ID NO: 30453 - RNA, 19 nt, Homo sapiens
aauauuuucauuuccuucu

SEQ ID NO: 30454 - RNA, 21 nt, Homo sapiens
aaugaauacagaggugaguga

SEQ ID NO: 30455 - RNA, 18 nt, Homo sapiens
aauugaguuuugggacuc

SEQ ID NO: 30456 - RNA, 22 nt, Homo sapiens
agagagaaagagaaaggaaaua

SEQ ID NO: 30457 - RNA, 18 nt, Homo sapiens
cagaagacacagaagaca

SEQ ID NO: 30458 - RNA, 19 nt, Homo sapiens
caggaccucagucuccgcg

SEQ ID NO: 30459 - RNA, 20 nt, Homo sapiens
ccccccccuuucccuccccc

SEQ ID NO: 30460 - RNA, 20 nt, Homo sapiens
ccuccccccccuuucccucc

SEQ ID NO: 30461 - RNA, 19 nt, Homo sapiens
cuugcuuucucuuuucucu

SEQ ID NO: 30462 - RNA, 22 nt, Homo sapiens
gagaacgcaugagcugguccug

SEQ ID NO: 30463 - RNA, 15 nt, Homo sapiens
gagagagagagagag

SEQ ID NO: 30464 - RNA, 21 nt, Homo sapiens
gagagagagagagagaaagag

SEQ ID NO: 30465 - RNA, 17 nt, Homo sapiens
uaagaaaaauguauuuc

SEQ ID NO: 30466 - RNA, 21 nt, Homo sapiens
uacugcuuuaguauaauaaua

SEQ ID NO: 30467 - RNA, 19 nt, Homo sapiens
uccacuucuuuauuucagu

SEQ ID NO: 30468 - RNA, 21 nt, Homo sapiens
ucuuauggauuauuuccccag

SEQ ID NO: 30469 - RNA, 19 nt, Homo sapiens
ugaaacaguacugaaaaac

SEQ ID NO: 30470 - RNA, 19 nt, Homo sapiens
ugaggagcuuucccuucau

SEQ ID NO: 30471 - RNA, 23 nt, Homo sapiens
ugaguauuugaacaucuaaagga

SEQ ID NO: 30472 - RNA, 20 nt, Homo sapiens
ugauauguauuuuccaaugc

SEQ ID NO: 30473 - RNA, 23 nt, Homo sapiens
ugcccuggaccuucaauuucucc

SEQ ID NO: 30474 - RNA, 18 nt, Homo sapiens
ugccugaagauuguuugc

SEQ ID NO: 30475 - RNA, 18 nt, Homo sapiens
ugcuacccuuuuuuuccu

SEQ ID NO: 30476 - RNA, 17 nt, Homo sapiens
uuacugcaauuaacugg

SEQ ID NO: 30477 - RNA, 16 nt, Homo sapiens
uugcccaaguuaacca

SEQ ID NO: 30478 - RNA, 23 nt, Homo sapiens
uuggauaaggcaggcucuaugaa

SEQ ID NO: 30479 - RNA, 22 nt, Homo sapiens
aacagcuggucaccaugguauu

SEQ ID NO: 30480 - RNA, 21 nt, Homo sapiens
agaagaaugauuaaaaccuuu

SEQ ID NO: 30481 - RNA, 20 nt, Homo sapiens
agagauuuaaagcaaaauaa

SEQ ID NO: 30482 - RNA, 20 nt, Homo sapiens
auuuuuccauuuuaaaugua

SEQ ID NO: 30483 - RNA, 21 nt, Homo sapiens
cagcagugugauuggauggaa

SEQ ID NO: 30484 - RNA, 19 nt, Homo sapiens
cccgcuuccucuucuuccc

SEQ ID NO: 30485 - RNA, 21 nt, Homo sapiens
ccuaguaauucccuccucccu

SEQ ID NO: 30486 - RNA, 19 nt, Homo sapiens
cuguaacagcccauuaagg

SEQ ID NO: 30487 - RNA, 17 nt, Homo sapiens
gcgcuccaagagcucgc

SEQ ID NO: 30488 - RNA, 17 nt, Homo sapiens
gggaucucaagacuuuu

SEQ ID NO: 30489 - RNA, 20 nt, Homo sapiens
gucaugguuauggaggcugc

SEQ ID NO: 30490 - RNA, 21 nt, Homo sapiens
guuacuuaauacuuuauccac

SEQ ID NO: 30491 - RNA, 17 nt, Homo sapiens
uaauaccuguaaaccag

SEQ ID NO: 30492 - RNA, 16 nt, Homo sapiens
uacacaccaggugcca

SEQ ID NO: 30493 - RNA, 22 nt, Homo sapiens
uaggacaucaaaggaaauagua

SEQ ID NO: 30494 - RNA, 20 nt, Homo sapiens
uauuuuguuuugauacagaa

SEQ ID NO: 30495 - RNA, 18 nt, Homo sapiens
ugagaggauuggaucuca

SEQ ID NO: 30496 - RNA, 16 nt, Homo sapiens
ugauaugggagaacca

SEQ ID NO: 30497 - RNA, 18 nt, Homo sapiens
ugcuguugcuuuuagaga

SEQ ID NO: 30498 - RNA, 21 nt, Homo sapiens
uuacaggaaguguauuacuuu

SEQ ID NO: 30499 - RNA, 19 nt, Homo sapiens
uucagauuaaacuaagagg

SEQ ID NO: 30500 - RNA, 19 nt, Homo sapiens
uugaaauuuuggugagagg

SEQ ID NO: 30501 - RNA, 15 nt, Homo sapiens
uuuacaugcuguugc

SEQ ID NO: 30502 - RNA, 21 nt, Homo sapiens
uuuccauuuuauucagccggg

SEQ ID NO: 30503 - RNA, 22 nt, Homo sapiens
gggaggaucgcuugagaucaag

SEQ ID NO: 30504 - RNA, 19 nt, Homo sapiens
acugucaaauggcaguuuu

SEQ ID NO: 30505 - RNA, 14 nt, Homo sapiens
aacauucuuggggg

SEQ ID NO: 30506 - RNA, 21 nt, Homo sapiens
agcugggugcgggcuuccugc

SEQ ID NO: 30507 - RNA, 21 nt, Homo sapiens
gggaagguuggugcacacagg

SEQ ID NO: 30508 - RNA, 17 nt, Homo sapiens
uagcauuuugguuauuu

SEQ ID NO: 30509 - RNA, 15 nt, Homo sapiens
gcuggcagagccagg

SEQ ID NO: 30510 - RNA, 16 nt, Homo sapiens
ggcuuccuccuccuuc

SEQ ID NO: 30511 - RNA, 22 nt, Homo sapiens
gggccucaguggggcuuggggg

SEQ ID NO: 30512 - RNA, 22 nt, Homo sapiens
ugcacacaggcccaucugccgc

SEQ ID NO: 30513 - RNA, 20 nt, Homo sapiens
agcacacgguucaggcucca

SEQ ID NO: 30514 - RNA, 20 nt, Homo sapiens
aggccucgggaucccaccuc

SEQ ID NO: 30515 - RNA, 22 nt, Homo sapiens
ccccggcgcggcgggcgagacg

SEQ ID NO: 30516 - RNA, 22 nt, Homo sapiens
ccuccuccuucucuaacauugg

SEQ ID NO: 30517 - RNA, 20 nt, Homo sapiens
cggcccccuccucgacagcu

SEQ ID NO: 30518 - RNA, 17 nt, Homo sapiens
cuccuucucuaacauug

SEQ ID NO: 30519 - RNA, 21 nt, Homo sapiens
gacagaucggggagaguuggc

SEQ ID NO: 30520 - RNA, 17 nt, Homo sapiens
gacuggagaggccucgg

SEQ ID NO: 30521 - RNA, 23 nt, Homo sapiens
gcacacacugggucagcccgggg

SEQ ID NO: 30522 - RNA, 21 nt, Homo sapiens
gcucugagcccuuuuccagcc

SEQ ID NO: 30523 - RNA, 19 nt, Homo sapiens
ggagaguuggcuuaaaggu

SEQ ID NO: 30524 - RNA, 20 nt, Homo sapiens
gggcccacacaagcuugccu

SEQ ID NO: 30525 - RNA, 20 nt, Homo sapiens
ggguggaggggaagccaagc

SEQ ID NO: 30526 - RNA, 19 nt, Homo sapiens
uacacaaggacagagcaca

SEQ ID NO: 30527 - RNA, 18 nt, Homo sapiens
ucggcccaucaugcccag

SEQ ID NO: 30528 - RNA, 20 nt, Homo sapiens
ugagaacaguccccugaagc

SEQ ID NO: 30529 - RNA, 19 nt, Homo sapiens
ugaggcucaggagggugac

SEQ ID NO: 30530 - RNA, 17 nt, Homo sapiens
cggcagccucucuucug

SEQ ID NO: 30531 - RNA, 15 nt, Homo sapiens
cuaaaugugagugug

SEQ ID NO: 30532 - RNA, 18 nt, Homo sapiens
gaaguuuguaaacaaucu

SEQ ID NO: 30533 - RNA, 17 nt, Homo sapiens
gcgagggaggcagcggc

SEQ ID NO: 30534 - RNA, 21 nt, Homo sapiens
ugcggcgggcgggacugcggu

SEQ ID NO: 30535 - RNA, 23 nt, Homo sapiens
ugguaagcagacgacguuuggua

SEQ ID NO: 30536 - RNA, 18 nt, Homo sapiens
ugugagugugugugugug

SEQ ID NO: 30537 - RNA, 19 nt, Homo sapiens
ugugagugugugugugugu

SEQ ID NO: 30538 - RNA, 20 nt, Homo sapiens
ugugaguguguguguguguu

SEQ ID NO: 30539 - RNA, 26 nt, Homo sapiens
ccgcccccugccccuccccuccgccc

SEQ ID NO: 30540 - RNA, 15 nt, Homo sapiens
uggauggggaggggg

SEQ ID NO: 30541 - RNA, 24 nt, Homo sapiens
agcuguugugcagcagagugugag

SEQ ID NO: 30542 - RNA, 17 nt, Homo sapiens
agggugucuggccgggu

SEQ ID NO: 30543 - RNA, 18 nt, Homo sapiens
cagcagagugugagcugg

SEQ ID NO: 30544 - RNA, 20 nt, Homo sapiens
ccugccacucggggcagcag

SEQ ID NO: 30545 - RNA, 14 nt, Homo sapiens
gcacucgcccagcu

SEQ ID NO: 30546 - RNA, 18 nt, Homo sapiens
gugagggugucuggccgg

SEQ ID NO: 30547 - RNA, 21 nt, Homo sapiens
ugccacucggggcagcagcgc

SEQ ID NO: 30548 - RNA, 17 nt, Homo sapiens
ugcuuguuuuggggcuc

SEQ ID NO: 30549 - RNA, 14 nt, Homo sapiens
aucaucuaaccacu

SEQ ID NO: 30550 - RNA, 22 nt, Homo sapiens
ugugcagcuaguuuuccacuuu

SEQ ID NO: 30551 - RNA, 28 nt, Homo sapiens
uugguugauaagcugguguaccgguugg

SEQ ID NO: 30552 - RNA, 22 nt, Homo sapiens
accgagggauuuguuuagauug

SEQ ID NO: 30553 - RNA, 19 nt, Homo sapiens
agaacaaugguuggagcuu

SEQ ID NO: 30554 - RNA, 19 nt, Homo sapiens
agcacugcagagauuuagu

SEQ ID NO: 30555 - RNA, 21 nt, Homo sapiens
aggaagcuaagaaauuaaaga

SEQ ID NO: 30556 - RNA, 17 nt, Homo sapiens
gccacugggagaguguu

SEQ ID NO: 30557 - RNA, 21 nt, Homo sapiens
uaaaaacucaucuugguauug

SEQ ID NO: 30558 - RNA, 19 nt, Homo sapiens
uagcaccauuggauguggg

SEQ ID NO: 30559 - RNA, 21 nt, Homo sapiens
ucaacccaguacuuuuaguac

SEQ ID NO: 30560 - RNA, 19 nt, Homo sapiens
ucauccucagcccuguccc

SEQ ID NO: 30561 - RNA, 17 nt, Homo sapiens
ucuuuauaugagguaaa

SEQ ID NO: 30562 - RNA, 22 nt, Homo sapiens
uguuuucuaauaagcaucauuc

SEQ ID NO: 30563 - RNA, 20 nt, Homo sapiens
uucauuauuuaaaaacucau

SEQ ID NO: 30564 - RNA, 22 nt, Homo sapiens
aauuucuugucauuuacaaaaa

SEQ ID NO: 30565 - RNA, 19 nt, Homo sapiens
cuugaugauagaugaccau

SEQ ID NO: 30566 - RNA, 15 nt, Homo sapiens
ggugggggcagggaa

SEQ ID NO: 30567 - RNA, 16 nt, Homo sapiens
uccaaauucucuugau

SEQ ID NO: 30568 - RNA, 20 nt, Homo sapiens
aggaguguguuuuuucucca

SEQ ID NO: 30569 - RNA, 16 nt, Homo sapiens
cagcugcugguacaug

SEQ ID NO: 30570 - RNA, 20 nt, Homo sapiens
aggaguguguuuuuucucca

SEQ ID NO: 30571 - RNA, 16 nt, Homo sapiens
cagcugcugguacaug

SEQ ID NO: 30572 - RNA, 17 nt, Homo sapiens
aggguucuauggcaauu

SEQ ID NO: 30573 - RNA, 15 nt, Homo sapiens
cagccgaugaugucc

SEQ ID NO: 30574 - RNA, 21 nt, Homo sapiens
ccgccgcccggccugacgccc

SEQ ID NO: 30575 - RNA, 21 nt, Homo sapiens
cgccgguacucgggaggcgcc

SEQ ID NO: 30576 - RNA, 23 nt, Homo sapiens
cugaagagucaggaggauaaaaa

SEQ ID NO: 30577 - RNA, 20 nt, Homo sapiens
gaaguuaugaggcgcgggcc

SEQ ID NO: 30578 - RNA, 18 nt, Homo sapiens
gagagguagcugggaggu

SEQ ID NO: 30579 - RNA, 18 nt, Homo sapiens
gaugaagugauugccaaa

SEQ ID NO: 30580 - RNA, 15 nt, Homo sapiens
gccugaagagucagg

SEQ ID NO: 30581 - RNA, 17 nt, Homo sapiens
gcgccugcccaggcgcc

SEQ ID NO: 30582 - RNA, 19 nt, Homo sapiens
ggagguaagaaggugacuu

SEQ ID NO: 30583 - RNA, 17 nt, Homo sapiens
ggccggccaccgcccuc

SEQ ID NO: 30584 - RNA, 24 nt, Homo sapiens
gggcaucuguucuguagaaggugc

SEQ ID NO: 30585 - RNA, 17 nt, Homo sapiens
ggugcugacuuuugugg

SEQ ID NO: 30586 - RNA, 21 nt, Homo sapiens
ucacagaguacguccgccugc

SEQ ID NO: 30587 - RNA, 18 nt, Homo sapiens
uggccugaagagucagga

SEQ ID NO: 30588 - RNA, 17 nt, Homo sapiens
uuuaauguguuuauauu

SEQ ID NO: 30589 - RNA, 20 nt, Homo sapiens
uuugucuuuuaauguguuua

SEQ ID NO: 30590 - RNA, 18 nt, Homo sapiens
cagccgcgucgcccccgu

SEQ ID NO: 30591 - RNA, 18 nt, Homo sapiens
ccucagccgcgucgcccc

SEQ ID NO: 30592 - RNA, 19 nt, Homo sapiens
acggagcgcgcgcgaagcg

SEQ ID NO: 30593 - RNA, 18 nt, Homo sapiens
agcauuggacacacacuc

SEQ ID NO: 30594 - RNA, 19 nt, Homo sapiens
gcacaguuuuuaaugcauu

SEQ ID NO: 30595 - RNA, 16 nt, Homo sapiens
gcgucacggagcgcgc

SEQ ID NO: 30596 - RNA, 22 nt, Homo sapiens
ggcagaacaacguggcaagucu

SEQ ID NO: 30597 - RNA, 17 nt, Homo sapiens
uccauggccucuggauc

SEQ ID NO: 30598 - RNA, 18 nt, Homo sapiens
cccgugcuccccuagccc

SEQ ID NO: 30599 - RNA, 18 nt, Homo sapiens
gggaggacgggaggugga

SEQ ID NO: 30600 - RNA, 18 nt, Homo sapiens
ggggaggacgggaggugg

SEQ ID NO: 30601 - RNA, 24 nt, Homo sapiens
aggcagcugcgcgggccgcgggug

SEQ ID NO: 30602 - RNA, 22 nt, Homo sapiens
cagcugcgcgggccgcgggugc

SEQ ID NO: 30603 - RNA, 18 nt, Homo sapiens
gcagcugcgcgggccgcg

SEQ ID NO: 30604 - RNA, 21 nt, Homo sapiens
uacaaaguauuuccugcccca

SEQ ID NO: 30605 - RNA, 16 nt, Homo sapiens
ugugucccugucaccc

SEQ ID NO: 30606 - RNA, 20 nt, Homo sapiens
aagugggggaggccaggggg

SEQ ID NO: 30607 - RNA, 18 nt, Homo sapiens
agcuuccaccccaccuug

SEQ ID NO: 30608 - RNA, 18 nt, Homo sapiens
caggggagagggccacca

SEQ ID NO: 30609 - RNA, 21 nt, Homo sapiens
ccuccagcuguccagccaccu

SEQ ID NO: 30610 - RNA, 18 nt, Homo sapiens
ccuggccugggcuccucc

SEQ ID NO: 30611 - RNA, 22 nt, Homo sapiens
cgcguggggcucgccauuagcc

SEQ ID NO: 30612 - RNA, 23 nt, Homo sapiens
cggggcgggcggagcgcggcgcg

SEQ ID NO: 30613 - RNA, 15 nt, Homo sapiens
gcggagcgcggcgcg

SEQ ID NO: 30614 - RNA, 18 nt, Homo sapiens
ggccaggggggcaaggga

SEQ ID NO: 30615 - RNA, 23 nt, Homo sapiens
ggcggagcgcggcgcguggggcu

SEQ ID NO: 30616 - RNA, 23 nt, Homo sapiens
ggggaggccaggggggcaaggga

SEQ ID NO: 30617 - RNA, 19 nt, Homo sapiens
gugggggaggccagggggg

SEQ ID NO: 30618 - RNA, 20 nt, Homo sapiens
uccggugcuggcuuagucug

SEQ ID NO: 30619 - RNA, 20 nt, Homo sapiens
ugcugucccuggaggaggac

SEQ ID NO: 30620 - RNA, 21 nt, Homo sapiens
uucgccaucucgggcuuuguc

SEQ ID NO: 30621 - RNA, 20 nt, Homo sapiens
aaccauacacugccaccccu

SEQ ID NO: 30622 - RNA, 19 nt, Homo sapiens
ccuagggcggcggcacccu

SEQ ID NO: 30623 - RNA, 22 nt, Homo sapiens
gccgugguggugcuccugcugg

SEQ ID NO: 30624 - RNA, 20 nt, Homo sapiens
ucuuucgcucaggacggccc

SEQ ID NO: 30625 - RNA, 23 nt, Homo sapiens
aagcaguguaccuuauccugguu

SEQ ID NO: 30626 - RNA, 18 nt, Homo sapiens
accccggcuccucauccc

SEQ ID NO: 30627 - RNA, 18 nt, Homo sapiens
aggaggcucagccuguga

SEQ ID NO: 30628 - RNA, 17 nt, Homo sapiens
cggcuccuguguccccg

SEQ ID NO: 30629 - RNA, 18 nt, Homo sapiens
cucccucugaagcaugaa

SEQ ID NO: 30630 - RNA, 19 nt, Homo sapiens
cuccugccccuccucuucc

SEQ ID NO: 30631 - RNA, 20 nt, Homo sapiens
gagggaacauuuggguauag

SEQ ID NO: 30632 - RNA, 19 nt, Homo sapiens
gggcaaaaaaaaaaauccu

SEQ ID NO: 30633 - RNA, 18 nt, Homo sapiens
ggguuuucaggaggcuca

SEQ ID NO: 30634 - RNA, 16 nt, Homo sapiens
uaccaaguccuugugu

SEQ ID NO: 30635 - RNA, 26 nt, Homo sapiens
uaggauacaaagcacacauuagagcu

SEQ ID NO: 30636 - RNA, 20 nt, Homo sapiens
ucccagaggggacaggagga

SEQ ID NO: 30637 - RNA, 19 nt, Homo sapiens
ugcuaggggcuccacugac

SEQ ID NO: 30638 - RNA, 21 nt, Homo sapiens
uggugagaugaaccaagacgg

SEQ ID NO: 30639 - RNA, 24 nt, Homo sapiens
uucccuuuuuguucuuucucaaca

SEQ ID NO: 30640 - RNA, 21 nt, Homo sapiens
caauaguuuaagcuguuaguu

SEQ ID NO: 30641 - RNA, 25 nt, Homo sapiens
caauauacaguauuuacacaacagc

SEQ ID NO: 30642 - RNA, 15 nt, Homo sapiens
cgaguucacuuucca

SEQ ID NO: 30643 - RNA, 18 nt, Homo sapiens
gaaccugccuucaaagcc

SEQ ID NO: 30644 - RNA, 16 nt, Homo sapiens
uagcacauuauugcag

SEQ ID NO: 30645 - RNA, 18 nt, Homo sapiens
ucuuuggugauuucuucc

SEQ ID NO: 30646 - RNA, 17 nt, Homo sapiens
ggaaggaccaccuuuaa

SEQ ID NO: 30647 - RNA, 22 nt, Homo sapiens
aaaaguaucuccaccuuuccca

SEQ ID NO: 30648 - RNA, 21 nt, Homo sapiens
aggcagcuguagggcuucuag

SEQ ID NO: 30649 - RNA, 16 nt, Homo sapiens
caagggcaguggcccc

SEQ ID NO: 30650 - RNA, 19 nt, Homo sapiens
caccugauuugaagaacaa

SEQ ID NO: 30651 - RNA, 19 nt, Homo sapiens
cguucuguuaaaaaccucc

SEQ ID NO: 30652 - RNA, 19 nt, Homo sapiens
cuaggcuguggcaggccua

SEQ ID NO: 30653 - RNA, 19 nt, Homo sapiens
gcgaacacuggggacccag

SEQ ID NO: 30654 - RNA, 15 nt, Homo sapiens
ggaggcggugagggg

SEQ ID NO: 30655 - RNA, 16 nt, Homo sapiens
ugaggggagggggugg

SEQ ID NO: 30656 - RNA, 21 nt, Homo sapiens
ugauuuuaagacaaggggugc

SEQ ID NO: 30657 - RNA, 14 nt, Homo sapiens
uuuggucugugccc

SEQ ID NO: 30658 - RNA, 15 nt, Homo sapiens
aucccagggcugauc

SEQ ID NO: 30659 - RNA, 23 nt, Homo sapiens
cuccaaugugguuuucauuacaa

SEQ ID NO: 30660 - RNA, 17 nt, Homo sapiens
cugguuaagaaaacacc

SEQ ID NO: 30661 - RNA, 19 nt, Homo sapiens
cuuugggacuacaauccua

SEQ ID NO: 30662 - RNA, 16 nt, Homo sapiens
gcagcgugcguuccug

SEQ ID NO: 30663 - RNA, 22 nt, Homo sapiens
acacauacaugguauggacuau

SEQ ID NO: 30664 - RNA, 20 nt, Homo sapiens
agggaagacaaaaagcaaaa

SEQ ID NO: 30665 - RNA, 18 nt, Homo sapiens
cauaauagcuccauggca

SEQ ID NO: 30666 - RNA, 18 nt, Homo sapiens
ccgccgcccgcucucggc

SEQ ID NO: 30667 - RNA, 18 nt, Homo sapiens
cggcuccgggucgccggc

SEQ ID NO: 30668 - RNA, 19 nt, Homo sapiens
gacuacaggcacgugccac

SEQ ID NO: 30669 - RNA, 16 nt, Homo sapiens
gcgccggcguggccgc

SEQ ID NO: 30670 - RNA, 22 nt, Homo sapiens
uaaguuuccguuccucauuucc

SEQ ID NO: 30671 - RNA, 17 nt, Homo sapiens
uagccugcuugcacuca

SEQ ID NO: 30672 - RNA, 17 nt, Homo sapiens
uccgaggcaggcccagc

SEQ ID NO: 30673 - RNA, 22 nt, Homo sapiens
agggagcagggcuguccgggau

SEQ ID NO: 30674 - RNA, 19 nt, Homo sapiens
gcgcuucgccgccugccac

SEQ ID NO: 30675 - RNA, 19 nt, Homo sapiens
ggucgcuccaccucugcuc

SEQ ID NO: 30676 - RNA, 16 nt, Homo sapiens
agccagggucuggggu

SEQ ID NO: 30677 - RNA, 18 nt, Homo sapiens
agggucuggggucggccu

SEQ ID NO: 30678 - RNA, 18 nt, Homo sapiens
cuuccugggaggaaggug

SEQ ID NO: 30679 - RNA, 16 nt, Homo sapiens
gaagcugggggcugca

SEQ ID NO: 30680 - RNA, 21 nt, Homo sapiens
guggacacaggaguuucuggc

SEQ ID NO: 30681 - RNA, 14 nt, Homo sapiens
uauuccaccaccuc

SEQ ID NO: 30682 - RNA, 18 nt, Homo sapiens
caaccagcaaguccccag

SEQ ID NO: 30683 - RNA, 23 nt, Homo sapiens
ccuccaugcccucucuggaugcc

SEQ ID NO: 30684 - RNA, 22 nt, Homo sapiens
gucaacaaaaaaguuauuuauu

SEQ ID NO: 30685 - RNA, 17 nt, Homo sapiens
uauauccacuauauuua

SEQ ID NO: 30686 - RNA, 19 nt, Homo sapiens
uccaagcagccagccggcc

SEQ ID NO: 30687 - RNA, 15 nt, Homo sapiens
aagcaccacaaaugu

SEQ ID NO: 30688 - RNA, 18 nt, Homo sapiens
aagcggaaaguggggugg

SEQ ID NO: 30689 - RNA, 14 nt, Homo sapiens
cauggugcagagcc

SEQ ID NO: 30690 - RNA, 24 nt, Homo sapiens
ccgcacggaccgugccugccgccu

SEQ ID NO: 30691 - RNA, 18 nt, Homo sapiens
cgcucgcucgccucuccg

SEQ ID NO: 30692 - RNA, 24 nt, Homo sapiens
uauuaauaaggucuucacuucuag

SEQ ID NO: 30693 - RNA, 20 nt, Homo sapiens
ucacaccaggauaaaaagag

SEQ ID NO: 30694 - RNA, 20 nt, Homo sapiens
ugaaugacaguuuuguggcu

SEQ ID NO: 30695 - RNA, 22 nt, Homo sapiens
agucaguguggugaggggccac

SEQ ID NO: 30696 - RNA, 16 nt, Homo sapiens
gagggggagcuguguc

SEQ ID NO: 30697 - RNA, 25 nt, Homo sapiens
gggcggggaggaaaaccggggcgcc

SEQ ID NO: 30698 - RNA, 19 nt, Homo sapiens
aggcauuauguuuuaaaag

SEQ ID NO: 30699 - RNA, 21 nt, Homo sapiens
auacaaauauauauauauaua

SEQ ID NO: 30700 - RNA, 22 nt, Homo sapiens
auacaaauauauauauauauau

SEQ ID NO: 30701 - RNA, 20 nt, Homo sapiens
gccccgguucugcucuuccc

SEQ ID NO: 30702 - RNA, 19 nt, Homo sapiens
guauaacauaaagcacauu

SEQ ID NO: 30703 - RNA, 15 nt, Homo sapiens
uagcuauaagaaucu

SEQ ID NO: 30704 - RNA, 18 nt, Homo sapiens
uggucccuaaacuauuuu

SEQ ID NO: 30705 - RNA, 19 nt, Homo sapiens
uguaaauaguuuucucucc

SEQ ID NO: 30706 - RNA, 19 nt, Homo sapiens
uucauaguaaauauuuucu

SEQ ID NO: 30707 - RNA, 15 nt, Homo sapiens
uucugcucuucccag

SEQ ID NO: 30708 - RNA, 20 nt, Homo sapiens
uuuuuugugaaaguaaaaau

SEQ ID NO: 30709 - RNA, 14 nt, Homo sapiens
cacccggccgcccc

SEQ ID NO: 30710 - RNA, 19 nt, Homo sapiens
gccgggcugggguccaccg

SEQ ID NO: 30711 - RNA, 18 nt, Homo sapiens
gcggcggcgaggacucgg

SEQ ID NO: 30712 - RNA, 18 nt, Homo sapiens
caggcugggcacagaggc

SEQ ID NO: 30713 - RNA, 23 nt, Homo sapiens
caguagguagggggcuggguggg

SEQ ID NO: 30714 - RNA, 22 nt, Homo sapiens
ugaggggucagggcuggcugga

SEQ ID NO: 30715 - RNA, 18 nt, Homo sapiens
aagauucuuucucaugcu

SEQ ID NO: 30716 - RNA, 18 nt, Homo sapiens
gcccuuggaaugagaggc

SEQ ID NO: 30717 - RNA, 18 nt, Homo sapiens
ggguuaauuuuauugaca

SEQ ID NO: 30718 - RNA, 18 nt, Homo sapiens
ucacagcguagagacugu

SEQ ID NO: 30719 - RNA, 18 nt, Homo sapiens
uccggagcccggugucgc

SEQ ID NO: 30720 - RNA, 18 nt, Homo sapiens
uggcauuacaaaagguug

SEQ ID NO: 30721 - RNA, 17 nt, Homo sapiens
uuuuggaccucagauau

SEQ ID NO: 30722 - RNA, 18 nt, Homo sapiens
cauguggcuacugcuuug

SEQ ID NO: 30723 - RNA, 22 nt, Homo sapiens
ccuuuccgcccucccuaggacc

SEQ ID NO: 30724 - RNA, 17 nt, Homo sapiens
gccgaaguccccgcugc

SEQ ID NO: 30725 - RNA, 18 nt, Homo sapiens
ucgcugguugacaaaucu

SEQ ID NO: 30726 - RNA, 20 nt, Homo sapiens
uggcaacauuaaaaaagaaa

SEQ ID NO: 30727 - RNA, 14 nt, Homo sapiens
uggcagugccuccc

SEQ ID NO: 30728 - RNA, 18 nt, Homo sapiens
gguguugaauuuaugggc

SEQ ID NO: 30729 - RNA, 21 nt, Homo sapiens
uucacaucaauccuuuuuucu

SEQ ID NO: 30730 - RNA, 26 nt, Homo sapiens
uucauguggcugaaauagcucugugc

SEQ ID NO: 30731 - RNA, 17 nt, Homo sapiens
aaaugguuaugacaaug

SEQ ID NO: 30732 - RNA, 19 nt, Homo sapiens
aagcacacgugauacauau

SEQ ID NO: 30733 - RNA, 18 nt, Homo sapiens
gaaacuuuuuaauuaagg

SEQ ID NO: 30734 - RNA, 22 nt, Homo sapiens
guugauagaauaacuguucaua

SEQ ID NO: 30735 - RNA, 22 nt, Homo sapiens
uacagcaaacaaauaugaaaga

SEQ ID NO: 30736 - RNA, 18 nt, Homo sapiens
uggcacaaaacuauuugg

SEQ ID NO: 30737 - RNA, 16 nt, Homo sapiens
acgugcacacacacuc

SEQ ID NO: 30738 - RNA, 14 nt, Homo sapiens
aucuugguauccca

SEQ ID NO: 30739 - RNA, 18 nt, Homo sapiens
cccggcccauccuguucg

SEQ ID NO: 30740 - RNA, 17 nt, Homo sapiens
ccuucauggcuggggcc

SEQ ID NO: 30741 - RNA, 21 nt, Homo sapiens
gaggcuuucuuuuccgcccuc

SEQ ID NO: 30742 - RNA, 18 nt, Homo sapiens
aagggccuggagacccuc

SEQ ID NO: 30743 - RNA, 18 nt, Homo sapiens
caagguggagcgugcucg

SEQ ID NO: 30744 - RNA, 18 nt, Homo sapiens
cagaaaacacaacuuuau

SEQ ID NO: 30745 - RNA, 16 nt, Homo sapiens
ccagccccagcccucc

SEQ ID NO: 30746 - RNA, 14 nt, Homo sapiens
gacuguugcuggga

SEQ ID NO: 30747 - RNA, 21 nt, Homo sapiens
gagcgcgccggucgggccccg

SEQ ID NO: 30748 - RNA, 18 nt, Homo sapiens
gcggcugaagacauggcu

SEQ ID NO: 30749 - RNA, 17 nt, Homo sapiens
ggaggcagcgggggugc

SEQ ID NO: 30750 - RNA, 18 nt, Homo sapiens
ucuguccacuugccgcuc

SEQ ID NO: 30751 - RNA, 19 nt, Homo sapiens
ugcaagguggagcgugcuc

SEQ ID NO: 30752 - RNA, 19 nt, Homo sapiens
uugggcggcgcgucggggc

SEQ ID NO: 30753 - RNA, 17 nt, Homo sapiens
acgccgcuccuacggau

SEQ ID NO: 30754 - RNA, 17 nt, Homo sapiens
aggggaaggaggcgggg

SEQ ID NO: 30755 - RNA, 19 nt, Homo sapiens
ccaggcguucggcuccggc

SEQ ID NO: 30756 - RNA, 21 nt, Homo sapiens
ccaggcguucggcuccggccc

SEQ ID NO: 30757 - RNA, 21 nt, Homo sapiens
cgccaugcgcuggcagccggg

SEQ ID NO: 30758 - RNA, 17 nt, Homo sapiens
gagagcguuccaggcgu

SEQ ID NO: 30759 - RNA, 21 nt, Homo sapiens
gaggaggggaaggaggcgggg

SEQ ID NO: 30760 - RNA, 17 nt, Homo sapiens
ggaggcggacggagagc

SEQ ID NO: 30761 - RNA, 21 nt, Homo sapiens
ucgccaugcgcuggcagccgg

SEQ ID NO: 30762 - RNA, 19 nt, Homo sapiens
caguuaagguuuuccguug

SEQ ID NO: 30763 - RNA, 21 nt, Homo sapiens
uaagccgauaauuauaaacua

SEQ ID NO: 30764 - RNA, 19 nt, Homo sapiens
caccuguaaucucagcacu

SEQ ID NO: 30765 - RNA, 19 nt, Homo sapiens
cgcggcgaguguggacgcc

SEQ ID NO: 30766 - RNA, 18 nt, Homo sapiens
cggccccgcgcgcgcggc

SEQ ID NO: 30767 - RNA, 20 nt, Homo sapiens
gcaggcugugugaauaguaa

SEQ ID NO: 30768 - RNA, 18 nt, Homo sapiens
gccccgcgcgcgcggcga

SEQ ID NO: 30769 - RNA, 23 nt, Homo sapiens
gcgcgcggcgaguguggacgccg

SEQ ID NO: 30770 - RNA, 21 nt, Homo sapiens
gucuaucaagcuguuggcugg

SEQ ID NO: 30771 - RNA, 22 nt, Homo sapiens
uaucugucuaguaaucugacua

SEQ ID NO: 30772 - RNA, 20 nt, Homo sapiens
ucugucuuuugggggcucug

SEQ ID NO: 30773 - RNA, 24 nt, Homo sapiens
ugucuggcgggggucuggcugggg

SEQ ID NO: 30774 - RNA, 19 nt, Homo sapiens
ugugguccccugagugucc

SEQ ID NO: 30775 - RNA, 20 nt, Homo sapiens
uggcuggcuuguaaggcucu

SEQ ID NO: 30776 - RNA, 23 nt, Homo sapiens
ccuccagcuuucuccccuuaccu

SEQ ID NO: 30777 - RNA, 22 nt, Homo sapiens
uuggugcucugaccagcaggau

SEQ ID NO: 30778 - RNA, 20 nt, Homo sapiens
caacuaggggaaucaucugc

SEQ ID NO: 30779 - RNA, 18 nt, Homo sapiens
ccaaccgccucggacgcc

SEQ ID NO: 30780 - RNA, 18 nt, Homo sapiens
gcuacucaacuaggggaa

SEQ ID NO: 30781 - RNA, 18 nt, Homo sapiens
ugaacaucccuuuguucc

SEQ ID NO: 30782 - RNA, 17 nt, Homo sapiens
ugaagaagacugaaggg

SEQ ID NO: 30783 - RNA, 22 nt, Homo sapiens
aaacugcacucggguugauggc

SEQ ID NO: 30784 - RNA, 16 nt, Homo sapiens
cagguuuugccuuuuu

SEQ ID NO: 30785 - RNA, 15 nt, Homo sapiens
cccccgcucccggcc

SEQ ID NO: 30786 - RNA, 18 nt, Homo sapiens
gcucccggccacgcgucc

SEQ ID NO: 30787 - RNA, 23 nt, Homo sapiens
ccuaacucagaggcucuaagagg

SEQ ID NO: 30788 - RNA, 19 nt, Homo sapiens
cuggggcgcuucuggggcg

SEQ ID NO: 30789 - RNA, 18 nt, Homo sapiens
cacaccuuugcucuagaa

SEQ ID NO: 30790 - RNA, 19 nt, Homo sapiens
uaucaugauuuacauucag

SEQ ID NO: 30791 - RNA, 22 nt, Homo sapiens
ucaugauuuacauucagaggug

SEQ ID NO: 30792 - RNA, 21 nt, Homo sapiens
aagagggaggggagggacaag

SEQ ID NO: 30793 - RNA, 20 nt, Homo sapiens
ccuggaguuggcccugcugg

SEQ ID NO: 30794 - RNA, 17 nt, Homo sapiens
ccuuuccugucccuaca

SEQ ID NO: 30795 - RNA, 17 nt, Homo sapiens
guacaucuucacaacac

SEQ ID NO: 30796 - RNA, 19 nt, Homo sapiens
uggcuucacuguccuuuuc

SEQ ID NO: 30797 - RNA, 21 nt, Homo sapiens
uucugcaugucccaguuugcc

SEQ ID NO: 30798 - RNA, 20 nt, Homo sapiens
uuuaagaacuaccuaugggu

SEQ ID NO: 30799 - RNA, 18 nt, Homo sapiens
auguauacagaugaagaa

SEQ ID NO: 30800 - RNA, 16 nt, Homo sapiens
cagaaauaaaaguaac

SEQ ID NO: 30801 - RNA, 17 nt, Homo sapiens
cagagcgaagagauaga

SEQ ID NO: 30802 - RNA, 16 nt, Homo sapiens
cugauuuuuguggggu

SEQ ID NO: 30803 - RNA, 19 nt, Homo sapiens
uaaaaaaagggagaacuga

SEQ ID NO: 30804 - RNA, 21 nt, Homo sapiens
uauaaagcauuucauuauucu

SEQ ID NO: 30805 - RNA, 16 nt, Homo sapiens
uccauaaaggagugcg

SEQ ID NO: 30806 - RNA, 18 nt, Homo sapiens
ugagaggguuaccuauaa

SEQ ID NO: 30807 - RNA, 17 nt, Homo sapiens
uguaacaagcugguccu

SEQ ID NO: 30808 - RNA, 23 nt, Homo sapiens
uguuguaucuuaaugguguaccu

SEQ ID NO: 30809 - RNA, 20 nt, Homo sapiens
uuugaaagaaucagaagggu

SEQ ID NO: 30810 - RNA, 21 nt, Homo sapiens
accgagaucggaucgugccuu

SEQ ID NO: 30811 - RNA, 17 nt, Homo sapiens
acggagucugacucugu

SEQ ID NO: 30812 - RNA, 19 nt, Homo sapiens
cacaguuuugucauuagaa

SEQ ID NO: 30813 - RNA, 21 nt, Homo sapiens
cagcaucugcuucugauuugu

SEQ ID NO: 30814 - RNA, 19 nt, Homo sapiens
ccuugaaaaguuucuuuca

SEQ ID NO: 30815 - RNA, 18 nt, Homo sapiens
cuaagagugagcagaccu

SEQ ID NO: 30816 - RNA, 16 nt, Homo sapiens
gcagcgccgcgaucug

SEQ ID NO: 30817 - RNA, 17 nt, Homo sapiens
ugcucuuuaauaaggcc

SEQ ID NO: 30818 - RNA, 15 nt, Homo sapiens
uugaaagaaaauccu

SEQ ID NO: 30819 - RNA, 19 nt, Homo sapiens
uuuauaucauagcuuugca

SEQ ID NO: 30820 - RNA, 16 nt, Homo sapiens
ugcugaguguccgcca

SEQ ID NO: 30821 - RNA, 19 nt, Homo sapiens
agcucagacaauuggaagg

SEQ ID NO: 30822 - RNA, 19 nt, Homo sapiens
aguggcuaccauuuuugga

SEQ ID NO: 30823 - RNA, 14 nt, Homo sapiens
cgggcggcuggagc

SEQ ID NO: 30824 - RNA, 18 nt, Homo sapiens
gcugccgcugggggaccg

SEQ ID NO: 30825 - RNA, 21 nt, Homo sapiens
gcuggcccgcgggcggcugga

SEQ ID NO: 30826 - RNA, 17 nt, Homo sapiens
gcuggcuuugauaaggc

SEQ ID NO: 30827 - RNA, 23 nt, Homo sapiens
ucaaaugauuuccuucagaggug

SEQ ID NO: 30828 - RNA, 18 nt, Homo sapiens
ccaugaauuacucaggga

SEQ ID NO: 30829 - RNA, 21 nt, Homo sapiens
ccccgggccgggccgacuggg

SEQ ID NO: 30830 - RNA, 18 nt, Homo sapiens
ccuggagguggggugagc

SEQ ID NO: 30831 - RNA, 18 nt, Homo sapiens
gcugccccaaccagggcg

SEQ ID NO: 30832 - RNA, 18 nt, Homo sapiens
ggcugcugucuccagggc

SEQ ID NO: 30833 - RNA, 20 nt, Homo sapiens
uaaauguuuuuguggagugu

SEQ ID NO: 30834 - RNA, 18 nt, Homo sapiens
uggggugggaaggaaccu

SEQ ID NO: 30835 - RNA, 18 nt, Homo sapiens
uuacccguacguuccuga

SEQ ID NO: 30836 - RNA, 21 nt, Homo sapiens
caguccacucagaauuaugaa

SEQ ID NO: 30837 - RNA, 20 nt, Homo sapiens
ccuucuccuccucucuggcc

SEQ ID NO: 30838 - RNA, 19 nt, Homo sapiens
gcacgucccuccugaaaau

SEQ ID NO: 30839 - RNA, 22 nt, Homo sapiens
gcuccucucacccuccuucucc

SEQ ID NO: 30840 - RNA, 16 nt, Homo sapiens
uuucagggauauugca

SEQ ID NO: 30841 - RNA, 18 nt, Homo sapiens
aagcugcaguacaguggc

SEQ ID NO: 30842 - RNA, 16 nt, Homo sapiens
caaaacuaacugguac

SEQ ID NO: 30843 - RNA, 18 nt, Homo sapiens
gaauucauugccuuuacu

SEQ ID NO: 30844 - RNA, 21 nt, Homo sapiens
uaaaacuguucuaaugaagaa

SEQ ID NO: 30845 - RNA, 18 nt, Homo sapiens
ucauagcucacugcagcc

SEQ ID NO: 30846 - RNA, 18 nt, Homo sapiens
uccuauaaacauuuuuau

SEQ ID NO: 30847 - RNA, 22 nt, Homo sapiens
ucuauuauugucauguuuagau

SEQ ID NO: 30848 - RNA, 23 nt, Homo sapiens
ucuggauuuuuccugugugucua

SEQ ID NO: 30849 - RNA, 22 nt, Homo sapiens
uuuuacucaauuuuuacacugg

SEQ ID NO: 30850 - RNA, 16 nt, Homo sapiens
aggcaggcgggggcgg

SEQ ID NO: 30851 - RNA, 17 nt, Homo sapiens
auguuauggcaguuuuc

SEQ ID NO: 30852 - RNA, 20 nt, Homo sapiens
caguggcggcgccgggccug

SEQ ID NO: 30853 - RNA, 22 nt, Homo sapiens
ccagucccggcuccgcuaggcc

SEQ ID NO: 30854 - RNA, 14 nt, Homo sapiens
ccgggaggcggcgg

SEQ ID NO: 30855 - RNA, 22 nt, Homo sapiens
gcggcggcggcagcgaugcgcc

SEQ ID NO: 30856 - RNA, 22 nt, Homo sapiens
ggaggcggcggggguuccggag

SEQ ID NO: 30857 - RNA, 22 nt, Homo sapiens
uagcucacggaaaccaucuuau

SEQ ID NO: 30858 - RNA, 17 nt, Homo sapiens
uccgggaggcggcgggg

SEQ ID NO: 30859 - RNA, 21 nt, Homo sapiens
ucgagcccgcccagggggcgg

SEQ ID NO: 30860 - RNA, 18 nt, Homo sapiens
ugaggcaggcgggggcgg

SEQ ID NO: 30861 - RNA, 19 nt, Homo sapiens
ugaugugacacaguguugu

SEQ ID NO: 30862 - RNA, 17 nt, Homo sapiens
uggcggcgccgggccug

SEQ ID NO: 30863 - RNA, 17 nt, Homo sapiens
caccgcccucacccccc

SEQ ID NO: 30864 - RNA, 17 nt, Homo sapiens
cugugcgaggaaagaag

SEQ ID NO: 30865 - RNA, 22 nt, Homo sapiens
ggguuuguagggacaugggcca

SEQ ID NO: 30866 - RNA, 15 nt, Homo sapiens
ucaccugcuguaacu

SEQ ID NO: 30867 - RNA, 24 nt, Homo sapiens
uugcuguuguuauaguacaaacac

SEQ ID NO: 30868 - RNA, 16 nt, Homo sapiens
gacuguggggacagga

SEQ ID NO: 30869 - RNA, 17 nt, Homo sapiens
gcgagucgcgccgccgc

SEQ ID NO: 30870 - RNA, 18 nt, Homo sapiens
gggggcccggcugggcgc

SEQ ID NO: 30871 - RNA, 17 nt, Homo sapiens
ggugggugugggggcac

SEQ ID NO: 30872 - RNA, 22 nt, Homo sapiens
ucucgggcguggggggacugcc

SEQ ID NO: 30873 - RNA, 21 nt, Homo sapiens
ugccccuucucaucggggcag

SEQ ID NO: 30874 - RNA, 20 nt, Homo sapiens
ugccuugcuggcccuccccc

SEQ ID NO: 30875 - RNA, 24 nt, Homo sapiens
uacuaugacuaaauaauaaaauua

SEQ ID NO: 30876 - RNA, 21 nt, Homo sapiens
cuuucucacucuugaacuacu

SEQ ID NO: 30877 - RNA, 17 nt, Homo sapiens
gcgccuggggcucugcg

SEQ ID NO: 30878 - RNA, 18 nt, Homo sapiens
ggcauaguuuaguuccua

SEQ ID NO: 30879 - RNA, 19 nt, Homo sapiens
uauggcugggaucaaaggg

SEQ ID NO: 30880 - RNA, 15 nt, Homo sapiens
ugagaggacacuuuu

SEQ ID NO: 30881 - RNA, 21 nt, Homo sapiens
ugccuguaccaauaauaucaa

SEQ ID NO: 30882 - RNA, 21 nt, Homo sapiens
ugcuaugugcauaugggaagu

SEQ ID NO: 30883 - RNA, 18 nt, Homo sapiens
uaaagagacuuagcacau

SEQ ID NO: 30884 - RNA, 16 nt, Homo sapiens
aucgggagcgggagcg

SEQ ID NO: 30885 - RNA, 14 nt, Homo sapiens
caguggcucgcgcc

SEQ ID NO: 30886 - RNA, 19 nt, Homo sapiens
gcuuugagaaagaggaagg

SEQ ID NO: 30887 - RNA, 16 nt, Homo sapiens
ggcggagcaggcgacc

SEQ ID NO: 30888 - RNA, 24 nt, Homo sapiens
gggagggaagggagaacaggggca

SEQ ID NO: 30889 - RNA, 24 nt, Homo sapiens
ggguaggcgcuaagaagaguagga

SEQ ID NO: 30890 - RNA, 16 nt, Homo sapiens
ugcccacuucccucuc

SEQ ID NO: 30891 - RNA, 16 nt, Homo sapiens
uucugccccaccccag

SEQ ID NO: 30892 - RNA, 22 nt, Homo sapiens
uuuuuuuuuuuucuagaaacau

SEQ ID NO: 30893 - RNA, 18 nt, Homo sapiens
aagugaaggagaggugag

SEQ ID NO: 30894 - RNA, 18 nt, Homo sapiens
ggagaggugagaaagaca

SEQ ID NO: 30895 - RNA, 19 nt, Homo sapiens
ugaauaauucugcuguuuc

SEQ ID NO: 30896 - RNA, 18 nt, Homo sapiens
ucgggcugcuggccuggc

SEQ ID NO: 30897 - RNA, 18 nt, Homo sapiens
cuccugcuaggguucuua

SEQ ID NO: 30898 - RNA, 17 nt, Homo sapiens
gcccuuaccccuccccc

SEQ ID NO: 30899 - RNA, 18 nt, Homo sapiens
ggagcggggguggggagg

SEQ ID NO: 30900 - RNA, 17 nt, Homo sapiens
ggcccguaccccgcagc

SEQ ID NO: 30901 - RNA, 19 nt, Homo sapiens
ugccccugcuacggggggc

SEQ ID NO: 30902 - RNA, 19 nt, Homo sapiens
uugccuccuccaucacgaa

SEQ ID NO: 30903 - RNA, 23 nt, Homo sapiens
aauauauauauauauauauauaa

SEQ ID NO: 30904 - RNA, 22 nt, Homo sapiens
acacauauauguauauauauau

SEQ ID NO: 30905 - RNA, 22 nt, Homo sapiens
acauauauauauuuauauauau

SEQ ID NO: 30906 - RNA, 20 nt, Homo sapiens
acgcagccgcaggaccacgc

SEQ ID NO: 30907 - RNA, 22 nt, Homo sapiens
auauauacguacauauauauau

SEQ ID NO: 30908 - RNA, 21 nt, Homo sapiens
auauauauauauauauauaua

SEQ ID NO: 30909 - RNA, 23 nt, Homo sapiens
auauauauauauauauauauauu

SEQ ID NO: 30910 - RNA, 24 nt, Homo sapiens
cacacacauauauguauauauaua

SEQ ID NO: 30911 - RNA, 16 nt, Homo sapiens
cacuuccagaccuucu

SEQ ID NO: 30912 - RNA, 18 nt, Homo sapiens
cacuuguacuuuuaucac

SEQ ID NO: 30913 - RNA, 20 nt, Homo sapiens
ccagguaggagccaggugcg

SEQ ID NO: 30914 - RNA, 18 nt, Homo sapiens
ccuguuggggugcccggg

SEQ ID NO: 30915 - RNA, 16 nt, Homo sapiens
gaacccaggaggcgga

SEQ ID NO: 30916 - RNA, 20 nt, Homo sapiens
gcggaucacagggucaggag

SEQ ID NO: 30917 - RNA, 22 nt, Homo sapiens
gucuguaauccuagcuacuugg

SEQ ID NO: 30918 - RNA, 24 nt, Homo sapiens
uacauauauacguacauauauaua

SEQ ID NO: 30919 - RNA, 22 nt, Homo sapiens
uacauauauauauuuauauaua

SEQ ID NO: 30920 - RNA, 19 nt, Homo sapiens
uauauauauauuuauauau

SEQ ID NO: 30921 - RNA, 24 nt, Homo sapiens
uauauauauuuauauauacguaua

SEQ ID NO: 30922 - RNA, 23 nt, Homo sapiens
uauauauuuauauauacguauau

SEQ ID NO: 30923 - RNA, 24 nt, Homo sapiens
uauauguauauauauauuuauaua

SEQ ID NO: 30924 - RNA, 24 nt, Homo sapiens
uauguauauauauauuuauauaua

SEQ ID NO: 30925 - RNA, 18 nt, Homo sapiens
ucugggcacuuccagacc

SEQ ID NO: 30926 - RNA, 23 nt, Homo sapiens
ugcccguaaucccagcacuuugg

SEQ ID NO: 30927 - RNA, 20 nt, Homo sapiens
uguuuugucccgaggcugcu

SEQ ID NO: 30928 - RNA, 17 nt, Homo sapiens
uugggaggccgaggcgg

SEQ ID NO: 30929 - RNA, 14 nt, Homo sapiens
gcuagccccaaaaa

SEQ ID NO: 30930 - RNA, 17 nt, Homo sapiens
uccucccgcccaccggg

SEQ ID NO: 30931 - RNA, 18 nt, Homo sapiens
acuuagcucagcuggagc

SEQ ID NO: 30932 - RNA, 17 nt, Homo sapiens
ccucaggggcacuguga

SEQ ID NO: 30933 - RNA, 20 nt, Homo sapiens
cugauuccuuuucuucuccg

SEQ ID NO: 30934 - RNA, 16 nt, Homo sapiens
cugcgauguccugagu

SEQ ID NO: 30935 - RNA, 23 nt, Homo sapiens
uaaaaaaacaaaagcaacaugcu

SEQ ID NO: 30936 - RNA, 22 nt, Homo sapiens
ucaauuuucucucguccucagg

SEQ ID NO: 30937 - RNA, 19 nt, Homo sapiens
uuugauggguguguacagc

SEQ ID NO: 30938 - RNA, 18 nt, Homo sapiens
aaagagaugaaaaauuag

SEQ ID NO: 30939 - RNA, 19 nt, Homo sapiens
uggagugguuaugaagguc

SEQ ID NO: 30940 - RNA, 22 nt, Homo sapiens
ugguggacaccaauuauaugcu

SEQ ID NO: 30941 - RNA, 18 nt, Homo sapiens
ccgcccccucccgccccc

SEQ ID NO: 30942 - RNA, 18 nt, Homo sapiens
ccgccgccugggccccgc

SEQ ID NO: 30943 - RNA, 23 nt, Homo sapiens
cuucuuauaggguuuucugaaau

SEQ ID NO: 30944 - RNA, 17 nt, Homo sapiens
gagggaugagccucuca

SEQ ID NO: 30945 - RNA, 21 nt, Homo sapiens
gcgcggggagcgcacggaccg

SEQ ID NO: 30946 - RNA, 20 nt, Homo sapiens
gcggcggcggcggcagcgcc

SEQ ID NO: 30947 - RNA, 19 nt, Homo sapiens
gcggggagcgcacggaccg

SEQ ID NO: 30948 - RNA, 18 nt, Homo sapiens
ggagugggcggcgagggg

SEQ ID NO: 30949 - RNA, 21 nt, Homo sapiens
ggggagugggcggcgaggggg

SEQ ID NO: 30950 - RNA, 24 nt, Homo sapiens
ggggagugggcggcgagggggagc

SEQ ID NO: 30951 - RNA, 15 nt, Homo sapiens
acuguggugcucaug

SEQ ID NO: 30952 - RNA, 20 nt, Homo sapiens
aggaguguguuuucucucca

SEQ ID NO: 30953 - RNA, 17 nt, Homo sapiens
ugagggaagguggaaca

SEQ ID NO: 30954 - RNA, 18 nt, Homo sapiens
ucucagaagggcgaguga

SEQ ID NO: 30955 - RNA, 21 nt, Homo sapiens
uguacaugcugguaucuguug

SEQ ID NO: 30956 - RNA, 18 nt, Homo sapiens
ccagagcaggaugcccgg

SEQ ID NO: 30957 - RNA, 19 nt, Homo sapiens
ugggggcaaagagguggca

SEQ ID NO: 30958 - RNA, 21 nt, Homo sapiens
cagaaacagcucagggcaccu

SEQ ID NO: 30959 - RNA, 20 nt, Homo sapiens
ccgcucgucggccagcggcu

SEQ ID NO: 30960 - RNA, 20 nt, Homo sapiens
cuugucaaugacuaauugca

SEQ ID NO: 30961 - RNA, 20 nt, Homo sapiens
gauuugccaguaucaguccu

SEQ ID NO: 30962 - RNA, 17 nt, Homo sapiens
guguccugguucuugca

SEQ ID NO: 30963 - RNA, 17 nt, Homo sapiens
uaaacuaugacuuccuu

SEQ ID NO: 30964 - RNA, 21 nt, Homo sapiens
uuggguacagaaaacacacac

SEQ ID NO: 30965 - RNA, 18 nt, Homo sapiens
gacuuuuauaaauauuga

SEQ ID NO: 30966 - RNA, 24 nt, Homo sapiens
uagcagaaaguagaaauguuucag

SEQ ID NO: 30967 - RNA, 17 nt, Homo sapiens
cauaauguugucuugcu

SEQ ID NO: 30968 - RNA, 17 nt, Homo sapiens
gauaaaaugguccugau

SEQ ID NO: 30969 - RNA, 18 nt, Homo sapiens
uauguugaauagucagua

SEQ ID NO: 30970 - RNA, 21 nt, Homo sapiens
uguuaaagauucaauuuaugu

SEQ ID NO: 30971 - RNA, 15 nt, Homo sapiens
uuccggauagagggu

SEQ ID NO: 30972 - RNA, 20 nt, Homo sapiens
uuuguccuugagauaacaug

SEQ ID NO: 30973 - RNA, 19 nt, Homo sapiens
cagcgggacagaccugagc

SEQ ID NO: 30974 - RNA, 20 nt, Homo sapiens
ugagaggccagagccaaggg

SEQ ID NO: 30975 - RNA, 19 nt, Homo sapiens
cccgccgcaucccgccgcc

SEQ ID NO: 30976 - RNA, 15 nt, Homo sapiens
ccgcaucccgccgcc

SEQ ID NO: 30977 - RNA, 23 nt, Homo sapiens
gggcggcgacgcgggacuuggag

SEQ ID NO: 30978 - RNA, 22 nt, Homo sapiens
ugugcagucucccgacuccugc

SEQ ID NO: 30979 - RNA, 21 nt, Homo sapiens
agaguuuaguaggggcugaag

SEQ ID NO: 30980 - RNA, 22 nt, Homo sapiens
auauauauauguauauauauau

SEQ ID NO: 30981 - RNA, 22 nt, Homo sapiens
auauauauguauauauauauau

SEQ ID NO: 30982 - RNA, 22 nt, Homo sapiens
auauauguauauauauauauau

SEQ ID NO: 30983 - RNA, 18 nt, Homo sapiens
caccaucuaccuggaucu

SEQ ID NO: 30984 - RNA, 19 nt, Homo sapiens
ccuccggcgggccuagccc

SEQ ID NO: 30985 - RNA, 20 nt, Homo sapiens
ccuccggcgggccuagcccu

SEQ ID NO: 30986 - RNA, 21 nt, Homo sapiens
cgggaugcggcucugugcgcg

SEQ ID NO: 30987 - RNA, 23 nt, Homo sapiens
gagccuccgaaggcugcaagugc

SEQ ID NO: 30988 - RNA, 19 nt, Homo sapiens
gcccggggccaggagcggu

SEQ ID NO: 30989 - RNA, 20 nt, Homo sapiens
uagugguuuugauuuggagu

SEQ ID NO: 30990 - RNA, 19 nt, Homo sapiens
uauauauauauguauauau

SEQ ID NO: 30991 - RNA, 20 nt, Homo sapiens
uauauauauauguauauaua

SEQ ID NO: 30992 - RNA, 21 nt, Homo sapiens
uauauauauauguauauauau

SEQ ID NO: 30993 - RNA, 22 nt, Homo sapiens
uauauauauauguauauauaua

SEQ ID NO: 30994 - RNA, 24 nt, Homo sapiens
uauauauauauguauauauauaua

SEQ ID NO: 30995 - RNA, 22 nt, Homo sapiens
uauauauauguauauauauaua

SEQ ID NO: 30996 - RNA, 24 nt, Homo sapiens
uauauauauguauauauauauaua

SEQ ID NO: 30997 - RNA, 22 nt, Homo sapiens
uauauauguauauauauauaua

SEQ ID NO: 30998 - RNA, 23 nt, Homo sapiens
uauauauguauauauauauauau

SEQ ID NO: 30999 - RNA, 21 nt, Homo sapiens
uauauauguguauauauauau

SEQ ID NO: 31000 - RNA, 21 nt, Homo sapiens
uauauguauauauauauauau

SEQ ID NO: 31001 - RNA, 19 nt, Homo sapiens
uauguauauauauauauau

SEQ ID NO: 31002 - RNA, 17 nt, Homo sapiens
uggcacaaaaauggggg

SEQ ID NO: 31003 - RNA, 19 nt, Homo sapiens
aaaaacaaaaacccacaaa

SEQ ID NO: 31004 - RNA, 19 nt, Homo sapiens
ccugaaccugggaggcgga

SEQ ID NO: 31005 - RNA, 17 nt, Homo sapiens
gagguugcagugagcca

SEQ ID NO: 31006 - RNA, 22 nt, Homo sapiens
gagguugcagugagccaagauc

SEQ ID NO: 31007 - RNA, 17 nt, Homo sapiens
gaguuugaaaccagccc

SEQ ID NO: 31008 - RNA, 18 nt, Homo sapiens
gcacaggcuguauuacuu

SEQ ID NO: 31009 - RNA, 22 nt, Homo sapiens
guggaucaacugaggucaggag

SEQ ID NO: 31010 - RNA, 20 nt, Homo sapiens
guggaucacgaggucaggag

SEQ ID NO: 31011 - RNA, 23 nt, Homo sapiens
uacaaaaauuagccagguguggu

SEQ ID NO: 31012 - RNA, 22 nt, Homo sapiens
ucaaaaaaaaaaaaagcgagcu

SEQ ID NO: 31013 - RNA, 23 nt, Homo sapiens
ugccuguaauccuagcacuuugg

SEQ ID NO: 31014 - RNA, 23 nt, Homo sapiens
uucaugguugggcacgguggcuc

SEQ ID NO: 31015 - RNA, 17 nt, Homo sapiens
uugggaggccaaggcgg

SEQ ID NO: 31016 - RNA, 17 nt, Homo sapiens
uugggaggcugaggcgg

SEQ ID NO: 31017 - RNA, 17 nt, Homo sapiens
caccccgcaauagcccc

SEQ ID NO: 31018 - RNA, 20 nt, Homo sapiens
ccccgcaauagccccgaacc

SEQ ID NO: 31019 - RNA, 18 nt, Homo sapiens
aggcagcgaguggugggg

SEQ ID NO: 31020 - RNA, 25 nt, Homo sapiens
cccucggcuucccuauuggccugug

SEQ ID NO: 31021 - RNA, 18 nt, Homo sapiens
cgggcggcggcgguggcg

SEQ ID NO: 31022 - RNA, 18 nt, Homo sapiens
ggcggcgguggcguggac

SEQ ID NO: 31023 - RNA, 18 nt, Homo sapiens
gagcgggcgggcgggcgg

SEQ ID NO: 31024 - RNA, 20 nt, Homo sapiens
gguccuggcaggugcagccc

SEQ ID NO: 31025 - RNA, 19 nt, Homo sapiens
uguugcaguggaguucggc

SEQ ID NO: 31026 - RNA, 18 nt, Homo sapiens
agcaugacaggaaggagg

SEQ ID NO: 31027 - RNA, 16 nt, Homo sapiens
agugagccuccuagcc

SEQ ID NO: 31028 - RNA, 18 nt, Homo sapiens
caggguguccugggcagu

SEQ ID NO: 31029 - RNA, 20 nt, Homo sapiens
gcagugagccuccuagcccc

SEQ ID NO: 31030 - RNA, 19 nt, Homo sapiens
ggagggcugaccgcagguc

SEQ ID NO: 31031 - RNA, 17 nt, Homo sapiens
gggagcaugacaggaag

SEQ ID NO: 31032 - RNA, 20 nt, Homo sapiens
guuuauuuuuuaaacucaac

SEQ ID NO: 31033 - RNA, 22 nt, Homo sapiens
ugugucagucuuuauuuggcaa

SEQ ID NO: 31034 - RNA, 17 nt, Homo sapiens
cuggugguagggugggc

SEQ ID NO: 31035 - RNA, 20 nt, Homo sapiens
gaggguagguccaggugguc

SEQ ID NO: 31036 - RNA, 16 nt, Homo sapiens
gcuggaggguaggucc

SEQ ID NO: 31037 - RNA, 21 nt, Homo sapiens
ggugggagcagggaaggguca

SEQ ID NO: 31038 - RNA, 20 nt, Homo sapiens
uggaggugcagacccggggg

SEQ ID NO: 31039 - RNA, 17 nt, Homo sapiens
cuggugguagggugggc

SEQ ID NO: 31040 - RNA, 20 nt, Homo sapiens
gaggguagguccaggugguc

SEQ ID NO: 31041 - RNA, 16 nt, Homo sapiens
gcuggaggguaggucc

SEQ ID NO: 31042 - RNA, 21 nt, Homo sapiens
ggugggagcagggaaggguca

SEQ ID NO: 31043 - RNA, 20 nt, Homo sapiens
uggaggugcagacccggggg

SEQ ID NO: 31044 - RNA, 18 nt, Homo sapiens
cgcgagggcgcgcagcgg

SEQ ID NO: 31045 - RNA, 19 nt, Homo sapiens
gcgcagcggggacagcggc

SEQ ID NO: 31046 - RNA, 22 nt, Homo sapiens
uauauauaucucauauauauau

SEQ ID NO: 31047 - RNA, 28 nt, Homo sapiens
uauaucuauauauaucucauauauauau

SEQ ID NO: 31048 - RNA, 19 nt, Homo sapiens
ugugucuuuaguugguugu

SEQ ID NO: 31049 - RNA, 22 nt, Homo sapiens
acugaauucacgugacuaacca

SEQ ID NO: 31050 - RNA, 25 nt, Homo sapiens
guuuuguuuuuccacauacauguaa

SEQ ID NO: 31051 - RNA, 23 nt, Homo sapiens
uggcuuuuggcuucuagguucua

SEQ ID NO: 31052 - RNA, 22 nt, Homo sapiens
uguuuuuccacauacauguaaa

SEQ ID NO: 31053 - RNA, 20 nt, Homo sapiens
uucuuuuuuccuucuuucca

SEQ ID NO: 31054 - RNA, 18 nt, Homo sapiens
aauaaaccugaguucaga

SEQ ID NO: 31055 - RNA, 16 nt, Homo sapiens
cacacacaggggcaca

SEQ ID NO: 31056 - RNA, 20 nt, Homo sapiens
cagggguuccagcaaguucc

SEQ ID NO: 31057 - RNA, 16 nt, Homo sapiens
cagucuuucucuucug

SEQ ID NO: 31058 - RNA, 18 nt, Homo sapiens
ccaggccauucuguaacu

SEQ ID NO: 31059 - RNA, 20 nt, Homo sapiens
cccagccccgccugggucuc

SEQ ID NO: 31060 - RNA, 21 nt, Homo sapiens
cccugccugugggccacagca

SEQ ID NO: 31061 - RNA, 19 nt, Homo sapiens
cccugcucgggcgcgcggg

SEQ ID NO: 31062 - RNA, 19 nt, Homo sapiens
cccuggagccaacccuccu

SEQ ID NO: 31063 - RNA, 25 nt, Homo sapiens
ccgccgcccugggcccagccccgcc

SEQ ID NO: 31064 - RNA, 24 nt, Homo sapiens
ccugucaagugccagcuggauaca

SEQ ID NO: 31065 - RNA, 19 nt, Homo sapiens
cgcggcccgcgcggcuccu

SEQ ID NO: 31066 - RNA, 29 nt, Homo sapiens
cgcggcuccugcucgucucccgcgcucgc

SEQ ID NO: 31067 - RNA, 16 nt, Homo sapiens
cuucggcuuccccggc

SEQ ID NO: 31068 - RNA, 20 nt, Homo sapiens
gagacagggucucacuuugc

SEQ ID NO: 31069 - RNA, 21 nt, Homo sapiens
gauguggauacauguggaggg

SEQ ID NO: 31070 - RNA, 21 nt, Homo sapiens
gccuucagguaaucccugcua

SEQ ID NO: 31071 - RNA, 23 nt, Homo sapiens
gcgcgcgggguggggcgcggucc

SEQ ID NO: 31072 - RNA, 16 nt, Homo sapiens
gcgcgggguggggcgc

SEQ ID NO: 31073 - RNA, 23 nt, Homo sapiens
ggaggccaaggugggcagaucgu

SEQ ID NO: 31074 - RNA, 21 nt, Homo sapiens
gguggggcgcgguccggcggc

SEQ ID NO: 31075 - RNA, 24 nt, Homo sapiens
gguuggguugugcaggcuuugggu

SEQ ID NO: 31076 - RNA, 25 nt, Homo sapiens
gucaucuagaucccacccucccauu

SEQ ID NO: 31077 - RNA, 19 nt, Homo sapiens
guucgauccuuggagaaag

SEQ ID NO: 31078 - RNA, 22 nt, Homo sapiens
uaagcgagguuggguugugcag

SEQ ID NO: 31079 - RNA, 23 nt, Homo sapiens
uacagcugauccccuuucaucac

SEQ ID NO: 31080 - RNA, 21 nt, Homo sapiens
uagacaauagcggcugcccag

SEQ ID NO: 31081 - RNA, 19 nt, Homo sapiens
uccccggcuucucccgccg

SEQ ID NO: 31082 - RNA, 16 nt, Homo sapiens
ucccgcuuguuuccag

SEQ ID NO: 31083 - RNA, 27 nt, Homo sapiens
ucgcagcuccuccuccccaggcucuuc

SEQ ID NO: 31084 - RNA, 21 nt, Homo sapiens
ucucugauuucucuguguucu

SEQ ID NO: 31085 - RNA, 17 nt, Homo sapiens
ugaguacuugggaggaa

SEQ ID NO: 31086 - RNA, 17 nt, Homo sapiens
ugaguuugguggaauug

SEQ ID NO: 31087 - RNA, 16 nt, Homo sapiens
uggcaaggcugccugc

SEQ ID NO: 31088 - RNA, 17 nt, Homo sapiens
uguaugucagaaagacu

SEQ ID NO: 31089 - RNA, 16 nt, Homo sapiens
ugucagagaugugagg

SEQ ID NO: 31090 - RNA, 16 nt, Homo sapiens
uguugacaucccccuc

SEQ ID NO: 31091 - RNA, 15 nt, Homo sapiens
uugcugcuuacuugg

SEQ ID NO: 31092 - RNA, 17 nt, Homo sapiens
uugggaggccaaggugg

SEQ ID NO: 31093 - RNA, 14 nt, Homo sapiens
uugugcaggcuuug

SEQ ID NO: 31094 - RNA, 22 nt, Homo sapiens
aaaggaaacgcaggaaaggaaa

SEQ ID NO: 31095 - RNA, 17 nt, Homo sapiens
aacugguuaaagugcca

SEQ ID NO: 31096 - RNA, 17 nt, Homo sapiens
cccuaggucacucaucu

SEQ ID NO: 31097 - RNA, 20 nt, Homo sapiens
uaaagugccauuaaggaacc

SEQ ID NO: 31098 - RNA, 14 nt, Homo sapiens
uucaugugucugua

SEQ ID NO: 31099 - RNA, 20 nt, Homo sapiens
ccggagcugcgagcucucgg

SEQ ID NO: 31100 - RNA, 18 nt, Homo sapiens
gacagccucucgggaggu

SEQ ID NO: 31101 - RNA, 18 nt, Homo sapiens
gggggcgcgggcucggcc

SEQ ID NO: 31102 - RNA, 19 nt, Homo sapiens
uccagcugcugcccgcggc

SEQ ID NO: 31103 - RNA, 20 nt, Homo sapiens
uguauuuccaugccagccag

SEQ ID NO: 31104 - RNA, 16 nt, Homo sapiens
agguggguuggccauc

SEQ ID NO: 31105 - RNA, 23 nt, Homo sapiens
caaggacacugcagagucccugg

SEQ ID NO: 31106 - RNA, 19 nt, Homo sapiens
cacgguuugcuucugugac

SEQ ID NO: 31107 - RNA, 18 nt, Homo sapiens
cagcaggcuagcccacuc

SEQ ID NO: 31108 - RNA, 22 nt, Homo sapiens
cagccuguccugggaggcugca

SEQ ID NO: 31109 - RNA, 17 nt, Homo sapiens
caguggccaugaagcaa

SEQ ID NO: 31110 - RNA, 23 nt, Homo sapiens
cauugaguacaguggggauuugc

SEQ ID NO: 31111 - RNA, 21 nt, Homo sapiens
ccgccgcucgcccccggcacg

SEQ ID NO: 31112 - RNA, 19 nt, Homo sapiens
gcaagugaauugccucagg

SEQ ID NO: 31113 - RNA, 21 nt, Homo sapiens
gcccuggcuuugaauccucuc

SEQ ID NO: 31114 - RNA, 18 nt, Homo sapiens
uaugugugugugcauguu

SEQ ID NO: 31115 - RNA, 18 nt, Homo sapiens
uccugggaggcugcaggg

SEQ ID NO: 31116 - RNA, 18 nt, Homo sapiens
ugaagcaagccaggggag

SEQ ID NO: 31117 - RNA, 19 nt, Homo sapiens
ugcauaugugugugugcau

SEQ ID NO: 31118 - RNA, 17 nt, Homo sapiens
uggcccgggcacgcggc

SEQ ID NO: 31119 - RNA, 19 nt, Homo sapiens
uggugcuguuggaugucua

SEQ ID NO: 31120 - RNA, 26 nt, Homo sapiens
ugugcauguuugugugugugugugua

SEQ ID NO: 31121 - RNA, 23 nt, Homo sapiens
ugugugcauguuugugugugugu

SEQ ID NO: 31122 - RNA, 18 nt, Homo sapiens
ugugugugugugugugug

SEQ ID NO: 31123 - RNA, 20 nt, Homo sapiens
ugugugugugugugugugua

SEQ ID NO: 31124 - RNA, 22 nt, Homo sapiens
uguguguguguguguguguagu

SEQ ID NO: 31125 - RNA, 22 nt, Homo sapiens
uucccuggggcaucagugaggg

SEQ ID NO: 31126 - RNA, 23 nt, Homo sapiens
uuugugugugugugugugugugu

SEQ ID NO: 31127 - RNA, 18 nt, Homo sapiens
ccagugugugugugaugu

SEQ ID NO: 31128 - RNA, 16 nt, Homo sapiens
ccgcggagcggccugu

SEQ ID NO: 31129 - RNA, 18 nt, Homo sapiens
cgcuggcggcugcagcgg

SEQ ID NO: 31130 - RNA, 16 nt, Homo sapiens
cugcuagucauuucag

SEQ ID NO: 31131 - RNA, 21 nt, Homo sapiens
gagagacgugcagauggagag

SEQ ID NO: 31132 - RNA, 18 nt, Homo sapiens
gaggguguugccuggcug

SEQ ID NO: 31133 - RNA, 23 nt, Homo sapiens
ggagagacgugcagauggagagc

SEQ ID NO: 31134 - RNA, 16 nt, Homo sapiens
ggcggcugcagcgggc

SEQ ID NO: 31135 - RNA, 19 nt, Homo sapiens
gggaaggggcugcggaggg

SEQ ID NO: 31136 - RNA, 23 nt, Homo sapiens
gugugugaugugccuaagugaac

SEQ ID NO: 31137 - RNA, 23 nt, Homo sapiens
guuccguucagaggccccuccca

SEQ ID NO: 31138 - RNA, 17 nt, Homo sapiens
ugggaggggggcccggc

SEQ ID NO: 31139 - RNA, 16 nt, Homo sapiens
uuccaugggguccccu

SEQ ID NO: 31140 - RNA, 22 nt, Homo sapiens
uucuacguaggggcuccacuua

SEQ ID NO: 31141 - RNA, 20 nt, Homo sapiens
uugggaagaagccuuggcuu

SEQ ID NO: 31142 - RNA, 21 nt, Homo sapiens
uuuuugggaagaagccuuggc

SEQ ID NO: 31143 - RNA, 18 nt, Homo sapiens
gcaaaaacaacacaaaag

SEQ ID NO: 31144 - RNA, 20 nt, Homo sapiens
caguugcuagaacguuuuca

SEQ ID NO: 31145 - RNA, 17 nt, Homo sapiens
cuguugcucgcucgcuc

SEQ ID NO: 31146 - RNA, 18 nt, Homo sapiens
gcucucgcucucgcuguu

SEQ ID NO: 31147 - RNA, 16 nt, Homo sapiens
ucgcucgccugcgcuc

SEQ ID NO: 31148 - RNA, 19 nt, Homo sapiens
uggcagugucaguuguaca

SEQ ID NO: 31149 - RNA, 22 nt, Homo sapiens
auauauauauauauauauauau

SEQ ID NO: 31150 - RNA, 18 nt, Homo sapiens
ccccuugggggccagagg

SEQ ID NO: 31151 - RNA, 19 nt, Homo sapiens
ccucucucccucucugccu

SEQ ID NO: 31152 - RNA, 25 nt, Homo sapiens
gaggggagggugggggcauggggug

SEQ ID NO: 31153 - RNA, 22 nt, Homo sapiens
ggagggugggggcauggggugg

SEQ ID NO: 31154 - RNA, 24 nt, Homo sapiens
gggagggugggggcaugggguggg

SEQ ID NO: 31155 - RNA, 19 nt, Homo sapiens
ggggagggugggggcaugg

SEQ ID NO: 31156 - RNA, 18 nt, Homo sapiens
uauauauauauauauaua

SEQ ID NO: 31157 - RNA, 21 nt, Homo sapiens
uauauauauauauauauauau

SEQ ID NO: 31158 - RNA, 22 nt, Homo sapiens
uauauauauauauauauauaua

SEQ ID NO: 31159 - RNA, 23 nt, Homo sapiens
uauauauauauauauauauauau

SEQ ID NO: 31160 - RNA, 25 nt, Homo sapiens
uauauauauauauauauauauauau

SEQ ID NO: 31161 - RNA, 18 nt, Homo sapiens
uccugcauuccuccugcc

SEQ ID NO: 31162 - RNA, 18 nt, Homo sapiens
ugggggcauggggugggg

SEQ ID NO: 31163 - RNA, 16 nt, Homo sapiens
aaaaaagaagagaagg

SEQ ID NO: 31164 - RNA, 16 nt, Homo sapiens
aacugguuguaagcac

SEQ ID NO: 31165 - RNA, 22 nt, Homo sapiens
accacauuucccaacaaauaaa

SEQ ID NO: 31166 - RNA, 23 nt, Homo sapiens
agcugggacugggcaagcuggcc

SEQ ID NO: 31167 - RNA, 19 nt, Homo sapiens
caaauagaaaauuuguccu

SEQ ID NO: 31168 - RNA, 21 nt, Homo sapiens
caguagcuccugccauauaau

SEQ ID NO: 31169 - RNA, 22 nt, Homo sapiens
ccagcgccggcugcuucuaguc

SEQ ID NO: 31170 - RNA, 16 nt, Homo sapiens
ccccuguugagaguga

SEQ ID NO: 31171 - RNA, 24 nt, Homo sapiens
cccugccugcagccggcgggagca

SEQ ID NO: 31172 - RNA, 18 nt, Homo sapiens
ccuggagggguggagugg

SEQ ID NO: 31173 - RNA, 22 nt, Homo sapiens
cgugagggcgucagaaaaagac

SEQ ID NO: 31174 - RNA, 15 nt, Homo sapiens
gcccuaccccuuccc

SEQ ID NO: 31175 - RNA, 23 nt, Homo sapiens
gccugcccgcccugccugcagcc

SEQ ID NO: 31176 - RNA, 18 nt, Homo sapiens
gggguccgacugggaccu

SEQ ID NO: 31177 - RNA, 19 nt, Homo sapiens
gggguggagugggggagaa

SEQ ID NO: 31178 - RNA, 22 nt, Homo sapiens
ggugggcugggaugguggcaag

SEQ ID NO: 31179 - RNA, 17 nt, Homo sapiens
gugaacucgccucugag

SEQ ID NO: 31180 - RNA, 24 nt, Homo sapiens
uagaaacaaugaugugaauaaugc

SEQ ID NO: 31181 - RNA, 16 nt, Homo sapiens
ugcacagccccucccc

SEQ ID NO: 31182 - RNA, 18 nt, Homo sapiens
ugcccucgggcaggaugc

SEQ ID NO: 31183 - RNA, 16 nt, Homo sapiens
uggguaccuuugcacc

SEQ ID NO: 31184 - RNA, 16 nt, Homo sapiens
uuccagagagugggga

SEQ ID NO: 31185 - RNA, 19 nt, Homo sapiens
uuggagcuuuuccacaccu

SEQ ID NO: 31186 - RNA, 17 nt, Homo sapiens
uuguaccucacucccua

SEQ ID NO: 31187 - RNA, 21 nt, Homo sapiens
aggcaguggaagaaaagacau

SEQ ID NO: 31188 - RNA, 20 nt, Homo sapiens
cugccgccuucgacccaggu

SEQ ID NO: 31189 - RNA, 19 nt, Homo sapiens
cuggcuacucauggggcuc

SEQ ID NO: 31190 - RNA, 23 nt, Homo sapiens
ggaaagcaugccucauaggaaga

SEQ ID NO: 31191 - RNA, 26 nt, Homo sapiens
gggaccacugucacuuuucugagggc

SEQ ID NO: 31192 - RNA, 18 nt, Homo sapiens
ucacagagauacucuuca

SEQ ID NO: 31193 - RNA, 22 nt, Homo sapiens
ugaacucccucaagaaagggaa

SEQ ID NO: 31194 - RNA, 18 nt, Homo sapiens
uggcccugggagauggcu

SEQ ID NO: 31195 - RNA, 18 nt, Homo sapiens
uucuccucauucucguag

SEQ ID NO: 31196 - RNA, 16 nt, Homo sapiens
uuuaagggacagcaua

SEQ ID NO: 31197 - RNA, 25 nt, Homo sapiens
agcggucgaggggaugggcuaugua

SEQ ID NO: 31198 - RNA, 18 nt, Homo sapiens
gaggggaugggcuauguc

SEQ ID NO: 31199 - RNA, 19 nt, Homo sapiens
ccucagagcugccgggcgg

SEQ ID NO: 31200 - RNA, 14 nt, Homo sapiens
cgggcggcuggagc

SEQ ID NO: 31201 - RNA, 24 nt, Homo sapiens
uuuugcauucacucugaaacauuu

SEQ ID NO: 31202 - RNA, 17 nt, Homo sapiens
aaacccuggaagcucua

SEQ ID NO: 31203 - RNA, 18 nt, Homo sapiens
aaaggagggaucccaggc

SEQ ID NO: 31204 - RNA, 15 nt, Homo sapiens
acaaacacacucgag

SEQ ID NO: 31205 - RNA, 20 nt, Homo sapiens
ccccaggcccaguuccuccc

SEQ ID NO: 31206 - RNA, 21 nt, Homo sapiens
cccguccccgcuggggaaggc

SEQ ID NO: 31207 - RNA, 18 nt, Homo sapiens
ccuugcuguggggagggg

SEQ ID NO: 31208 - RNA, 21 nt, Homo sapiens
gaacugcaaagagggaaaggg

SEQ ID NO: 31209 - RNA, 15 nt, Homo sapiens
gacacugcucggggg

SEQ ID NO: 31210 - RNA, 20 nt, Homo sapiens
gcccagcaccugucuccauc

SEQ ID NO: 31211 - RNA, 20 nt, Homo sapiens
gcccaguuccucccuucucc

SEQ ID NO: 31212 - RNA, 19 nt, Homo sapiens
gccugggaaggcaaaggag

SEQ ID NO: 31213 - RNA, 18 nt, Homo sapiens
gcucggggggcagucugc

SEQ ID NO: 31214 - RNA, 19 nt, Homo sapiens
ggacacugcucggggggca

SEQ ID NO: 31215 - RNA, 18 nt, Homo sapiens
ggcacccguguccccaug

SEQ ID NO: 31216 - RNA, 20 nt, Homo sapiens
gugaggacuaagaaauuaag

SEQ ID NO: 31217 - RNA, 18 nt, Homo sapiens
uaaacucauuaaacaauu

SEQ ID NO: 31218 - RNA, 18 nt, Homo sapiens
uaaguuuuuucuuuuucc

SEQ ID NO: 31219 - RNA, 18 nt, Homo sapiens
uccccucccuuucuuacu

SEQ ID NO: 31220 - RNA, 17 nt, Homo sapiens
ucccugagccgucaccc

SEQ ID NO: 31221 - RNA, 21 nt, Homo sapiens
ucccuugcuguggggaggggg

SEQ ID NO: 31222 - RNA, 24 nt, Homo sapiens
ucugggcuccugacaguucucuua

SEQ ID NO: 31223 - RNA, 20 nt, Homo sapiens
ugacgcugcuuccacgggcc

SEQ ID NO: 31224 - RNA, 19 nt, Homo sapiens
uggcacaccuuucccuggu

SEQ ID NO: 31225 - RNA, 17 nt, Homo sapiens
uggcuggguacggccug

SEQ ID NO: 31226 - RNA, 19 nt, Homo sapiens
ugggagaaggcucaugugg

SEQ ID NO: 31227 - RNA, 26 nt, Homo sapiens
uuaagggcucguggaguugucacaga

SEQ ID NO: 31228 - RNA, 23 nt, Homo sapiens
uucagcaucaccugccacuucuu

SEQ ID NO: 31229 - RNA, 18 nt, Homo sapiens
agugaacaaaauaugugg

SEQ ID NO: 31230 - RNA, 18 nt, Homo sapiens
auauauauauauauauau

SEQ ID NO: 31231 - RNA, 22 nt, Homo sapiens
auauauauauauauauauauau

SEQ ID NO: 31232 - RNA, 22 nt, Homo sapiens
caaaauacaguucaucuucugu

SEQ ID NO: 31233 - RNA, 21 nt, Homo sapiens
cuacaccaaguauacacuaua

SEQ ID NO: 31234 - RNA, 22 nt, Homo sapiens
uacaauauacaacacuauaugc

SEQ ID NO: 31235 - RNA, 18 nt, Homo sapiens
uaccuuucaauguuaaua

SEQ ID NO: 31236 - RNA, 18 nt, Homo sapiens
uauauauauauauauaua

SEQ ID NO: 31237 - RNA, 22 nt, Homo sapiens
uauauauauauauauauauaua

SEQ ID NO: 31238 - RNA, 23 nt, Homo sapiens
uauauauauauauauauauauau

SEQ ID NO: 31239 - RNA, 25 nt, Homo sapiens
uauauauauauauauauauauauau

SEQ ID NO: 31240 - RNA, 21 nt, Homo sapiens
ucucuggcgcucucgcucccc

SEQ ID NO: 31241 - RNA, 20 nt, Homo sapiens
uggaaauauacacaaggcuc

SEQ ID NO: 31242 - RNA, 19 nt, Homo sapiens
uggaaauguacaccgugua

SEQ ID NO: 31243 - RNA, 20 nt, Homo sapiens
acagaugccuauaucuauua

SEQ ID NO: 31244 - RNA, 22 nt, Homo sapiens
acauacuuuuguaccuugaaag

SEQ ID NO: 31245 - RNA, 19 nt, Homo sapiens
acuuccauuuuaaaagaca

SEQ ID NO: 31246 - RNA, 16 nt, Homo sapiens
agacauuucccuguau

SEQ ID NO: 31247 - RNA, 22 nt, Homo sapiens
aucauuuuuauaauuuuaacau

SEQ ID NO: 31248 - RNA, 20 nt, Homo sapiens
cauauauauauauauauaua

SEQ ID NO: 31249 - RNA, 22 nt, Homo sapiens
cauauauauauauauauauaua

SEQ ID NO: 31250 - RNA, 24 nt, Homo sapiens
cauauauauauauauauauauaua

SEQ ID NO: 31251 - RNA, 20 nt, Homo sapiens
cauuauauacauaaaauaua

SEQ ID NO: 31252 - RNA, 23 nt, Homo sapiens
ccgacugcuaggcugugggcagc

SEQ ID NO: 31253 - RNA, 22 nt, Homo sapiens
cggccgagcagauccggcgcgg

SEQ ID NO: 31254 - RNA, 17 nt, Homo sapiens
cggcgcggcggcggcgg

SEQ ID NO: 31255 - RNA, 22 nt, Homo sapiens
gcggcgcggcggcggcggcggc

SEQ ID NO: 31256 - RNA, 21 nt, Homo sapiens
gcugcaacuucuccugcucug

SEQ ID NO: 31257 - RNA, 16 nt, Homo sapiens
uaaauggccacccugg

SEQ ID NO: 31258 - RNA, 21 nt, Homo sapiens
uacaguuuuuucaguacuuug

SEQ ID NO: 31259 - RNA, 20 nt, Homo sapiens
uagcucuguguucaaaugug

SEQ ID NO: 31260 - RNA, 18 nt, Homo sapiens
uauauauauauauauaua

SEQ ID NO: 31261 - RNA, 21 nt, Homo sapiens
uauauauauauuuuuugcaua

SEQ ID NO: 31262 - RNA, 29 nt, Homo sapiens
uauauauauauuuuuugcauauauauaua

SEQ ID NO: 31263 - RNA, 31 nt, Homo sapiens
uauauauauauuuuuugcauauauauauaua

SEQ ID NO: 31264 - RNA, 33 nt, Homo sapiens
uauauauauauuuuuugcauauauauauauaua

SEQ ID NO: 31265 - RNA, 33 nt, Homo sapiens
uauauauauuuuuugcauauauauauauauaua

SEQ ID NO: 31266 - RNA, 33 nt, Homo sapiens
uauauauuuuuugcauauauauauauauauaua

SEQ ID NO: 31267 - RNA, 18 nt, Homo sapiens
caagcaacuccuuuucuu

SEQ ID NO: 31268 - RNA, 21 nt, Homo sapiens
cacauccguuugugguuuguu

SEQ ID NO: 31269 - RNA, 18 nt, Homo sapiens
cagguaagcauuuggcag

SEQ ID NO: 31270 - RNA, 21 nt, Homo sapiens
cggggggcggggggugguggu

SEQ ID NO: 31271 - RNA, 22 nt, Homo sapiens
cucaggcagauucucaagcacu

SEQ ID NO: 31272 - RNA, 15 nt, Homo sapiens
gaacugccuugacug

SEQ ID NO: 31273 - RNA, 18 nt, Homo sapiens
uaaaaucugaauggucca

SEQ ID NO: 31274 - RNA, 19 nt, Homo sapiens
ugucuguuuaauucugagu

SEQ ID NO: 31275 - RNA, 20 nt, Homo sapiens
uuuaaaaagucuuuaguagu

SEQ ID NO: 31276 - RNA, 21 nt, Homo sapiens
aaauauacaguuggaagcucu

SEQ ID NO: 31277 - RNA, 19 nt, Homo sapiens
cacugggguaaguggagca

SEQ ID NO: 31278 - RNA, 17 nt, Homo sapiens
caucugacaugggagug

SEQ ID NO: 31279 - RNA, 22 nt, Homo sapiens
cccaggacuaaggcggagugca

SEQ ID NO: 31280 - RNA, 22 nt, Homo sapiens
ccggccuacggccuccuucccc

SEQ ID NO: 31281 - RNA, 19 nt, Homo sapiens
ccugucccuuuuuggcaua

SEQ ID NO: 31282 - RNA, 22 nt, Homo sapiens
cggagcgggcucgcgcgcggcg

SEQ ID NO: 31283 - RNA, 21 nt, Homo sapiens
gccagcagaugggcuggggcc

SEQ ID NO: 31284 - RNA, 23 nt, Homo sapiens
gcccggggccgggccucucgggg

SEQ ID NO: 31285 - RNA, 19 nt, Homo sapiens
gccuacggccuccuucccc

SEQ ID NO: 31286 - RNA, 23 nt, Homo sapiens
gcggagcgggcucgcgcgcggcg

SEQ ID NO: 31287 - RNA, 21 nt, Homo sapiens
gcgggcuucgcuccccgcggc

SEQ ID NO: 31288 - RNA, 25 nt, Homo sapiens
gcucgcgcgcggcggcggguuuucc

SEQ ID NO: 31289 - RNA, 18 nt, Homo sapiens
ggaggaagggauuccugg

SEQ ID NO: 31290 - RNA, 18 nt, Homo sapiens
ggccugaggggcgcagcc

SEQ ID NO: 31291 - RNA, 21 nt, Homo sapiens
gggagacauaauacuccagga

SEQ ID NO: 31292 - RNA, 19 nt, Homo sapiens
gggagggaggaggaggagc

SEQ ID NO: 31293 - RNA, 19 nt, Homo sapiens
gggccgggcccggggccgg

SEQ ID NO: 31294 - RNA, 18 nt, Homo sapiens
gggccuugggagggagga

SEQ ID NO: 31295 - RNA, 21 nt, Homo sapiens
ucacugguguuacuguugguu

SEQ ID NO: 31296 - RNA, 19 nt, Homo sapiens
uccgcgcuaccgccgcggc

SEQ ID NO: 31297 - RNA, 19 nt, Homo sapiens
uucucuuuucucuccacca

SEQ ID NO: 31298 - RNA, 15 nt, Homo sapiens
gagcuggccuugggg

SEQ ID NO: 31299 - RNA, 18 nt, Homo sapiens
gccuguagcccacagccc

SEQ ID NO: 31300 - RNA, 20 nt, Homo sapiens
ugggaaagaugaggccugca

SEQ ID NO: 31301 - RNA, 21 nt, Homo sapiens
ugggguggggagugguggaag

SEQ ID NO: 31302 - RNA, 19 nt, Homo sapiens
ugguggcuggggugggccu

SEQ ID NO: 31303 - RNA, 20 nt, Homo sapiens
uuccucugacuuuccacaca

SEQ ID NO: 31304 - RNA, 20 nt, Homo sapiens
acauaacaauauuuucacac

SEQ ID NO: 31305 - RNA, 19 nt, Homo sapiens
acccuguuacauaguauau

SEQ ID NO: 31306 - RNA, 23 nt, Homo sapiens
acucagaaaaccggcaacgccuc

SEQ ID NO: 31307 - RNA, 16 nt, Homo sapiens
caaccgccggcguccc

SEQ ID NO: 31308 - RNA, 20 nt, Homo sapiens
cauuaacuugucaaauucag

SEQ ID NO: 31309 - RNA, 18 nt, Homo sapiens
cccgcccgccgcggcccc

SEQ ID NO: 31310 - RNA, 24 nt, Homo sapiens
ccgccgccuaguccucggcagcgg

SEQ ID NO: 31311 - RNA, 17 nt, Homo sapiens
ccgggcgcccgcccgcc

SEQ ID NO: 31312 - RNA, 19 nt, Homo sapiens
cgccggcgucccgggcgcc

SEQ ID NO: 31313 - RNA, 19 nt, Homo sapiens
gcccgcccgccgcggcccc

SEQ ID NO: 31314 - RNA, 20 nt, Homo sapiens
gccgcggacaccgccgcggc

SEQ ID NO: 31315 - RNA, 18 nt, Homo sapiens
gcuuauguuugcuuugcu

SEQ ID NO: 31316 - RNA, 19 nt, Homo sapiens
ggacaccgccgcggcuugg

SEQ ID NO: 31317 - RNA, 21 nt, Homo sapiens
uaaaugguuaaugugcaauga

SEQ ID NO: 31318 - RNA, 20 nt, Homo sapiens
ucugcauuugaaaugguuag

SEQ ID NO: 31319 - RNA, 17 nt, Homo sapiens
ugaaacaucaaagggca

SEQ ID NO: 31320 - RNA, 19 nt, Homo sapiens
uuacugguuaaacucagaa

SEQ ID NO: 31321 - RNA, 21 nt, Homo sapiens
uuguuauuuaaaugaccucua

SEQ ID NO: 31322 - RNA, 20 nt, Homo sapiens
uuuauuauuguucucuagca

SEQ ID NO: 31323 - RNA, 19 nt, Homo sapiens
aaggaagacagacccucca

SEQ ID NO: 31324 - RNA, 23 nt, Homo sapiens
acggcugugugggccggaggugu

SEQ ID NO: 31325 - RNA, 18 nt, Homo sapiens
caaguucugcugaggcuu

SEQ ID NO: 31326 - RNA, 21 nt, Homo sapiens
ccuccuccuccucgccugggu

SEQ ID NO: 31327 - RNA, 19 nt, Homo sapiens
uauagacugucgacguuag

SEQ ID NO: 31328 - RNA, 17 nt, Homo sapiens
uauugaugauacacaaa

SEQ ID NO: 31329 - RNA, 19 nt, Homo sapiens
uggaacuggauugcuuaag

SEQ ID NO: 31330 - RNA, 18 nt, Homo sapiens
ggggcagggagagggccc

SEQ ID NO: 31331 - RNA, 18 nt, Homo sapiens
ugagggugcggaggucug

SEQ ID NO: 31332 - RNA, 23 nt, Homo sapiens
aacagucuuuauguaggcuguau

SEQ ID NO: 31333 - RNA, 18 nt, Homo sapiens
cccacacucauccggcag

SEQ ID NO: 31334 - RNA, 18 nt, Homo sapiens
gccugcuguccugagaga

SEQ ID NO: 31335 - RNA, 14 nt, Homo sapiens
aagaagccgcgaag

SEQ ID NO: 31336 - RNA, 15 nt, Homo sapiens
aauugugugguuacu

SEQ ID NO: 31337 - RNA, 21 nt, Homo sapiens
cacgugcaugaacagcuuaac

SEQ ID NO: 31338 - RNA, 22 nt, Homo sapiens
cagaaauggugagaagaaaaag

SEQ ID NO: 31339 - RNA, 15 nt, Homo sapiens
gcaaaaacaguuugg

SEQ ID NO: 31340 - RNA, 22 nt, Homo sapiens
uaaaauauaucuauauauugaa

SEQ ID NO: 31341 - RNA, 16 nt, Homo sapiens
ucccggagcaaacugu

SEQ ID NO: 31342 - RNA, 20 nt, Homo sapiens
ucgcauggacucggcgcccu

SEQ ID NO: 31343 - RNA, 23 nt, Homo sapiens
ucucugaaccacacaguuuuuag

SEQ ID NO: 31344 - RNA, 18 nt, Homo sapiens
ucaauaccuuccaagugu

SEQ ID NO: 31345 - RNA, 17 nt, Homo sapiens
ucugcuucuccaccacc

SEQ ID NO: 31346 - RNA, 18 nt, Homo sapiens
ugaguuuuucucuugguc

SEQ ID NO: 31347 - RNA, 18 nt, Homo sapiens
acucuccucaggugccag

SEQ ID NO: 31348 - RNA, 20 nt, Homo sapiens
ggagccacgaggagcuuuau

SEQ ID NO: 31349 - RNA, 18 nt, Homo sapiens
gguggcagcgguggcggc

SEQ ID NO: 31350 - RNA, 23 nt, Homo sapiens
aaccaggauaauuaaauccucug

SEQ ID NO: 31351 - RNA, 17 nt, Homo sapiens
agcaggagccucacucu

SEQ ID NO: 31352 - RNA, 18 nt, Homo sapiens
auguuggagaguagagca

SEQ ID NO: 31353 - RNA, 18 nt, Homo sapiens
caccagagaaauucaagg

SEQ ID NO: 31354 - RNA, 22 nt, Homo sapiens
cagccgcggcugcaggggagag

SEQ ID NO: 31355 - RNA, 17 nt, Homo sapiens
cauucccugggacuggu

SEQ ID NO: 31356 - RNA, 15 nt, Homo sapiens
cucugugucucugug

SEQ ID NO: 31357 - RNA, 20 nt, Homo sapiens
cugauccccuaaugucugcc

SEQ ID NO: 31358 - RNA, 18 nt, Homo sapiens
cugccggcccggguuguc

SEQ ID NO: 31359 - RNA, 18 nt, Homo sapiens
gaacugaccuacccaugu

SEQ ID NO: 31360 - RNA, 21 nt, Homo sapiens
ggacagggccacacauuuugg

SEQ ID NO: 31361 - RNA, 22 nt, Homo sapiens
ggcaagcucaagccugcuggag

SEQ ID NO: 31362 - RNA, 25 nt, Homo sapiens
uaagaaaagccucaacucuccucca

SEQ ID NO: 31363 - RNA, 19 nt, Homo sapiens
uaucuacaucuguaaagaa

SEQ ID NO: 31364 - RNA, 17 nt, Homo sapiens
uaugucccacggcacag

SEQ ID NO: 31365 - RNA, 19 nt, Homo sapiens
ucaugggcucagaggucag

SEQ ID NO: 31366 - RNA, 22 nt, Homo sapiens
ucuggagaacauguagucacau

SEQ ID NO: 31367 - RNA, 20 nt, Homo sapiens
uggaagaaaguguuucaugg

SEQ ID NO: 31368 - RNA, 18 nt, Homo sapiens
ugggagggacacaagggc

SEQ ID NO: 31369 - RNA, 20 nt, Homo sapiens
uuuucccagcauucccccag

SEQ ID NO: 31370 - RNA, 19 nt, Homo sapiens
ucuauagaugaaguccaac

SEQ ID NO: 31371 - RNA, 21 nt, Homo sapiens
aaaaagaaaaaaaaaggaauu

SEQ ID NO: 31372 - RNA, 14 nt, Homo sapiens
aaggaacauuggcc

SEQ ID NO: 31373 - RNA, 15 nt, Homo sapiens
acaggauaaaaugua

SEQ ID NO: 31374 - RNA, 18 nt, Homo sapiens
agaggaaagggcagcuac

SEQ ID NO: 31375 - RNA, 23 nt, Homo sapiens
cauuucacuaaacacagcuucag

SEQ ID NO: 31376 - RNA, 23 nt, Homo sapiens
cugcugcugcugcugcgcgccga

SEQ ID NO: 31377 - RNA, 19 nt, Homo sapiens
gcuccgggcgugggcggcc

SEQ ID NO: 31378 - RNA, 19 nt, Homo sapiens
ggcggccgguuuccucggg

SEQ ID NO: 31379 - RNA, 18 nt, Homo sapiens
ucuauuuuuucccaaaga

SEQ ID NO: 31380 - RNA, 18 nt, Homo sapiens
ugagaagagaggcuggac

SEQ ID NO: 31381 - RNA, 19 nt, Homo sapiens
uguaauccccaggaagaau

SEQ ID NO: 31382 - RNA, 17 nt, Homo sapiens
ugugugcaugugugugu

SEQ ID NO: 31383 - RNA, 21 nt, Homo sapiens
uuugugugcaugugugugugu

SEQ ID NO: 31384 - RNA, 23 nt, Homo sapiens
cuuccuuuucucuuuuuuugcuu

SEQ ID NO: 31385 - RNA, 20 nt, Homo sapiens
cuuuauacugacagcacuua

SEQ ID NO: 31386 - RNA, 23 nt, Homo sapiens
uacaauucauuuuuuucaaaacc

SEQ ID NO: 31387 - RNA, 16 nt, Homo sapiens
uacugguaaacaacag

SEQ ID NO: 31388 - RNA, 25 nt, Homo sapiens
uaguauacaauuuuuuguauaauaa

SEQ ID NO: 31389 - RNA, 24 nt, Homo sapiens
ucaaagaacucagaacuauaauca

SEQ ID NO: 31390 - RNA, 23 nt, Homo sapiens
ucuauauugaaacuacugugaau

SEQ ID NO: 31391 - RNA, 16 nt, Homo sapiens
ugcacccccccccucc

SEQ ID NO: 31392 - RNA, 22 nt, Homo sapiens
uuacugcaguuaguuugucaga

SEQ ID NO: 31393 - RNA, 22 nt, Homo sapiens
uuuguauauauacaauucauuu

SEQ ID NO: 31394 - RNA, 21 nt, Homo sapiens
aaauguaugccauguauaaaa

SEQ ID NO: 31395 - RNA, 19 nt, Homo sapiens
aacaauuguuuaaugucug

SEQ ID NO: 31396 - RNA, 16 nt, Homo sapiens
agcaagcagaaggaac

SEQ ID NO: 31397 - RNA, 18 nt, Homo sapiens
ccuaguauuucccuucuc

SEQ ID NO: 31398 - RNA, 20 nt, Homo sapiens
gccgccauaacccgccuccc

SEQ ID NO: 31399 - RNA, 19 nt, Homo sapiens
gggggccacagacccccgu

SEQ ID NO: 31400 - RNA, 19 nt, Homo sapiens
uaacucaaaccuucaaacc

SEQ ID NO: 31401 - RNA, 23 nt, Homo sapiens
uagauuuaugaagaagaaacucu

SEQ ID NO: 31402 - RNA, 21 nt, Homo sapiens
uccacuugcuuauaauuaucc

SEQ ID NO: 31403 - RNA, 20 nt, Homo sapiens
ugccauguauaaaaauucag

SEQ ID NO: 31404 - RNA, 20 nt, Homo sapiens
ccuccagcuccucccacagc

SEQ ID NO: 31405 - RNA, 18 nt, Homo sapiens
cgcuugcucugcaccucu

SEQ ID NO: 31406 - RNA, 19 nt, Homo sapiens
aggaggagaugcugauuca

SEQ ID NO: 31407 - RNA, 17 nt, Homo sapiens
cauuugguauguaugua

SEQ ID NO: 31408 - RNA, 22 nt, Homo sapiens
ccauccgcccugcagcgccccu

SEQ ID NO: 31409 - RNA, 25 nt, Homo sapiens
ccugguauaaccauaaucggagaug

SEQ ID NO: 31410 - RNA, 25 nt, Homo sapiens
gggcaccuggcuguugcggcacgcc

SEQ ID NO: 31411 - RNA, 15 nt, Homo sapiens
ggguguuuggggcgg

SEQ ID NO: 31412 - RNA, 20 nt, Homo sapiens
ggugacccaguccuggcccc

SEQ ID NO: 31413 - RNA, 21 nt, Homo sapiens
ugguauguauguagggauagg

SEQ ID NO: 31414 - RNA, 18 nt, Homo sapiens
auauguacauauacugua

SEQ ID NO: 31415 - RNA, 22 nt, Homo sapiens
ccccaccaaccuacuuccugcg

SEQ ID NO: 31416 - RNA, 21 nt, Homo sapiens
cgcgccggcgagcgagcgagc

SEQ ID NO: 31417 - RNA, 23 nt, Homo sapiens
cggggggugugcgcgcgccggcg

SEQ ID NO: 31418 - RNA, 20 nt, Homo sapiens
cggguuggucagcucugagg

SEQ ID NO: 31419 - RNA, 21 nt, Homo sapiens
gcauugagcaggccuggcggg

SEQ ID NO: 31420 - RNA, 18 nt, Homo sapiens
gcgcgcgccggcgagcga

SEQ ID NO: 31421 - RNA, 23 nt, Homo sapiens
gcgcggggggugugcgcgcgccg

SEQ ID NO: 31422 - RNA, 18 nt, Homo sapiens
ggaguggggagggggcgg

SEQ ID NO: 31423 - RNA, 17 nt, Homo sapiens
ggcgcccgccgaggugc

SEQ ID NO: 31424 - RNA, 18 nt, Homo sapiens
gggggaagcggagagugu

SEQ ID NO: 31425 - RNA, 14 nt, Homo sapiens
guguuguaugugug

SEQ ID NO: 31426 - RNA, 25 nt, Homo sapiens
uauauguacauauacuguauauaua

SEQ ID NO: 31427 - RNA, 25 nt, Homo sapiens
uauguacauauacuguauauauaga

SEQ ID NO: 31428 - RNA, 16 nt, Homo sapiens
ucaaaaauaagugugc

SEQ ID NO: 31429 - RNA, 18 nt, Homo sapiens
acauuuacauacacacgu

SEQ ID NO: 31430 - RNA, 20 nt, Homo sapiens
cagccccugcaugcuggaaa

SEQ ID NO: 31431 - RNA, 21 nt, Homo sapiens
ucuuucaggagauaguauugu

SEQ ID NO: 31432 - RNA, 24 nt, Homo sapiens
uuuaaaucuauguuuuuccaacaa

SEQ ID NO: 31433 - RNA, 17 nt, Homo sapiens
aaaguguaccaaaaagg

SEQ ID NO: 31434 - RNA, 18 nt, Homo sapiens
agggaaacagagaagcca

SEQ ID NO: 31435 - RNA, 21 nt, Homo sapiens
agggggcuggccagugguggg

SEQ ID NO: 31436 - RNA, 23 nt, Homo sapiens
agguugggcguuuggaccguuga

SEQ ID NO: 31437 - RNA, 17 nt, Homo sapiens
cacucuauuuacaaguu

SEQ ID NO: 31438 - RNA, 19 nt, Homo sapiens
cagagagagucagagguag

SEQ ID NO: 31439 - RNA, 19 nt, Homo sapiens
cagcaggcuuagcuacaca

SEQ ID NO: 31440 - RNA, 16 nt, Homo sapiens
caggcuuagcuacaca

SEQ ID NO: 31441 - RNA, 17 nt, Homo sapiens
caucaaauguggucggc

SEQ ID NO: 31442 - RNA, 21 nt, Homo sapiens
ccgaagcggggacagugaccu

SEQ ID NO: 31443 - RNA, 18 nt, Homo sapiens
cgucgaucucaucuuuca

SEQ ID NO: 31444 - RNA, 20 nt, Homo sapiens
cugcauuucucaguggcaaa

SEQ ID NO: 31445 - RNA, 16 nt, Homo sapiens
gaacccgggaggcgga

SEQ ID NO: 31446 - RNA, 20 nt, Homo sapiens
gagacggagucuggcucugu

SEQ ID NO: 31447 - RNA, 17 nt, Homo sapiens
gaguucgagaucagccc

SEQ ID NO: 31448 - RNA, 17 nt, Homo sapiens
gcccgccucggccuccc

SEQ ID NO: 31449 - RNA, 17 nt, Homo sapiens
gccuccccucucucccu

SEQ ID NO: 31450 - RNA, 22 nt, Homo sapiens
gcgcgcggcgcccagccggggg

SEQ ID NO: 31451 - RNA, 16 nt, Homo sapiens
ggggaaaccagucaga

SEQ ID NO: 31452 - RNA, 19 nt, Homo sapiens
uaacuuaaagaauaucaaa

SEQ ID NO: 31453 - RNA, 14 nt, Homo sapiens
uagcuaauaggaag

SEQ ID NO: 31454 - RNA, 19 nt, Homo sapiens
ucccacccuccaaccuugg

SEQ ID NO: 31455 - RNA, 20 nt, Homo sapiens
uccccucucucccucuuaaa

SEQ ID NO: 31456 - RNA, 16 nt, Homo sapiens
ucgagaucagcccggc

SEQ ID NO: 31457 - RNA, 22 nt, Homo sapiens
ugcugcaaccaccugcccgggc

SEQ ID NO: 31458 - RNA, 20 nt, Homo sapiens
uggccuucuguuccuccaca

SEQ ID NO: 31459 - RNA, 23 nt, Homo sapiens
ugguggguuagaggcaggcaagg

SEQ ID NO: 31460 - RNA, 21 nt, Homo sapiens
cagaccgacgggcggaccggg

SEQ ID NO: 31461 - RNA, 22 nt, Homo sapiens
ccgccucggccuccccaagugc

SEQ ID NO: 31462 - RNA, 19 nt, Homo sapiens
cgggggcgcggggggccgg

SEQ ID NO: 31463 - RNA, 20 nt, Homo sapiens
cuguguaugugugugugugu

SEQ ID NO: 31464 - RNA, 20 nt, Homo sapiens
gaauuacaggcaugugccac

SEQ ID NO: 31465 - RNA, 21 nt, Homo sapiens
gcgcgggggcgcggggggccg

SEQ ID NO: 31466 - RNA, 18 nt, Homo sapiens
uaugugugugugugugug

SEQ ID NO: 31467 - RNA, 23 nt, Homo sapiens
ucuguguaugugugugugugugu

SEQ ID NO: 31468 - RNA, 18 nt, Homo sapiens
ugugugugugugugugug

SEQ ID NO: 31469 - RNA, 19 nt, Homo sapiens
uuuguguuuuugucugugu

SEQ ID NO: 31470 - RNA, 19 nt, Homo sapiens
agucagccccgggacugac

SEQ ID NO: 31471 - RNA, 15 nt, Homo sapiens
caggccugagccccu

SEQ ID NO: 31472 - RNA, 18 nt, Homo sapiens
ccagggcccaagccucgg

SEQ ID NO: 31473 - RNA, 17 nt, Homo sapiens
cccagcgggugccacag

SEQ ID NO: 31474 - RNA, 17 nt, Homo sapiens
ccccagccuuccuuccc

SEQ ID NO: 31475 - RNA, 19 nt, Homo sapiens
ccccggccccgcccggccc

SEQ ID NO: 31476 - RNA, 18 nt, Homo sapiens
ccccuggcagggagaggg

SEQ ID NO: 31477 - RNA, 21 nt, Homo sapiens
ccgcccggcccccggcccccg

SEQ ID NO: 31478 - RNA, 16 nt, Homo sapiens
ccgccgcggugccucc

SEQ ID NO: 31479 - RNA, 19 nt, Homo sapiens
ccgccgcggugccucuccg

SEQ ID NO: 31480 - RNA, 20 nt, Homo sapiens
ccucccgcccuucucccacc

SEQ ID NO: 31481 - RNA, 22 nt, Homo sapiens
ccucgcgccucucuccccgccc

SEQ ID NO: 31482 - RNA, 23 nt, Homo sapiens
gaaguagggaaggagggugggga

SEQ ID NO: 31483 - RNA, 21 nt, Homo sapiens
gcgggguagggaugaagcgga

SEQ ID NO: 31484 - RNA, 21 nt, Homo sapiens
ggauuggagggcuugggaaga

SEQ ID NO: 31485 - RNA, 17 nt, Homo sapiens
ggccugagccccuuccc

SEQ ID NO: 31486 - RNA, 19 nt, Homo sapiens
gggaaggaggguggggaca

SEQ ID NO: 31487 - RNA, 20 nt, Homo sapiens
gggaaggaggguggggacag

SEQ ID NO: 31488 - RNA, 16 nt, Homo sapiens
ggggagcgcccggggg

SEQ ID NO: 31489 - RNA, 21 nt, Homo sapiens
gguugggguguuuuccaagac

SEQ ID NO: 31490 - RNA, 16 nt, Homo sapiens
gucuguaauauauauc

SEQ ID NO: 31491 - RNA, 18 nt, Homo sapiens
uccgaggaggaugcuccg

SEQ ID NO: 31492 - RNA, 19 nt, Homo sapiens
ugcacgucgcccggcggca

SEQ ID NO: 31493 - RNA, 18 nt, Homo sapiens
ugcguuuccucuucguaa

SEQ ID NO: 31494 - RNA, 17 nt, Homo sapiens
uggagggcuugggaaga

SEQ ID NO: 31495 - RNA, 18 nt, Homo sapiens
ugucugccgccucgcgcc

SEQ ID NO: 31496 - RNA, 16 nt, Homo sapiens
uucuuuuucccacaca

SEQ ID NO: 31497 - RNA, 18 nt, Homo sapiens
uuuucuuuuucccacaca

SEQ ID NO: 31498 - RNA, 20 nt, Homo sapiens
acuguugccaagcaacaagu

SEQ ID NO: 31499 - RNA, 19 nt, Homo sapiens
aggaggaggaggaggcggc

SEQ ID NO: 31500 - RNA, 19 nt, Homo sapiens
aggaggaggaggcggcggc

SEQ ID NO: 31501 - RNA, 15 nt, Homo sapiens
aggaggcggcggcgg

SEQ ID NO: 31502 - RNA, 16 nt, Homo sapiens
aggaggcggcggcgga

SEQ ID NO: 31503 - RNA, 19 nt, Homo sapiens
aggcggcggcggagggcgg

SEQ ID NO: 31504 - RNA, 19 nt, Homo sapiens
agugguggggaggaguagg

SEQ ID NO: 31505 - RNA, 14 nt, Homo sapiens
cacagggucaggug

SEQ ID NO: 31506 - RNA, 19 nt, Homo sapiens
ccgccgcccgaaccggccg

SEQ ID NO: 31507 - RNA, 20 nt, Homo sapiens
cggcccacgacgcuggggcc

SEQ ID NO: 31508 - RNA, 17 nt, Homo sapiens
gcccgccucggccuccc

SEQ ID NO: 31509 - RNA, 21 nt, Homo sapiens
gcccggggcugaggaggaagc

SEQ ID NO: 31510 - RNA, 19 nt, Homo sapiens
ggggaggaguagggaacga

SEQ ID NO: 31511 - RNA, 22 nt, Homo sapiens
ggggaggaguagggaacgaugg

SEQ ID NO: 31512 - RNA, 19 nt, Homo sapiens
ucacccuugacccuggggu

SEQ ID NO: 31513 - RNA, 20 nt, Homo sapiens
ugagagaggcggaugaaggc

SEQ ID NO: 31514 - RNA, 22 nt, Homo sapiens
ugugauuucuucgcgaccccag

SEQ ID NO: 31515 - RNA, 22 nt, Homo sapiens
uuucucuguuucugaguggggu

SEQ ID NO: 31516 - RNA, 19 nt, Homo sapiens
aagaagaaaagaaaucacu

SEQ ID NO: 31517 - RNA, 19 nt, Homo sapiens
aaggcauuguuccucucag

SEQ ID NO: 31518 - RNA, 16 nt, Homo sapiens
agaagauacagggcca

SEQ ID NO: 31519 - RNA, 20 nt, Homo sapiens
auacauuccugaucaucuga

SEQ ID NO: 31520 - RNA, 19 nt, Homo sapiens
gccgucuccaccgucgccu

SEQ ID NO: 31521 - RNA, 22 nt, Homo sapiens
gccuuguuuuauaaauacacau

SEQ ID NO: 31522 - RNA, 21 nt, Homo sapiens
gcucugugggcugacauuuaa

SEQ ID NO: 31523 - RNA, 18 nt, Homo sapiens
uaaagcauuuaaacuucu

SEQ ID NO: 31524 - RNA, 15 nt, Homo sapiens
ucugucaguggguua

SEQ ID NO: 31525 - RNA, 19 nt, Homo sapiens
uggcacuaugcggcagcaa

SEQ ID NO: 31526 - RNA, 20 nt, Homo sapiens
uguagguacugcugcuguug

SEQ ID NO: 31527 - RNA, 22 nt, Homo sapiens
aaagggacuuauucuugagaaa

SEQ ID NO: 31528 - RNA, 19 nt, Homo sapiens
aggagggggggagggaggg

SEQ ID NO: 31529 - RNA, 18 nt, Homo sapiens
aggggaaggggagagccc

SEQ ID NO: 31530 - RNA, 19 nt, Homo sapiens
gaggaggaggaggaggggg

SEQ ID NO: 31531 - RNA, 20 nt, Homo sapiens
gaggaggagggggggaggga

SEQ ID NO: 31532 - RNA, 17 nt, Homo sapiens
ggaggaggaggaggggg

SEQ ID NO: 31533 - RNA, 15 nt, Homo sapiens
ggagggggggaggga

SEQ ID NO: 31534 - RNA, 22 nt, Homo sapiens
cggcgguuuuacucggcuucgc

SEQ ID NO: 31535 - RNA, 21 nt, Homo sapiens
ugcuugagaugggggcaguuu

SEQ ID NO: 31536 - RNA, 23 nt, Homo sapiens
aacagaugauggagaugcagaaa

SEQ ID NO: 31537 - RNA, 18 nt, Homo sapiens
acaaaugauucagauaau

SEQ ID NO: 31538 - RNA, 21 nt, Homo sapiens
aggcaggcaggaggcauuacg

SEQ ID NO: 31539 - RNA, 18 nt, Homo sapiens
cgcuuucuuuucuggcuu

SEQ ID NO: 31540 - RNA, 20 nt, Homo sapiens
cugcagaucccguugcgaug

SEQ ID NO: 31541 - RNA, 17 nt, Homo sapiens
gcagaugcaggcagagg

SEQ ID NO: 31542 - RNA, 20 nt, Homo sapiens
gcauaccaaauacaugugca

SEQ ID NO: 31543 - RNA, 18 nt, Homo sapiens
uagcagcgcacagucuga

SEQ ID NO: 31544 - RNA, 27 nt, Homo sapiens
uauuuuacauugcaguauauaaaucua

SEQ ID NO: 31545 - RNA, 16 nt, Homo sapiens
ucacacagcacugaca

SEQ ID NO: 31546 - RNA, 19 nt, Homo sapiens
ucugcauuuuagucucaaa

SEQ ID NO: 31547 - RNA, 20 nt, Homo sapiens
ugcugggcgcccgggugugc

SEQ ID NO: 31548 - RNA, 20 nt, Homo sapiens
uucaaccugcaugagggcug

SEQ ID NO: 31549 - RNA, 21 nt, Homo sapiens
aaagaucuugcccaugagucu

SEQ ID NO: 31550 - RNA, 20 nt, Homo sapiens
aaaguaugugugugaacuuu

SEQ ID NO: 31551 - RNA, 18 nt, Homo sapiens
aggccuuguuguuguugg

SEQ ID NO: 31552 - RNA, 18 nt, Homo sapiens
agggugacuggcacaugu

SEQ ID NO: 31553 - RNA, 16 nt, Homo sapiens
aguaaaacuucucagu

SEQ ID NO: 31554 - RNA, 22 nt, Homo sapiens
cagcacccuggccagcggcggc

SEQ ID NO: 31555 - RNA, 24 nt, Homo sapiens
ccagcuuuucucuccuccuucucc

SEQ ID NO: 31556 - RNA, 21 nt, Homo sapiens
cccuucuauuuguuauucuug

SEQ ID NO: 31557 - RNA, 17 nt, Homo sapiens
ccgcgcagcacuggccc

SEQ ID NO: 31558 - RNA, 17 nt, Homo sapiens
ccucucgccuuucgagg

SEQ ID NO: 31559 - RNA, 17 nt, Homo sapiens
ccugaaagaucuugccc

SEQ ID NO: 31560 - RNA, 23 nt, Homo sapiens
ccuucucccacuccugccaacuc

SEQ ID NO: 31561 - RNA, 19 nt, Homo sapiens
cucgcucgcuugcuugcuu

SEQ ID NO: 31562 - RNA, 18 nt, Homo sapiens
cuuccgcucggguuugac

SEQ ID NO: 31563 - RNA, 19 nt, Homo sapiens
cuugcuugcuugcuugcuu

SEQ ID NO: 31564 - RNA, 24 nt, Homo sapiens
cuugcuugcuuucuugcuugcuug

SEQ ID NO: 31565 - RNA, 18 nt, Homo sapiens
cuugcuuucuuucuuucu

SEQ ID NO: 31566 - RNA, 19 nt, Homo sapiens
cuuguuguuguuggggacu

SEQ ID NO: 31567 - RNA, 19 nt, Homo sapiens
gaaagaucuugcccaugag

SEQ ID NO: 31568 - RNA, 19 nt, Homo sapiens
gacccccaguucugugacu

SEQ ID NO: 31569 - RNA, 19 nt, Homo sapiens
gauguuuguacuuuuagua

SEQ ID NO: 31570 - RNA, 22 nt, Homo sapiens
gcuugcuuucuugcuugcuugc

SEQ ID NO: 31571 - RNA, 26 nt, Homo sapiens
gcuugcuuucuugcuugcuugcuugc

SEQ ID NO: 31572 - RNA, 27 nt, Homo sapiens
gcuugcuuucuugcuugcuugcuugcg

SEQ ID NO: 31573 - RNA, 16 nt, Homo sapiens
gcuuucuugcuuuccu

SEQ ID NO: 31574 - RNA, 20 nt, Homo sapiens
ggaggaaauuaauuucuaca

SEQ ID NO: 31575 - RNA, 18 nt, Homo sapiens
ggcaaaacuggcacauga

SEQ ID NO: 31576 - RNA, 17 nt, Homo sapiens
ggugguggugccuuccc

SEQ ID NO: 31577 - RNA, 20 nt, Homo sapiens
gugauugauguuucgagacg

SEQ ID NO: 31578 - RNA, 16 nt, Homo sapiens
uaauucugggggaagc

SEQ ID NO: 31579 - RNA, 17 nt, Homo sapiens
uagccaagacugaaggg

SEQ ID NO: 31580 - RNA, 20 nt, Homo sapiens
ucgcucgcuugcuugcuugc

SEQ ID NO: 31581 - RNA, 22 nt, Homo sapiens
ugcuugcuuucuugcuugcuug

SEQ ID NO: 31582 - RNA, 23 nt, Homo sapiens
uggggaaaaagaagaaaagaaaa

SEQ ID NO: 31583 - RNA, 20 nt, Homo sapiens
uggugaauuucuuggcucac

SEQ ID NO: 31584 - RNA, 17 nt, Homo sapiens
uggcacuacccaaagcc

SEQ ID NO: 31585 - RNA, 15 nt, Homo sapiens
cgcuggaggcggcgg

SEQ ID NO: 31586 - RNA, 19 nt, Homo sapiens
acucugugugucugugugu

SEQ ID NO: 31587 - RNA, 20 nt, Homo sapiens
agaucacacccacccggggc

SEQ ID NO: 31588 - RNA, 19 nt, Homo sapiens
aggcuggggaggccccugg

SEQ ID NO: 31589 - RNA, 23 nt, Homo sapiens
cacuucucuacgugcgugugugu

SEQ ID NO: 31590 - RNA, 18 nt, Homo sapiens
cagcacccgcuuucugcu

SEQ ID NO: 31591 - RNA, 18 nt, Homo sapiens
ccgcuuucugcuguucug

SEQ ID NO: 31592 - RNA, 19 nt, Homo sapiens
ccucacacuccccuccccc

SEQ ID NO: 31593 - RNA, 17 nt, Homo sapiens
cuguggcuggggagggg

SEQ ID NO: 31594 - RNA, 15 nt, Homo sapiens
gagagagagagagag

SEQ ID NO: 31595 - RNA, 21 nt, Homo sapiens
gcccaagaaugucguguaccu

SEQ ID NO: 31596 - RNA, 18 nt, Homo sapiens
gcgggcugcguaugccca

SEQ ID NO: 31597 - RNA, 18 nt, Homo sapiens
gcuggggcccccggcccc

SEQ ID NO: 31598 - RNA, 16 nt, Homo sapiens
ggaggccccuggggga

SEQ ID NO: 31599 - RNA, 15 nt, Homo sapiens
ggggaaggggaagcc

SEQ ID NO: 31600 - RNA, 18 nt, Homo sapiens
ggggaggguggacagggg

SEQ ID NO: 31601 - RNA, 18 nt, Homo sapiens
gggggaggguggacaggg

SEQ ID NO: 31602 - RNA, 17 nt, Homo sapiens
guugggccaagaggucu

SEQ ID NO: 31603 - RNA, 20 nt, Homo sapiens
uaggguaaaauauacagaua

SEQ ID NO: 31604 - RNA, 22 nt, Homo sapiens
uauauuaucaaaaaguccccaa

SEQ ID NO: 31605 - RNA, 21 nt, Homo sapiens
ucuguguguaugugugugugu

SEQ ID NO: 31606 - RNA, 19 nt, Homo sapiens
uggaaggaaggcugaaguc

SEQ ID NO: 31607 - RNA, 17 nt, Homo sapiens
uggagguaucuccgggg

SEQ ID NO: 31608 - RNA, 15 nt, Homo sapiens
uggcuggggagggga

SEQ ID NO: 31609 - RNA, 21 nt, Homo sapiens
uaauauugcuagacaguucau

SEQ ID NO: 31610 - RNA, 21 nt, Homo sapiens
ugggacaggaaaaggcucagu

SEQ ID NO: 31611 - RNA, 23 nt, Homo sapiens
accuccugacuccucuaccaacu

SEQ ID NO: 31612 - RNA, 21 nt, Homo sapiens
ccgcccccgcgggcuccggcc

SEQ ID NO: 31613 - RNA, 22 nt, Homo sapiens
ucccgcgguccuccgagcccgc

SEQ ID NO: 31614 - RNA, 18 nt, Homo sapiens
ugaugcaugaagaugccc

SEQ ID NO: 31615 - RNA, 18 nt, Homo sapiens
acccugucucaaaugugu

SEQ ID NO: 31616 - RNA, 18 nt, Homo sapiens
aggaaggguuaaguaauu

SEQ ID NO: 31617 - RNA, 17 nt, Homo sapiens
ccccugacugccccgac

SEQ ID NO: 31618 - RNA, 20 nt, Homo sapiens
gaaaggauguaaaauauuua

SEQ ID NO: 31619 - RNA, 18 nt, Homo sapiens
gcugcggcgcggacggcc

SEQ ID NO: 31620 - RNA, 19 nt, Homo sapiens
ggacgagugcguggugaag

SEQ ID NO: 31621 - RNA, 22 nt, Homo sapiens
ucauugguaacaaaacucaguu

SEQ ID NO: 31622 - RNA, 17 nt, Homo sapiens
aaauguguugacacuga

SEQ ID NO: 31623 - RNA, 16 nt, Homo sapiens
aaccagccuucugcug

SEQ ID NO: 31624 - RNA, 17 nt, Homo sapiens
gaaaauaaagaagaaaa

SEQ ID NO: 31625 - RNA, 19 nt, Homo sapiens
gccgcuggcgacccgcagg

SEQ ID NO: 31626 - RNA, 18 nt, Homo sapiens
uaaacugugccaccuucc

SEQ ID NO: 31627 - RNA, 23 nt, Homo sapiens
uucauuuaaaauuacauuuguag

SEQ ID NO: 31628 - RNA, 20 nt, Homo sapiens
uucccauacuguuuuuccca

SEQ ID NO: 31629 - RNA, 19 nt, Homo sapiens
aaacuuguuaaguugcagu

SEQ ID NO: 31630 - RNA, 21 nt, Homo sapiens
aagcaggaagaugucugacag

SEQ ID NO: 31631 - RNA, 18 nt, Homo sapiens
aagugccugcuauuuagu

SEQ ID NO: 31632 - RNA, 27 nt, Homo sapiens
agauauagauauauguuuguaaacaaa

SEQ ID NO: 31633 - RNA, 21 nt, Homo sapiens
aggaaagaaaaauuuuguaga

SEQ ID NO: 31634 - RNA, 22 nt, Homo sapiens
aggugcgucauaaaagcuggcc

SEQ ID NO: 31635 - RNA, 18 nt, Homo sapiens
aguggugcccucugugac

SEQ ID NO: 31636 - RNA, 21 nt, Homo sapiens
ccaaggagaaauugaacugca

SEQ ID NO: 31637 - RNA, 19 nt, Homo sapiens
cugccacacugugaagaac

SEQ ID NO: 31638 - RNA, 16 nt, Homo sapiens
cuuagcaguuggcacc

SEQ ID NO: 31639 - RNA, 18 nt, Homo sapiens
gagaagaaagcuuccacu

SEQ ID NO: 31640 - RNA, 24 nt, Homo sapiens
gccaugaggaagcugacugugagg

SEQ ID NO: 31641 - RNA, 17 nt, Homo sapiens
gguggggaaggcuuccu

SEQ ID NO: 31642 - RNA, 18 nt, Homo sapiens
guacaccaccccugugcc

SEQ ID NO: 31643 - RNA, 19 nt, Homo sapiens
uacuucaaaaaauauauac

SEQ ID NO: 31644 - RNA, 18 nt, Homo sapiens
uagagaauuacauaauua

SEQ ID NO: 31645 - RNA, 23 nt, Homo sapiens
uauauauauagauauagauauau

SEQ ID NO: 31646 - RNA, 22 nt, Homo sapiens
uaucuauauauauagauauaga

SEQ ID NO: 31647 - RNA, 22 nt, Homo sapiens
ucaaaacccucaauaccagugg

SEQ ID NO: 31648 - RNA, 18 nt, Homo sapiens
ucaaaaugaauuuccgau

SEQ ID NO: 31649 - RNA, 23 nt, Homo sapiens
ucauaaaagagcuauuuuacaaa

SEQ ID NO: 31650 - RNA, 24 nt, Homo sapiens
ucccacucugggcaccuugggacu

SEQ ID NO: 31651 - RNA, 23 nt, Homo sapiens
ucuaaaauuuuuaaucccauucu

SEQ ID NO: 31652 - RNA, 18 nt, Homo sapiens
ucucugaccacaccaccu

SEQ ID NO: 31653 - RNA, 18 nt, Homo sapiens
ugugacguuaagagcaaa

SEQ ID NO: 31654 - RNA, 19 nt, Homo sapiens
uucauuuuaguuggcaaaa

SEQ ID NO: 31655 - RNA, 18 nt, Homo sapiens
uuuaagcuuauuuaauau

SEQ ID NO: 31656 - RNA, 16 nt, Homo sapiens
uuuucccagaccccag

SEQ ID NO: 31657 - RNA, 23 nt, Homo sapiens
aaagguuucacgcaaaggaaaaa

SEQ ID NO: 31658 - RNA, 21 nt, Homo sapiens
auguuuauacaaaauacugac

SEQ ID NO: 31659 - RNA, 20 nt, Homo sapiens
cauugccagagacauuuuag

SEQ ID NO: 31660 - RNA, 20 nt, Homo sapiens
gccuagguaguuuugcccaa

SEQ ID NO: 31661 - RNA, 16 nt, Homo sapiens
ggacaugcugaugacc

SEQ ID NO: 31662 - RNA, 22 nt, Homo sapiens
gguacagauuuuuauuuuaucu

SEQ ID NO: 31663 - RNA, 18 nt, Homo sapiens
guuuauuucauacaaugu

SEQ ID NO: 31664 - RNA, 20 nt, Homo sapiens
uaguauucucuacuugucau

SEQ ID NO: 31665 - RNA, 21 nt, Homo sapiens
uauaagcaaaacaaaauacaa

SEQ ID NO: 31666 - RNA, 18 nt, Homo sapiens
uguuauaaaagguuucac

SEQ ID NO: 31667 - RNA, 20 nt, Homo sapiens
uugcugcagugacugggaca

SEQ ID NO: 31668 - RNA, 15 nt, Homo sapiens
uugugcuaugggguu

SEQ ID NO: 31669 - RNA, 18 nt, Homo sapiens
uuucuguacauugccaga

SEQ ID NO: 31670 - RNA, 17 nt, Homo sapiens
agcccucuggggcgugc

SEQ ID NO: 31671 - RNA, 16 nt, Homo sapiens
aggcaacaucuggggg

SEQ ID NO: 31672 - RNA, 15 nt, Homo sapiens
aggucuggaucugcu

SEQ ID NO: 31673 - RNA, 16 nt, Homo sapiens
agugucucugauggcu

SEQ ID NO: 31674 - RNA, 20 nt, Homo sapiens
cagcaggccugggaggcaca

SEQ ID NO: 31675 - RNA, 17 nt, Homo sapiens
ccaugggcgccgccaug

SEQ ID NO: 31676 - RNA, 26 nt, Homo sapiens
ccauuuccacauauuggccgguugcg

SEQ ID NO: 31677 - RNA, 22 nt, Homo sapiens
ccucauucaugugaggaagugg

SEQ ID NO: 31678 - RNA, 20 nt, Homo sapiens
ccucuggggcgugcugcauc

SEQ ID NO: 31679 - RNA, 22 nt, Homo sapiens
cgcuguggcuuggacaccggag

SEQ ID NO: 31680 - RNA, 18 nt, Homo sapiens
gugguggggacacaggca

SEQ ID NO: 31681 - RNA, 19 nt, Homo sapiens
uccacauauugguuauuug

SEQ ID NO: 31682 - RNA, 19 nt, Homo sapiens
ugguaugaguccauuccug

SEQ ID NO: 31683 - RNA, 18 nt, Homo sapiens
uuccaaguggcuggcaca

SEQ ID NO: 31684 - RNA, 18 nt, Homo sapiens
uugaacauuuccuaaaug

SEQ ID NO: 31685 - RNA, 21 nt, Homo sapiens
auauaugaaauaauuucuaga

SEQ ID NO: 31686 - RNA, 15 nt, Homo sapiens
ccugccuccuccccc

SEQ ID NO: 31687 - RNA, 16 nt, Homo sapiens
ccugccuccucccccc

SEQ ID NO: 31688 - RNA, 18 nt, Homo sapiens
cuacaccuacaucucccc

SEQ ID NO: 31689 - RNA, 17 nt, Homo sapiens
cucaaaugcguucuuuc

SEQ ID NO: 31690 - RNA, 18 nt, Homo sapiens
gcaguuucccucuuuccu

SEQ ID NO: 31691 - RNA, 18 nt, Homo sapiens
ggaggagaggggaaggga

SEQ ID NO: 31692 - RNA, 17 nt, Homo sapiens
ggccccggagagcaagc

SEQ ID NO: 31693 - RNA, 18 nt, Homo sapiens
uaaaaacaaaaacauaau

SEQ ID NO: 31694 - RNA, 19 nt, Homo sapiens
uauaaaccaacauagcauu

SEQ ID NO: 31695 - RNA, 27 nt, Homo sapiens
uugaacuuuauguacaaaaucauuuga

SEQ ID NO: 31696 - RNA, 21 nt, Homo sapiens
aggcuggcggggcgcgcgcgc

SEQ ID NO: 31697 - RNA, 18 nt, Homo sapiens
gcggggcgcgcgcgcgcc

SEQ ID NO: 31698 - RNA, 22 nt, Homo sapiens
gcgggggcgagcacgcugcggc

SEQ ID NO: 31699 - RNA, 19 nt, Homo sapiens
gcucccggccccgucugcc

SEQ ID NO: 31700 - RNA, 19 nt, Homo sapiens
aaccuuuuuuguaguaacc

SEQ ID NO: 31701 - RNA, 18 nt, Homo sapiens
aaguggaggggaggggaa

SEQ ID NO: 31702 - RNA, 19 nt, Homo sapiens
acaggggccucucucuucu

SEQ ID NO: 31703 - RNA, 18 nt, Homo sapiens
aggaucccuccagggaaa

SEQ ID NO: 31704 - RNA, 21 nt, Homo sapiens
ccaaaauaaugaaauuaaaaa

SEQ ID NO: 31705 - RNA, 17 nt, Homo sapiens
ccugacuucaucacuca

SEQ ID NO: 31706 - RNA, 19 nt, Homo sapiens
cuuccagcacccuaguugu

SEQ ID NO: 31707 - RNA, 21 nt, Homo sapiens
gcacaggcauugaaaacaaau

SEQ ID NO: 31708 - RNA, 15 nt, Homo sapiens
ggcauuucuggcuaa

SEQ ID NO: 31709 - RNA, 25 nt, Homo sapiens
gggaugggaagcugaugggauccua

SEQ ID NO: 31710 - RNA, 20 nt, Homo sapiens
ggggaggggaaaggcugaag

SEQ ID NO: 31711 - RNA, 18 nt, Homo sapiens
ggguuuuaaggaaauuca

SEQ ID NO: 31712 - RNA, 18 nt, Homo sapiens
uaaacacaacacuucucu

SEQ ID NO: 31713 - RNA, 19 nt, Homo sapiens
uaggugaguuauuuggaau

SEQ ID NO: 31714 - RNA, 22 nt, Homo sapiens
ucgccgggcgggcgggcugcgc

SEQ ID NO: 31715 - RNA, 18 nt, Homo sapiens
ucggugaaaugcugccgu

SEQ ID NO: 31716 - RNA, 17 nt, Homo sapiens
uguccccccagcagcca

SEQ ID NO: 31717 - RNA, 19 nt, Homo sapiens
ugucuggugggggauggga

SEQ ID NO: 31718 - RNA, 19 nt, Homo sapiens
ugugggaagagguaacuca

SEQ ID NO: 31719 - RNA, 18 nt, Homo sapiens
uugcuuaugguugucccc

SEQ ID NO: 31720 - RNA, 18 nt, Homo sapiens
cagcuccuuggcuggggc

SEQ ID NO: 31721 - RNA, 20 nt, Homo sapiens
ccagacuuuguuucucugcu

SEQ ID NO: 31722 - RNA, 18 nt, Homo sapiens
cuuuauucagggaucaua

SEQ ID NO: 31723 - RNA, 19 nt, Homo sapiens
ucagaucucccccaagcca

SEQ ID NO: 31724 - RNA, 21 nt, Homo sapiens
agcgggggaggacgcaggagg

SEQ ID NO: 31725 - RNA, 20 nt, Homo sapiens
cacccguuccugcgcucuac

SEQ ID NO: 31726 - RNA, 18 nt, Homo sapiens
ccaggcccugccccuccc

SEQ ID NO: 31727 - RNA, 20 nt, Homo sapiens
gaggaggaggaggaagagga

SEQ ID NO: 31728 - RNA, 17 nt, Homo sapiens
uuacccacccguuccug

SEQ ID NO: 31729 - RNA, 20 nt, Homo sapiens
aacaauuuagaauaggaaag

SEQ ID NO: 31730 - RNA, 18 nt, Homo sapiens
aagaggguaucuuuggac

SEQ ID NO: 31731 - RNA, 17 nt, Homo sapiens
aagguucgaugggagaa

SEQ ID NO: 31732 - RNA, 21 nt, Homo sapiens
aguagcauacucauuucuuuu

SEQ ID NO: 31733 - RNA, 17 nt, Homo sapiens
ccuugagugacagcaga

SEQ ID NO: 31734 - RNA, 20 nt, Homo sapiens
cuaaccaucauuucuagguu

SEQ ID NO: 31735 - RNA, 16 nt, Homo sapiens
cuugaugauacuuccu

SEQ ID NO: 31736 - RNA, 20 nt, Homo sapiens
gcaauauuauuaauaaucac

SEQ ID NO: 31737 - RNA, 20 nt, Homo sapiens
gcggagcgcgaagagcggcg

SEQ ID NO: 31738 - RNA, 21 nt, Homo sapiens
gcucuuugugaaaaauuccca

SEQ ID NO: 31739 - RNA, 21 nt, Homo sapiens
guuguuuuuaauuguacuaca

SEQ ID NO: 31740 - RNA, 20 nt, Homo sapiens
uaaguuuggcacagagaagc

SEQ ID NO: 31741 - RNA, 19 nt, Homo sapiens
uaauaauuccuucucagau

SEQ ID NO: 31742 - RNA, 18 nt, Homo sapiens
uacuuccuugagugacag

SEQ ID NO: 31743 - RNA, 17 nt, Homo sapiens
uauacaacauuacaagc

SEQ ID NO: 31744 - RNA, 21 nt, Homo sapiens
ugauauguucaaaugcccaau

SEQ ID NO: 31745 - RNA, 19 nt, Homo sapiens
uguuguaugugggcauggu

SEQ ID NO: 31746 - RNA, 22 nt, Homo sapiens
aaaugguuuuaaagauuacuca

SEQ ID NO: 31747 - RNA, 21 nt, Homo sapiens
aaucacaaauauaguuaaucc

SEQ ID NO: 31748 - RNA, 19 nt, Homo sapiens
aguccaaaacuauuuuaaa

SEQ ID NO: 31749 - RNA, 18 nt, Homo sapiens
auuacucauaaacuaucc

SEQ ID NO: 31750 - RNA, 17 nt, Homo sapiens
caccuagugaauauuac

SEQ ID NO: 31751 - RNA, 20 nt, Homo sapiens
ccauacagugcaauuuuauu

SEQ ID NO: 31752 - RNA, 20 nt, Homo sapiens
ggugauccuuuguauuuuaa

SEQ ID NO: 31753 - RNA, 20 nt, Homo sapiens
guaaauggauaaaugagucu

SEQ ID NO: 31754 - RNA, 25 nt, Homo sapiens
uaauuuuuuguauuuuuaguagaca

SEQ ID NO: 31755 - RNA, 19 nt, Homo sapiens
uacagugagccucauuauc

SEQ ID NO: 31756 - RNA, 17 nt, Homo sapiens
uaccauaagaaaguuau

SEQ ID NO: 31757 - RNA, 18 nt, Homo sapiens
ucuugcccuuucgcccag

SEQ ID NO: 31758 - RNA, 24 nt, Homo sapiens
ugagaauaaauguaaauggauaaa

SEQ ID NO: 31759 - RNA, 23 nt, Homo sapiens
ugagggagcacaaaaaagugagg

SEQ ID NO: 31760 - RNA, 23 nt, Homo sapiens
uguauauugcacauacuuuuagu

SEQ ID NO: 31761 - RNA, 18 nt, Homo sapiens
uguucaauagaggauugu

SEQ ID NO: 31762 - RNA, 23 nt, Homo sapiens
uuugaaaaacauuucuaugguca

SEQ ID NO: 31763 - RNA, 20 nt, Homo sapiens
aaaaugaaaauagaauauuu

SEQ ID NO: 31764 - RNA, 17 nt, Homo sapiens
agcgcgcggcggccgcc

SEQ ID NO: 31765 - RNA, 16 nt, Homo sapiens
gagaagcagcugaggc

SEQ ID NO: 31766 - RNA, 19 nt, Homo sapiens
gaggaaacgggaaggcggg

SEQ ID NO: 31767 - RNA, 21 nt, Homo sapiens
gccccgggccggccugugggg

SEQ ID NO: 31768 - RNA, 21 nt, Homo sapiens
gcucccuccugaagccagccc

SEQ ID NO: 31769 - RNA, 17 nt, Homo sapiens
ggaggaaacgggaaggc

SEQ ID NO: 31770 - RNA, 16 nt, Homo sapiens
gggccugugguggggg

SEQ ID NO: 31771 - RNA, 18 nt, Homo sapiens
ggggagcggucgccgggg

SEQ ID NO: 31772 - RNA, 21 nt, Homo sapiens
gugagucccgagauugcggag

SEQ ID NO: 31773 - RNA, 19 nt, Homo sapiens
uuaaaaagggaacuguaca

SEQ ID NO: 31774 - RNA, 18 nt, Homo sapiens
agaagcucaucaacuuac

SEQ ID NO: 31775 - RNA, 18 nt, Homo sapiens
aggggcgcucgcggccug

SEQ ID NO: 31776 - RNA, 16 nt, Homo sapiens
gccuggccgaggcucc

SEQ ID NO: 31777 - RNA, 19 nt, Homo sapiens
ggccuggggaggggcuggg

SEQ ID NO: 31778 - RNA, 23 nt, Homo sapiens
ucugugcuuuuuuuucuauuuuc

SEQ ID NO: 31779 - RNA, 19 nt, Homo sapiens
aagggacguguuuuauuuc

SEQ ID NO: 31780 - RNA, 17 nt, Homo sapiens
acaggaaaaugucauga

SEQ ID NO: 31781 - RNA, 19 nt, Homo sapiens
ggaacgaauuuauaucuuu

SEQ ID NO: 31782 - RNA, 20 nt, Homo sapiens
guggguguguuugucuuuuu

SEQ ID NO: 31783 - RNA, 19 nt, Homo sapiens
uccugugaguucucuguca

SEQ ID NO: 31784 - RNA, 18 nt, Homo sapiens
uguggccaaguuucaaaa

SEQ ID NO: 31785 - RNA, 24 nt, Homo sapiens
uuuucauuuuuugaagcaaucuaa

SEQ ID NO: 31786 - RNA, 19 nt, Homo sapiens
acccuuuugcauauaugaa

SEQ ID NO: 31787 - RNA, 23 nt, Homo sapiens
agcacauuuuaagaaguauuaau

SEQ ID NO: 31788 - RNA, 20 nt, Homo sapiens
cacuggcgaccugugugugu

SEQ ID NO: 31789 - RNA, 16 nt, Homo sapiens
gaagcuuucuuucagg

SEQ ID NO: 31790 - RNA, 22 nt, Homo sapiens
ggagaaagaaaagggggaaggg

SEQ ID NO: 31791 - RNA, 19 nt, Homo sapiens
gggagcgagggcgagaggc

SEQ ID NO: 31792 - RNA, 20 nt, Homo sapiens
ggggaggagggacggggagc

SEQ ID NO: 31793 - RNA, 21 nt, Homo sapiens
uguuacggcuguucccagacu

SEQ ID NO: 31794 - RNA, 18 nt, Homo sapiens
uuuugcauauaugaacca

SEQ ID NO: 31795 - RNA, 22 nt, Homo sapiens
uacucuuuccucuuaaauauuu

SEQ ID NO: 31796 - RNA, 24 nt, Homo sapiens
uccuguguuuacacagauuaaaaa

SEQ ID NO: 31797 - RNA, 20 nt, Homo sapiens
ugagcacuucaguucuuuau

SEQ ID NO: 31798 - RNA, 20 nt, Homo sapiens
aggcagaugggaagaaaaca

SEQ ID NO: 31799 - RNA, 16 nt, Homo sapiens
cagcauuucugugcgg

SEQ ID NO: 31800 - RNA, 18 nt, Homo sapiens
ccagaguacucguaauaa

SEQ ID NO: 31801 - RNA, 19 nt, Homo sapiens
cugcuccaccccgcccgcc

SEQ ID NO: 31802 - RNA, 21 nt, Homo sapiens
cugugcgggggcagaaggggc

SEQ ID NO: 31803 - RNA, 17 nt, Homo sapiens
gcugcuccaccccgccc

SEQ ID NO: 31804 - RNA, 17 nt, Homo sapiens
ggcagaugggaagaaaa

SEQ ID NO: 31805 - RNA, 16 nt, Homo sapiens
ggcuguaaacacacag

SEQ ID NO: 31806 - RNA, 24 nt, Homo sapiens
ucacauuucuuuggagcauuuuug

SEQ ID NO: 31807 - RNA, 19 nt, Homo sapiens
ugccgacaacucuggaucu

SEQ ID NO: 31808 - RNA, 23 nt, Homo sapiens
uggaaucugaagggaugacaggg

SEQ ID NO: 31809 - RNA, 20 nt, Homo sapiens
ugguggcagcucauauuagg

SEQ ID NO: 31810 - RNA, 16 nt, Homo sapiens
uuuuuuuuccgagacc

SEQ ID NO: 31811 - RNA, 17 nt, Homo sapiens
cgggaggggagggcagg

SEQ ID NO: 31812 - RNA, 21 nt, Homo sapiens
gggaggggagggcagggcggg

SEQ ID NO: 31813 - RNA, 18 nt, Homo sapiens
ugagaugggcugauggaa

SEQ ID NO: 31814 - RNA, 22 nt, Homo sapiens
uguuagcugagauugagcauuu

SEQ ID NO: 31815 - RNA, 18 nt, Homo sapiens
gccauuauuauugacagu

SEQ ID NO: 31816 - RNA, 18 nt, Homo sapiens
ugacugaauuguauacuu

SEQ ID NO: 31817 - RNA, 18 nt, Homo sapiens
uguauacuuaagucccag

SEQ ID NO: 31818 - RNA, 19 nt, Homo sapiens
uuaguguuuaagaaaaaca

SEQ ID NO: 31819 - RNA, 17 nt, Homo sapiens
uuuauaaagaauuauuc

SEQ ID NO: 31820 - RNA, 20 nt, Homo sapiens
aaggguaccaccacaggaaa

SEQ ID NO: 31821 - RNA, 23 nt, Homo sapiens
cacagugagaaucuacagcugca

SEQ ID NO: 31822 - RNA, 23 nt, Homo sapiens
gggucccugcagccagcgucgcc

SEQ ID NO: 31823 - RNA, 16 nt, Homo sapiens
uacaauaagcuacaag

SEQ ID NO: 31824 - RNA, 20 nt, Homo sapiens
uuaaagacaagaucaccguc

SEQ ID NO: 31825 - RNA, 18 nt, Homo sapiens
caaaaggaaaacuuauuu

SEQ ID NO: 31826 - RNA, 22 nt, Homo sapiens
cagcaacucaacagauucugcu

SEQ ID NO: 31827 - RNA, 18 nt, Homo sapiens
ccccagcucccaaguccc

SEQ ID NO: 31828 - RNA, 18 nt, Homo sapiens
ccccagggagaaauugca

SEQ ID NO: 31829 - RNA, 19 nt, Homo sapiens
ugcugggggggaggggguu

SEQ ID NO: 31830 - RNA, 21 nt, Homo sapiens
acggagcuggacgugcggaug

SEQ ID NO: 31831 - RNA, 19 nt, Homo sapiens
agcaggcggcagggaagga

SEQ ID NO: 31832 - RNA, 19 nt, Homo sapiens
caaacacaugcgcgugucc

SEQ ID NO: 31833 - RNA, 19 nt, Homo sapiens
ccagcucccagcacccucc

SEQ ID NO: 31834 - RNA, 19 nt, Homo sapiens
cccccacccccucuccggu

SEQ ID NO: 31835 - RNA, 26 nt, Homo sapiens
cuggcgcgggcggcuggaacgcggcc

SEQ ID NO: 31836 - RNA, 15 nt, Homo sapiens
cuucgggaggagggg

SEQ ID NO: 31837 - RNA, 22 nt, Homo sapiens
gccuguggucuuagcuacuugg

SEQ ID NO: 31838 - RNA, 18 nt, Homo sapiens
gcgggcacagcacgcugg

SEQ ID NO: 31839 - RNA, 18 nt, Homo sapiens
ggggagagguucggggga

SEQ ID NO: 31840 - RNA, 18 nt, Homo sapiens
ugacagccuguugggggc

SEQ ID NO: 31841 - RNA, 17 nt, Homo sapiens
agcagggcaauuggaac

SEQ ID NO: 31842 - RNA, 18 nt, Homo sapiens
agccagcugcuagcugcc

SEQ ID NO: 31843 - RNA, 17 nt, Homo sapiens
aguggaaggagaaggga

SEQ ID NO: 31844 - RNA, 22 nt, Homo sapiens
gaaagaggcauuuccucauguu

SEQ ID NO: 31845 - RNA, 17 nt, Homo sapiens
ggaaggagaagggaggc

SEQ ID NO: 31846 - RNA, 21 nt, Homo sapiens
gggagcacaggugcuucuggc

SEQ ID NO: 31847 - RNA, 15 nt, Homo sapiens
acggaggagugagga

SEQ ID NO: 31848 - RNA, 19 nt, Homo sapiens
acggaggagugaggaggca

SEQ ID NO: 31849 - RNA, 18 nt, Homo sapiens
aggggcagggggagggga

SEQ ID NO: 31850 - RNA, 14 nt, Homo sapiens
caucuuggucccca

SEQ ID NO: 31851 - RNA, 24 nt, Homo sapiens
gaggaggcaggcauuggggguggg

SEQ ID NO: 31852 - RNA, 19 nt, Homo sapiens
gcggcugcggggcgcggcg

SEQ ID NO: 31853 - RNA, 19 nt, Homo sapiens
gggauuugcagagcugggc

SEQ ID NO: 31854 - RNA, 20 nt, Homo sapiens
ggggaggugaggggcagggg

SEQ ID NO: 31855 - RNA, 26 nt, Homo sapiens
gggguggggaggugaggcuugggugg

SEQ ID NO: 31856 - RNA, 16 nt, Homo sapiens
ugagaggaggcuggac

SEQ ID NO: 31857 - RNA, 20 nt, Homo sapiens
ugaggaggcaggcauugggg

SEQ ID NO: 31858 - RNA, 15 nt, Homo sapiens
agccaggcugaguug

SEQ ID NO: 31859 - RNA, 22 nt, Homo sapiens
uagauggucuuguggccccugg

SEQ ID NO: 31860 - RNA, 15 nt, Homo sapiens
uuccagaugaaggga

SEQ ID NO: 31861 - RNA, 22 nt, Homo sapiens
uuccuggauggugauaaucagc

SEQ ID NO: 31862 - RNA, 19 nt, Homo sapiens
agagaggaggagaaaagaa

SEQ ID NO: 31863 - RNA, 19 nt, Homo sapiens
gaggaggaagggagcacua

SEQ ID NO: 31864 - RNA, 19 nt, Homo sapiens
guggggaugggcagagucu

SEQ ID NO: 31865 - RNA, 21 nt, Homo sapiens
ucggggugggguggggauggg

SEQ ID NO: 31866 - RNA, 17 nt, Homo sapiens
ugggguggggaugggca

SEQ ID NO: 31867 - RNA, 18 nt, Homo sapiens
aggcggcgaugcugggcc

SEQ ID NO: 31868 - RNA, 20 nt, Homo sapiens
aggggcugacuccauuagcg

SEQ ID NO: 31869 - RNA, 22 nt, Homo sapiens
agucauggucgagucggaccug

SEQ ID NO: 31870 - RNA, 20 nt, Homo sapiens
cagcguggggaugauaaaaa

SEQ ID NO: 31871 - RNA, 16 nt, Homo sapiens
cagggcccucgcccgc

SEQ ID NO: 31872 - RNA, 16 nt, Homo sapiens
cagugcugccagagac

SEQ ID NO: 31873 - RNA, 19 nt, Homo sapiens
caguuguaacguguggugu

SEQ ID NO: 31874 - RNA, 27 nt, Homo sapiens
ccgcacgcgcgccccacgcuucggccg

SEQ ID NO: 31875 - RNA, 19 nt, Homo sapiens
ccgcuuggccgccgcugcc

SEQ ID NO: 31876 - RNA, 24 nt, Homo sapiens
ccugcaccccccaucaugucugcc

SEQ ID NO: 31877 - RNA, 18 nt, Homo sapiens
gcccgccgcgcuccugac

SEQ ID NO: 31878 - RNA, 18 nt, Homo sapiens
gccgcuuggccgccgcug

SEQ ID NO: 31879 - RNA, 20 nt, Homo sapiens
gccuggggcagaccaccugc

SEQ ID NO: 31880 - RNA, 24 nt, Homo sapiens
gcgcggcguggccguggccgcggc

SEQ ID NO: 31881 - RNA, 19 nt, Homo sapiens
ggagguaccuacggagaaa

SEQ ID NO: 31882 - RNA, 21 nt, Homo sapiens
guggaggugguccacacaggg

SEQ ID NO: 31883 - RNA, 21 nt, Homo sapiens
uccaccagucccuggaacccg

SEQ ID NO: 31884 - RNA, 22 nt, Homo sapiens
ucccuggaacccggcaggucag

SEQ ID NO: 31885 - RNA, 22 nt, Homo sapiens
ucugagcuugguggaggugguc

SEQ ID NO: 31886 - RNA, 20 nt, Homo sapiens
ugcccuuuccacuuacacag

SEQ ID NO: 31887 - RNA, 19 nt, Homo sapiens
uucaaacaugucuuugaua

SEQ ID NO: 31888 - RNA, 17 nt, Homo sapiens
cccugaggccggccugg

SEQ ID NO: 31889 - RNA, 24 nt, Homo sapiens
ccgggggggccaggccgacguucc

SEQ ID NO: 31890 - RNA, 19 nt, Homo sapiens
gccgcagccaguuggccug

SEQ ID NO: 31891 - RNA, 16 nt, Homo sapiens
ggcguccugacccuga

SEQ ID NO: 31892 - RNA, 19 nt, Homo sapiens
gggaggagugugggggugg

SEQ ID NO: 31893 - RNA, 15 nt, Homo sapiens
guacuucuccgccuc

SEQ ID NO: 31894 - RNA, 22 nt, Homo sapiens
uaagaucauuguccuggucuuu

SEQ ID NO: 31895 - RNA, 17 nt, Homo sapiens
uacuucuccgccucguc

SEQ ID NO: 31896 - RNA, 16 nt, Homo sapiens
ucgcaccuucaucucu

SEQ ID NO: 31897 - RNA, 18 nt, Homo sapiens
ucucugacaccuuguagc

SEQ ID NO: 31898 - RNA, 19 nt, Homo sapiens
uucccugggcggucagggc

SEQ ID NO: 31899 - RNA, 21 nt, Homo sapiens
cccccaucaucucugacuguc

SEQ ID NO: 31900 - RNA, 18 nt, Homo sapiens
agaggcaggcucagcucc

SEQ ID NO: 31901 - RNA, 19 nt, Homo sapiens
agcagaugcguggaauuca

SEQ ID NO: 31902 - RNA, 17 nt, Homo sapiens
caacccuagaaagauca

SEQ ID NO: 31903 - RNA, 21 nt, Homo sapiens
ccgggcccaagauggcuccgg

SEQ ID NO: 31904 - RNA, 18 nt, Homo sapiens
gaggaaauggaccgcagg

SEQ ID NO: 31905 - RNA, 21 nt, Homo sapiens
gggaaaaaaggggggccuggc

SEQ ID NO: 31906 - RNA, 16 nt, Homo sapiens
gggggugagugggggu

SEQ ID NO: 31907 - RNA, 18 nt, Homo sapiens
guuaagccaacaggauuu

SEQ ID NO: 31908 - RNA, 18 nt, Homo sapiens
uaagucaugauuaucuga

SEQ ID NO: 31909 - RNA, 24 nt, Homo sapiens
uagcaaacacaaagggaaaggaaa

SEQ ID NO: 31910 - RNA, 21 nt, Homo sapiens
ucuuggagucacaaccaagac

SEQ ID NO: 31911 - RNA, 19 nt, Homo sapiens
ugaagaggagaggggcugc

SEQ ID NO: 31912 - RNA, 21 nt, Homo sapiens
ugcccucugagggggaaaagg

SEQ ID NO: 31913 - RNA, 20 nt, Homo sapiens
ugggggaaaaaaggggggcc

SEQ ID NO: 31914 - RNA, 16 nt, Homo sapiens
uucccagcugccggag

SEQ ID NO: 31915 - RNA, 19 nt, Homo sapiens
ucaaaaaaggccacauacu

SEQ ID NO: 31916 - RNA, 19 nt, Homo sapiens
uccaacaauucaucacucu

SEQ ID NO: 31917 - RNA, 25 nt, Homo sapiens
uuuaaaaaucagaauaauagguaga

SEQ ID NO: 31918 - RNA, 21 nt, Homo sapiens
accagcaaguuuuuucugggu

SEQ ID NO: 31919 - RNA, 21 nt, Homo sapiens
aggaagggcaccagcuucuuc

SEQ ID NO: 31920 - RNA, 18 nt, Homo sapiens
caggaucauccuuucagc

SEQ ID NO: 31921 - RNA, 17 nt, Homo sapiens
cgcccuccuccccuucc

SEQ ID NO: 31922 - RNA, 14 nt, Homo sapiens
ggacccauggcgag

SEQ ID NO: 31923 - RNA, 21 nt, Homo sapiens
guggguuccagcucgugcucg

SEQ ID NO: 31924 - RNA, 18 nt, Homo sapiens
ucgaagcuggagguggug

SEQ ID NO: 31925 - RNA, 18 nt, Homo sapiens
uggugcuggggcaccagg

SEQ ID NO: 31926 - RNA, 17 nt, Homo sapiens
acgguggagucugggga

SEQ ID NO: 31927 - RNA, 18 nt, Homo sapiens
aggccccgggcccgcggc

SEQ ID NO: 31928 - RNA, 15 nt, Homo sapiens
agggguguuggucca

SEQ ID NO: 31929 - RNA, 17 nt, Homo sapiens
caaauggaauguucuau

SEQ ID NO: 31930 - RNA, 19 nt, Homo sapiens
caccgggguauggggagcc

SEQ ID NO: 31931 - RNA, 19 nt, Homo sapiens
cagcacggguaccgucgcc

SEQ ID NO: 31932 - RNA, 19 nt, Homo sapiens
ccgcuagcugccgcccgcc

SEQ ID NO: 31933 - RNA, 18 nt, Homo sapiens
ccggagcuggugccccgg

SEQ ID NO: 31934 - RNA, 17 nt, Homo sapiens
ccuccgcgcgcugcggc

SEQ ID NO: 31935 - RNA, 15 nt, Homo sapiens
cggcgcgcucgcggc

SEQ ID NO: 31936 - RNA, 24 nt, Homo sapiens
cgggcgugugcccgcguccccggc

SEQ ID NO: 31937 - RNA, 20 nt, Homo sapiens
cguggccgcccagcucccgg

SEQ ID NO: 31938 - RNA, 17 nt, Homo sapiens
cugguaccaggcauuug

SEQ ID NO: 31939 - RNA, 16 nt, Homo sapiens
cuguggcagggagggg

SEQ ID NO: 31940 - RNA, 17 nt, Homo sapiens
gagcaucuuacccgaug

SEQ ID NO: 31941 - RNA, 21 nt, Homo sapiens
gaguacugguccaggggcaug

SEQ ID NO: 31942 - RNA, 17 nt, Homo sapiens
gccuguggcagggaggg

SEQ ID NO: 31943 - RNA, 19 nt, Homo sapiens
gcgcucggugcucggcgcc

SEQ ID NO: 31944 - RNA, 17 nt, Homo sapiens
gcucccguccgccaccc

SEQ ID NO: 31945 - RNA, 17 nt, Homo sapiens
gcuccggcccgccgccc

SEQ ID NO: 31946 - RNA, 19 nt, Homo sapiens
ggaggcggggcggggggag

SEQ ID NO: 31947 - RNA, 19 nt, Homo sapiens
gggagggcguguggguggc

SEQ ID NO: 31948 - RNA, 18 nt, Homo sapiens
guaguugcccuugucaga

SEQ ID NO: 31949 - RNA, 22 nt, Homo sapiens
gucgcaagagcuccgcggccgg

SEQ ID NO: 31950 - RNA, 18 nt, Homo sapiens
guggagaggagguggagg

SEQ ID NO: 31951 - RNA, 16 nt, Homo sapiens
guggcagucagcggcg

SEQ ID NO: 31952 - RNA, 20 nt, Homo sapiens
guggugggcccagcaggcug

SEQ ID NO: 31953 - RNA, 22 nt, Homo sapiens
uaauuuaaaaaaauaaaacagc

SEQ ID NO: 31954 - RNA, 20 nt, Homo sapiens
uccgccguggcuugugcgag

SEQ ID NO: 31955 - RNA, 17 nt, Homo sapiens
ucggucccguccggacg

SEQ ID NO: 31956 - RNA, 21 nt, Homo sapiens
ugaaggcaggccacacaggaa

SEQ ID NO: 31957 - RNA, 18 nt, Homo sapiens
ugaaguggcuggcagcaa

SEQ ID NO: 31958 - RNA, 19 nt, Homo sapiens
ugagggcacugcaugccag

SEQ ID NO: 31959 - RNA, 20 nt, Homo sapiens
ugccugguggcagggagggg

SEQ ID NO: 31960 - RNA, 17 nt, Homo sapiens
uggaauguucuauuugu

SEQ ID NO: 31961 - RNA, 19 nt, Homo sapiens
ugggacaaagagguaaaca

SEQ ID NO: 31962 - RNA, 19 nt, Homo sapiens
ugggaggggaugaaguggc

SEQ ID NO: 31963 - RNA, 21 nt, Homo sapiens
uucuggguucaagcaguuagc

SEQ ID NO: 31964 - RNA, 20 nt, Homo sapiens
ccaagaauaucaauaaauac

SEQ ID NO: 31965 - RNA, 22 nt, Homo sapiens
gcaggaaguggggacugagcuc

SEQ ID NO: 31966 - RNA, 19 nt, Homo sapiens
ugagugugcaaaaaauaau

SEQ ID NO: 31967 - RNA, 17 nt, Homo sapiens
caagaacugagaggccg

SEQ ID NO: 31968 - RNA, 25 nt, Homo sapiens
cccccaccgaagcagcagaugccug

SEQ ID NO: 31969 - RNA, 18 nt, Homo sapiens
cggcccccuuccugccgc

SEQ ID NO: 31970 - RNA, 22 nt, Homo sapiens
gaaggggaacucggccuccucc

SEQ ID NO: 31971 - RNA, 22 nt, Homo sapiens
gaagguggggagagaggggugg

SEQ ID NO: 31972 - RNA, 23 nt, Homo sapiens
ggaagguggggagagaggggugg

SEQ ID NO: 31973 - RNA, 16 nt, Homo sapiens
ggggagagaggggugg

SEQ ID NO: 31974 - RNA, 18 nt, Homo sapiens
ucaagagccagaaacuca

SEQ ID NO: 31975 - RNA, 18 nt, Homo sapiens
ucucucaacaauaacugc

SEQ ID NO: 31976 - RNA, 18 nt, Homo sapiens
ugugacaaaccgugcuca

SEQ ID NO: 31977 - RNA, 27 nt, Homo sapiens
uuuuucauuucccaauuuguuuuuuuc

SEQ ID NO: 31978 - RNA, 18 nt, Homo sapiens
uggcggugggcggcuccg

SEQ ID NO: 31979 - RNA, 20 nt, Homo sapiens
acaaauuuaggaacuuuugc

SEQ ID NO: 31980 - RNA, 24 nt, Homo sapiens
uauaacacacucuuuauggagagc

SEQ ID NO: 31981 - RNA, 23 nt, Homo sapiens
uucagcagucccauuuugugcau

SEQ ID NO: 31982 - RNA, 16 nt, Homo sapiens
cucccggcgcgcugcg

SEQ ID NO: 31983 - RNA, 23 nt, Homo sapiens
ugccuggcgggaaggaaacacgc

SEQ ID NO: 31984 - RNA, 19 nt, Homo sapiens
gaagauuuacaagguauac

SEQ ID NO: 31985 - RNA, 18 nt, Homo sapiens
ugcuuuucuuuuaaaagc

SEQ ID NO: 31986 - RNA, 23 nt, Homo sapiens
agagggaugggccccgaacaccc

SEQ ID NO: 31987 - RNA, 17 nt, Homo sapiens
ucacagacggaggggag

SEQ ID NO: 31988 - RNA, 22 nt, Homo sapiens
uccugcugcagccaacaguggc

SEQ ID NO: 31989 - RNA, 19 nt, Homo sapiens
aagaaucacagaugaaaga

SEQ ID NO: 31990 - RNA, 16 nt, Homo sapiens
gaaaguugguuaaguu

SEQ ID NO: 31991 - RNA, 15 nt, Homo sapiens
gaaggaaaguuggua

SEQ ID NO: 31992 - RNA, 20 nt, Homo sapiens
ggcgaggcggcgaggcgaga

SEQ ID NO: 31993 - RNA, 16 nt, Homo sapiens
uccaguaaguucuugg

SEQ ID NO: 31994 - RNA, 18 nt, Homo sapiens
uuaguauauggaacaugc

SEQ ID NO: 31995 - RNA, 18 nt, Homo sapiens
caggcggagcauggaagc

SEQ ID NO: 31996 - RNA, 23 nt, Homo sapiens
aaccaucaauggcauuuuauugu

SEQ ID NO: 31997 - RNA, 25 nt, Homo sapiens
ccuuugcucacuacagcuguagaca

SEQ ID NO: 31998 - RNA, 19 nt, Homo sapiens
gcacagaguuaagagggcu

SEQ ID NO: 31999 - RNA, 23 nt, Homo sapiens
gcauuaugguucauguguaguaa

SEQ ID NO: 32000 - RNA, 15 nt, Homo sapiens
ggcgcuucuccuuuc

SEQ ID NO: 32001 - RNA, 22 nt, Homo sapiens
ugauaaacaggggcauuugugc

SEQ ID NO: 32002 - RNA, 22 nt, Homo sapiens
aggaugguggcagacaugcugg

SEQ ID NO: 32003 - RNA, 23 nt, Homo sapiens
cccgccucuggauucuuuuaggu

SEQ ID NO: 32004 - RNA, 14 nt, Homo sapiens
ugccuggugagcuc

SEQ ID NO: 32005 - RNA, 18 nt, Homo sapiens
ugguuacaaaggcauuau

SEQ ID NO: 32006 - RNA, 23 nt, Homo sapiens
uuuacauacauucagcccaaauc

SEQ ID NO: 32007 - RNA, 15 nt, Homo sapiens
caucccucccccacc

SEQ ID NO: 32008 - RNA, 19 nt, Homo sapiens
ccaguccgcgcgcgcuccc

SEQ ID NO: 32009 - RNA, 18 nt, Homo sapiens
ccgcgcgcgcucccggcc

SEQ ID NO: 32010 - RNA, 20 nt, Homo sapiens
gcgcgcucccggccuggggc

SEQ ID NO: 32011 - RNA, 19 nt, Homo sapiens
gcuuggggcuccggcuccg

SEQ ID NO: 32012 - RNA, 15 nt, Homo sapiens
guccauguugacacc

SEQ ID NO: 32013 - RNA, 18 nt, Homo sapiens
gucgcugggguggcacgc

SEQ ID NO: 32014 - RNA, 19 nt, Homo sapiens
ucccaggaucugggcacag

SEQ ID NO: 32015 - RNA, 22 nt, Homo sapiens
accccaggugcccacucucagc

SEQ ID NO: 32016 - RNA, 22 nt, Homo sapiens
agcuguuuccacacagccuggg

SEQ ID NO: 32017 - RNA, 19 nt, Homo sapiens
agguggggguuugaagagg

SEQ ID NO: 32018 - RNA, 19 nt, Homo sapiens
aguggaaggagaaacggga

SEQ ID NO: 32019 - RNA, 23 nt, Homo sapiens
cuugccugauucccuucggagcc

SEQ ID NO: 32020 - RNA, 22 nt, Homo sapiens
gggagaggggagaauaggagga

SEQ ID NO: 32021 - RNA, 22 nt, Homo sapiens
gggggcccgguaccccaggugc

SEQ ID NO: 32022 - RNA, 27 nt, Homo sapiens
ugagaggacaggguggggccucgcuga

SEQ ID NO: 32023 - RNA, 23 nt, Homo sapiens
uugaagaggggagaggggagaau

SEQ ID NO: 32024 - RNA, 24 nt, Homo sapiens
uugaagaggggagaggggagaaua

SEQ ID NO: 32025 - RNA, 15 nt, Homo sapiens
ccagggcguggcggc

SEQ ID NO: 32026 - RNA, 20 nt, Homo sapiens
gccggcgcugacagcagagg

SEQ ID NO: 32027 - RNA, 23 nt, Homo sapiens
acuuuaguauaagccucucagcu

SEQ ID NO: 32028 - RNA, 20 nt, Homo sapiens
cagaucacuuucucccucac

SEQ ID NO: 32029 - RNA, 19 nt, Homo sapiens
cagcagcagcacagcacuc

SEQ ID NO: 32030 - RNA, 20 nt, Homo sapiens
gccccucgggcaggaagcag

SEQ ID NO: 32031 - RNA, 20 nt, Homo sapiens
uaauguacuggugaugaagc

SEQ ID NO: 32032 - RNA, 18 nt, Homo sapiens
acugaucaccacuuccuu

SEQ ID NO: 32033 - RNA, 19 nt, Homo sapiens
caccauuagacacaucauc

SEQ ID NO: 32034 - RNA, 19 nt, Homo sapiens
cagcgccugcucggagacg

SEQ ID NO: 32035 - RNA, 17 nt, Homo sapiens
ccgccgcucucaagccc

SEQ ID NO: 32036 - RNA, 21 nt, Homo sapiens
gguucggccgccgccgccgag

SEQ ID NO: 32037 - RNA, 23 nt, Homo sapiens
gguucggccgccgccgccgaggc

SEQ ID NO: 32038 - RNA, 20 nt, Homo sapiens
gucaggauccgacucgguug

SEQ ID NO: 32039 - RNA, 19 nt, Homo sapiens
uagcugagaguucagaucu

SEQ ID NO: 32040 - RNA, 18 nt, Homo sapiens
uaucucucauaagccuau

SEQ ID NO: 32041 - RNA, 22 nt, Homo sapiens
ugaugaacaaguggaaaauacu

SEQ ID NO: 32042 - RNA, 18 nt, Homo sapiens
uuugcccaucacuauauc

SEQ ID NO: 32043 - RNA, 22 nt, Homo sapiens
uauucaaaaagggaaguauagg

SEQ ID NO: 32044 - RNA, 18 nt, Homo sapiens
cugucuugagcgcucccc

SEQ ID NO: 32045 - RNA, 21 nt, Homo sapiens
guggguacagagucuggcugg

SEQ ID NO: 32046 - RNA, 19 nt, Homo sapiens
uacagagucuggcugggga

SEQ ID NO: 32047 - RNA, 20 nt, Homo sapiens
uuuauuguuacugaggcugu

SEQ ID NO: 32048 - RNA, 21 nt, Homo sapiens
aaguggaggggcacagggaag

SEQ ID NO: 32049 - RNA, 24 nt, Homo sapiens
accccaccccccggucccccuccc

SEQ ID NO: 32050 - RNA, 18 nt, Homo sapiens
ccaggcugagagggaggc

SEQ ID NO: 32051 - RNA, 15 nt, Homo sapiens
gcccuuggaggaagc

SEQ ID NO: 32052 - RNA, 22 nt, Homo sapiens
ggagagccagggagagacugac

SEQ ID NO: 32053 - RNA, 19 nt, Homo sapiens
gugaguuuuccagaacaag

SEQ ID NO: 32054 - RNA, 17 nt, Homo sapiens
uccagaacaaguggagg

SEQ ID NO: 32055 - RNA, 19 nt, Homo sapiens
ugacagacacagggcucug

SEQ ID NO: 32056 - RNA, 21 nt, Homo sapiens
aaggacacuagaguuacaugg

SEQ ID NO: 32057 - RNA, 20 nt, Homo sapiens
cacucgagggggaggaagug

SEQ ID NO: 32058 - RNA, 24 nt, Homo sapiens
cacuuguaucuguuaaccacucua

SEQ ID NO: 32059 - RNA, 23 nt, Homo sapiens
ccuuccgaaugcguuccggaucc

SEQ ID NO: 32060 - RNA, 23 nt, Homo sapiens
ggggaggaaguggagaugggggg

SEQ ID NO: 32061 - RNA, 22 nt, Homo sapiens
uaucuuuucaguccaaaaacua

SEQ ID NO: 32062 - RNA, 18 nt, Homo sapiens
ucccucacaggcgcugac

SEQ ID NO: 32063 - RNA, 19 nt, Homo sapiens
ugcaucuugaguguucaaa

SEQ ID NO: 32064 - RNA, 19 nt, Homo sapiens
uggcagacgaagcaggguu

SEQ ID NO: 32065 - RNA, 16 nt, Homo sapiens
ccuagaauggagaaag

SEQ ID NO: 32066 - RNA, 21 nt, Homo sapiens
cuucucacuauaagcuauuua

SEQ ID NO: 32067 - RNA, 19 nt, Homo sapiens
gaacauuuucaucuggggu

SEQ ID NO: 32068 - RNA, 18 nt, Homo sapiens
ugaggggaaccacuggaa

SEQ ID NO: 32069 - RNA, 22 nt, Homo sapiens
uggguacaaacugaacauuuuc

SEQ ID NO: 32070 - RNA, 19 nt, Homo sapiens
ugguagacaugugaauugu

SEQ ID NO: 32071 - RNA, 17 nt, Homo sapiens
cacccugcuguccugcc

SEQ ID NO: 32072 - RNA, 19 nt, Homo sapiens
gcucuuguacccaucccug

SEQ ID NO: 32073 - RNA, 23 nt, Homo sapiens
uguaacucugauaccaaaauaug

SEQ ID NO: 32074 - RNA, 18 nt, Homo sapiens
ccgccccggcccgccccc

SEQ ID NO: 32075 - RNA, 26 nt, Homo sapiens
ccuaaaaaaaggaaaaaaaacacgcu

SEQ ID NO: 32076 - RNA, 19 nt, Homo sapiens
ccuggccccgccccggccc

SEQ ID NO: 32077 - RNA, 16 nt, Homo sapiens
gccccggcccgccccc

SEQ ID NO: 32078 - RNA, 21 nt, Homo sapiens
gcuuguauacuuuucuaaaca

SEQ ID NO: 32079 - RNA, 21 nt, Homo sapiens
uaaaaaaaggaaaaaaaacac

SEQ ID NO: 32080 - RNA, 23 nt, Homo sapiens
acaggacugguuacagagcugga

SEQ ID NO: 32081 - RNA, 23 nt, Homo sapiens
agucccaggcuggcugcagcccc

SEQ ID NO: 32082 - RNA, 18 nt, Homo sapiens
aucucguugacacaacug

SEQ ID NO: 32083 - RNA, 19 nt, Homo sapiens
caccaagcaccuucucugg

SEQ ID NO: 32084 - RNA, 15 nt, Homo sapiens
cuagaagaugaggcg

SEQ ID NO: 32085 - RNA, 21 nt, Homo sapiens
cuccugcugggcugugcggca

SEQ ID NO: 32086 - RNA, 16 nt, Homo sapiens
cuggccccugcaggau

SEQ ID NO: 32087 - RNA, 18 nt, Homo sapiens
cuuguccuuuuauuugug

SEQ ID NO: 32088 - RNA, 21 nt, Homo sapiens
gaaaacaguagcaccccuccc

SEQ ID NO: 32089 - RNA, 24 nt, Homo sapiens
gccugagaccucgcacaagccucc

SEQ ID NO: 32090 - RNA, 20 nt, Homo sapiens
gccugugugugcagcagagg

SEQ ID NO: 32091 - RNA, 18 nt, Homo sapiens
gcuucuccagucccugcc

SEQ ID NO: 32092 - RNA, 17 nt, Homo sapiens
ggagggcagcagagagc

SEQ ID NO: 32093 - RNA, 23 nt, Homo sapiens
ggcagguugcugaccaggccaug

SEQ ID NO: 32094 - RNA, 17 nt, Homo sapiens
ggcaucccugcuggugc

SEQ ID NO: 32095 - RNA, 19 nt, Homo sapiens
gggcaagaaggaaacgaca

SEQ ID NO: 32096 - RNA, 20 nt, Homo sapiens
gugugaugugcugaaccuca

SEQ ID NO: 32097 - RNA, 18 nt, Homo sapiens
ucugcuugucgcagcauu

SEQ ID NO: 32098 - RNA, 22 nt, Homo sapiens
ugugugaugugcugaaccucac

SEQ ID NO: 32099 - RNA, 19 nt, Homo sapiens
uuuaaaaaacauuauauac

SEQ ID NO: 32100 - RNA, 15 nt, Homo sapiens
ugggagaggaaccuu

SEQ ID NO: 32101 - RNA, 23 nt, Homo sapiens
cccgcggacggcggcagcagagg

SEQ ID NO: 32102 - RNA, 19 nt, Homo sapiens
cgcgggggccgggcagcgg

SEQ ID NO: 32103 - RNA, 20 nt, Homo sapiens
gcgccccgcagcccggcagc

SEQ ID NO: 32104 - RNA, 21 nt, Homo sapiens
gcggcagcagaggcggcggcg

SEQ ID NO: 32105 - RNA, 16 nt, Homo sapiens
gcggggaagcagcagc

SEQ ID NO: 32106 - RNA, 16 nt, Homo sapiens
gggggccgggcagcgg

SEQ ID NO: 32107 - RNA, 21 nt, Homo sapiens
uccagggacugggcucagccc

SEQ ID NO: 32108 - RNA, 18 nt, Homo sapiens
ugcaacucugcagcagca

SEQ ID NO: 32109 - RNA, 15 nt, Homo sapiens
gccgcggcgggcgcc

SEQ ID NO: 32110 - RNA, 19 nt, Homo sapiens
guuccaggcaucacagugc

SEQ ID NO: 32111 - RNA, 21 nt, Homo sapiens
aaaaaagccuuauaaaaauau

SEQ ID NO: 32112 - RNA, 19 nt, Homo sapiens
agggggagguggggauggu

SEQ ID NO: 32113 - RNA, 22 nt, Homo sapiens
auaaaaaagccuuauaaaaaua

SEQ ID NO: 32114 - RNA, 18 nt, Homo sapiens
cagaguagaagaaugguu

SEQ ID NO: 32115 - RNA, 18 nt, Homo sapiens
guggggaugguuaauggg

SEQ ID NO: 32116 - RNA, 19 nt, Homo sapiens
uacacguauuucacauugc

SEQ ID NO: 32117 - RNA, 19 nt, Homo sapiens
uauaaaacagcaaucuaua

SEQ ID NO: 32118 - RNA, 22 nt, Homo sapiens
ucauucuccaugauacacguau

SEQ ID NO: 32119 - RNA, 28 nt, Homo sapiens
agacuuuguucaaguucuagaguuucuc

SEQ ID NO: 32120 - RNA, 18 nt, Homo sapiens
aggagacugcaggcggcc

SEQ ID NO: 32121 - RNA, 16 nt, Homo sapiens
aggggcaugcaggacc

SEQ ID NO: 32122 - RNA, 27 nt, Homo sapiens
cacccagagaggagacugcaggcggcc

SEQ ID NO: 32123 - RNA, 18 nt, Homo sapiens
cccuuuccuccuccaggc

SEQ ID NO: 32124 - RNA, 16 nt, Homo sapiens
cggccugcuccuuccc

SEQ ID NO: 32125 - RNA, 17 nt, Homo sapiens
gggaaggagcgggccgg

SEQ ID NO: 32126 - RNA, 23 nt, Homo sapiens
gggaggagcugggaaggagcggg

SEQ ID NO: 32127 - RNA, 23 nt, Homo sapiens
gggccggcaucucccugcuguuu

SEQ ID NO: 32128 - RNA, 21 nt, Homo sapiens
ggggaggagcugggaaggagc

SEQ ID NO: 32129 - RNA, 23 nt, Homo sapiens
ggggaggagcugggaaggagcgg

SEQ ID NO: 32130 - RNA, 16 nt, Homo sapiens
ugcaggcggccgugcu

SEQ ID NO: 32131 - RNA, 20 nt, Homo sapiens
ugggguguggggagggagag

SEQ ID NO: 32132 - RNA, 21 nt, Homo sapiens
uuagcgggcacggggaggagc

SEQ ID NO: 32133 - RNA, 18 nt, Homo sapiens
uuuucccccugucuccuu

SEQ ID NO: 32134 - RNA, 20 nt, Homo sapiens
agugaucugcccauucggcc

SEQ ID NO: 32135 - RNA, 22 nt, Homo sapiens
caagugaucugcccauucggcc

SEQ ID NO: 32136 - RNA, 18 nt, Homo sapiens
ccugcuuuucuacccguc

SEQ ID NO: 32137 - RNA, 16 nt, Homo sapiens
cuccuuucuccgcucc

SEQ ID NO: 32138 - RNA, 19 nt, Homo sapiens
gauuacaggcgugugccac

SEQ ID NO: 32139 - RNA, 16 nt, Homo sapiens
ucuccgcuccuccugc

SEQ ID NO: 32140 - RNA, 17 nt, Homo sapiens
ccccucggcgggugggg

SEQ ID NO: 32141 - RNA, 18 nt, Homo sapiens
ccggcccgaguccuccuc

SEQ ID NO: 32142 - RNA, 18 nt, Homo sapiens
gcagaagggcugucagga

SEQ ID NO: 32143 - RNA, 16 nt, Homo sapiens
gcuccggcccgagucc

SEQ ID NO: 32144 - RNA, 23 nt, Homo sapiens
uuugguuuugugugugggugugu

SEQ ID NO: 32145 - RNA, 22 nt, Homo sapiens
acacuuuuccaucuaaugggga

SEQ ID NO: 32146 - RNA, 20 nt, Homo sapiens
acauauucuuuacaauuugu

SEQ ID NO: 32147 - RNA, 26 nt, Homo sapiens
agacgccggggugcugggugcccucc

SEQ ID NO: 32148 - RNA, 25 nt, Homo sapiens
agugugccguggccacagcagcgcu

SEQ ID NO: 32149 - RNA, 18 nt, Homo sapiens
caccugugggagacggga

SEQ ID NO: 32150 - RNA, 18 nt, Homo sapiens
ccagagacgccggggugc

SEQ ID NO: 32151 - RNA, 18 nt, Homo sapiens
cggcugggccccggcgcg

SEQ ID NO: 32152 - RNA, 19 nt, Homo sapiens
cuacaugcucuuacauucg

SEQ ID NO: 32153 - RNA, 22 nt, Homo sapiens
cuccggcugggccccggcgcgg

SEQ ID NO: 32154 - RNA, 21 nt, Homo sapiens
gaaauaggauuuggggaagaa

SEQ ID NO: 32155 - RNA, 18 nt, Homo sapiens
gcaacucuuucuuuuugg

SEQ ID NO: 32156 - RNA, 21 nt, Homo sapiens
gcaagggcgagggcggcggcu

SEQ ID NO: 32157 - RNA, 18 nt, Homo sapiens
ggcaagggcgagggcggc

SEQ ID NO: 32158 - RNA, 20 nt, Homo sapiens
ucaggaagggcgcuggucug

SEQ ID NO: 32159 - RNA, 19 nt, Homo sapiens
ucccguaauuauuaagguc

SEQ ID NO: 32160 - RNA, 15 nt, Homo sapiens
ugacaccaacuggcc

SEQ ID NO: 32161 - RNA, 17 nt, Homo sapiens
ugccguggccacagcag

SEQ ID NO: 32162 - RNA, 20 nt, Homo sapiens
ugcucagaaacacccugugu

SEQ ID NO: 32163 - RNA, 15 nt, Homo sapiens
uggaagugcuggugc

SEQ ID NO: 32164 - RNA, 19 nt, Homo sapiens
uuauuaaggucagaaaaau

SEQ ID NO: 32165 - RNA, 20 nt, Homo sapiens
uuuaaacaauuuauuuauau

SEQ ID NO: 32166 - RNA, 14 nt, Homo sapiens
caguggcucaggcc

SEQ ID NO: 32167 - RNA, 23 nt, Homo sapiens
uagccaacauggugaaacccugu

SEQ ID NO: 32168 - RNA, 19 nt, Homo sapiens
ugaacaggccuuguuuuuc

SEQ ID NO: 32169 - RNA, 23 nt, Homo sapiens
ugggugugguagugcgcacuugu

SEQ ID NO: 32170 - RNA, 17 nt, Homo sapiens
uugggaggccgaggcgg

SEQ ID NO: 32171 - RNA, 17 nt, Homo sapiens
ggagggagugggggagg

SEQ ID NO: 32172 - RNA, 21 nt, Homo sapiens
aggugacaucaucgcggaaaa

SEQ ID NO: 32173 - RNA, 27 nt, Homo sapiens
ccgcggcccccgcuccacgcacgcccg

SEQ ID NO: 32174 - RNA, 16 nt, Homo sapiens
gcacgcccgccugcga

SEQ ID NO: 32175 - RNA, 23 nt, Homo sapiens
gcggggauugagguuggucuggu

SEQ ID NO: 32176 - RNA, 16 nt, Homo sapiens
uaagggaauaaaauug

SEQ ID NO: 32177 - RNA, 15 nt, Homo sapiens
uacacgaaauccccu

SEQ ID NO: 32178 - RNA, 17 nt, Homo sapiens
ucugguauuacgugucu

SEQ ID NO: 32179 - RNA, 21 nt, Homo sapiens
ugccguggugccugccuucca

SEQ ID NO: 32180 - RNA, 18 nt, Homo sapiens
uggcugugaggcggccug

SEQ ID NO: 32181 - RNA, 24 nt, Homo sapiens
uugaaaugaauaagggaauaaaau

SEQ ID NO: 32182 - RNA, 19 nt, Homo sapiens
caggggccuaagguaacuc

SEQ ID NO: 32183 - RNA, 16 nt, Homo sapiens
ccacucucaaacuugu

SEQ ID NO: 32184 - RNA, 20 nt, Homo sapiens
uaacuccaacuccugccucc

SEQ ID NO: 32185 - RNA, 21 nt, Homo sapiens
ucacgggcucagggacuugga

SEQ ID NO: 32186 - RNA, 24 nt, Homo sapiens
uggcccuggguggcguggggaggg

SEQ ID NO: 32187 - RNA, 19 nt, Homo sapiens
aauugaguguccaaauccu

SEQ ID NO: 32188 - RNA, 18 nt, Homo sapiens
ggaaagaccuaacauuua

SEQ ID NO: 32189 - RNA, 20 nt, Homo sapiens
acacuggauguuuuuaucac

SEQ ID NO: 32190 - RNA, 16 nt, Homo sapiens
aucucuuccaggagcu

SEQ ID NO: 32191 - RNA, 22 nt, Homo sapiens
cagcaccucccagguuagcucu

SEQ ID NO: 32192 - RNA, 20 nt, Homo sapiens
cccaagcuuagcucccuccc

SEQ ID NO: 32193 - RNA, 20 nt, Homo sapiens
ccccagcaccaauccuuccc

SEQ ID NO: 32194 - RNA, 22 nt, Homo sapiens
ccccagccccaaauccccuccc

SEQ ID NO: 32195 - RNA, 22 nt, Homo sapiens
ccuuccuguugccccagcacca

SEQ ID NO: 32196 - RNA, 18 nt, Homo sapiens
gccccaaauccccucccc

SEQ ID NO: 32197 - RNA, 22 nt, Homo sapiens
ugagggcugggucccacucuag

SEQ ID NO: 32198 - RNA, 20 nt, Homo sapiens
ugggagacgggagggcaccc

SEQ ID NO: 32199 - RNA, 18 nt, Homo sapiens
uuggcuggaugcaguggg

SEQ ID NO: 32200 - RNA, 18 nt, Homo sapiens
aagggcacugggcggcga

SEQ ID NO: 32201 - RNA, 25 nt, Homo sapiens
cagcaggacagcgggcggaagcggg

SEQ ID NO: 32202 - RNA, 19 nt, Homo sapiens
cagcgggcggaagcggggc

SEQ ID NO: 32203 - RNA, 21 nt, Homo sapiens
ccgccgcgcuuucccgcuucg

SEQ ID NO: 32204 - RNA, 18 nt, Homo sapiens
ccgcgucgccgggauuug

SEQ ID NO: 32205 - RNA, 22 nt, Homo sapiens
cggccaccccgcgaccccgcgu

SEQ ID NO: 32206 - RNA, 19 nt, Homo sapiens
cgggggcgucugcgcggcg

SEQ ID NO: 32207 - RNA, 15 nt, Homo sapiens
cugcugaacgcaucu

SEQ ID NO: 32208 - RNA, 21 nt, Homo sapiens
gcagcugccgcggcgcccgaa

SEQ ID NO: 32209 - RNA, 18 nt, Homo sapiens
gccccggcggccaccccg

SEQ ID NO: 32210 - RNA, 15 nt, Homo sapiens
gccgccggccggcag

SEQ ID NO: 32211 - RNA, 18 nt, Homo sapiens
gcgguagcuggcgacucc

SEQ ID NO: 32212 - RNA, 20 nt, Homo sapiens
gcgucgacugggcaggccgu

SEQ ID NO: 32213 - RNA, 17 nt, Homo sapiens
gcugccccggcggccac

SEQ ID NO: 32214 - RNA, 19 nt, Homo sapiens
ggcagccggagcagcugcc

SEQ ID NO: 32215 - RNA, 16 nt, Homo sapiens
uucccgcuucgcggag

SEQ ID NO: 32216 - RNA, 18 nt, Homo sapiens
aacaagguuauagaaaug

SEQ ID NO: 32217 - RNA, 17 nt, Homo sapiens
cgccggggguggugggg

SEQ ID NO: 32218 - RNA, 18 nt, Homo sapiens
gggugguggggcgcggga

SEQ ID NO: 32219 - RNA, 17 nt, Homo sapiens
ggugguggggcgcggga

SEQ ID NO: 32220 - RNA, 18 nt, Homo sapiens
uaccauacaaagaugugu

SEQ ID NO: 32221 - RNA, 19 nt, Homo sapiens
uauaaaaauuagguaugau

SEQ ID NO: 32222 - RNA, 21 nt, Homo sapiens
uauaaaaauuagguaugauau

SEQ ID NO: 32223 - RNA, 15 nt, Homo sapiens
ugaguggcucagcag

SEQ ID NO: 32224 - RNA, 18 nt, Homo sapiens
ccgccgcccuggccccgc

SEQ ID NO: 32225 - RNA, 19 nt, Homo sapiens
uccaucccucccguaaggc

SEQ ID NO: 32226 - RNA, 17 nt, Homo sapiens
ucuauagauacuuuugc

SEQ ID NO: 32227 - RNA, 23 nt, Homo sapiens
uuuaacaaucugaaaauguguuc

SEQ ID NO: 32228 - RNA, 20 nt, Homo sapiens
agggaggcgucuggguccug

SEQ ID NO: 32229 - RNA, 20 nt, Homo sapiens
cgagcggccccgggggggcc

SEQ ID NO: 32230 - RNA, 14 nt, Homo sapiens
acugucuccucuuc

SEQ ID NO: 32231 - RNA, 17 nt, Homo sapiens
cugcugccacccgccgc

SEQ ID NO: 32232 - RNA, 15 nt, Homo sapiens
gagcuucccacagac

SEQ ID NO: 32233 - RNA, 23 nt, Homo sapiens
uaacuaaccaauuacuuaagaga

SEQ ID NO: 32234 - RNA, 23 nt, Homo sapiens
uagauggagggugggaaaugcuu

SEQ ID NO: 32235 - RNA, 18 nt, Homo sapiens
ugaaaaccagggaccaaa

SEQ ID NO: 32236 - RNA, 19 nt, Homo sapiens
ugccauuaccuggggcucc

SEQ ID NO: 32237 - RNA, 19 nt, Homo sapiens
uggggaaggggaaguguca

SEQ ID NO: 32238 - RNA, 25 nt, Homo sapiens
uuccugcacauaguaguagcaaagg

SEQ ID NO: 32239 - RNA, 16 nt, Homo sapiens
uucuggaagggguaga

SEQ ID NO: 32240 - RNA, 19 nt, Homo sapiens
agccagcaggugggggugc

SEQ ID NO: 32241 - RNA, 18 nt, Homo sapiens
gaaggggagggcaggggu

SEQ ID NO: 32242 - RNA, 20 nt, Homo sapiens
gcuugcucacucuugcaucc

SEQ ID NO: 32243 - RNA, 17 nt, Homo sapiens
ggggagggcaggggugg

SEQ ID NO: 32244 - RNA, 20 nt, Homo sapiens
aagugaaugggaaaucuuuu

SEQ ID NO: 32245 - RNA, 20 nt, Homo sapiens
aagugggcagagucccggcg

SEQ ID NO: 32246 - RNA, 21 nt, Homo sapiens
aggggcggcaggcgaagccgg

SEQ ID NO: 32247 - RNA, 21 nt, Homo sapiens
cccugccacgaaggcgaccac

SEQ ID NO: 32248 - RNA, 22 nt, Homo sapiens
gaacaaacaauaucaagugaau

SEQ ID NO: 32249 - RNA, 16 nt, Homo sapiens
gcgcccgucggccggc

SEQ ID NO: 32250 - RNA, 20 nt, Homo sapiens
ggaggccucuggugagggac

SEQ ID NO: 32251 - RNA, 19 nt, Homo sapiens
agggcggggcggcgcgggg

SEQ ID NO: 32252 - RNA, 16 nt, Homo sapiens
ccgcgcaacaccaccc

SEQ ID NO: 32253 - RNA, 18 nt, Homo sapiens
ccggccccggcccgcggc

SEQ ID NO: 32254 - RNA, 19 nt, Homo sapiens
cgcggggagggggcgcggg

SEQ ID NO: 32255 - RNA, 16 nt, Homo sapiens
cggcgccccggccccg

SEQ ID NO: 32256 - RNA, 18 nt, Homo sapiens
cggcggcccccacccccg

SEQ ID NO: 32257 - RNA, 18 nt, Homo sapiens
gagaggagcggagagcgg

SEQ ID NO: 32258 - RNA, 16 nt, Homo sapiens
gcaucgauacauaucc

SEQ ID NO: 32259 - RNA, 17 nt, Homo sapiens
gcgcggggagggggcgc

SEQ ID NO: 32260 - RNA, 23 nt, Homo sapiens
gcggggagggggcgcgggggggg

SEQ ID NO: 32261 - RNA, 19 nt, Homo sapiens
ggagaggagcggagagcgg

SEQ ID NO: 32262 - RNA, 19 nt, Homo sapiens
ggcgcggggggggaaucgg

SEQ ID NO: 32263 - RNA, 23 nt, Homo sapiens
gggaaggagaggcagagggaggc

SEQ ID NO: 32264 - RNA, 19 nt, Homo sapiens
ggggcuggcgcucggcggc

SEQ ID NO: 32265 - RNA, 18 nt, Homo sapiens
uccuuuagucuuucugag

SEQ ID NO: 32266 - RNA, 18 nt, Homo sapiens
cagugaccagggccaggg

SEQ ID NO: 32267 - RNA, 24 nt, Homo sapiens
ccagggcggcuggcaggggcggcc

SEQ ID NO: 32268 - RNA, 19 nt, Homo sapiens
ggcggcuggcaggggcggc

SEQ ID NO: 32269 - RNA, 20 nt, Homo sapiens
ggugggugugggcugcccgc

SEQ ID NO: 32270 - RNA, 24 nt, Homo sapiens
uccaagguggaauggccaacgugu

SEQ ID NO: 32271 - RNA, 20 nt, Homo sapiens
ugggaagggccucccugcag

SEQ ID NO: 32272 - RNA, 16 nt, Homo sapiens
cccgccgccuccgccc

SEQ ID NO: 32273 - RNA, 19 nt, Homo sapiens
ccuccucgcuuccucaggg

SEQ ID NO: 32274 - RNA, 19 nt, Homo sapiens
cuguauccuccccuccccc

SEQ ID NO: 32275 - RNA, 16 nt, Homo sapiens
gccgccuccgcccgcc

SEQ ID NO: 32276 - RNA, 21 nt, Homo sapiens
gccgguccgcccgccucagcc

SEQ ID NO: 32277 - RNA, 17 nt, Homo sapiens
ggaaagggagcccucca

SEQ ID NO: 32278 - RNA, 23 nt, Homo sapiens
gcgggggcggggggugcuggagg

SEQ ID NO: 32279 - RNA, 21 nt, Homo sapiens
ggcgggggcggggggugcugg

SEQ ID NO: 32280 - RNA, 21 nt, Homo sapiens
ugcagcuguggugauggccug

SEQ ID NO: 32281 - RNA, 19 nt, Homo sapiens
gcccugacuaaagagaagu

SEQ ID NO: 32282 - RNA, 15 nt, Homo sapiens
uagaagaauaaaaug

SEQ ID NO: 32283 - RNA, 21 nt, Homo sapiens
ucucggggacgggaaaacgac

SEQ ID NO: 32284 - RNA, 24 nt, Homo sapiens
ugugcacauuuuccuuaaaaacac

SEQ ID NO: 32285 - RNA, 19 nt, Homo sapiens
ccccacucccggggccugg

SEQ ID NO: 32286 - RNA, 19 nt, Homo sapiens
gguccccacucccggggcc

SEQ ID NO: 32287 - RNA, 16 nt, Homo sapiens
ugaggucacugccggu

SEQ ID NO: 32288 - RNA, 20 nt, Homo sapiens
ugaggucacugccgguuguc

SEQ ID NO: 32289 - RNA, 21 nt, Homo sapiens
agaaaauaguacaugcuuucc

SEQ ID NO: 32290 - RNA, 18 nt, Homo sapiens
cagcucgcugcuucgcgu

SEQ ID NO: 32291 - RNA, 20 nt, Homo sapiens
ccgcuggccgccgccucagc

SEQ ID NO: 32292 - RNA, 16 nt, Homo sapiens
cuggucuuuccacuag

SEQ ID NO: 32293 - RNA, 18 nt, Homo sapiens
uacaugcuuuccuauuac

SEQ ID NO: 32294 - RNA, 23 nt, Homo sapiens
ucuugcgauccauauacucucuu

SEQ ID NO: 32295 - RNA, 17 nt, Homo sapiens
cccuccacccauucaug

SEQ ID NO: 32296 - RNA, 18 nt, Homo sapiens
ccuguuggggucucugag

SEQ ID NO: 32297 - RNA, 19 nt, Homo sapiens
gcuguuucuucuuccccug

SEQ ID NO: 32298 - RNA, 20 nt, Homo sapiens
uggggagcagaacugccuug

SEQ ID NO: 32299 - RNA, 18 nt, Homo sapiens
uaguaaugcauuuuaaug

SEQ ID NO: 32300 - RNA, 20 nt, Homo sapiens
uaugugcugccgaggugagc

SEQ ID NO: 32301 - RNA, 26 nt, Homo sapiens
uccuaaacucuuuuugauauuuguuu

SEQ ID NO: 32302 - RNA, 19 nt, Homo sapiens
ugauuugguuaucaguggg

SEQ ID NO: 32303 - RNA, 18 nt, Homo sapiens
ugccaaguccuucugugu

SEQ ID NO: 32304 - RNA, 20 nt, Homo sapiens
uguuucugaugaaacagaga

SEQ ID NO: 32305 - RNA, 16 nt, Homo sapiens
uucuguguccucugug

SEQ ID NO: 32306 - RNA, 18 nt, Homo sapiens
aggaggagcaaugacguc

SEQ ID NO: 32307 - RNA, 18 nt, Homo sapiens
cuuggaaaggaguucccc

SEQ ID NO: 32308 - RNA, 19 nt, Homo sapiens
gcacgaagucagagguaua

SEQ ID NO: 32309 - RNA, 18 nt, Homo sapiens
ggucgugggagcccagcg

SEQ ID NO: 32310 - RNA, 26 nt, Homo sapiens
ucacguccagcugggagugcucaguc

SEQ ID NO: 32311 - RNA, 19 nt, Homo sapiens
uccaggauggggaggaaaa

SEQ ID NO: 32312 - RNA, 14 nt, Homo sapiens
uuuccacaacgggu

SEQ ID NO: 32313 - RNA, 19 nt, Homo sapiens
aaucguaccaaaaauagcg

SEQ ID NO: 32314 - RNA, 16 nt, Homo sapiens
agaugcgccgggcccc

SEQ ID NO: 32315 - RNA, 20 nt, Homo sapiens
cccccgcccccuccccgguc

SEQ ID NO: 32316 - RNA, 20 nt, Homo sapiens
cccgcccccggcccuggccc

SEQ ID NO: 32317 - RNA, 20 nt, Homo sapiens
cccggcccccgcccccuccc

SEQ ID NO: 32318 - RNA, 20 nt, Homo sapiens
cccgggcgggcggcggcgga

SEQ ID NO: 32319 - RNA, 18 nt, Homo sapiens
cccggucccccgcccccg

SEQ ID NO: 32320 - RNA, 25 nt, Homo sapiens
cccuggcccgcauugugcgcggucg

SEQ ID NO: 32321 - RNA, 22 nt, Homo sapiens
ccgcgccuuccaccucuggucc

SEQ ID NO: 32322 - RNA, 21 nt, Homo sapiens
cggcggcgcgggcgucagcgu

SEQ ID NO: 32323 - RNA, 18 nt, Homo sapiens
cggcgggccggcggcgcg

SEQ ID NO: 32324 - RNA, 24 nt, Homo sapiens
cgggcggcggcggagcgggcggcg

SEQ ID NO: 32325 - RNA, 18 nt, Homo sapiens
cgggcggcggcggcggcg

SEQ ID NO: 32326 - RNA, 19 nt, Homo sapiens
cgggcggcgggccggcggc

SEQ ID NO: 32327 - RNA, 17 nt, Homo sapiens
cggggggcggcgcggcg

SEQ ID NO: 32328 - RNA, 21 nt, Homo sapiens
gcggagcgggcggcggcggcg

SEQ ID NO: 32329 - RNA, 19 nt, Homo sapiens
gcgggcggcggcggcggcg

SEQ ID NO: 32330 - RNA, 21 nt, Homo sapiens
ggccggcggcgcgggcgucag

SEQ ID NO: 32331 - RNA, 23 nt, Homo sapiens
ggcggcggcggcggcggcggcgg

SEQ ID NO: 32332 - RNA, 21 nt, Homo sapiens
ggcggcggcggcgggcggcgg

SEQ ID NO: 32333 - RNA, 21 nt, Homo sapiens
ggcggcggcgggcggcgggcc

SEQ ID NO: 32334 - RNA, 17 nt, Homo sapiens
ggggggcggcgcggcgg

SEQ ID NO: 32335 - RNA, 19 nt, Homo sapiens
ggggggcggcgcggcgggg

SEQ ID NO: 32336 - RNA, 18 nt, Homo sapiens
ucacuaagcuaaucgccc

SEQ ID NO: 32337 - RNA, 17 nt, Homo sapiens
ccaggggcccauuuggg

SEQ ID NO: 32338 - RNA, 16 nt, Homo sapiens
gaggggugucuggggu

SEQ ID NO: 32339 - RNA, 21 nt, Homo sapiens
gcugcagaggggugucugggg

SEQ ID NO: 32340 - RNA, 23 nt, Homo sapiens
gggauggggucggagacugggga

SEQ ID NO: 32341 - RNA, 19 nt, Homo sapiens
gggcagagggugggggcuu

SEQ ID NO: 32342 - RNA, 14 nt, Homo sapiens
gggcuguaauuagc

SEQ ID NO: 32343 - RNA, 22 nt, Homo sapiens
uccccaucugcagcaggccucu

SEQ ID NO: 32344 - RNA, 15 nt, Homo sapiens
ucugcagcaggccuc

SEQ ID NO: 32345 - RNA, 20 nt, Homo sapiens
uggggucggagacuggggag

SEQ ID NO: 32346 - RNA, 16 nt, Homo sapiens
acacgugcccacgggg

SEQ ID NO: 32347 - RNA, 24 nt, Homo sapiens
cagcacccggcacuggcuggcagc

SEQ ID NO: 32348 - RNA, 19 nt, Homo sapiens
cagcuccugguacccuggu

SEQ ID NO: 32349 - RNA, 20 nt, Homo sapiens
cccggucuucucggaccgug

SEQ ID NO: 32350 - RNA, 15 nt, Homo sapiens
ccgcgcggcccgccc

SEQ ID NO: 32351 - RNA, 19 nt, Homo sapiens
ccucuccuuccucuccugc

SEQ ID NO: 32352 - RNA, 20 nt, Homo sapiens
cggcuggcacugcguguucu

SEQ ID NO: 32353 - RNA, 19 nt, Homo sapiens
gaagggcacagagcguggc

SEQ ID NO: 32354 - RNA, 19 nt, Homo sapiens
gaccgcccccucuccuucc

SEQ ID NO: 32355 - RNA, 18 nt, Homo sapiens
gcccggggcaaucacgcc

SEQ ID NO: 32356 - RNA, 20 nt, Homo sapiens
gcccugaccgcccccucucc

SEQ ID NO: 32357 - RNA, 19 nt, Homo sapiens
gcucccggcggaaacuguu

SEQ ID NO: 32358 - RNA, 21 nt, Homo sapiens
gcucccggcggaaacuguucc

SEQ ID NO: 32359 - RNA, 19 nt, Homo sapiens
ggagcccuguggguaagca

SEQ ID NO: 32360 - RNA, 14 nt, Homo sapiens
gggccccgccugcc

SEQ ID NO: 32361 - RNA, 23 nt, Homo sapiens
gggggguggccauagcccugcug

SEQ ID NO: 32362 - RNA, 20 nt, Homo sapiens
ggggguggccauagcccugc

SEQ ID NO: 32363 - RNA, 21 nt, Homo sapiens
gguccgccugcucuucggcuc

SEQ ID NO: 32364 - RNA, 18 nt, Homo sapiens
uggcaccacucacaggcc

SEQ ID NO: 32365 - RNA, 21 nt, Homo sapiens
uggggugccaaggauguagaa

SEQ ID NO: 32366 - RNA, 25 nt, Homo sapiens
aaaguuaccacuauaguauacaguc

SEQ ID NO: 32367 - RNA, 24 nt, Homo sapiens
aauauauauguauauauauauaua

SEQ ID NO: 32368 - RNA, 19 nt, Homo sapiens
auauauauguauauauaua

SEQ ID NO: 32369 - RNA, 21 nt, Homo sapiens
auauauauguauauauauaua

SEQ ID NO: 32370 - RNA, 23 nt, Homo sapiens
caccacccucccacccauuuccc

SEQ ID NO: 32371 - RNA, 17 nt, Homo sapiens
cuuucacaacaagcauu

SEQ ID NO: 32372 - RNA, 20 nt, Homo sapiens
gaacaccuuuuucuuuuucu

SEQ ID NO: 32373 - RNA, 18 nt, Homo sapiens
gcugggucgcaaggccuu

SEQ ID NO: 32374 - RNA, 18 nt, Homo sapiens
uaaaagugcuaagggcug

SEQ ID NO: 32375 - RNA, 25 nt, Homo sapiens
uaaauauauauguauauauauauau

SEQ ID NO: 32376 - RNA, 22 nt, Homo sapiens
uauaaauauauauguauauaua

SEQ ID NO: 32377 - RNA, 24 nt, Homo sapiens
uauaaauauauauguauauauaua

SEQ ID NO: 32378 - RNA, 25 nt, Homo sapiens
uauaaauauauauguauauauauau

SEQ ID NO: 32379 - RNA, 19 nt, Homo sapiens
uauauauauauauuauaua

SEQ ID NO: 32380 - RNA, 22 nt, Homo sapiens
uauauauauauuauauacacau

SEQ ID NO: 32381 - RNA, 18 nt, Homo sapiens
uauauauauuauauacac

SEQ ID NO: 32382 - RNA, 21 nt, Homo sapiens
uauauauguauauauauauau

SEQ ID NO: 32383 - RNA, 25 nt, Homo sapiens
uauauguauauauauauauuauaua

SEQ ID NO: 32384 - RNA, 17 nt, Homo sapiens
uccaggagcugauuagu

SEQ ID NO: 32385 - RNA, 19 nt, Homo sapiens
ugauuggcuuggaagaaaa

SEQ ID NO: 32386 - RNA, 19 nt, Homo sapiens
ugcaaugcugacugcucaa

SEQ ID NO: 32387 - RNA, 18 nt, Homo sapiens
uguuugaaaaguuaccac

SEQ ID NO: 32388 - RNA, 23 nt, Homo sapiens
uuuuugauuucaacucaaaaugu

SEQ ID NO: 32389 - RNA, 22 nt, Homo sapiens
uuuuuuuuuuugauuucaacuc

SEQ ID NO: 32390 - RNA, 15 nt, Homo sapiens
caaacuucaaauaau

SEQ ID NO: 32391 - RNA, 19 nt, Homo sapiens
ccaaaucccuuucuucucc

SEQ ID NO: 32392 - RNA, 18 nt, Homo sapiens
cccggucgcuccccgccg

SEQ ID NO: 32393 - RNA, 16 nt, Homo sapiens
cugccgccgcucccgg

SEQ ID NO: 32394 - RNA, 16 nt, Homo sapiens
gcucccggucgcuccc

SEQ ID NO: 32395 - RNA, 21 nt, Homo sapiens
uauaaaaauucagaaguguac

SEQ ID NO: 32396 - RNA, 16 nt, Homo sapiens
ucaacgcauuucuuua

SEQ ID NO: 32397 - RNA, 23 nt, Homo sapiens
ucucuccugcuguuuagcugcuu

SEQ ID NO: 32398 - RNA, 19 nt, Homo sapiens
uuuaagaguuuaauuuuca

SEQ ID NO: 32399 - RNA, 24 nt, Homo sapiens
cccagaccaugguccccaauccua

SEQ ID NO: 32400 - RNA, 16 nt, Homo sapiens
ggaggggaggacauga

SEQ ID NO: 32401 - RNA, 16 nt, Homo sapiens
ggcagcgacccccaug

SEQ ID NO: 32402 - RNA, 21 nt, Homo sapiens
gguggcaagggcugcggcgcc

SEQ ID NO: 32403 - RNA, 22 nt, Homo sapiens
uacagcacauaggaaaauacac

SEQ ID NO: 32404 - RNA, 14 nt, Homo sapiens
ucagguuccuucug

SEQ ID NO: 32405 - RNA, 18 nt, Homo sapiens
uggcaagggcugcggcgc

SEQ ID NO: 32406 - RNA, 19 nt, Homo sapiens
uaacuuguagccucaguaa

SEQ ID NO: 32407 - RNA, 19 nt, Homo sapiens
ugagaaauaugcuuaacag

SEQ ID NO: 32408 - RNA, 18 nt, Homo sapiens
gcuaccgcgcccaccucg

SEQ ID NO: 32409 - RNA, 22 nt, Homo sapiens
gggaguuauuuuucuaauuuug

SEQ ID NO: 32410 - RNA, 20 nt, Homo sapiens
uagcaacauuguaaacacca

SEQ ID NO: 32411 - RNA, 19 nt, Homo sapiens
ugcauauuauuucaccauu

SEQ ID NO: 32412 - RNA, 21 nt, Homo sapiens
uguaaugauuagcaacauugu

SEQ ID NO: 32413 - RNA, 19 nt, Homo sapiens
uguauacagguauguuuug

SEQ ID NO: 32414 - RNA, 14 nt, Homo sapiens
uguguauacaggua

SEQ ID NO: 32415 - RNA, 19 nt, Homo sapiens
accugcucuuccgcuuccg

SEQ ID NO: 32416 - RNA, 22 nt, Homo sapiens
ucguucucccuagacccguggg

SEQ ID NO: 32417 - RNA, 19 nt, Homo sapiens
ccggaaccgcaccagaggc

SEQ ID NO: 32418 - RNA, 15 nt, Homo sapiens
gcccagggagggacc

SEQ ID NO: 32419 - RNA, 18 nt, Homo sapiens
uugaggacuuuuccagaa

SEQ ID NO: 32420 - RNA, 19 nt, Homo sapiens
ucugaguacucauuguugg

SEQ ID NO: 32421 - RNA, 24 nt, Homo sapiens
cccgcggucucugggcguccucgc

SEQ ID NO: 32422 - RNA, 19 nt, Homo sapiens
uagccgcuuccuucuccac

SEQ ID NO: 32423 - RNA, 17 nt, Homo sapiens
aaacaggaaaaaagaua

SEQ ID NO: 32424 - RNA, 22 nt, Homo sapiens
aagcaucauucauauguaucca

SEQ ID NO: 32425 - RNA, 22 nt, Homo sapiens
acaaagaugguacagagugguc

SEQ ID NO: 32426 - RNA, 19 nt, Homo sapiens
acaauguguguauauaguu

SEQ ID NO: 32427 - RNA, 17 nt, Homo sapiens
accacggcgucugagau

SEQ ID NO: 32428 - RNA, 21 nt, Homo sapiens
acuuguguagauuuguauaag

SEQ ID NO: 32429 - RNA, 17 nt, Homo sapiens
cugugucauuuuaucac

SEQ ID NO: 32430 - RNA, 19 nt, Homo sapiens
guacauuuauuaucuuguu

SEQ ID NO: 32431 - RNA, 22 nt, Homo sapiens
ucuuguauuaaaacuuagauaa

SEQ ID NO: 32432 - RNA, 21 nt, Homo sapiens
uguauauaguucugugucauu

SEQ ID NO: 32433 - RNA, 22 nt, Homo sapiens
uguuauucacuuaugccuguua

SEQ ID NO: 32434 - RNA, 17 nt, Homo sapiens
aaaaaagaaaaggaggc

SEQ ID NO: 32435 - RNA, 19 nt, Homo sapiens
agcaauucugugaccugga

SEQ ID NO: 32436 - RNA, 21 nt, Homo sapiens
gaguccggggccccuucccag

SEQ ID NO: 32437 - RNA, 15 nt, Homo sapiens
ggaguccggggcccc

SEQ ID NO: 32438 - RNA, 18 nt, Homo sapiens
uaggaaauagcacuuucc

SEQ ID NO: 32439 - RNA, 24 nt, Homo sapiens
ucucucgagggaguccggggcccc

SEQ ID NO: 32440 - RNA, 19 nt, Homo sapiens
ugaacaccuccccgccugg

SEQ ID NO: 32441 - RNA, 18 nt, Homo sapiens
uggaaguugcucuggaca

SEQ ID NO: 32442 - RNA, 17 nt, Homo sapiens
cuguuguuaauuacaaa

SEQ ID NO: 32443 - RNA, 18 nt, Homo sapiens
cuuaagucuuuuuuuucu

SEQ ID NO: 32444 - RNA, 16 nt, Homo sapiens
ggcugggagacaaggg

SEQ ID NO: 32445 - RNA, 18 nt, Homo sapiens
ggcuuaaggguguuuaaa

SEQ ID NO: 32446 - RNA, 20 nt, Homo sapiens
ugggcaggggcuuggugagc

SEQ ID NO: 32447 - RNA, 22 nt, Homo sapiens
acagggccguucuacccccugg

SEQ ID NO: 32448 - RNA, 18 nt, Homo sapiens
ucaaucuccagggccacu

SEQ ID NO: 32449 - RNA, 18 nt, Homo sapiens
ugagggcuggugugcccg

SEQ ID NO: 32450 - RNA, 17 nt, Homo sapiens
cacaacuugucacaccc

SEQ ID NO: 32451 - RNA, 17 nt, Homo sapiens
gcuuacaaggggcugcu

SEQ ID NO: 32452 - RNA, 22 nt, Homo sapiens
uccagaagcugcaagaaccugu

SEQ ID NO: 32453 - RNA, 17 nt, Homo sapiens
ugaccguguggcucucc

SEQ ID NO: 32454 - RNA, 20 nt, Homo sapiens
ugaggaggaugaggccgggg

SEQ ID NO: 32455 - RNA, 19 nt, Homo sapiens
agaauaucucaucuguguu

SEQ ID NO: 32456 - RNA, 20 nt, Homo sapiens
agccaguuagacuuguuaug

SEQ ID NO: 32457 - RNA, 18 nt, Homo sapiens
aggacugcacucagcuau

SEQ ID NO: 32458 - RNA, 20 nt, Homo sapiens
gaagagcagugcuggucuuu

SEQ ID NO: 32459 - RNA, 15 nt, Homo sapiens
gaucaccagaaaaca

SEQ ID NO: 32460 - RNA, 22 nt, Homo sapiens
gcacaggcugaagaaaauaaau

SEQ ID NO: 32461 - RNA, 19 nt, Homo sapiens
ugaauuaaagcauuuuuuu

SEQ ID NO: 32462 - RNA, 21 nt, Homo sapiens
agauacguuuacaauaaagaa

SEQ ID NO: 32463 - RNA, 18 nt, Homo sapiens
auaaaaauuuaaguaugc

SEQ ID NO: 32464 - RNA, 19 nt, Homo sapiens
ugagagugauguuagauuc

SEQ ID NO: 32465 - RNA, 22 nt, Homo sapiens
acugucaaagcaggcaggcugu

SEQ ID NO: 32466 - RNA, 22 nt, Homo sapiens
aguggccgaggggucccagggg

SEQ ID NO: 32467 - RNA, 19 nt, Homo sapiens
caccagggcaucgccagga

SEQ ID NO: 32468 - RNA, 18 nt, Homo sapiens
cccacuccccccuagccc

SEQ ID NO: 32469 - RNA, 18 nt, Homo sapiens
cugcuccaccagggcauc

SEQ ID NO: 32470 - RNA, 21 nt, Homo sapiens
gagccuggggcugugugcaaa

SEQ ID NO: 32471 - RNA, 20 nt, Homo sapiens
gcugcggcugagggccuggu

SEQ ID NO: 32472 - RNA, 15 nt, Homo sapiens
ggacagagagaggga

SEQ ID NO: 32473 - RNA, 18 nt, Homo sapiens
uauguggggugggaauca

SEQ ID NO: 32474 - RNA, 18 nt, Homo sapiens
uccuauguggggugggaa

SEQ ID NO: 32475 - RNA, 21 nt, Homo sapiens
uccuccaugucuguaucuucu

SEQ ID NO: 32476 - RNA, 19 nt, Homo sapiens
ucucaggguccucuccagu

SEQ ID NO: 32477 - RNA, 22 nt, Homo sapiens
uggaaaguuuguccucgggggc

SEQ ID NO: 32478 - RNA, 22 nt, Homo sapiens
uggugugucugcacagggccug

SEQ ID NO: 32479 - RNA, 18 nt, Homo sapiens
uugaagacuuugccagag

SEQ ID NO: 32480 - RNA, 18 nt, Homo sapiens
uuuuccauuuucuuccuu

SEQ ID NO: 32481 - RNA, 23 nt, Homo sapiens
ccugcccccuccucuagauucgc

SEQ ID NO: 32482 - RNA, 16 nt, Homo sapiens
aggccggcccgcccuc

SEQ ID NO: 32483 - RNA, 17 nt, Homo sapiens
uauugaugauacacaaa

SEQ ID NO: 32484 - RNA, 20 nt, Homo sapiens
aaggguuggacuggccuccg

SEQ ID NO: 32485 - RNA, 19 nt, Homo sapiens
cugcagcuacugcgggccg

SEQ ID NO: 32486 - RNA, 19 nt, Homo sapiens
uuaacccgagcacaaaaca

SEQ ID NO: 32487 - RNA, 24 nt, Homo sapiens
agguggguggcagaggagccggag

SEQ ID NO: 32488 - RNA, 23 nt, Homo sapiens
caggggcaguggcagccugcucu

SEQ ID NO: 32489 - RNA, 18 nt, Homo sapiens
caccgccccccacccccc

SEQ ID NO: 32490 - RNA, 19 nt, Homo sapiens
cccccaccccccuuguggu

SEQ ID NO: 32491 - RNA, 19 nt, Homo sapiens
gaggcagagacuggcucua

SEQ ID NO: 32492 - RNA, 22 nt, Homo sapiens
uccugcgcccgccgcugucugc

SEQ ID NO: 32493 - RNA, 18 nt, Homo sapiens
ugggcccaggccucagag

SEQ ID NO: 32494 - RNA, 18 nt, Homo sapiens
aagagucagguucucacu

SEQ ID NO: 32495 - RNA, 19 nt, Homo sapiens
ccuaaaaagccuggaaaag

SEQ ID NO: 32496 - RNA, 21 nt, Homo sapiens
ggcaguuucugaacccguuuc

SEQ ID NO: 32497 - RNA, 23 nt, Homo sapiens
uaaaaagccuggaaaagugcaac

SEQ ID NO: 32498 - RNA, 19 nt, Homo sapiens
ucagcuuucugaauugcug

SEQ ID NO: 32499 - RNA, 21 nt, Homo sapiens
uuuauuaguauggccacaagu

SEQ ID NO: 32500 - RNA, 19 nt, Homo sapiens
aagagcuguggucaguggc

SEQ ID NO: 32501 - RNA, 18 nt, Homo sapiens
acaugugcggugucuggu

SEQ ID NO: 32502 - RNA, 20 nt, Homo sapiens
accccagcccucacuccacc

SEQ ID NO: 32503 - RNA, 16 nt, Homo sapiens
ugggagaggagguggc

SEQ ID NO: 32504 - RNA, 20 nt, Homo sapiens
ccugaagaaagagcuguggu

SEQ ID NO: 32505 - RNA, 18 nt, Homo sapiens
aaagauacuaaagaagga

SEQ ID NO: 32506 - RNA, 21 nt, Homo sapiens
aggcaagugggggaugcuggg

SEQ ID NO: 32507 - RNA, 16 nt, Homo sapiens
aggcaggcugggcugg

SEQ ID NO: 32508 - RNA, 16 nt, Homo sapiens
gaggaagagaggaaga

SEQ ID NO: 32509 - RNA, 18 nt, Homo sapiens
gaggaugcucugccauag

SEQ ID NO: 32510 - RNA, 17 nt, Homo sapiens
gcccuggcucucugcca

SEQ ID NO: 32511 - RNA, 19 nt, Homo sapiens
gcccuuggccguggcccug

SEQ ID NO: 32512 - RNA, 19 nt, Homo sapiens
gcucucugccauccuggug

SEQ ID NO: 32513 - RNA, 16 nt, Homo sapiens
ggagggaugagcagga

SEQ ID NO: 32514 - RNA, 18 nt, Homo sapiens
ggaugagcaggaggcugg

SEQ ID NO: 32515 - RNA, 24 nt, Homo sapiens
ggaugcugggggacggucucaugg

SEQ ID NO: 32516 - RNA, 20 nt, Homo sapiens
ggccuuccccaagcugggcc

SEQ ID NO: 32517 - RNA, 20 nt, Homo sapiens
guaggcuguuugugaucugg

SEQ ID NO: 32518 - RNA, 20 nt, Homo sapiens
gucggaauaauucaagccuu

SEQ ID NO: 32519 - RNA, 21 nt, Homo sapiens
uaccuggcuguucugacuuga

SEQ ID NO: 32520 - RNA, 18 nt, Homo sapiens
uacugcaucggucccaga

SEQ ID NO: 32521 - RNA, 18 nt, Homo sapiens
ucagaaguucuggcugua

SEQ ID NO: 32522 - RNA, 18 nt, Homo sapiens
ucccccagaucuucccug

SEQ ID NO: 32523 - RNA, 18 nt, Homo sapiens
ugcucuccugccccuccc

SEQ ID NO: 32524 - RNA, 18 nt, Homo sapiens
ugcugggguccuggaggg

SEQ ID NO: 32525 - RNA, 18 nt, Homo sapiens
uguccauggcaggugucc

SEQ ID NO: 32526 - RNA, 19 nt, Homo sapiens
cacggggugggagaaggca

SEQ ID NO: 32527 - RNA, 15 nt, Homo sapiens
cagcugcuccagcug

SEQ ID NO: 32528 - RNA, 14 nt, Homo sapiens
cccaaaggagaaca

SEQ ID NO: 32529 - RNA, 21 nt, Homo sapiens
ccgggccgggccgggggcgcc

SEQ ID NO: 32530 - RNA, 21 nt, Homo sapiens
ccuccuugaggaacguccucu

SEQ ID NO: 32531 - RNA, 18 nt, Homo sapiens
ccuugcccagcaccuccc

SEQ ID NO: 32532 - RNA, 19 nt, Homo sapiens
ggcccggcggggcuggggc

SEQ ID NO: 32533 - RNA, 20 nt, Homo sapiens
gggaggcgggggcggagggc

SEQ ID NO: 32534 - RNA, 23 nt, Homo sapiens
gggcagcggcguguggaaagggg

SEQ ID NO: 32535 - RNA, 18 nt, Homo sapiens
ggggggcaguuugggggg

SEQ ID NO: 32536 - RNA, 20 nt, Homo sapiens
ggggggcggggcccggcggg

SEQ ID NO: 32537 - RNA, 21 nt, Homo sapiens
gggugggugggucccaccucc

SEQ ID NO: 32538 - RNA, 19 nt, Homo sapiens
uaagucauggucccacggg

SEQ ID NO: 32539 - RNA, 21 nt, Homo sapiens
uccagcugugggcccaguggc

SEQ ID NO: 32540 - RNA, 18 nt, Homo sapiens
uccuggaugggggugggu

SEQ ID NO: 32541 - RNA, 22 nt, Homo sapiens
agugcucucucucucugucugg

SEQ ID NO: 32542 - RNA, 21 nt, Homo sapiens
ccugcuguuccccccaaaugu

SEQ ID NO: 32543 - RNA, 22 nt, Homo sapiens
gccaggccgggccaggccgggc

SEQ ID NO: 32544 - RNA, 18 nt, Homo sapiens
agggaugugaaaauucca

SEQ ID NO: 32545 - RNA, 18 nt, Homo sapiens
aaaaguuuaagugagggu

SEQ ID NO: 32546 - RNA, 22 nt, Homo sapiens
aaaggcaggcucagaaggaaaa

SEQ ID NO: 32547 - RNA, 19 nt, Homo sapiens
agcuaaccccacgguuggc

SEQ ID NO: 32548 - RNA, 27 nt, Homo sapiens
aggcaccguggccgcuuucgaagggcc

SEQ ID NO: 32549 - RNA, 19 nt, Homo sapiens
ccugccaucuggaggcacc

SEQ ID NO: 32550 - RNA, 19 nt, Homo sapiens
cuggaaggaaaaaggagga

SEQ ID NO: 32551 - RNA, 18 nt, Homo sapiens
gagaggagggcuaguggc

SEQ ID NO: 32552 - RNA, 18 nt, Homo sapiens
ggcagacauccuugggug

SEQ ID NO: 32553 - RNA, 21 nt, Homo sapiens
gugcaaccaccuccacaguca

SEQ ID NO: 32554 - RNA, 22 nt, Homo sapiens
uccuggguggggggauaaaggc

SEQ ID NO: 32555 - RNA, 20 nt, Homo sapiens
uggguggggggauaaaggca

SEQ ID NO: 32556 - RNA, 21 nt, Homo sapiens
ugguggagagaaccaaguaua

SEQ ID NO: 32557 - RNA, 20 nt, Homo sapiens
uguuacagggcuauuuccag

SEQ ID NO: 32558 - RNA, 18 nt, Homo sapiens
cagcugcugccugccguc

SEQ ID NO: 32559 - RNA, 20 nt, Homo sapiens
ccugcaugccucgcccuuug

SEQ ID NO: 32560 - RNA, 22 nt, Homo sapiens
ccuuucccccuccgggauuguc

SEQ ID NO: 32561 - RNA, 20 nt, Homo sapiens
cgcccuccuugggccgccuc

SEQ ID NO: 32562 - RNA, 22 nt, Homo sapiens
cuagugacaguguugggaggug

SEQ ID NO: 32563 - RNA, 19 nt, Homo sapiens
cuccucggauugucguccc

SEQ ID NO: 32564 - RNA, 20 nt, Homo sapiens
gagacggagucucacucugu

SEQ ID NO: 32565 - RNA, 19 nt, Homo sapiens
gccacagcugcugccugcc

SEQ ID NO: 32566 - RNA, 19 nt, Homo sapiens
ggaacccuuucugcgcuuu

SEQ ID NO: 32567 - RNA, 21 nt, Homo sapiens
ggggaggaggguacacugggg

SEQ ID NO: 32568 - RNA, 18 nt, Homo sapiens
guaaaaccucuuuccagu

SEQ ID NO: 32569 - RNA, 15 nt, Homo sapiens
cugguggcuccugag

SEQ ID NO: 32570 - RNA, 18 nt, Homo sapiens
gcucgccuuucccccucc

SEQ ID NO: 32571 - RNA, 20 nt, Homo sapiens
aaggaggagcccagaggaga

SEQ ID NO: 32572 - RNA, 23 nt, Homo sapiens
cccaggguuuuguugcacauuug

SEQ ID NO: 32573 - RNA, 20 nt, Homo sapiens
cgagggacgcugcggcugaa

SEQ ID NO: 32574 - RNA, 24 nt, Homo sapiens
cggcgagggacgcugcggccgcgc

SEQ ID NO: 32575 - RNA, 16 nt, Homo sapiens
cuucgaggggggccgu

SEQ ID NO: 32576 - RNA, 22 nt, Homo sapiens
ggcaaggaggagcccagaggag

SEQ ID NO: 32577 - RNA, 17 nt, Homo sapiens
cacguggcuuccucucc

SEQ ID NO: 32578 - RNA, 17 nt, Homo sapiens
ccucucccacucccacu

SEQ ID NO: 32579 - RNA, 18 nt, Homo sapiens
gacugcgagggcgcgcgc

SEQ ID NO: 32580 - RNA, 21 nt, Homo sapiens
gccucggccucccccguggcc

SEQ ID NO: 32581 - RNA, 21 nt, Homo sapiens
ggagggggaagaaaaaagaau

SEQ ID NO: 32582 - RNA, 21 nt, Homo sapiens
gggagaggacagcggaggagg

SEQ ID NO: 32583 - RNA, 17 nt, Homo sapiens
gggcgguggcagcggcg

SEQ ID NO: 32584 - RNA, 17 nt, Homo sapiens
gggggcagagggcgggg

SEQ ID NO: 32585 - RNA, 16 nt, Homo sapiens
ggucugcaaaguggcc

SEQ ID NO: 32586 - RNA, 20 nt, Homo sapiens
ugacugcgagggcgcgcgcg

SEQ ID NO: 32587 - RNA, 18 nt, Homo sapiens
ugcgagggcgcgcgcggc

SEQ ID NO: 32588 - RNA, 21 nt, Homo sapiens
ugggaaggacagggggcucgg

SEQ ID NO: 32589 - RNA, 24 nt, Homo sapiens
ccucggccucccccguggccuccc

SEQ ID NO: 32590 - RNA, 21 nt, Homo sapiens
ggcagagggcgggggccgggu

SEQ ID NO: 32591 - RNA, 22 nt, Homo sapiens
gugcuuccuccuccccucugcc

SEQ ID NO: 32592 - RNA, 19 nt, Homo sapiens
acccagagccggguuuucc

SEQ ID NO: 32593 - RNA, 17 nt, Homo sapiens
agccagcccgggcgggg

SEQ ID NO: 32594 - RNA, 21 nt, Homo sapiens
ccgcgcugcgcucugugcccg

SEQ ID NO: 32595 - RNA, 22 nt, Homo sapiens
gaaggagcgggcggcggccggg

SEQ ID NO: 32596 - RNA, 18 nt, Homo sapiens
gugcaucuaacaguuuuc

SEQ ID NO: 32597 - RNA, 21 nt, Homo sapiens
ucaaagacugaguggaagccc

SEQ ID NO: 32598 - RNA, 18 nt, Homo sapiens
uguaaugugacggucauc

SEQ ID NO: 32599 - RNA, 21 nt, Homo sapiens
acugacccacaugggcgaggg

SEQ ID NO: 32600 - RNA, 22 nt, Homo sapiens
agagaggguaaaaggaagagac

SEQ ID NO: 32601 - RNA, 20 nt, Homo sapiens
cagaaaaaagaaaagagaag

SEQ ID NO: 32602 - RNA, 17 nt, Homo sapiens
ccgcgcgcgcccucacc

SEQ ID NO: 32603 - RNA, 17 nt, Homo sapiens
cguccccgcgccggccg

SEQ ID NO: 32604 - RNA, 21 nt, Homo sapiens
cucggggggcgcgcucagccg

SEQ ID NO: 32605 - RNA, 17 nt, Homo sapiens
gagaaggagagagaaag

SEQ ID NO: 32606 - RNA, 18 nt, Homo sapiens
gagagagaaagggagaga

SEQ ID NO: 32607 - RNA, 18 nt, Homo sapiens
gcccgcccgcgcgcgccc

SEQ ID NO: 32608 - RNA, 17 nt, Homo sapiens
gccgcccggggcgccgc

SEQ ID NO: 32609 - RNA, 16 nt, Homo sapiens
gcguccccgcccgccc

SEQ ID NO: 32610 - RNA, 23 nt, Homo sapiens
ggcggggcuggcccccuggcccg

SEQ ID NO: 32611 - RNA, 19 nt, Homo sapiens
gggaaaaggccucaggaga

SEQ ID NO: 32612 - RNA, 18 nt, Homo sapiens
gggagacggcaagucggc

SEQ ID NO: 32613 - RNA, 20 nt, Homo sapiens
uacggagggaccaggacaca

SEQ ID NO: 32614 - RNA, 23 nt, Homo sapiens
cuggaguuguguuuuaaagcagu

SEQ ID NO: 32615 - RNA, 21 nt, Homo sapiens
gaaaaaaauagcaagcgaggg

SEQ ID NO: 32616 - RNA, 24 nt, Homo sapiens
ggggaggggagcuuggggaggggc

SEQ ID NO: 32617 - RNA, 25 nt, Homo sapiens
uagaaaacuuuauucuuaagaagaa

SEQ ID NO: 32618 - RNA, 20 nt, Homo sapiens
uaugugggggggacauaggc

SEQ ID NO: 32619 - RNA, 20 nt, Homo sapiens
ucuaaaucuucccccucagc

SEQ ID NO: 32620 - RNA, 15 nt, Homo sapiens
ggccccugggccuuu

SEQ ID NO: 32621 - RNA, 18 nt, Homo sapiens
ggccuggaguccgcccuc

SEQ ID NO: 32622 - RNA, 21 nt, Homo sapiens
ucguggugcagagcucccagc

SEQ ID NO: 32623 - RNA, 16 nt, Homo sapiens
agagggaugcaaaaua

SEQ ID NO: 32624 - RNA, 18 nt, Homo sapiens
gucauugucaauguguaa

SEQ ID NO: 32625 - RNA, 19 nt, Homo sapiens
uuugucauugucaaugugu

SEQ ID NO: 32626 - RNA, 19 nt, Homo sapiens
acccuuguuuaaauaugcu

SEQ ID NO: 32627 - RNA, 18 nt, Homo sapiens
caucaagcauguuccagc

SEQ ID NO: 32628 - RNA, 22 nt, Homo sapiens
ccagcauuuuucuuucucuucu

SEQ ID NO: 32629 - RNA, 19 nt, Homo sapiens
cugccgcgggcggccgcgc

SEQ ID NO: 32630 - RNA, 22 nt, Homo sapiens
gccugccgcgggcggccgcgcg

SEQ ID NO: 32631 - RNA, 18 nt, Homo sapiens
ucuauuagcuaaaauacc

SEQ ID NO: 32632 - RNA, 24 nt, Homo sapiens
ucucacaaaaggcguuuguuuuug

SEQ ID NO: 32633 - RNA, 19 nt, Homo sapiens
ugagaggaagguguuaggc

SEQ ID NO: 32634 - RNA, 28 nt, Homo sapiens
ugccuugauguuccaaguuggcuucagc

SEQ ID NO: 32635 - RNA, 22 nt, Homo sapiens
uggcuacaaauuaaaauuuuuc

SEQ ID NO: 32636 - RNA, 24 nt, Homo sapiens
uggcuacaaauuaaaauuuuucca

SEQ ID NO: 32637 - RNA, 18 nt, Homo sapiens
ugggaaaagauggcuaca

SEQ ID NO: 32638 - RNA, 18 nt, Homo sapiens
uuugaugcaauauaaaaa

SEQ ID NO: 32639 - RNA, 18 nt, Homo sapiens
ccagacucuuccuuuugc

SEQ ID NO: 32640 - RNA, 21 nt, Homo sapiens
ggcgccuggaaaugagcucca

SEQ ID NO: 32641 - RNA, 19 nt, Homo sapiens
gucucagaugcguaguucc

SEQ ID NO: 32642 - RNA, 19 nt, Homo sapiens
uccgaagagggaagggcgc

SEQ ID NO: 32643 - RNA, 15 nt, Homo sapiens
acuuucuagcggccu

SEQ ID NO: 32644 - RNA, 21 nt, Homo sapiens
ccagagagauaacacacauag

SEQ ID NO: 32645 - RNA, 21 nt, Homo sapiens
cccuucaaguuuucccuuuuu

SEQ ID NO: 32646 - RNA, 18 nt, Homo sapiens
uugugcaugucucugagg

SEQ ID NO: 32647 - RNA, 15 nt, Homo sapiens
guagaaaauagucau

SEQ ID NO: 32648 - RNA, 19 nt, Homo sapiens
ucugcuucacucuuuaauu

SEQ ID NO: 32649 - RNA, 18 nt, Homo sapiens
uuuuaaucuucuggauaa

SEQ ID NO: 32650 - RNA, 19 nt, Homo sapiens
aagaggaggagguauggga

SEQ ID NO: 32651 - RNA, 18 nt, Homo sapiens
acccugcuuuggcccagc

SEQ ID NO: 32652 - RNA, 22 nt, Homo sapiens
auggccaccuggaacaagguug

SEQ ID NO: 32653 - RNA, 21 nt, Homo sapiens
gaagcagagguuucacuuugc

SEQ ID NO: 32654 - RNA, 20 nt, Homo sapiens
gcagaaaagugauuuauuug

SEQ ID NO: 32655 - RNA, 17 nt, Homo sapiens
uaaauggcuugccaugg

SEQ ID NO: 32656 - RNA, 18 nt, Homo sapiens
uccagcugcggccacggc

SEQ ID NO: 32657 - RNA, 18 nt, Homo sapiens
ugauuuauuuggaaggga

SEQ ID NO: 32658 - RNA, 18 nt, Homo sapiens
agaccaggcaggcagagg

SEQ ID NO: 32659 - RNA, 16 nt, Homo sapiens
caggcagaggugaggu

SEQ ID NO: 32660 - RNA, 18 nt, Homo sapiens
gaggugaguguggaggug

SEQ ID NO: 32661 - RNA, 18 nt, Homo sapiens
ggaggcgagcaggggagg

SEQ ID NO: 32662 - RNA, 18 nt, Homo sapiens
ugagugccugcucugugu

SEQ ID NO: 32663 - RNA, 20 nt, Homo sapiens
cacacuuucucuccagggaa

SEQ ID NO: 32664 - RNA, 18 nt, Homo sapiens
caccgcuugguucuuccc

SEQ ID NO: 32665 - RNA, 15 nt, Homo sapiens
ccuccuggcgagugg

SEQ ID NO: 32666 - RNA, 19 nt, Homo sapiens
ccuguaucccuuuuacucu

SEQ ID NO: 32667 - RNA, 17 nt, Homo sapiens
ccugugaccaaaauacc

SEQ ID NO: 32668 - RNA, 24 nt, Homo sapiens
cucgcccuugguguauugccuaag

SEQ ID NO: 32669 - RNA, 17 nt, Homo sapiens
gcaauuccucaaggauc

SEQ ID NO: 32670 - RNA, 19 nt, Homo sapiens
gcaggccugguggugacaa

SEQ ID NO: 32671 - RNA, 17 nt, Homo sapiens
gccccugucucuccccu

SEQ ID NO: 32672 - RNA, 18 nt, Homo sapiens
gcgccucccccuccacac

SEQ ID NO: 32673 - RNA, 20 nt, Homo sapiens
gcggccccugucucuccccu

SEQ ID NO: 32674 - RNA, 23 nt, Homo sapiens
ggcuuggaggaagaggugagccg

SEQ ID NO: 32675 - RNA, 18 nt, Homo sapiens
gggcuggcgggagugggc

SEQ ID NO: 32676 - RNA, 19 nt, Homo sapiens
uaggaaaugucaaaguguc

SEQ ID NO: 32677 - RNA, 19 nt, Homo sapiens
ucaaguccucaaaagguag

SEQ ID NO: 32678 - RNA, 19 nt, Homo sapiens
ucauuuucagcacaccagu

SEQ ID NO: 32679 - RNA, 21 nt, Homo sapiens
ucccgcccccucccaggaucu

SEQ ID NO: 32680 - RNA, 15 nt, Homo sapiens
ugaagguuaugaaca

SEQ ID NO: 32681 - RNA, 17 nt, Homo sapiens
ugcaguggcuggcacca

SEQ ID NO: 32682 - RNA, 22 nt, Homo sapiens
uggcaccaguuuuucuuuucca

SEQ ID NO: 32683 - RNA, 17 nt, Homo sapiens
uguaucccuuuuacucu

SEQ ID NO: 32684 - RNA, 18 nt, Homo sapiens
ugucccuuucaucaacag

SEQ ID NO: 32685 - RNA, 14 nt, Homo sapiens
uugcuuaugaagcu

SEQ ID NO: 32686 - RNA, 19 nt, Homo sapiens
uugguuguugagugaggcc

SEQ ID NO: 32687 - RNA, 19 nt, Homo sapiens
aagugggaaaaucgcugac

SEQ ID NO: 32688 - RNA, 19 nt, Homo sapiens
acucgcagggcuaccaggu

SEQ ID NO: 32689 - RNA, 24 nt, Homo sapiens
aggaggcgggcgccgccgggccgg

SEQ ID NO: 32690 - RNA, 23 nt, Homo sapiens
agggaccgccaggucaccgagug

SEQ ID NO: 32691 - RNA, 17 nt, Homo sapiens
cacacuucuguguacag

SEQ ID NO: 32692 - RNA, 18 nt, Homo sapiens
ccaaauuuucaaagcagu

SEQ ID NO: 32693 - RNA, 18 nt, Homo sapiens
cugcuggcugcugcuccg

SEQ ID NO: 32694 - RNA, 21 nt, Homo sapiens
gaggaggggaaggaagaagga

SEQ ID NO: 32695 - RNA, 22 nt, Homo sapiens
gagggcguuccaggaacaaugu

SEQ ID NO: 32696 - RNA, 16 nt, Homo sapiens
gcaguggugauggugu

SEQ ID NO: 32697 - RNA, 22 nt, Homo sapiens
uaaacagcuuucagugcagguu

SEQ ID NO: 32698 - RNA, 20 nt, Homo sapiens
ucaguauuuucaguauauau

SEQ ID NO: 32699 - RNA, 26 nt, Homo sapiens
ucgcugaccugggaggugcgcuucgg

SEQ ID NO: 32700 - RNA, 20 nt, Homo sapiens
uggcugcugcuccggacucg

SEQ ID NO: 32701 - RNA, 18 nt, Homo sapiens
uuucuguugucuucccug

SEQ ID NO: 32702 - RNA, 19 nt, Homo sapiens
uuccuaaauuguccaauuu

SEQ ID NO: 32703 - RNA, 18 nt, Homo sapiens
aagcagaccagcuggggu

SEQ ID NO: 32704 - RNA, 15 nt, Homo sapiens
agccuaccucggggg

SEQ ID NO: 32705 - RNA, 18 nt, Homo sapiens
aguggggagcccccaucg

SEQ ID NO: 32706 - RNA, 17 nt, Homo sapiens
cagggcugcaguccacu

SEQ ID NO: 32707 - RNA, 18 nt, Homo sapiens
gacugggcaguggggagc

SEQ ID NO: 32708 - RNA, 18 nt, Homo sapiens
uggccacaggcugaagga

SEQ ID NO: 32709 - RNA, 25 nt, Homo sapiens
aauacuuuuguaaaguggucuuuau

SEQ ID NO: 32710 - RNA, 20 nt, Homo sapiens
auggaaugcaagagguguag

SEQ ID NO: 32711 - RNA, 19 nt, Homo sapiens
augugcaggaaagcaucug

SEQ ID NO: 32712 - RNA, 18 nt, Homo sapiens
cacugauuuggucaccuc

SEQ ID NO: 32713 - RNA, 20 nt, Homo sapiens
gacaaugagagagcucaaug

SEQ ID NO: 32714 - RNA, 16 nt, Homo sapiens
gagagcucaaugcaug

SEQ ID NO: 32715 - RNA, 18 nt, Homo sapiens
ucaggcgauccacccggc

SEQ ID NO: 32716 - RNA, 21 nt, Homo sapiens
uguugaggauggaaugcaaga

SEQ ID NO: 32717 - RNA, 21 nt, Homo sapiens
cagaucuguggggacacagca

SEQ ID NO: 32718 - RNA, 17 nt, Homo sapiens
cagcaccuccacuaugu

SEQ ID NO: 32719 - RNA, 16 nt, Homo sapiens
aaggagcacuggacug

SEQ ID NO: 32720 - RNA, 18 nt, Homo sapiens
aagggaaggggaggagag

SEQ ID NO: 32721 - RNA, 17 nt, Homo sapiens
agagauagcuccaucca

SEQ ID NO: 32722 - RNA, 23 nt, Homo sapiens
agccugugagagcucacggccca

SEQ ID NO: 32723 - RNA, 19 nt, Homo sapiens
aggagaccugaauucgagu

SEQ ID NO: 32724 - RNA, 16 nt, Homo sapiens
cagcggcuccgcggcg

SEQ ID NO: 32725 - RNA, 17 nt, Homo sapiens
ccauuucccgcacgagg

SEQ ID NO: 32726 - RNA, 21 nt, Homo sapiens
cccagcccuguccaaggcucc

SEQ ID NO: 32727 - RNA, 19 nt, Homo sapiens
cuuacucaggggaagccuu

SEQ ID NO: 32728 - RNA, 16 nt, Homo sapiens
gccgcuggugaccgac

SEQ ID NO: 32729 - RNA, 16 nt, Homo sapiens
gcuccuccucccuccc

SEQ ID NO: 32730 - RNA, 20 nt, Homo sapiens
ggccaucagacauuguccuc

SEQ ID NO: 32731 - RNA, 21 nt, Homo sapiens
gguuguuucgggcucuguggu

SEQ ID NO: 32732 - RNA, 18 nt, Homo sapiens
guuuuguuauuuuauggg

SEQ ID NO: 32733 - RNA, 20 nt, Homo sapiens
ugcagcggcuccgcggcggc

SEQ ID NO: 32734 - RNA, 21 nt, Homo sapiens
ugcuccuccucccucccguug

SEQ ID NO: 32735 - RNA, 19 nt, Homo sapiens
ugucagcacugguggucau

SEQ ID NO: 32736 - RNA, 14 nt, Homo sapiens
uccgcggcggcggg

SEQ ID NO: 32737 - RNA, 18 nt, Homo sapiens
ucuccuucuuuuugcucu

SEQ ID NO: 32738 - RNA, 20 nt, Homo sapiens
aauaguacaaauuuuguccc

SEQ ID NO: 32739 - RNA, 19 nt, Homo sapiens
aaucaucuagaaaauucau

SEQ ID NO: 32740 - RNA, 15 nt, Homo sapiens
cugguggugugugcc

SEQ ID NO: 32741 - RNA, 22 nt, Homo sapiens
gaacaggauuugggggugggga

SEQ ID NO: 32742 - RNA, 19 nt, Homo sapiens
gauacuaaauguggcaggg

SEQ ID NO: 32743 - RNA, 20 nt, Homo sapiens
guggaucaugaagucaggag

SEQ ID NO: 32744 - RNA, 21 nt, Homo sapiens
uaagguauguaugaccuuguu

SEQ ID NO: 32745 - RNA, 18 nt, Homo sapiens
uaugaccuuguuuauuau

SEQ ID NO: 32746 - RNA, 14 nt, Homo sapiens
uuagcugaguauac

SEQ ID NO: 32747 - RNA, 17 nt, Homo sapiens
uugggaggccgaggugg

SEQ ID NO: 32748 - RNA, 20 nt, Homo sapiens
agugggcgguccgaggccgg

SEQ ID NO: 32749 - RNA, 21 nt, Homo sapiens
gacugggcccuccugccucuu

SEQ ID NO: 32750 - RNA, 18 nt, Homo sapiens
uaaaaacuuggacacggu

SEQ ID NO: 32751 - RNA, 20 nt, Homo sapiens
uaccgcgccgcgcucgccga

SEQ ID NO: 32752 - RNA, 17 nt, Homo sapiens
cgacgcgcccgcggagc

SEQ ID NO: 32753 - RNA, 21 nt, Homo sapiens
auuucuuuggucacauuuucu

SEQ ID NO: 32754 - RNA, 24 nt, Homo sapiens
ucgugcauuucuuuggucacauuu

SEQ ID NO: 32755 - RNA, 23 nt, Homo sapiens
cuagaagcauuuaaggagaggca

SEQ ID NO: 32756 - RNA, 20 nt, Homo sapiens
uguuuuauugaugaugccua

SEQ ID NO: 32757 - RNA, 21 nt, Homo sapiens
acagaugggaaaauauugugc

SEQ ID NO: 32758 - RNA, 21 nt, Homo sapiens
augugauuggaaaucuacauu

SEQ ID NO: 32759 - RNA, 19 nt, Homo sapiens
cucuuugucaaguaauaca

SEQ ID NO: 32760 - RNA, 21 nt, Homo sapiens
cugcacagugucucuuuguca

SEQ ID NO: 32761 - RNA, 21 nt, Homo sapiens
ucacccucugcacagugucuc

SEQ ID NO: 32762 - RNA, 23 nt, Homo sapiens
ucaccacugccacugcugcagcu

SEQ ID NO: 32763 - RNA, 15 nt, Homo sapiens
gagcuggccuggggc

SEQ ID NO: 32764 - RNA, 18 nt, Homo sapiens
uugcaaguuuuuugacuu

SEQ ID NO: 32765 - RNA, 19 nt, Homo sapiens
agcugccuguucccagagg

SEQ ID NO: 32766 - RNA, 20 nt, Homo sapiens
ccaacacagaggcccagcca

SEQ ID NO: 32767 - RNA, 20 nt, Homo sapiens
ccugggcuggggcuguggcu

SEQ ID NO: 32768 - RNA, 22 nt, Homo sapiens
cucucucggggcgagcggaggg

SEQ ID NO: 32769 - RNA, 20 nt, Homo sapiens
cugguggcagggaugacugc

SEQ ID NO: 32770 - RNA, 20 nt, Homo sapiens
gaacuacgggugugugccac

SEQ ID NO: 32771 - RNA, 22 nt, Homo sapiens
gcuguggcuggacagcagugcu

SEQ ID NO: 32772 - RNA, 18 nt, Homo sapiens
ggcugccugggcuggggc

SEQ ID NO: 32773 - RNA, 16 nt, Homo sapiens
uggcugccuccagccc

SEQ ID NO: 32774 - RNA, 22 nt, Homo sapiens
ugugggcugccugggcuggggc

SEQ ID NO: 32775 - RNA, 17 nt, Homo sapiens
gcccgccucggccuccc

SEQ ID NO: 32776 - RNA, 19 nt, Homo sapiens
gggcuggaagggaaggggc

SEQ ID NO: 32777 - RNA, 19 nt, Homo sapiens
ugcaauggccugaucucgg

SEQ ID NO: 32778 - RNA, 21 nt, Homo sapiens
uggauaguuaaacauuuauuu

SEQ ID NO: 32779 - RNA, 22 nt, Homo sapiens
ccucccaggcugggacugguuc

SEQ ID NO: 32780 - RNA, 23 nt, Homo sapiens
aauaaaaauauauauauauauau

SEQ ID NO: 32781 - RNA, 21 nt, Homo sapiens
agaggcaaucauuggcaaacu

SEQ ID NO: 32782 - RNA, 18 nt, Homo sapiens
agagguugcagugagauc

SEQ ID NO: 32783 - RNA, 21 nt, Homo sapiens
agcugcaaagugcccuggaca

SEQ ID NO: 32784 - RNA, 23 nt, Homo sapiens
auaaaaauauauauauauauaua

SEQ ID NO: 32785 - RNA, 23 nt, Homo sapiens
auauauauauaaaauauauauau

SEQ ID NO: 32786 - RNA, 24 nt, Homo sapiens
auauauauauauauauaaaauaua

SEQ ID NO: 32787 - RNA, 19 nt, Homo sapiens
cauauauauuauauauaua

SEQ ID NO: 32788 - RNA, 19 nt, Homo sapiens
cccagccccacaucucucc

SEQ ID NO: 32789 - RNA, 18 nt, Homo sapiens
gaagccaaggcaggugga

SEQ ID NO: 32790 - RNA, 17 nt, Homo sapiens
gugagaaaauaaaauaa

SEQ ID NO: 32791 - RNA, 16 nt, Homo sapiens
uaacugccuagaaaag

SEQ ID NO: 32792 - RNA, 23 nt, Homo sapiens
uaauauacauauuccauauauau

SEQ ID NO: 32793 - RNA, 23 nt, Homo sapiens
uaauauauauauuccauauauau

SEQ ID NO: 32794 - RNA, 20 nt, Homo sapiens
uagaauaggauaaaguuguu

SEQ ID NO: 32795 - RNA, 18 nt, Homo sapiens
uaguaccccugagcuuua

SEQ ID NO: 32796 - RNA, 26 nt, Homo sapiens
uauaauauauauauuccauauauauu

SEQ ID NO: 32797 - RNA, 26 nt, Homo sapiens
uauauaauauauauauuccauauaua

SEQ ID NO: 32798 - RNA, 18 nt, Homo sapiens
uauauauaauauauauau

SEQ ID NO: 32799 - RNA, 21 nt, Homo sapiens
uauauauauaaaaauauauau

SEQ ID NO: 32800 - RNA, 23 nt, Homo sapiens
uauauauauaaaaauauauauau

SEQ ID NO: 32801 - RNA, 19 nt, Homo sapiens
uauauauauaauauauaua

SEQ ID NO: 32802 - RNA, 20 nt, Homo sapiens
uauauauauaauauauauau

SEQ ID NO: 32803 - RNA, 25 nt, Homo sapiens
uauauauauauauaaaauauauaua

SEQ ID NO: 32804 - RNA, 21 nt, Homo sapiens
ugguuuuccaccuuccuuuuc

SEQ ID NO: 32805 - RNA, 15 nt, Homo sapiens
agcagcagcucaggc

SEQ ID NO: 32806 - RNA, 20 nt, Homo sapiens
ccacgcccaaucacaacugc

SEQ ID NO: 32807 - RNA, 17 nt, Homo sapiens
ccauacucugcauuagg

SEQ ID NO: 32808 - RNA, 23 nt, Homo sapiens
ccucuuuucucacugugaagaac

SEQ ID NO: 32809 - RNA, 24 nt, Homo sapiens
gcucccagguuccagcccuguccc

SEQ ID NO: 32810 - RNA, 17 nt, Homo sapiens
ggccacacccggugcca

SEQ ID NO: 32811 - RNA, 17 nt, Homo sapiens
uguuagcugaacuucaa

SEQ ID NO: 32812 - RNA, 23 nt, Homo sapiens
uucgcuggugccggcuguccugu

SEQ ID NO: 32813 - RNA, 21 nt, Homo sapiens
uugacauaucccuuguuacac

SEQ ID NO: 32814 - RNA, 21 nt, Homo sapiens
gaguugcagaaucauuuuuca

SEQ ID NO: 32815 - RNA, 18 nt, Homo sapiens
gggcuggcugagggcggc

SEQ ID NO: 32816 - RNA, 20 nt, Homo sapiens
uguagguuugugaggugugg

SEQ ID NO: 32817 - RNA, 27 nt, Homo sapiens
acuacacuucuugaaauuccuaaaaau

SEQ ID NO: 32818 - RNA, 22 nt, Homo sapiens
agccaaaacaauagugcaaaaa

SEQ ID NO: 32819 - RNA, 20 nt, Homo sapiens
gcgccgccgcugcugccaga

SEQ ID NO: 32820 - RNA, 16 nt, Homo sapiens
gggucgccgcgccgcc

SEQ ID NO: 32821 - RNA, 18 nt, Homo sapiens
gggugguuaugucacgug

SEQ ID NO: 32822 - RNA, 17 nt, Homo sapiens
cgccugccgcgggcgcc

SEQ ID NO: 32823 - RNA, 16 nt, Homo sapiens
ugggcgcgcagcaggc

SEQ ID NO: 32824 - RNA, 16 nt, Homo sapiens
aaugcaggcgcucaaa

SEQ ID NO: 32825 - RNA, 18 nt, Homo sapiens
cccuugaaacccugggcc

SEQ ID NO: 32826 - RNA, 18 nt, Homo sapiens
cugguuacacacccacac

SEQ ID NO: 32827 - RNA, 19 nt, Homo sapiens
ggguccuagguagggggag

SEQ ID NO: 32828 - RNA, 21 nt, Homo sapiens
uaccagaagauguccgggaag

SEQ ID NO: 32829 - RNA, 18 nt, Homo sapiens
uacuccuguauucagaug

SEQ ID NO: 32830 - RNA, 22 nt, Homo sapiens
ucaugggccugagccugggcag

SEQ ID NO: 32831 - RNA, 20 nt, Homo sapiens
uugcucaacagccacaguag

SEQ ID NO: 32832 - RNA, 20 nt, Homo sapiens
cugaucaggcuccaucugcc

SEQ ID NO: 32833 - RNA, 24 nt, Homo sapiens
gcggagggcggcgcgccgcgguuu

SEQ ID NO: 32834 - RNA, 21 nt, Homo sapiens
ggagguggcggugggucagug

SEQ ID NO: 32835 - RNA, 16 nt, Homo sapiens
ucuccgcggagguggc

SEQ ID NO: 32836 - RNA, 19 nt, Homo sapiens
gcuugagauacaaacguuu

SEQ ID NO: 32837 - RNA, 22 nt, Homo sapiens
aucuguguaugugagcauguug

SEQ ID NO: 32838 - RNA, 17 nt, Homo sapiens
cccacagaccucugcgg

SEQ ID NO: 32839 - RNA, 19 nt, Homo sapiens
cuuaaacuaaagagagguc

SEQ ID NO: 32840 - RNA, 18 nt, Homo sapiens
gaaugcuaugaaaaauga

SEQ ID NO: 32841 - RNA, 19 nt, Homo sapiens
uaauaugugaguauguaua

SEQ ID NO: 32842 - RNA, 18 nt, Homo sapiens
uaauuucuuuauuaaaca

SEQ ID NO: 32843 - RNA, 21 nt, Homo sapiens
uagaaaguugcucaggaagau

SEQ ID NO: 32844 - RNA, 21 nt, Homo sapiens
uggcauauuugucauuguauu

SEQ ID NO: 32845 - RNA, 21 nt, Homo sapiens
uuaaaaaaugcuuauuuuccc

SEQ ID NO: 32846 - RNA, 21 nt, Homo sapiens
cagguuuauuuuauacucaac

SEQ ID NO: 32847 - RNA, 23 nt, Homo sapiens
aaguacacaucagccuguaucca

SEQ ID NO: 32848 - RNA, 19 nt, Homo sapiens
gcauuacuagaagaaagga

SEQ ID NO: 32849 - RNA, 16 nt, Homo sapiens
agacccacugauccug

SEQ ID NO: 32850 - RNA, 17 nt, Homo sapiens
agggaaucacuuugcug

SEQ ID NO: 32851 - RNA, 19 nt, Homo sapiens
cagccuccuggcccgcggc

SEQ ID NO: 32852 - RNA, 21 nt, Homo sapiens
cagcugaaauacuauuuucgu

SEQ ID NO: 32853 - RNA, 21 nt, Homo sapiens
cccgcguuucccgugcccucg

SEQ ID NO: 32854 - RNA, 16 nt, Homo sapiens
gcaccaguccuaagag

SEQ ID NO: 32855 - RNA, 17 nt, Homo sapiens
uauccugagcugccucc

SEQ ID NO: 32856 - RNA, 19 nt, Homo sapiens
agguccuaaugaugguauu

SEQ ID NO: 32857 - RNA, 21 nt, Homo sapiens
gguccgcuccuucccacgcuc

SEQ ID NO: 32858 - RNA, 22 nt, Homo sapiens
guaggcaaaguuuuccucuuuc

SEQ ID NO: 32859 - RNA, 19 nt, Homo sapiens
ugaauguuagacacuggga

SEQ ID NO: 32860 - RNA, 22 nt, Homo sapiens
cacaugguccacaagguuuucu

SEQ ID NO: 32861 - RNA, 17 nt, Homo sapiens
aacagaugggaacagaa

SEQ ID NO: 32862 - RNA, 19 nt, Homo sapiens
agaaacagaaauaugagga

SEQ ID NO: 32863 - RNA, 17 nt, Homo sapiens
agcagaugucagcaucc

SEQ ID NO: 32864 - RNA, 19 nt, Homo sapiens
augagaauucuuccuugcu

SEQ ID NO: 32865 - RNA, 18 nt, Homo sapiens
augcaaauguuucaaguc

SEQ ID NO: 32866 - RNA, 20 nt, Homo sapiens
cacugucagcaagaagcucc

SEQ ID NO: 32867 - RNA, 20 nt, Homo sapiens
cagcuagguaagaaaacugg

SEQ ID NO: 32868 - RNA, 18 nt, Homo sapiens
ccuugcuggggcugggac

SEQ ID NO: 32869 - RNA, 17 nt, Homo sapiens
ggccaaaagaaaguccc

SEQ ID NO: 32870 - RNA, 20 nt, Homo sapiens
guagcaacaugacagguagu

SEQ ID NO: 32871 - RNA, 19 nt, Homo sapiens
uacaauaaacuuagggcuu

SEQ ID NO: 32872 - RNA, 18 nt, Homo sapiens
uggagauguauaaauugg

SEQ ID NO: 32873 - RNA, 19 nt, Homo sapiens
uuucuccucuguuuacaag

SEQ ID NO: 32874 - RNA, 16 nt, Homo sapiens
acggcagaguaggugc

SEQ ID NO: 32875 - RNA, 19 nt, Homo sapiens
agucccaggcuggaggccc

SEQ ID NO: 32876 - RNA, 22 nt, Homo sapiens
cagcgggggcggcggcgcgggc

SEQ ID NO: 32877 - RNA, 22 nt, Homo sapiens
ccgggcgccucggggaaggcgg

SEQ ID NO: 32878 - RNA, 17 nt, Homo sapiens
cgggcuggccccagggc

SEQ ID NO: 32879 - RNA, 21 nt, Homo sapiens
cuccccauucucccugccugg

SEQ ID NO: 32880 - RNA, 17 nt, Homo sapiens
cucccugccugggagac

SEQ ID NO: 32881 - RNA, 22 nt, Homo sapiens
cuguguccuuguuccucugcca

SEQ ID NO: 32882 - RNA, 20 nt, Homo sapiens
gccgccucucccagcauggu

SEQ ID NO: 32883 - RNA, 19 nt, Homo sapiens
gcgggcucggagccgggcg

SEQ ID NO: 32884 - RNA, 17 nt, Homo sapiens
gcucggagccgggcgcc

SEQ ID NO: 32885 - RNA, 21 nt, Homo sapiens
gggagagcccaggggaggggc

SEQ ID NO: 32886 - RNA, 21 nt, Homo sapiens
gggcggcggcgcgggccccgg

SEQ ID NO: 32887 - RNA, 19 nt, Homo sapiens
gggcucggagccgggcgcc

SEQ ID NO: 32888 - RNA, 20 nt, Homo sapiens
ggugugugcgggcuggcccc

SEQ ID NO: 32889 - RNA, 16 nt, Homo sapiens
gugcacuucacggcag

SEQ ID NO: 32890 - RNA, 17 nt, Homo sapiens
ucccugggguauugcuu

SEQ ID NO: 32891 - RNA, 19 nt, Homo sapiens
uaccaagaguccuuagaag

SEQ ID NO: 32892 - RNA, 24 nt, Homo sapiens
uagaaaaaauaccugaggaagaac

SEQ ID NO: 32893 - RNA, 22 nt, Homo sapiens
ucaguguuuuuguuucucucaa

SEQ ID NO: 32894 - RNA, 22 nt, Homo sapiens
uccggguuugcgcgcaugugcg

SEQ ID NO: 32895 - RNA, 16 nt, Homo sapiens
ucuuuccaacauuacu

SEQ ID NO: 32896 - RNA, 16 nt, Homo sapiens
uguacauuuuucuggg

SEQ ID NO: 32897 - RNA, 16 nt, Homo sapiens
ccccaguucccgcucc

SEQ ID NO: 32898 - RNA, 22 nt, Homo sapiens
gccagaauuccccaguucccgc

SEQ ID NO: 32899 - RNA, 21 nt, Homo sapiens
accggaguacuuagcagcaau

SEQ ID NO: 32900 - RNA, 21 nt, Homo sapiens
caucgauuucuucuauggcaa

SEQ ID NO: 32901 - RNA, 19 nt, Homo sapiens
ucguauguugcaccauauu

SEQ ID NO: 32902 - RNA, 18 nt, Homo sapiens
uauaaacauauuucuagc

SEQ ID NO: 32903 - RNA, 19 nt, Homo sapiens
aauggcuccagcgacuugg

SEQ ID NO: 32904 - RNA, 18 nt, Homo sapiens
cgguggcguugaacgucu

SEQ ID NO: 32905 - RNA, 21 nt, Homo sapiens
uaacuuagggccaucaccaca

SEQ ID NO: 32906 - RNA, 18 nt, Homo sapiens
ugugugugugugugugug

SEQ ID NO: 32907 - RNA, 20 nt, Homo sapiens
aggaugcggugguagaaacg

SEQ ID NO: 32908 - RNA, 15 nt, Homo sapiens
aggggucggacuccg

SEQ ID NO: 32909 - RNA, 17 nt, Homo sapiens
caccccaaagccguucc

SEQ ID NO: 32910 - RNA, 19 nt, Homo sapiens
cacgccccacuggccugug

SEQ ID NO: 32911 - RNA, 15 nt, Homo sapiens
caggguugcuggugc

SEQ ID NO: 32912 - RNA, 25 nt, Homo sapiens
ccaucuuccaccccaaagccguucc

SEQ ID NO: 32913 - RNA, 22 nt, Homo sapiens
cccaggggcuggagaggcgccc

SEQ ID NO: 32914 - RNA, 18 nt, Homo sapiens
ccugcccucauggggcuc

SEQ ID NO: 32915 - RNA, 15 nt, Homo sapiens
ccugguccucuccau

SEQ ID NO: 32916 - RNA, 15 nt, Homo sapiens
cggcccccucccggg

SEQ ID NO: 32917 - RNA, 20 nt, Homo sapiens
cggggcggcgggggcgcucu

SEQ ID NO: 32918 - RNA, 18 nt, Homo sapiens
gaguggugcuuguggggu

SEQ ID NO: 32919 - RNA, 19 nt, Homo sapiens
gcaggagggcagaagguug

SEQ ID NO: 32920 - RNA, 18 nt, Homo sapiens
gcccccucccgggccccg

SEQ ID NO: 32921 - RNA, 18 nt, Homo sapiens
gccggucgcggcgcgggc

SEQ ID NO: 32922 - RNA, 16 nt, Homo sapiens
gcgcgggcgguggcgg

SEQ ID NO: 32923 - RNA, 19 nt, Homo sapiens
gcgcgggcgguggcggucg

SEQ ID NO: 32924 - RNA, 20 nt, Homo sapiens
gcuagggcggggcggcuggg

SEQ ID NO: 32925 - RNA, 16 nt, Homo sapiens
ggagcaaagggcggga

SEQ ID NO: 32926 - RNA, 17 nt, Homo sapiens
ggccggcaccgggcgcc

SEQ ID NO: 32927 - RNA, 17 nt, Homo sapiens
ggcgccugcuccccaug

SEQ ID NO: 32928 - RNA, 16 nt, Homo sapiens
ggcgcgggcgguggcg

SEQ ID NO: 32929 - RNA, 19 nt, Homo sapiens
ggcuggagaggcgcccagg

SEQ ID NO: 32930 - RNA, 20 nt, Homo sapiens
ggggagggccgggccggggc

SEQ ID NO: 32931 - RNA, 20 nt, Homo sapiens
gguagagcgcggcggagagc

SEQ ID NO: 32932 - RNA, 21 nt, Homo sapiens
gugagcuccgacaccggcucc

SEQ ID NO: 32933 - RNA, 21 nt, Homo sapiens
uccccuagcgccauccccugc

SEQ ID NO: 32934 - RNA, 24 nt, Homo sapiens
uccugaugccacccucuccucaca

SEQ ID NO: 32935 - RNA, 14 nt, Homo sapiens
ugcccucauggggc

SEQ ID NO: 32936 - RNA, 17 nt, Homo sapiens
uggcacgccccacuggc

SEQ ID NO: 32937 - RNA, 16 nt, Homo sapiens
ccggagcccgcccgcc

SEQ ID NO: 32938 - RNA, 15 nt, Homo sapiens
cugaagagcagugac

SEQ ID NO: 32939 - RNA, 19 nt, Homo sapiens
uagaauaucuucauccacu

SEQ ID NO: 32940 - RNA, 15 nt, Homo sapiens
aggaagcagucucca

SEQ ID NO: 32941 - RNA, 17 nt, Homo sapiens
cgguggucccugcagcg

SEQ ID NO: 32942 - RNA, 18 nt, Homo sapiens
gcggcgggcgggcggcgg

SEQ ID NO: 32943 - RNA, 20 nt, Homo sapiens
ggagggcggauggcgguggg

SEQ ID NO: 32944 - RNA, 20 nt, Homo sapiens
ggcgguggggacggcggugg

SEQ ID NO: 32945 - RNA, 16 nt, Homo sapiens
uccagcugggcgcggc

SEQ ID NO: 32946 - RNA, 18 nt, Homo sapiens
aggcagccucacggccgc

SEQ ID NO: 32947 - RNA, 18 nt, Homo sapiens
cagccccgagccccggcg

SEQ ID NO: 32948 - RNA, 21 nt, Homo sapiens
ccucucucccgccgccgccgc

SEQ ID NO: 32949 - RNA, 16 nt, Homo sapiens
gccugggcaacagaac

SEQ ID NO: 32950 - RNA, 20 nt, Homo sapiens
ggggcccggggaggcagccu

SEQ ID NO: 32951 - RNA, 18 nt, Homo sapiens
ucacggccgcucacagcc

SEQ ID NO: 32952 - RNA, 19 nt, Homo sapiens
ccugcuuuucugaauggca

SEQ ID NO: 32953 - RNA, 17 nt, Homo sapiens
cucugcaaugucagaca

SEQ ID NO: 32954 - RNA, 21 nt, Homo sapiens
gagagaucgcucaaagucauu

SEQ ID NO: 32955 - RNA, 18 nt, Homo sapiens
gggaaauacacauucaug

SEQ ID NO: 32956 - RNA, 19 nt, Homo sapiens
ggggaaaaagccuuaaagu

SEQ ID NO: 32957 - RNA, 16 nt, Homo sapiens
ggggaggacuggcgag

SEQ ID NO: 32958 - RNA, 18 nt, Homo sapiens
uauuccauuuauuucucu

SEQ ID NO: 32959 - RNA, 18 nt, Homo sapiens
uggcacuuuugagaaauu

SEQ ID NO: 32960 - RNA, 18 nt, Homo sapiens
ugggaucuuuugugggug

SEQ ID NO: 32961 - RNA, 21 nt, Homo sapiens
cuccuguagggcccggguaag

SEQ ID NO: 32962 - RNA, 17 nt, Homo sapiens
cuggcagcucucucagc

SEQ ID NO: 32963 - RNA, 21 nt, Homo sapiens
gccacggcugccuggccucug

SEQ ID NO: 32964 - RNA, 19 nt, Homo sapiens
ucguuauugguugggcaug

SEQ ID NO: 32965 - RNA, 21 nt, Homo sapiens
ucucugguuggcguggcugag

SEQ ID NO: 32966 - RNA, 18 nt, Homo sapiens
ugcugaccuaacugcugu

SEQ ID NO: 32967 - RNA, 17 nt, Homo sapiens
uugacuaaaggggcucc

SEQ ID NO: 32968 - RNA, 21 nt, Homo sapiens
aacugcuugcauaaacacgcu

SEQ ID NO: 32969 - RNA, 17 nt, Homo sapiens
cauuugugugugugugu

SEQ ID NO: 32970 - RNA, 18 nt, Homo sapiens
cccucucucccagggcuc

SEQ ID NO: 32971 - RNA, 17 nt, Homo sapiens
cuuccgcuuaaaaccgu

SEQ ID NO: 32972 - RNA, 20 nt, Homo sapiens
aaggucucugggguagcucu

SEQ ID NO: 32973 - RNA, 19 nt, Homo sapiens
augggguaggaauagggau

SEQ ID NO: 32974 - RNA, 21 nt, Homo sapiens
ccucucccucuccacuagcuc

SEQ ID NO: 32975 - RNA, 21 nt, Homo sapiens
cucugggguagcucuuggagc

SEQ ID NO: 32976 - RNA, 20 nt, Homo sapiens
cuggguccacggcggauccc

SEQ ID NO: 32977 - RNA, 22 nt, Homo sapiens
ggaaguggggaagagggggugg

SEQ ID NO: 32978 - RNA, 21 nt, Homo sapiens
ugggguaggaauagggauccu

SEQ ID NO: 32979 - RNA, 17 nt, Homo sapiens
acaucccagcaaauugg

SEQ ID NO: 32980 - RNA, 15 nt, Homo sapiens
agcugggacaguccc

SEQ ID NO: 32981 - RNA, 19 nt, Homo sapiens
auaugcacaguauguacag

SEQ ID NO: 32982 - RNA, 21 nt, Homo sapiens
ccccagcccccgccguggcuc

SEQ ID NO: 32983 - RNA, 17 nt, Homo sapiens
cccuuuuuuggcccugc

SEQ ID NO: 32984 - RNA, 18 nt, Homo sapiens
cggccugcgggcuggagc

SEQ ID NO: 32985 - RNA, 18 nt, Homo sapiens
cgggcuggagcggggguc

SEQ ID NO: 32986 - RNA, 21 nt, Homo sapiens
gaugucccccgccgcccccgg

SEQ ID NO: 32987 - RNA, 19 nt, Homo sapiens
gccugcgggcuggagcggg

SEQ ID NO: 32988 - RNA, 19 nt, Homo sapiens
gcucacuaagaaauaaaca

SEQ ID NO: 32989 - RNA, 17 nt, Homo sapiens
uaacacuuuuauauauc

SEQ ID NO: 32990 - RNA, 17 nt, Homo sapiens
uaucagauguguaaaua

SEQ ID NO: 32991 - RNA, 19 nt, Homo sapiens
ucgcuccgcugcccuccga

SEQ ID NO: 32992 - RNA, 19 nt, Homo sapiens
ugagaacauuacaugaagc

SEQ ID NO: 32993 - RNA, 23 nt, Homo sapiens
ugggacagucccuuuuuuggccc

SEQ ID NO: 32994 - RNA, 16 nt, Homo sapiens
ugucaaggauggcaag

SEQ ID NO: 32995 - RNA, 21 nt, Homo sapiens
caggaggauggggccaggagg

SEQ ID NO: 32996 - RNA, 19 nt, Homo sapiens
ccugugggcaggcagaugu

SEQ ID NO: 32997 - RNA, 21 nt, Homo sapiens
aagaaacugaaaggagcacag

SEQ ID NO: 32998 - RNA, 18 nt, Homo sapiens
acauucucguggguucgu

SEQ ID NO: 32999 - RNA, 19 nt, Homo sapiens
uacagauuuaauucauguu

SEQ ID NO: 33000 - RNA, 16 nt, Homo sapiens
agccggaucaccacua

SEQ ID NO: 33001 - RNA, 17 nt, Homo sapiens
cccaccacccaccgccu

SEQ ID NO: 33002 - RNA, 19 nt, Homo sapiens
cgggcaacggccccuacgc

SEQ ID NO: 33003 - RNA, 19 nt, Homo sapiens
gcccccucuuucccagccc

SEQ ID NO: 33004 - RNA, 19 nt, Homo sapiens
gcggggagcucuggggagg

SEQ ID NO: 33005 - RNA, 22 nt, Homo sapiens
ggagaggggcggccacgggcgg

SEQ ID NO: 33006 - RNA, 22 nt, Homo sapiens
uggcuggcaaaaaggcaucagg

SEQ ID NO: 33007 - RNA, 19 nt, Homo sapiens
aagaggagggggagccgcu

SEQ ID NO: 33008 - RNA, 19 nt, Homo sapiens
cggcgccgccgggguaugc

SEQ ID NO: 33009 - RNA, 21 nt, Homo sapiens
gccggggucuagaccggccgg

SEQ ID NO: 33010 - RNA, 23 nt, Homo sapiens
gccggggucuagaccggccgggc

SEQ ID NO: 33011 - RNA, 23 nt, Homo sapiens
aggagcaagauccaggccugagc

SEQ ID NO: 33012 - RNA, 16 nt, Homo sapiens
aaagugacucuuuacu

SEQ ID NO: 33013 - RNA, 20 nt, Homo sapiens
acaagcauguaagauaauaa

SEQ ID NO: 33014 - RNA, 21 nt, Homo sapiens
agugguagcccucauaauugc

SEQ ID NO: 33015 - RNA, 22 nt, Homo sapiens
ccagccuccuuccugccuucau

SEQ ID NO: 33016 - RNA, 21 nt, Homo sapiens
ccuauauauuuuacuuguauu

SEQ ID NO: 33017 - RNA, 19 nt, Homo sapiens
uauuuauuccagccuccuu

SEQ ID NO: 33018 - RNA, 21 nt, Homo sapiens
ucagugguagcccucauaauu

SEQ ID NO: 33019 - RNA, 19 nt, Homo sapiens
uccuaauaucucuuugauu

SEQ ID NO: 33020 - RNA, 17 nt, Homo sapiens
ugagggggaggagggaa

SEQ ID NO: 33021 - RNA, 21 nt, Homo sapiens
ugccuuguuucuggucuccau

SEQ ID NO: 33022 - RNA, 20 nt, Homo sapiens
aaagugauguaaaucagagu

SEQ ID NO: 33023 - RNA, 16 nt, Homo sapiens
aagaaggcauugacca

SEQ ID NO: 33024 - RNA, 19 nt, Homo sapiens
agaaaguuggccgggugcg

SEQ ID NO: 33025 - RNA, 20 nt, Homo sapiens
agaucacaggagaaguaagg

SEQ ID NO: 33026 - RNA, 15 nt, Homo sapiens
cacagccucacugug

SEQ ID NO: 33027 - RNA, 19 nt, Homo sapiens
caccuguaaucucagcacu

SEQ ID NO: 33028 - RNA, 19 nt, Homo sapiens
cacuguguuacugaguacc

SEQ ID NO: 33029 - RNA, 18 nt, Homo sapiens
caguacuuauaguacuga

SEQ ID NO: 33030 - RNA, 17 nt, Homo sapiens
caugaguucuuagccag

SEQ ID NO: 33031 - RNA, 21 nt, Homo sapiens
ccagagaggguacuccuuugu

SEQ ID NO: 33032 - RNA, 18 nt, Homo sapiens
cccaaguuuugcuucacu

SEQ ID NO: 33033 - RNA, 24 nt, Homo sapiens
ccgggugcgguggcucacaccugu

SEQ ID NO: 33034 - RNA, 20 nt, Homo sapiens
ccugggcugccuccugcucc

SEQ ID NO: 33035 - RNA, 19 nt, Homo sapiens
cugcacugccuggcauuga

SEQ ID NO: 33036 - RNA, 26 nt, Homo sapiens
gagaaugcagugcuguacaauacuag

SEQ ID NO: 33037 - RNA, 21 nt, Homo sapiens
gaguacugugcugcauuccug

SEQ ID NO: 33038 - RNA, 18 nt, Homo sapiens
gagugguuuuccugggau

SEQ ID NO: 33039 - RNA, 18 nt, Homo sapiens
gauaugaauaggaguuac

SEQ ID NO: 33040 - RNA, 19 nt, Homo sapiens
gcacuuugggaagugcugc

SEQ ID NO: 33041 - RNA, 17 nt, Homo sapiens
gcccaccucccuccccc

SEQ ID NO: 33042 - RNA, 22 nt, Homo sapiens
gccuguaaccccagcuacuugg

SEQ ID NO: 33043 - RNA, 20 nt, Homo sapiens
gcgggggagggaagagcagc

SEQ ID NO: 33044 - RNA, 15 nt, Homo sapiens
gcuccccuggcagug

SEQ ID NO: 33045 - RNA, 21 nt, Homo sapiens
gcuugaaccugggagguagag

SEQ ID NO: 33046 - RNA, 17 nt, Homo sapiens
uaauaugcuaaugugca

SEQ ID NO: 33047 - RNA, 18 nt, Homo sapiens
uacacuguuacugaguau

SEQ ID NO: 33048 - RNA, 20 nt, Homo sapiens
uacauauacaagaaggcauu

SEQ ID NO: 33049 - RNA, 23 nt, Homo sapiens
uagccaacauggugaagcccugu

SEQ ID NO: 33050 - RNA, 17 nt, Homo sapiens
ucaggaaauauuuucgu

SEQ ID NO: 33051 - RNA, 15 nt, Homo sapiens
ugacucccuaaccaa

SEQ ID NO: 33052 - RNA, 20 nt, Homo sapiens
ugagugaaacagguuccacg

SEQ ID NO: 33053 - RNA, 19 nt, Homo sapiens
ugaugguggggugaauagg

SEQ ID NO: 33054 - RNA, 16 nt, Homo sapiens
uggcaagggcuuagca

SEQ ID NO: 33055 - RNA, 21 nt, Homo sapiens
uggcacaggaaaaagagacau

SEQ ID NO: 33056 - RNA, 17 nt, Homo sapiens
uggggugaauagguuug

SEQ ID NO: 33057 - RNA, 14 nt, Homo sapiens
uguguuacugagca

SEQ ID NO: 33058 - RNA, 19 nt, Homo sapiens
uuacugaguacuacacugu

SEQ ID NO: 33059 - RNA, 19 nt, Homo sapiens
uuacugaguacugcacugu

SEQ ID NO: 33060 - RNA, 18 nt, Homo sapiens
uucacauuuuaccagcuc

SEQ ID NO: 33061 - RNA, 17 nt, Homo sapiens
aagcgggaagaggacag

SEQ ID NO: 33062 - RNA, 18 nt, Homo sapiens
acugagaaggcucccuuc

SEQ ID NO: 33063 - RNA, 18 nt, Homo sapiens
agcgagugagcgagggag

SEQ ID NO: 33064 - RNA, 18 nt, Homo sapiens
agugguggcagcggcugc

SEQ ID NO: 33065 - RNA, 18 nt, Homo sapiens
cccccucccucuccuucc

SEQ ID NO: 33066 - RNA, 17 nt, Homo sapiens
ggugcccucccgagugg

SEQ ID NO: 33067 - RNA, 19 nt, Homo sapiens
uagaagggacucuaggggu

SEQ ID NO: 33068 - RNA, 16 nt, Homo sapiens
aagguaccagggcucu

SEQ ID NO: 33069 - RNA, 19 nt, Homo sapiens
agaaguuuauuaaugaaug

SEQ ID NO: 33070 - RNA, 18 nt, Homo sapiens
cacaagaaaaaccaaucu

SEQ ID NO: 33071 - RNA, 22 nt, Homo sapiens
caggaagaugaugggccuccuc

SEQ ID NO: 33072 - RNA, 14 nt, Homo sapiens
uggcugcagggccu

SEQ ID NO: 33073 - RNA, 22 nt, Homo sapiens
ccagaaggugggccagggccgg

SEQ ID NO: 33074 - RNA, 18 nt, Homo sapiens
cccacuguuccugcuuug

SEQ ID NO: 33075 - RNA, 19 nt, Homo sapiens
cccaggaagggguuuccuc

SEQ ID NO: 33076 - RNA, 22 nt, Homo sapiens
cccaggaugggucuuuuggagg

SEQ ID NO: 33077 - RNA, 19 nt, Homo sapiens
cguucccgagguaccaguc

SEQ ID NO: 33078 - RNA, 22 nt, Homo sapiens
cugcagcuugcucaggccgugg

SEQ ID NO: 33079 - RNA, 16 nt, Homo sapiens
cugcuggagggugcug

SEQ ID NO: 33080 - RNA, 20 nt, Homo sapiens
gaauucuugugggacaguuc

SEQ ID NO: 33081 - RNA, 20 nt, Homo sapiens
gcuugcucaggccgugggcc

SEQ ID NO: 33082 - RNA, 19 nt, Homo sapiens
ggaagcuggcugagggccu

SEQ ID NO: 33083 - RNA, 19 nt, Homo sapiens
ggagggugcugcugcuccg

SEQ ID NO: 33084 - RNA, 19 nt, Homo sapiens
gguucagggccucucccag

SEQ ID NO: 33085 - RNA, 18 nt, Homo sapiens
uccguggagggcagcagg

SEQ ID NO: 33086 - RNA, 16 nt, Homo sapiens
ugccugcuggagggug

SEQ ID NO: 33087 - RNA, 17 nt, Homo sapiens
uggcaugcugggcugcc

SEQ ID NO: 33088 - RNA, 18 nt, Homo sapiens
uguggacguuucauugaa

SEQ ID NO: 33089 - RNA, 22 nt, Homo sapiens
ccuggcucccagagcaccgggu

SEQ ID NO: 33090 - RNA, 20 nt, Homo sapiens
ggcauuggagcaagccuucu

SEQ ID NO: 33091 - RNA, 20 nt, Homo sapiens
ggguaggugguccaccagcc

SEQ ID NO: 33092 - RNA, 18 nt, Homo sapiens
ucacgguauucccagacg

SEQ ID NO: 33093 - RNA, 20 nt, Homo sapiens
ugcccagccuccuugcaguc

SEQ ID NO: 33094 - RNA, 18 nt, Homo sapiens
aaaaaaagaaaaaaaaaa

SEQ ID NO: 33095 - RNA, 20 nt, Homo sapiens
agcaaauguauagucaaugg

SEQ ID NO: 33096 - RNA, 18 nt, Homo sapiens
ccagauuuuuauagaaaa

SEQ ID NO: 33097 - RNA, 18 nt, Homo sapiens
cuugcugucuuccccgcu

SEQ ID NO: 33098 - RNA, 19 nt, Homo sapiens
gaguccaacucacuuuugc

SEQ ID NO: 33099 - RNA, 18 nt, Homo sapiens
gcaggaguuucccagccc

SEQ ID NO: 33100 - RNA, 18 nt, Homo sapiens
uacauauuuuauugcauu

SEQ ID NO: 33101 - RNA, 22 nt, Homo sapiens
ucacauauuuuuaaaagugcug

SEQ ID NO: 33102 - RNA, 23 nt, Homo sapiens
uccccauucuuugcuuccagauu

SEQ ID NO: 33103 - RNA, 22 nt, Homo sapiens
uuaaagacucuggaaguguuga

SEQ ID NO: 33104 - RNA, 23 nt, Homo sapiens
uuccaauaaaucuugcugucuuc

SEQ ID NO: 33105 - RNA, 17 nt, Homo sapiens
uugguggggguuggggu

SEQ ID NO: 33106 - RNA, 23 nt, Homo sapiens
gagcagcagccaucguggcaggc

SEQ ID NO: 33107 - RNA, 18 nt, Homo sapiens
gcauuaucaaaaugguua

SEQ ID NO: 33108 - RNA, 19 nt, Homo sapiens
ugcuacauuaguuagcaau

SEQ ID NO: 33109 - RNA, 17 nt, Homo sapiens
ggauaaugauuaaaaac

SEQ ID NO: 33110 - RNA, 18 nt, Homo sapiens
agguauuuggaaaacagg

SEQ ID NO: 33111 - RNA, 16 nt, Homo sapiens
uguacuccaucuuuag

SEQ ID NO: 33112 - RNA, 22 nt, Homo sapiens
aaaauccaaggaaauacagaag

SEQ ID NO: 33113 - RNA, 15 nt, Homo sapiens
cugccuuagagcagc

SEQ ID NO: 33114 - RNA, 22 nt, Homo sapiens
gaucaggaauggggucagguca

SEQ ID NO: 33115 - RNA, 17 nt, Homo sapiens
ggaaagauggauggaag

SEQ ID NO: 33116 - RNA, 15 nt, Homo sapiens
ggaaggaugaaugga

SEQ ID NO: 33117 - RNA, 22 nt, Homo sapiens
ggagagcaguggugcaaucuug

SEQ ID NO: 33118 - RNA, 18 nt, Homo sapiens
guggaggaaagagagagg

SEQ ID NO: 33119 - RNA, 21 nt, Homo sapiens
uaaggaaagcugagacucccc

SEQ ID NO: 33120 - RNA, 17 nt, Homo sapiens
uauagugaguguucugg

SEQ ID NO: 33121 - RNA, 16 nt, Homo sapiens
uauggugcaauaagac

SEQ ID NO: 33122 - RNA, 19 nt, Homo sapiens
ucuacugccuuagagcagg

SEQ ID NO: 33123 - RNA, 17 nt, Homo sapiens
ugcaauagguguucagu

SEQ ID NO: 33124 - RNA, 24 nt, Homo sapiens
ugggguccagauccuugaucauuc

SEQ ID NO: 33125 - RNA, 17 nt, Homo sapiens
uacccuacagaaaccag

SEQ ID NO: 33126 - RNA, 23 nt, Homo sapiens
uuuaucugcaugugguaggaguc

SEQ ID NO: 33127 - RNA, 17 nt, Homo sapiens
acccagagccacugagg

SEQ ID NO: 33128 - RNA, 16 nt, Homo sapiens
aggugagugggaaagu

SEQ ID NO: 33129 - RNA, 15 nt, Homo sapiens
ccggggcugcugcuu

SEQ ID NO: 33130 - RNA, 17 nt, Homo sapiens
gccagaguugccggggc

SEQ ID NO: 33131 - RNA, 18 nt, Homo sapiens
gcugcaaugugcucgcgg

SEQ ID NO: 33132 - RNA, 19 nt, Homo sapiens
ugagugggaaaguggggca

SEQ ID NO: 33133 - RNA, 20 nt, Homo sapiens
ugcugcuuuuaacucucuuu

SEQ ID NO: 33134 - RNA, 18 nt, Homo sapiens
aguugguuagagaagguu

SEQ ID NO: 33135 - RNA, 14 nt, Homo sapiens
uccaaccucucacu

SEQ ID NO: 33136 - RNA, 18 nt, Homo sapiens
uugguuagagaagguugu

SEQ ID NO: 33137 - RNA, 18 nt, Homo sapiens
uugguuagagaagguugu

SEQ ID NO: 33138 - RNA, 23 nt, Homo sapiens
aagcacauuggaaaaaaggagga

SEQ ID NO: 33139 - RNA, 20 nt, Homo sapiens
gggaacuuucugcagauuuc

SEQ ID NO: 33140 - RNA, 15 nt, Homo sapiens
guaggcuagcacacc

SEQ ID NO: 33141 - RNA, 18 nt, Homo sapiens
agaauuucaaagcauucu

SEQ ID NO: 33142 - RNA, 18 nt, Homo sapiens
uugguuagagaagguugu

SEQ ID NO: 33143 - RNA, 17 nt, Homo sapiens
uuguauucauauuucuc

SEQ ID NO: 33144 - RNA, 21 nt, Homo sapiens
gagagagagagagagaaagag

SEQ ID NO: 33145 - RNA, 18 nt, Homo sapiens
aguugguuagagaagguu

SEQ ID NO: 33146 - RNA, 14 nt, Homo sapiens
uccaaccucucacu

SEQ ID NO: 33147 - RNA, 18 nt, Homo sapiens
uugguuagagaagguugu

SEQ ID NO: 33148 - RNA, 21 nt, Homo sapiens
gagagagagagagagaaagag

SEQ ID NO: 33149 - RNA, 14 nt, Homo sapiens
uccaaccucucacu

SEQ ID NO: 33150 - RNA, 22 nt, Homo sapiens
aguuauugguuuauggcuggaa

SEQ ID NO: 33151 - RNA, 18 nt, Homo sapiens
ugaggaggagguggggga

SEQ ID NO: 33152 - RNA, 18 nt, Homo sapiens
ugaggaggagguggggga

SEQ ID NO: 33153 - RNA, 19 nt, Homo sapiens
aggggcuggcaccaaacca

SEQ ID NO: 33154 - RNA, 18 nt, Homo sapiens
agugggguggggaggagg

SEQ ID NO: 33155 - RNA, 22 nt, Homo sapiens
aguuauugguuuauggcuggaa

SEQ ID NO: 33156 - RNA, 18 nt, Homo sapiens
aaagccauauaaauauua

SEQ ID NO: 33157 - RNA, 19 nt, Homo sapiens
aggggcuggcaccaaacca

SEQ ID NO: 33158 - RNA, 18 nt, Homo sapiens
agugggguggggaggagg

SEQ ID NO: 33159 - RNA, 22 nt, Homo sapiens
aguuauugguuuauggcuggaa

SEQ ID NO: 33160 - RNA, 16 nt, Homo sapiens
cuuccugcuggggcuc

SEQ ID NO: 33161 - RNA, 16 nt, Homo sapiens
ggagugggguggggag

SEQ ID NO: 33162 - RNA, 23 nt, Homo sapiens
gucugggguucucuggcagcccc

SEQ ID NO: 33163 - RNA, 18 nt, Homo sapiens
ugaggaggagguggggga

SEQ ID NO: 33164 - RNA, 18 nt, Homo sapiens
aaagccauauaaauauua

SEQ ID NO: 33165 - RNA, 19 nt, Homo sapiens
aggggcuggcaccaaacca

SEQ ID NO: 33166 - RNA, 22 nt, Homo sapiens
aguuauugguuuauggcuggaa

SEQ ID NO: 33167 - RNA, 19 nt, Homo sapiens
aggggcuggcaccaaacca

SEQ ID NO: 33168 - RNA, 17 nt, Homo sapiens
cccgccgcccgcugccc

SEQ ID NO: 33169 - RNA, 23 nt, Homo sapiens
gucugggguucucuggcagcccc

SEQ ID NO: 33170 - RNA, 18 nt, Homo sapiens
agugggguggggaggagg

SEQ ID NO: 33171 - RNA, 17 nt, Homo sapiens
cccgccgcccgcugccc

SEQ ID NO: 33172 - RNA, 18 nt, Homo sapiens
agugggguggggaggagg

SEQ ID NO: 33173 - RNA, 18 nt, Homo sapiens
agugggguggggaggagg

SEQ ID NO: 33174 - RNA, 23 nt, Homo sapiens
gucugggguucucuggcagcccc

SEQ ID NO: 33175 - RNA, 19 nt, Homo sapiens
aggggcuggcaccaaacca

SEQ ID NO: 33176 - RNA, 22 nt, Homo sapiens
aguuauugguuuauggcuggaa

SEQ ID NO: 33177 - RNA, 19 nt, Homo sapiens
aggggcuggcaccaaacca

SEQ ID NO: 33178 - RNA, 18 nt, Homo sapiens
agugggguggggaggagg

SEQ ID NO: 33179 - RNA, 22 nt, Homo sapiens
aguuauugguuuauggcuggaa

SEQ ID NO: 33180 - RNA, 18 nt, Homo sapiens
aaagccauauaaauauua

SEQ ID NO: 33181 - RNA, 18 nt, Homo sapiens
agugggguggggaggagg

SEQ ID NO: 33182 - RNA, 17 nt, Homo sapiens
uaaaaaaguacaugcaa

SEQ ID NO: 33183 - RNA, 20 nt, Homo sapiens
caugcacauuuccugcuuug

SEQ ID NO: 33184 - RNA, 23 nt, Homo sapiens
aaaaaaagagaaucaaaugaaga

SEQ ID NO: 33185 - RNA, 21 nt, Homo sapiens
cuggguuaaagaaugaauugu

SEQ ID NO: 33186 - RNA, 21 nt, Homo sapiens
uaaaacaaagggagaaagaac

SEQ ID NO: 33187 - RNA, 19 nt, Homo sapiens
ugggaggacgguucugugg

SEQ ID NO: 33188 - RNA, 19 nt, Homo sapiens
uuuuacacauuaacacaca

SEQ ID NO: 33189 - RNA, 15 nt, Homo sapiens
gucauuauagccacu

SEQ ID NO: 33190 - RNA, 20 nt, Homo sapiens
ugacauuagcucuuaauacu

SEQ ID NO: 33191 - RNA, 18 nt, Homo sapiens
ugucuagauuuaaguuac

SEQ ID NO: 33192 - RNA, 17 nt, Homo sapiens
uuaacuuucauaucacc

SEQ ID NO: 33193 - RNA, 18 nt, Homo sapiens
cuagggcccggauuuccc

SEQ ID NO: 33194 - RNA, 16 nt, Homo sapiens
uaaaaggagacaccuc

SEQ ID NO: 33195 - RNA, 19 nt, Homo sapiens
uagggcccggauuucccgg

SEQ ID NO: 33196 - RNA, 17 nt, Homo sapiens
augugguggucacaaga

SEQ ID NO: 33197 - RNA, 22 nt, Homo sapiens
cacuagacaugugguggucaca

SEQ ID NO: 33198 - RNA, 20 nt, Homo sapiens
uucagauaaauuuauuacug

SEQ ID NO: 33199 - RNA, 21 nt, Homo sapiens
caucauguucuuacaugaggc

SEQ ID NO: 33200 - RNA, 24 nt, Homo sapiens
uaucuuacuuuauauaaaauuuca

SEQ ID NO: 33201 - RNA, 20 nt, Homo sapiens
aagcaggacuuuugguguau

SEQ ID NO: 33202 - RNA, 17 nt, Homo sapiens
augggugacugcagaaa

SEQ ID NO: 33203 - RNA, 17 nt, Homo sapiens
uaauagcaauguuugug

SEQ ID NO: 33204 - RNA, 18 nt, Homo sapiens
uaugaugcauuaaaagca

SEQ ID NO: 33205 - RNA, 17 nt, Homo sapiens
uucugagacuaggguag

SEQ ID NO: 33206 - RNA, 19 nt, Homo sapiens
uuucaauuuuguuuuccgc

SEQ ID NO: 33207 - RNA, 18 nt, Homo sapiens
ccccagccugccugcucc

SEQ ID NO: 33208 - RNA, 25 nt, Homo sapiens
ccgccggccgcggccugcgcucccg

SEQ ID NO: 33209 - RNA, 20 nt, Homo sapiens
ccucgguccgcuggggaugg

SEQ ID NO: 33210 - RNA, 16 nt, Homo sapiens
cgccgggcugggcugg

SEQ ID NO: 33211 - RNA, 20 nt, Homo sapiens
gagugcgcgccgacagcuga

SEQ ID NO: 33212 - RNA, 18 nt, Homo sapiens
ggacccacagguccaggg

SEQ ID NO: 33213 - RNA, 14 nt, Homo sapiens
ggcaggcggcggcc

SEQ ID NO: 33214 - RNA, 24 nt, Homo sapiens
gggcagucuguggggacagucacc

SEQ ID NO: 33215 - RNA, 21 nt, Homo sapiens
uccucgguccgcuggggaugg

SEQ ID NO: 33216 - RNA, 19 nt, Homo sapiens
ccaacgcggguggaucacc

SEQ ID NO: 33217 - RNA, 23 nt, Homo sapiens
aacagccacaugugguuaguggc

SEQ ID NO: 33218 - RNA, 18 nt, Homo sapiens
acuggaaggcggagguug

SEQ ID NO: 33219 - RNA, 18 nt, Homo sapiens
aguggcuaccacacugga

SEQ ID NO: 33220 - RNA, 16 nt, Homo sapiens
caaaagcaccauuccc

SEQ ID NO: 33221 - RNA, 18 nt, Homo sapiens
caaguucaagugauucuu

SEQ ID NO: 33222 - RNA, 19 nt, Homo sapiens
caccuguaauccuagaacu

SEQ ID NO: 33223 - RNA, 19 nt, Homo sapiens
cacugucccugaauaccac

SEQ ID NO: 33224 - RNA, 19 nt, Homo sapiens
cagugagauugcaccacug

SEQ ID NO: 33225 - RNA, 20 nt, Homo sapiens
caguggcacaauccuggcuc

SEQ ID NO: 33226 - RNA, 18 nt, Homo sapiens
caugaucugugguuuucu

SEQ ID NO: 33227 - RNA, 20 nt, Homo sapiens
cccuuguuuuugauucuacc

SEQ ID NO: 33228 - RNA, 18 nt, Homo sapiens
ccugaauaccacuaacuu

SEQ ID NO: 33229 - RNA, 18 nt, Homo sapiens
ccuggaaggcggagguug

SEQ ID NO: 33230 - RNA, 15 nt, Homo sapiens
gaaucuugcuugguu

SEQ ID NO: 33231 - RNA, 18 nt, Homo sapiens
gucaauacaguagccacu

SEQ ID NO: 33232 - RNA, 20 nt, Homo sapiens
guggaucacgaggucaggag

SEQ ID NO: 33233 - RNA, 21 nt, Homo sapiens
uacuacugggcugauuacuuc

SEQ ID NO: 33234 - RNA, 21 nt, Homo sapiens
uauguuuccuguaucauuucc

SEQ ID NO: 33235 - RNA, 17 nt, Homo sapiens
uccuguaucauuuccag

SEQ ID NO: 33236 - RNA, 17 nt, Homo sapiens
ucuuuaauauuacacau

SEQ ID NO: 33237 - RNA, 23 nt, Homo sapiens
uucugaauggcuguuagcgggcc

SEQ ID NO: 33238 - RNA, 17 nt, Homo sapiens
uugggaggccaaggugg

SEQ ID NO: 33239 - RNA, 21 nt, Homo sapiens
uuuagggcugcugcacugaca

SEQ ID NO: 33240 - RNA, 19 nt, Homo sapiens
uuuuaauuaucuuuagucu

SEQ ID NO: 33241 - RNA, 20 nt, Homo sapiens
aggcacaagugcaauucugc

SEQ ID NO: 33242 - RNA, 18 nt, Homo sapiens
uauguucgugaggcacaa

SEQ ID NO: 33243 - RNA, 19 nt, Homo sapiens
agccuguacgccgcagccc

SEQ ID NO: 33244 - RNA, 23 nt, Homo sapiens
ccacuugcugggguccagugcca

SEQ ID NO: 33245 - RNA, 19 nt, Homo sapiens
cgccagccuuuggcugucu

SEQ ID NO: 33246 - RNA, 16 nt, Homo sapiens
ggcgcgcucugcgggc

SEQ ID NO: 33247 - RNA, 22 nt, Homo sapiens
gggacaggaaccggcuaggggc

SEQ ID NO: 33248 - RNA, 20 nt, Homo sapiens
uauuugauaugacaaaauau

SEQ ID NO: 33249 - RNA, 17 nt, Homo sapiens
ugacucuuugaaguuga

SEQ ID NO: 33250 - RNA, 17 nt, Homo sapiens
cacccacagggacacaa

SEQ ID NO: 33251 - RNA, 17 nt, Homo sapiens
gaaugccaugacugaag

SEQ ID NO: 33252 - RNA, 24 nt, Homo sapiens
aaaaaguaaacucuaauuggaacc

SEQ ID NO: 33253 - RNA, 21 nt, Homo sapiens
aaacaaaaauaauaacuuuuu

SEQ ID NO: 33254 - RNA, 17 nt, Homo sapiens
aaacuaccaaauaaugc

SEQ ID NO: 33255 - RNA, 22 nt, Homo sapiens
aacacauuuaccucaugucaac

SEQ ID NO: 33256 - RNA, 20 nt, Homo sapiens
aagaacaaggaaaagauaga

SEQ ID NO: 33257 - RNA, 17 nt, Homo sapiens
aaggcuguggucucccc

SEQ ID NO: 33258 - RNA, 22 nt, Homo sapiens
aguuguauauuuagaaccccaa

SEQ ID NO: 33259 - RNA, 15 nt, Homo sapiens
auacagccucaguca

SEQ ID NO: 33260 - RNA, 17 nt, Homo sapiens
ccucuuuucuuccacuu

SEQ ID NO: 33261 - RNA, 19 nt, Homo sapiens
uaaagugugauguuuauau

SEQ ID NO: 33262 - RNA, 20 nt, Homo sapiens
uaaugcuuuuacagauaaua

SEQ ID NO: 33263 - RNA, 25 nt, Homo sapiens
uccgaagaguuuuguuuguggaggu

SEQ ID NO: 33264 - RNA, 16 nt, Homo sapiens
uuucuaaaauaccaga

SEQ ID NO: 33265 - RNA, 18 nt, Homo sapiens
acccccucccgagcgccg

SEQ ID NO: 33266 - RNA, 17 nt, Homo sapiens
agcaaaaugaauacagc

SEQ ID NO: 33267 - RNA, 22 nt, Homo sapiens
ccucugccgcgaagcgcagcac

SEQ ID NO: 33268 - RNA, 19 nt, Homo sapiens
cuugacugagaagggcucc

SEQ ID NO: 33269 - RNA, 18 nt, Homo sapiens
uauguagaccaacuccug

SEQ ID NO: 33270 - RNA, 19 nt, Homo sapiens
uucuuuucuuuuuaucccc

SEQ ID NO: 33271 - RNA, 19 nt, Homo sapiens
aguauuuuugguacaaaaa

SEQ ID NO: 33272 - RNA, 20 nt, Homo sapiens
agugaaacugaaaacauuag

SEQ ID NO: 33273 - RNA, 17 nt, Homo sapiens
augccugaugagcgaag

SEQ ID NO: 33274 - RNA, 19 nt, Homo sapiens
cagguucucaaaggucuuc

SEQ ID NO: 33275 - RNA, 18 nt, Homo sapiens
gaaaaauagguuagcuuu

SEQ ID NO: 33276 - RNA, 20 nt, Homo sapiens
ggaauuuucccuaggcacuu

SEQ ID NO: 33277 - RNA, 18 nt, Homo sapiens
uccaguaggugagcauuu

SEQ ID NO: 33278 - RNA, 21 nt, Homo sapiens
ugaaauggaaggguugacaug

SEQ ID NO: 33279 - RNA, 19 nt, Homo sapiens
uuaaaacaaacauacauug

SEQ ID NO: 33280 - RNA, 21 nt, Homo sapiens
uuguccauucucuggaauggg

SEQ ID NO: 33281 - RNA, 23 nt, Homo sapiens
agagcuauccugcucuuuaaagc

SEQ ID NO: 33282 - RNA, 16 nt, Homo sapiens
ccugggggcccaauag

SEQ ID NO: 33283 - RNA, 20 nt, Homo sapiens
cugcgugugugugugugugu

SEQ ID NO: 33284 - RNA, 19 nt, Homo sapiens
gccuggagauuggcugugc

SEQ ID NO: 33285 - RNA, 24 nt, Homo sapiens
gccuggagauuggcugugcgggcc

SEQ ID NO: 33286 - RNA, 15 nt, Homo sapiens
ggguuggaaaagcau

SEQ ID NO: 33287 - RNA, 18 nt, Homo sapiens
uaugugugugugugugug

SEQ ID NO: 33288 - RNA, 15 nt, Homo sapiens
uccaagcaccacagc

SEQ ID NO: 33289 - RNA, 15 nt, Homo sapiens
ugggagggagggagc

SEQ ID NO: 33290 - RNA, 16 nt, Homo sapiens
ugucuguggucagauu

SEQ ID NO: 33291 - RNA, 21 nt, Homo sapiens
ugugucugcgugugugugugu

SEQ ID NO: 33292 - RNA, 23 nt, Homo sapiens
ugugugugugugugucugcgugu

SEQ ID NO: 33293 - RNA, 19 nt, Homo sapiens
ugugugugugugugugucu

SEQ ID NO: 33294 - RNA, 18 nt, Homo sapiens
ugugugugugugugugug

SEQ ID NO: 33295 - RNA, 20 nt, Homo sapiens
ugugugugugugugugugua

SEQ ID NO: 33296 - RNA, 24 nt, Homo sapiens
cucgguuaccguaccgccacagag

SEQ ID NO: 33297 - RNA, 17 nt, Homo sapiens
ugggggucacucgaggg

SEQ ID NO: 33298 - RNA, 23 nt, Homo sapiens
aaaguauauuuauauauauagau

SEQ ID NO: 33299 - RNA, 21 nt, Homo sapiens
cccugaaagggcugcuccagc

SEQ ID NO: 33300 - RNA, 22 nt, Homo sapiens
uauauuuauauauauagauaua

SEQ ID NO: 33301 - RNA, 24 nt, Homo sapiens
uauauuuauauauauagauauaga

SEQ ID NO: 33302 - RNA, 23 nt, Homo sapiens
uuuggcagauacgaaaccaaguu

SEQ ID NO: 33303 - RNA, 25 nt, Homo sapiens
caaagugcuguaacagugaccaucu

SEQ ID NO: 33304 - RNA, 18 nt, Homo sapiens
caauccuagguacaauca

SEQ ID NO: 33305 - RNA, 18 nt, Homo sapiens
cugcuggggauuuuuuga

SEQ ID NO: 33306 - RNA, 20 nt, Homo sapiens
cuggguguuagcaaugggau

SEQ ID NO: 33307 - RNA, 18 nt, Homo sapiens
ggguguaaagggaaagca

SEQ ID NO: 33308 - RNA, 22 nt, Homo sapiens
uaaacagcuauacauguagguu

SEQ ID NO: 33309 - RNA, 21 nt, Homo sapiens
uacauacaauuagaagauaua

SEQ ID NO: 33310 - RNA, 23 nt, Homo sapiens
uagaaagauuuaaaaagaaaaag

SEQ ID NO: 33311 - RNA, 16 nt, Homo sapiens
ugagccagaugaguua

SEQ ID NO: 33312 - RNA, 21 nt, Homo sapiens
uguagguuccggaaauugugg

SEQ ID NO: 33313 - RNA, 21 nt, Homo sapiens
ucgcuguggccucgugacucc

SEQ ID NO: 33314 - RNA, 21 nt, Homo sapiens
gcauggugauaauaaaaugau

SEQ ID NO: 33315 - RNA, 17 nt, Homo sapiens
gcauugcauggugauaa

SEQ ID NO: 33316 - RNA, 15 nt, Homo sapiens
aaggauggcaaacca

SEQ ID NO: 33317 - RNA, 18 nt, Homo sapiens
aaugaacaaggauggcaa

SEQ ID NO: 33318 - RNA, 19 nt, Homo sapiens
agcaacuuccaccuccugg

SEQ ID NO: 33319 - RNA, 17 nt, Homo sapiens
agccauuaaaaauuuaa

SEQ ID NO: 33320 - RNA, 21 nt, Homo sapiens
auugauccuuauuuuaagguc

SEQ ID NO: 33321 - RNA, 20 nt, Homo sapiens
gcaaauuaaauauuuucaca

SEQ ID NO: 33322 - RNA, 20 nt, Homo sapiens
gcugggugcgguggcucaug

SEQ ID NO: 33323 - RNA, 17 nt, Homo sapiens
uccccucuuaauugaaa

SEQ ID NO: 33324 - RNA, 18 nt, Homo sapiens
uguauuagcuuuaaagua

SEQ ID NO: 33325 - RNA, 19 nt, Homo sapiens
ugggaggacgguucugugg

SEQ ID NO: 33326 - RNA, 19 nt, Homo sapiens
ggaaaaaaaaaagugccca

SEQ ID NO: 33327 - RNA, 19 nt, Homo sapiens
gugcauggcuuugugaggg

SEQ ID NO: 33328 - RNA, 21 nt, Homo sapiens
aaaaaaaaaaaaguguacacu

SEQ ID NO: 33329 - RNA, 21 nt, Homo sapiens
aaaauaaucucaacuuccacu

SEQ ID NO: 33330 - RNA, 17 nt, Homo sapiens
agacacagcuccuauau

SEQ ID NO: 33331 - RNA, 17 nt, Homo sapiens
ggcucuugguggcaagu

SEQ ID NO: 33332 - RNA, 21 nt, Homo sapiens
uggcucaaugcaauuuuggug

SEQ ID NO: 33333 - RNA, 20 nt, Homo sapiens
ugguauaagagcaacauuua

SEQ ID NO: 33334 - RNA, 20 nt, Homo sapiens
aucugugugugcaucugugu

SEQ ID NO: 33335 - RNA, 19 nt, Homo sapiens
cauuggcgugugugugugu

SEQ ID NO: 33336 - RNA, 17 nt, Homo sapiens
cccucccucccaugccc

SEQ ID NO: 33337 - RNA, 22 nt, Homo sapiens
ccgugugugugcauaucucugu

SEQ ID NO: 33338 - RNA, 20 nt, Homo sapiens
cguaucucugugugaccauc

SEQ ID NO: 33339 - RNA, 24 nt, Homo sapiens
cugugugugugcauuggcgugugu

SEQ ID NO: 33340 - RNA, 19 nt, Homo sapiens
gagagcuaaacaaccgccu

SEQ ID NO: 33341 - RNA, 18 nt, Homo sapiens
gugaagcugggaagcagg

SEQ ID NO: 33342 - RNA, 18 nt, Homo sapiens
gugugugugcaucugugu

SEQ ID NO: 33343 - RNA, 24 nt, Homo sapiens
ucucugucucugucucucucuguu

SEQ ID NO: 33344 - RNA, 16 nt, Homo sapiens
ugaaucuuggagucuc

SEQ ID NO: 33345 - RNA, 18 nt, Homo sapiens
ugcauccgugugcacuga

SEQ ID NO: 33346 - RNA, 23 nt, Homo sapiens
ugcaucugugugugcaucugugu

SEQ ID NO: 33347 - RNA, 16 nt, Homo sapiens
uggcuuucucuccaca

SEQ ID NO: 33348 - RNA, 23 nt, Homo sapiens
ugugcauuggcgugugugugugu

SEQ ID NO: 33349 - RNA, 17 nt, Homo sapiens
uugacauuccccauggg

SEQ ID NO: 33350 - RNA, 19 nt, Homo sapiens
uauuacacacaaugaggua

SEQ ID NO: 33351 - RNA, 17 nt, Homo sapiens
agcaggcucgggucugg

SEQ ID NO: 33352 - RNA, 18 nt, Homo sapiens
cagggaccaggggcaaga

SEQ ID NO: 33353 - RNA, 18 nt, Homo sapiens
cggagggcagcugggggc

SEQ ID NO: 33354 - RNA, 19 nt, Homo sapiens
cggguccucugccccaccg

SEQ ID NO: 33355 - RNA, 23 nt, Homo sapiens
ggagaggccuagucucuggacau

SEQ ID NO: 33356 - RNA, 27 nt, Homo sapiens
gggcaagaugcaggaagcggugaucca

SEQ ID NO: 33357 - RNA, 15 nt, Homo sapiens
ggggcagggaccagg

SEQ ID NO: 33358 - RNA, 17 nt, Homo sapiens
uccucugccccaccggg

SEQ ID NO: 33359 - RNA, 17 nt, Homo sapiens
ugaggccccuccagacc

SEQ ID NO: 33360 - RNA, 19 nt, Homo sapiens
aaccucugagaaaaguaua

SEQ ID NO: 33361 - RNA, 18 nt, Homo sapiens
auggugcuagguuccagg

SEQ ID NO: 33362 - RNA, 19 nt, Homo sapiens
cagcccaccuucugcagug

SEQ ID NO: 33363 - RNA, 19 nt, Homo sapiens
ccucagggcucucaccggg

SEQ ID NO: 33364 - RNA, 24 nt, Homo sapiens
ccugcagccugccucuuuucugcc

SEQ ID NO: 33365 - RNA, 19 nt, Homo sapiens
cuguucucaucccuccccc

SEQ ID NO: 33366 - RNA, 17 nt, Homo sapiens
gcaguguguauguugcc

SEQ ID NO: 33367 - RNA, 19 nt, Homo sapiens
gcucuggccccaauccucc

SEQ ID NO: 33368 - RNA, 24 nt, Homo sapiens
ggaaagccauuaagaguauguuaa

SEQ ID NO: 33369 - RNA, 15 nt, Homo sapiens
ggccucuccuggggc

SEQ ID NO: 33370 - RNA, 21 nt, Homo sapiens
ggguaagacaagaauggggag

SEQ ID NO: 33371 - RNA, 18 nt, Homo sapiens
ggugcuagguuccaggag

SEQ ID NO: 33372 - RNA, 19 nt, Homo sapiens
ucagggcucucaccgggcu

SEQ ID NO: 33373 - RNA, 18 nt, Homo sapiens
ucccccagcucuggcccc

SEQ ID NO: 33374 - RNA, 22 nt, Homo sapiens
ugccuguuuccagucuccuggu

SEQ ID NO: 33375 - RNA, 17 nt, Homo sapiens
aaggccucuuucauuac

SEQ ID NO: 33376 - RNA, 21 nt, Homo sapiens
ccgcggccccgccaggccucg

SEQ ID NO: 33377 - RNA, 18 nt, Homo sapiens
cgcccgagugggcgaucg

SEQ ID NO: 33378 - RNA, 17 nt, Homo sapiens
gaaagcuugacccagag

SEQ ID NO: 33379 - RNA, 20 nt, Homo sapiens
gcaaacgcgcggcggcggcg

SEQ ID NO: 33380 - RNA, 14 nt, Homo sapiens
gccaggcccggccg

SEQ ID NO: 33381 - RNA, 21 nt, Homo sapiens
gcccuucccugccaggcccgg

SEQ ID NO: 33382 - RNA, 19 nt, Homo sapiens
gcgcggcggcggcggcggc

SEQ ID NO: 33383 - RNA, 22 nt, Homo sapiens
gcucgggccgucucggagucug

SEQ ID NO: 33384 - RNA, 17 nt, Homo sapiens
gugcuguuggguugucc

SEQ ID NO: 33385 - RNA, 17 nt, Homo sapiens
ucugggcagcgcccacc

SEQ ID NO: 33386 - RNA, 17 nt, Homo sapiens
ggggugggauggaggug

SEQ ID NO: 33387 - RNA, 19 nt, Homo sapiens
uugguuuuuuuucucaaua

SEQ ID NO: 33388 - RNA, 17 nt, Homo sapiens
cccagcccugacaccuc

SEQ ID NO: 33389 - RNA, 19 nt, Homo sapiens
uguuuauuucaucuccauu

SEQ ID NO: 33390 - RNA, 23 nt, Homo sapiens
uuuaaaaaucaguucuggguaga

SEQ ID NO: 33391 - RNA, 19 nt, Homo sapiens
ugaguggggagacagggca

SEQ ID NO: 33392 - RNA, 18 nt, Homo sapiens
gggcaggaaggaagcggc

SEQ ID NO: 33393 - RNA, 17 nt, Homo sapiens
ggugggcagggcaggaa

SEQ ID NO: 33394 - RNA, 20 nt, Homo sapiens
ucugacuuugggggaucccc

SEQ ID NO: 33395 - RNA, 15 nt, Homo sapiens
uggccgagcuagggc

SEQ ID NO: 33396 - RNA, 17 nt, Homo sapiens
uuaauaauaguggccau

SEQ ID NO: 33397 - RNA, 18 nt, Homo sapiens
caccgggcggcgggugau

SEQ ID NO: 33398 - RNA, 19 nt, Homo sapiens
caggggcagggugugcgug

SEQ ID NO: 33399 - RNA, 21 nt, Homo sapiens
ccgguugcuggcgcgggcggc

SEQ ID NO: 33400 - RNA, 17 nt, Homo sapiens
ccuggagucgggguggg

SEQ ID NO: 33401 - RNA, 18 nt, Homo sapiens
cggggccgcaacgccgcc

SEQ ID NO: 33402 - RNA, 16 nt, Homo sapiens
cuuccaggaggacagg

SEQ ID NO: 33403 - RNA, 21 nt, Homo sapiens
gcgugggagugcagaggcugc

SEQ ID NO: 33404 - RNA, 22 nt, Homo sapiens
gcugcuggcgcuagcgcuggcg

SEQ ID NO: 33405 - RNA, 16 nt, Homo sapiens
ggcgcgggcggcggcg

SEQ ID NO: 33406 - RNA, 22 nt, Homo sapiens
ggcggcgggcaccgggcggcgg

SEQ ID NO: 33407 - RNA, 17 nt, Homo sapiens
ggggccgcaacgccgcc

SEQ ID NO: 33408 - RNA, 21 nt, Homo sapiens
uccgugggaagcaccaggaaa

SEQ ID NO: 33409 - RNA, 22 nt, Homo sapiens
uggagucgggguggguggggag

SEQ ID NO: 33410 - RNA, 20 nt, Homo sapiens
cgggcggcgggugaucgggc

SEQ ID NO: 33411 - RNA, 16 nt, Homo sapiens
ggcgcgggcggcggcg

SEQ ID NO: 33412 - RNA, 17 nt, Homo sapiens
agcagcuucucugguug

SEQ ID NO: 33413 - RNA, 19 nt, Homo sapiens
agggagcgagggaggcggc

SEQ ID NO: 33414 - RNA, 21 nt, Homo sapiens
caccacggccaccagugcccc

SEQ ID NO: 33415 - RNA, 19 nt, Homo sapiens
caccaggucuaggcccggc

SEQ ID NO: 33416 - RNA, 16 nt, Homo sapiens
cacgagcugccucugg

SEQ ID NO: 33417 - RNA, 18 nt, Homo sapiens
cagcuguccuccaggugc

SEQ ID NO: 33418 - RNA, 17 nt, Homo sapiens
cgcuugggguucagggc

SEQ ID NO: 33419 - RNA, 23 nt, Homo sapiens
cuacugucugccauggcaucauu

SEQ ID NO: 33420 - RNA, 18 nt, Homo sapiens
cugaugcccuccaccugc

SEQ ID NO: 33421 - RNA, 19 nt, Homo sapiens
gagcucacaaacgugugca

SEQ ID NO: 33422 - RNA, 21 nt, Homo sapiens
gcaaggaaggcgagcgcgguc

SEQ ID NO: 33423 - RNA, 21 nt, Homo sapiens
gcggcgggcagagcgggcgcc

SEQ ID NO: 33424 - RNA, 19 nt, Homo sapiens
ggccaggaggaaaucucag

SEQ ID NO: 33425 - RNA, 23 nt, Homo sapiens
gguccagguucaugcgcaggguc

SEQ ID NO: 33426 - RNA, 16 nt, Homo sapiens
gugaaggugguugugg

SEQ ID NO: 33427 - RNA, 17 nt, Homo sapiens
uccaggucgauggcagc

SEQ ID NO: 33428 - RNA, 17 nt, Homo sapiens
uccgaaaagugggagua

SEQ ID NO: 33429 - RNA, 19 nt, Homo sapiens
uggauccguuucagagaca

SEQ ID NO: 33430 - RNA, 18 nt, Homo sapiens
aggucccuugccccguuc

SEQ ID NO: 33431 - RNA, 20 nt, Homo sapiens
cacccagagcccugccugcu

SEQ ID NO: 33432 - RNA, 24 nt, Homo sapiens
cagagggaugugugacacaacgug

SEQ ID NO: 33433 - RNA, 18 nt, Homo sapiens
cagaugagguuguugaga

SEQ ID NO: 33434 - RNA, 21 nt, Homo sapiens
cagcagagcuuucaacuccuc

SEQ ID NO: 33435 - RNA, 17 nt, Homo sapiens
ccaaagauccuacagcc

SEQ ID NO: 33436 - RNA, 15 nt, Homo sapiens
cccccacacuagccc

SEQ ID NO: 33437 - RNA, 16 nt, Homo sapiens
ccccgcccggccccgc

SEQ ID NO: 33438 - RNA, 19 nt, Homo sapiens
cccggccccgcucggcucc

SEQ ID NO: 33439 - RNA, 19 nt, Homo sapiens
cccggguugggggagaggg

SEQ ID NO: 33440 - RNA, 20 nt, Homo sapiens
ccgcccgcccgcgcgcgcug

SEQ ID NO: 33441 - RNA, 17 nt, Homo sapiens
ccgcccggccccgcucg

SEQ ID NO: 33442 - RNA, 18 nt, Homo sapiens
cggcuccgaucuguccgc

SEQ ID NO: 33443 - RNA, 20 nt, Homo sapiens
cuguccgcccgcccgcgcgc

SEQ ID NO: 33444 - RNA, 20 nt, Homo sapiens
gaccgguggcgggcucagcg

SEQ ID NO: 33445 - RNA, 16 nt, Homo sapiens
gcacccagaaggagga

SEQ ID NO: 33446 - RNA, 19 nt, Homo sapiens
gccggagcccgcggccgcc

SEQ ID NO: 33447 - RNA, 21 nt, Homo sapiens
gccggagcccgcggccgccgc

SEQ ID NO: 33448 - RNA, 18 nt, Homo sapiens
gcggguccuggggcgcug

SEQ ID NO: 33449 - RNA, 15 nt, Homo sapiens
ggacagucacugggc

SEQ ID NO: 33450 - RNA, 18 nt, Homo sapiens
ggagagaguccaacucuu

SEQ ID NO: 33451 - RNA, 18 nt, Homo sapiens
ggaggagagaggggcagc

SEQ ID NO: 33452 - RNA, 19 nt, Homo sapiens
ggugggggcuaucucuaca

SEQ ID NO: 33453 - RNA, 24 nt, Homo sapiens
gugggagaaugguucucagagaca

SEQ ID NO: 33454 - RNA, 18 nt, Homo sapiens
uacagcaccagggccgca

SEQ ID NO: 33455 - RNA, 17 nt, Homo sapiens
ugaggucccuugccccg

SEQ ID NO: 33456 - RNA, 25 nt, Homo sapiens
ugggugggggcuaucucuacagcaa

SEQ ID NO: 33457 - RNA, 23 nt, Homo sapiens
ugucugguggagggagggggggc

SEQ ID NO: 33458 - RNA, 18 nt, Homo sapiens
aggcugggggcugggguc

SEQ ID NO: 33459 - RNA, 18 nt, Homo sapiens
cauuuguaagaaguuuau

SEQ ID NO: 33460 - RNA, 24 nt, Homo sapiens
cccccggaccggggcugaggcugg

SEQ ID NO: 33461 - RNA, 19 nt, Homo sapiens
cccuuggccccuuccugcc

SEQ ID NO: 33462 - RNA, 19 nt, Homo sapiens
ccuggcgggggcgcgggga

SEQ ID NO: 33463 - RNA, 18 nt, Homo sapiens
cuccccuucucucccugg

SEQ ID NO: 33464 - RNA, 19 nt, Homo sapiens
gagggcacaggccacagac

SEQ ID NO: 33465 - RNA, 19 nt, Homo sapiens
gccgcgagagaggacgccg

SEQ ID NO: 33466 - RNA, 19 nt, Homo sapiens
gccgggcagggcccccucc

SEQ ID NO: 33467 - RNA, 20 nt, Homo sapiens
ggagccggcagaggcugggg

SEQ ID NO: 33468 - RNA, 19 nt, Homo sapiens
ggccccuuccugccccgcc

SEQ ID NO: 33469 - RNA, 20 nt, Homo sapiens
gggagaaagggguugccuag

SEQ ID NO: 33470 - RNA, 25 nt, Homo sapiens
gggccgggcagggcccccucccggg

SEQ ID NO: 33471 - RNA, 27 nt, Homo sapiens
gggcugaggcugggggcuggggucggg

SEQ ID NO: 33472 - RNA, 18 nt, Homo sapiens
ggggcgcggggagagggg

SEQ ID NO: 33473 - RNA, 21 nt, Homo sapiens
ggucacgggcucaugggucac

SEQ ID NO: 33474 - RNA, 19 nt, Homo sapiens
uggggauggcucccggaca

SEQ ID NO: 33475 - RNA, 21 nt, Homo sapiens
uggggguggggaguggcagag

SEQ ID NO: 33476 - RNA, 22 nt, Homo sapiens
gccuuuggguggggucggggcu

SEQ ID NO: 33477 - RNA, 18 nt, Homo sapiens
aaaaaaaaaaaagcugcu

SEQ ID NO: 33478 - RNA, 19 nt, Homo sapiens
caucaaaguauaaaguaca

SEQ ID NO: 33479 - RNA, 18 nt, Homo sapiens
gaagcauacugacacuuu

SEQ ID NO: 33480 - RNA, 17 nt, Homo sapiens
uagccuucaucaaagua

SEQ ID NO: 33481 - RNA, 18 nt, Homo sapiens
aaacugcagggucugggg

SEQ ID NO: 33482 - RNA, 22 nt, Homo sapiens
aauccaguuacaccugggugag

SEQ ID NO: 33483 - RNA, 18 nt, Homo sapiens
acuuuaugaauaguggug

SEQ ID NO: 33484 - RNA, 24 nt, Homo sapiens
agcggauggagauggugaggaugu

SEQ ID NO: 33485 - RNA, 26 nt, Homo sapiens
agggaagggggaggugugaaacgugc

SEQ ID NO: 33486 - RNA, 18 nt, Homo sapiens
cggugucuacaacugcaa

SEQ ID NO: 33487 - RNA, 16 nt, Homo sapiens
cucaaacugcaggguc

SEQ ID NO: 33488 - RNA, 19 nt, Homo sapiens
gcacgggaggagcuguggu

SEQ ID NO: 33489 - RNA, 17 nt, Homo sapiens
ggagugcuguguauuuu

SEQ ID NO: 33490 - RNA, 14 nt, Homo sapiens
ggaucuguucaaca

SEQ ID NO: 33491 - RNA, 17 nt, Homo sapiens
ggccacugugcuggagc

SEQ ID NO: 33492 - RNA, 20 nt, Homo sapiens
ggcuggaggcaauuccuugg

SEQ ID NO: 33493 - RNA, 16 nt, Homo sapiens
gugcccaucucaacca

SEQ ID NO: 33494 - RNA, 18 nt, Homo sapiens
gugggugugggaaaggga

SEQ ID NO: 33495 - RNA, 20 nt, Homo sapiens
ucauccugagcugagcugcu

SEQ ID NO: 33496 - RNA, 22 nt, Homo sapiens
uccugcaaaacggugcccaucu

SEQ ID NO: 33497 - RNA, 20 nt, Homo sapiens
ucuuuuagagccuaggacuc

SEQ ID NO: 33498 - RNA, 20 nt, Homo sapiens
ugagcaggccaggcagggag

SEQ ID NO: 33499 - RNA, 16 nt, Homo sapiens
uggcugcccaggcugc

SEQ ID NO: 33500 - RNA, 21 nt, Homo sapiens
uggcugcccaggcugcuccuu

SEQ ID NO: 33501 - RNA, 18 nt, Homo sapiens
ugggaacuuuauuagagc

SEQ ID NO: 33502 - RNA, 20 nt, Homo sapiens
uguggagggagagcugcagg

SEQ ID NO: 33503 - RNA, 17 nt, Homo sapiens
ccagguccugucauugg

SEQ ID NO: 33504 - RNA, 17 nt, Homo sapiens
cggcgucgggccagagc

SEQ ID NO: 33505 - RNA, 18 nt, Homo sapiens
agcccuagagaauuuuuc

SEQ ID NO: 33506 - RNA, 21 nt, Homo sapiens
aggcuauagaacuuugguauu

SEQ ID NO: 33507 - RNA, 18 nt, Homo sapiens
aguggccaggggcuuggg

SEQ ID NO: 33508 - RNA, 22 nt, Homo sapiens
agugucacucugacauuaacaa

SEQ ID NO: 33509 - RNA, 23 nt, Homo sapiens
uacucugaugccuaucuacuucu

SEQ ID NO: 33510 - RNA, 18 nt, Homo sapiens
uuuacaaaugagggaacu

SEQ ID NO: 33511 - RNA, 19 nt, Homo sapiens
aaaaaaugcauaacaugaa

SEQ ID NO: 33512 - RNA, 21 nt, Homo sapiens
aagaaacugaaaaggggcuag

SEQ ID NO: 33513 - RNA, 20 nt, Homo sapiens
aggacaguauaauauuacua

SEQ ID NO: 33514 - RNA, 16 nt, Homo sapiens
aguggaacagaaugga

SEQ ID NO: 33515 - RNA, 21 nt, Homo sapiens
cgcccggcgccggagcccccg

SEQ ID NO: 33516 - RNA, 18 nt, Homo sapiens
ggcugcaaaagcuggagc

SEQ ID NO: 33517 - RNA, 16 nt, Homo sapiens
guggacaugaaccaga

SEQ ID NO: 33518 - RNA, 21 nt, Homo sapiens
uauaaauaguaucuuuuuuca

SEQ ID NO: 33519 - RNA, 21 nt, Homo sapiens
ucaaacuuuuuaaaaauugug

SEQ ID NO: 33520 - RNA, 22 nt, Homo sapiens
uguuaacuacaugcgcauugug

SEQ ID NO: 33521 - RNA, 21 nt, Homo sapiens
uuucaagugucaaacuauuua

SEQ ID NO: 33522 - RNA, 21 nt, Homo sapiens
aagggguuggagcccaugccu

SEQ ID NO: 33523 - RNA, 16 nt, Homo sapiens
aggaaaauuaccaccu

SEQ ID NO: 33524 - RNA, 19 nt, Homo sapiens
aggaggaggaggggcgggc

SEQ ID NO: 33525 - RNA, 17 nt, Homo sapiens
ccuguuucaccugcucc

SEQ ID NO: 33526 - RNA, 20 nt, Homo sapiens
cggcgggcggucgggcgggc

SEQ ID NO: 33527 - RNA, 18 nt, Homo sapiens
gaggaggaggaggggcgg

SEQ ID NO: 33528 - RNA, 19 nt, Homo sapiens
gaggaggaggaggggcggg

SEQ ID NO: 33529 - RNA, 21 nt, Homo sapiens
gcgggccgcagcugcgccggc

SEQ ID NO: 33530 - RNA, 18 nt, Homo sapiens
ggcgggcggucgggcggg

SEQ ID NO: 33531 - RNA, 16 nt, Homo sapiens
ggcggugggccggcgg

SEQ ID NO: 33532 - RNA, 20 nt, Homo sapiens
ggcggugggccggcgggcgg

SEQ ID NO: 33533 - RNA, 18 nt, Homo sapiens
gggaggggagaggcagga

SEQ ID NO: 33534 - RNA, 21 nt, Homo sapiens
ucaggcugucucccccauucc

SEQ ID NO: 33535 - RNA, 16 nt, Homo sapiens
aggccggauccccaug

SEQ ID NO: 33536 - RNA, 19 nt, Homo sapiens
auauuucuucuuuuucucu

SEQ ID NO: 33537 - RNA, 18 nt, Homo sapiens
caacacaaagcuccccau

SEQ ID NO: 33538 - RNA, 18 nt, Homo sapiens
caguaguuauaacucucg

SEQ ID NO: 33539 - RNA, 21 nt, Homo sapiens
caugaucuccagugugguucu

SEQ ID NO: 33540 - RNA, 16 nt, Homo sapiens
ccuccuccuccugauc

SEQ ID NO: 33541 - RNA, 18 nt, Homo sapiens
gaagaagagucccccaaa

SEQ ID NO: 33542 - RNA, 15 nt, Homo sapiens
gcugacccucuggac

SEQ ID NO: 33543 - RNA, 20 nt, Homo sapiens
gggugguggggauggcuugg

SEQ ID NO: 33544 - RNA, 20 nt, Homo sapiens
gguguggggucaucugggga

SEQ ID NO: 33545 - RNA, 18 nt, Homo sapiens
ucucuuuuuuccucuucu

SEQ ID NO: 33546 - RNA, 17 nt, Homo sapiens
ugaggaacacgugcuga

SEQ ID NO: 33547 - RNA, 23 nt, Homo sapiens
ugagguaaacacauagaauaucu

SEQ ID NO: 33548 - RNA, 18 nt, Homo sapiens
uucucuucuaaaacuauu

SEQ ID NO: 33549 - RNA, 23 nt, Homo sapiens
uuucacauuuguguucuuguugc

SEQ ID NO: 33550 - RNA, 18 nt, Homo sapiens
cauauaugcacucugaua

SEQ ID NO: 33551 - RNA, 21 nt, Homo sapiens
gacaugguuggagagcuuucc

SEQ ID NO: 33552 - RNA, 19 nt, Homo sapiens
uccagcuauguuugcuaau

SEQ ID NO: 33553 - RNA, 27 nt, Homo sapiens
aaccuacagacuuuuuuuuuucugggu

SEQ ID NO: 33554 - RNA, 18 nt, Homo sapiens
gaaaauccucuuuuaucu

SEQ ID NO: 33555 - RNA, 15 nt, Homo sapiens
uacucuuugauaaua

SEQ ID NO: 33556 - RNA, 15 nt, Homo sapiens
gugaacugacauccc

SEQ ID NO: 33557 - RNA, 21 nt, Homo sapiens
uaaguggugcuuuuaguuucc

SEQ ID NO: 33558 - RNA, 27 nt, Homo sapiens
ugauguguuugggcugggugauggcag

SEQ ID NO: 33559 - RNA, 16 nt, Homo sapiens
uucuauagccauuucu

SEQ ID NO: 33560 - RNA, 19 nt, Homo sapiens
uuggauucaguguuacaga

SEQ ID NO: 33561 - RNA, 22 nt, Homo sapiens
gcauacaaucauuuaguaaaac

SEQ ID NO: 33562 - RNA, 21 nt, Homo sapiens
aaacaagaaaagaaaggcauu

SEQ ID NO: 33563 - RNA, 22 nt, Homo sapiens
agaaggagagagaagcaagaag

SEQ ID NO: 33564 - RNA, 21 nt, Homo sapiens
agccggccagggacagucacc

SEQ ID NO: 33565 - RNA, 17 nt, Homo sapiens
aggcuugggggaaagaa

SEQ ID NO: 33566 - RNA, 29 nt, Homo sapiens
cacucgacgggaaaacggggggucuuccg

SEQ ID NO: 33567 - RNA, 20 nt, Homo sapiens
caguugcauggagccagggc

SEQ ID NO: 33568 - RNA, 17 nt, Homo sapiens
cuccccgcucgcguguc

SEQ ID NO: 33569 - RNA, 18 nt, Homo sapiens
gaaaucaaagaaugcagu

SEQ ID NO: 33570 - RNA, 23 nt, Homo sapiens
gacgauagccccccgccgggcug

SEQ ID NO: 33571 - RNA, 18 nt, Homo sapiens
gcaucacaggggggcaug

SEQ ID NO: 33572 - RNA, 19 nt, Homo sapiens
gcggcggcagcagccaccu

SEQ ID NO: 33573 - RNA, 20 nt, Homo sapiens
gcggcggcagcagccaccug

SEQ ID NO: 33574 - RNA, 18 nt, Homo sapiens
gcggcggcggcagcagcc

SEQ ID NO: 33575 - RNA, 21 nt, Homo sapiens
gcuguauuuucuccucucucu

SEQ ID NO: 33576 - RNA, 20 nt, Homo sapiens
ggcauggucggaggguggcu

SEQ ID NO: 33577 - RNA, 20 nt, Homo sapiens
gggggaaggggggagcccga

SEQ ID NO: 33578 - RNA, 16 nt, Homo sapiens
ggggggaaggggggag

SEQ ID NO: 33579 - RNA, 19 nt, Homo sapiens
ugauggagguuguaagagu

SEQ ID NO: 33580 - RNA, 16 nt, Homo sapiens
uggcugcugcgcuccg

SEQ ID NO: 33581 - RNA, 21 nt, Homo sapiens
uguaagagugugugugugugu

SEQ ID NO: 33582 - RNA, 15 nt, Homo sapiens
uguguguguuuguga

SEQ ID NO: 33583 - RNA, 24 nt, Homo sapiens
uguguguuugugaguaugugugag

SEQ ID NO: 33584 - RNA, 22 nt, Homo sapiens
uuguaagagugugugugugugu

SEQ ID NO: 33585 - RNA, 24 nt, Homo sapiens
aaacugugcucagguuuuuguuuu

SEQ ID NO: 33586 - RNA, 23 nt, Homo sapiens
aagcaggagcccuugguggaccc

SEQ ID NO: 33587 - RNA, 23 nt, Homo sapiens
acggcagaccccugaaacgaagc

SEQ ID NO: 33588 - RNA, 16 nt, Homo sapiens
agaggaaagggugcac

SEQ ID NO: 33589 - RNA, 22 nt, Homo sapiens
cacgucaccagcaggucccgcc

SEQ ID NO: 33590 - RNA, 18 nt, Homo sapiens
cagaucuuuaaacaaagg

SEQ ID NO: 33591 - RNA, 16 nt, Homo sapiens
caggaggcgcgcggcg

SEQ ID NO: 33592 - RNA, 20 nt, Homo sapiens
caggggaggacgggcugugu

SEQ ID NO: 33593 - RNA, 20 nt, Homo sapiens
cauguuggguuguuuauugg

SEQ ID NO: 33594 - RNA, 20 nt, Homo sapiens
ccccaccccucaugcucucc

SEQ ID NO: 33595 - RNA, 16 nt, Homo sapiens
cccgccgcuccuggcc

SEQ ID NO: 33596 - RNA, 21 nt, Homo sapiens
cccucaugcucuccucugguc

SEQ ID NO: 33597 - RNA, 18 nt, Homo sapiens
cccucgggaaagcccgcc

SEQ ID NO: 33598 - RNA, 16 nt, Homo sapiens
ccucaugcucuccucu

SEQ ID NO: 33599 - RNA, 24 nt, Homo sapiens
ccugggagaaacccaggcuuguca

SEQ ID NO: 33600 - RNA, 22 nt, Homo sapiens
cgcgggaccgcgcuccgcugcg

SEQ ID NO: 33601 - RNA, 16 nt, Homo sapiens
cgcucacaugccccuu

SEQ ID NO: 33602 - RNA, 18 nt, Homo sapiens
cggccuccccucggcagc

SEQ ID NO: 33603 - RNA, 20 nt, Homo sapiens
cggcgcccggagcuggggcc

SEQ ID NO: 33604 - RNA, 21 nt, Homo sapiens
cggcgcggcggcgcggcgcgg

SEQ ID NO: 33605 - RNA, 23 nt, Homo sapiens
cggcggcgcggcgcggggcgcgg

SEQ ID NO: 33606 - RNA, 17 nt, Homo sapiens
cggggacgugggugcgc

SEQ ID NO: 33607 - RNA, 20 nt, Homo sapiens
cuuccagcugggggcccucc

SEQ ID NO: 33608 - RNA, 18 nt, Homo sapiens
gaggacugucucagccug

SEQ ID NO: 33609 - RNA, 22 nt, Homo sapiens
gcagccccgggggcgucggcag

SEQ ID NO: 33610 - RNA, 19 nt, Homo sapiens
gcggcgcggggcgcggggg

SEQ ID NO: 33611 - RNA, 16 nt, Homo sapiens
gcggggcgcgcgcugc

SEQ ID NO: 33612 - RNA, 15 nt, Homo sapiens
gcgggggaggcgcgc

SEQ ID NO: 33613 - RNA, 21 nt, Homo sapiens
ggcgcggcggcgcggcgcggg

SEQ ID NO: 33614 - RNA, 18 nt, Homo sapiens
gggaagggaggggguagc

SEQ ID NO: 33615 - RNA, 17 nt, Homo sapiens
ggggcggccgggggggg

SEQ ID NO: 33616 - RNA, 17 nt, Homo sapiens
gggggcggccggggggg

SEQ ID NO: 33617 - RNA, 24 nt, Homo sapiens
ggucagauugcgaauaccuggggc

SEQ ID NO: 33618 - RNA, 16 nt, Homo sapiens
gugggugcgcgccccg

SEQ ID NO: 33619 - RNA, 19 nt, Homo sapiens
uauauauauuuauauauau

SEQ ID NO: 33620 - RNA, 20 nt, Homo sapiens
uauauauauuuauauauaua

SEQ ID NO: 33621 - RNA, 17 nt, Homo sapiens
ucaguaaggcacuagag

SEQ ID NO: 33622 - RNA, 19 nt, Homo sapiens
ucccacgccaggaaccaac

SEQ ID NO: 33623 - RNA, 19 nt, Homo sapiens
ucgccgggcucgggucgcc

SEQ ID NO: 33624 - RNA, 19 nt, Homo sapiens
ucucuuagcuugugcauuc

SEQ ID NO: 33625 - RNA, 18 nt, Homo sapiens
ucugaaaagcaggagccc

SEQ ID NO: 33626 - RNA, 20 nt, Homo sapiens
ugaaaaccuggagaacaaga

SEQ ID NO: 33627 - RNA, 19 nt, Homo sapiens
ugccuuuucaccuacgcag

SEQ ID NO: 33628 - RNA, 18 nt, Homo sapiens
uuccucucacuccucuuc

SEQ ID NO: 33629 - RNA, 19 nt, Homo sapiens
aacaugacuacguauauau

SEQ ID NO: 33630 - RNA, 18 nt, Homo sapiens
acucuguggguuugcaau

SEQ ID NO: 33631 - RNA, 19 nt, Homo sapiens
agcggcggggcgggcgggg

SEQ ID NO: 33632 - RNA, 20 nt, Homo sapiens
agcggcggggcgggcgggga

SEQ ID NO: 33633 - RNA, 20 nt, Homo sapiens
aggaggagcggcggggcggg

SEQ ID NO: 33634 - RNA, 19 nt, Homo sapiens
auguugcuuuucuuuuugg

SEQ ID NO: 33635 - RNA, 21 nt, Homo sapiens
caagggcuauuucccaagcug

SEQ ID NO: 33636 - RNA, 18 nt, Homo sapiens
ccgcgccccacuccgccc

SEQ ID NO: 33637 - RNA, 23 nt, Homo sapiens
ccuggcugccgcgccccacuccg

SEQ ID NO: 33638 - RNA, 20 nt, Homo sapiens
gaggaggagcggcggggcgg

SEQ ID NO: 33639 - RNA, 16 nt, Homo sapiens
gccgguccccgccccc

SEQ ID NO: 33640 - RNA, 17 nt, Homo sapiens
gcggggcgggcggggag

SEQ ID NO: 33641 - RNA, 22 nt, Homo sapiens
gggcggggaggaggcgcgcggg

SEQ ID NO: 33642 - RNA, 23 nt, Homo sapiens
aagggaagggacaugcagcagga

SEQ ID NO: 33643 - RNA, 20 nt, Homo sapiens
agcggggcggggagcgcagg

SEQ ID NO: 33644 - RNA, 20 nt, Homo sapiens
caccucagucgccggguucc

SEQ ID NO: 33645 - RNA, 18 nt, Homo sapiens
cagggaacccccuucugc

SEQ ID NO: 33646 - RNA, 17 nt, Homo sapiens
caguggccucaacuccu

SEQ ID NO: 33647 - RNA, 19 nt, Homo sapiens
ccuccuugcugauggcugc

SEQ ID NO: 33648 - RNA, 17 nt, Homo sapiens
cgccgugcugccggagc

SEQ ID NO: 33649 - RNA, 16 nt, Homo sapiens
cgccgugcugccggau

SEQ ID NO: 33650 - RNA, 20 nt, Homo sapiens
cucucugcugggcccugagc

SEQ ID NO: 33651 - RNA, 20 nt, Homo sapiens
gccccugggcuucuggcagc

SEQ ID NO: 33652 - RNA, 23 nt, Homo sapiens
ggagcggggcggggagcgcaggg

SEQ ID NO: 33653 - RNA, 16 nt, Homo sapiens
gggccgcgccgugcug

SEQ ID NO: 33654 - RNA, 19 nt, Homo sapiens
ggggagcggggcggggagc

SEQ ID NO: 33655 - RNA, 19 nt, Homo sapiens
ugauggcugcagacucugg

SEQ ID NO: 33656 - RNA, 18 nt, Homo sapiens
uggggaagggaagggaca

SEQ ID NO: 33657 - RNA, 20 nt, Homo sapiens
aaacuccuuaaauggaucua

SEQ ID NO: 33658 - RNA, 17 nt, Homo sapiens
acagggcgguuuucucc

SEQ ID NO: 33659 - RNA, 22 nt, Homo sapiens
aggccauaucucaggcugucuc

SEQ ID NO: 33660 - RNA, 19 nt, Homo sapiens
caaggaguaacagagcagu

SEQ ID NO: 33661 - RNA, 26 nt, Homo sapiens
ccggccucggcgcgcucggcuccggc

SEQ ID NO: 33662 - RNA, 19 nt, Homo sapiens
ccggcgcuggccucugagu

SEQ ID NO: 33663 - RNA, 18 nt, Homo sapiens
cggcgcgcucggcuccgg

SEQ ID NO: 33664 - RNA, 23 nt, Homo sapiens
cggcgcgcucggcuccggcucgg

SEQ ID NO: 33665 - RNA, 19 nt, Homo sapiens
gagggugugcguucuccca

SEQ ID NO: 33666 - RNA, 21 nt, Homo sapiens
gcugcaagguggggacacuga

SEQ ID NO: 33667 - RNA, 16 nt, Homo sapiens
uccaugggguacaugc

SEQ ID NO: 33668 - RNA, 19 nt, Homo sapiens
ucccaggugaguguuugug

SEQ ID NO: 33669 - RNA, 21 nt, Homo sapiens
ugagcaaaggaaucuguauca

SEQ ID NO: 33670 - RNA, 18 nt, Homo sapiens
uggaagaugagaugguug

SEQ ID NO: 33671 - RNA, 19 nt, Homo sapiens
aaaaaaaaaaaaaaaaaca

SEQ ID NO: 33672 - RNA, 19 nt, Homo sapiens
agaggaaaugagcuccugc

SEQ ID NO: 33673 - RNA, 18 nt, Homo sapiens
agggcacaguugcaaguu

SEQ ID NO: 33674 - RNA, 22 nt, Homo sapiens
cuucucuuuuuuuaaacacaca

SEQ ID NO: 33675 - RNA, 23 nt, Homo sapiens
cuuuuuuuaaacacacacacagg

SEQ ID NO: 33676 - RNA, 19 nt, Homo sapiens
gcauggcugcacucuggua

SEQ ID NO: 33677 - RNA, 20 nt, Homo sapiens
acuggugacaccugugccuc

SEQ ID NO: 33678 - RNA, 15 nt, Homo sapiens
cagggcccuggccgc

SEQ ID NO: 33679 - RNA, 20 nt, Homo sapiens
ccagcagcagcgagccugug

SEQ ID NO: 33680 - RNA, 19 nt, Homo sapiens
ccuuuggcuggaacuggug

SEQ ID NO: 33681 - RNA, 21 nt, Homo sapiens
cgcaccacgcaccuugcagag

SEQ ID NO: 33682 - RNA, 22 nt, Homo sapiens
cugcgcgcuggccaccgcgcug

SEQ ID NO: 33683 - RNA, 21 nt, Homo sapiens
gagcgucuguuugugcugcuu

SEQ ID NO: 33684 - RNA, 17 nt, Homo sapiens
gccacgcgcuccggauc

SEQ ID NO: 33685 - RNA, 17 nt, Homo sapiens
ggaggaggccuggccgg

SEQ ID NO: 33686 - RNA, 24 nt, Homo sapiens
ggcgaccucugccagugccccgau

SEQ ID NO: 33687 - RNA, 20 nt, Homo sapiens
gggcccucgcugugggcaug

SEQ ID NO: 33688 - RNA, 20 nt, Homo sapiens
gggcuggcugcaggaagcug

SEQ ID NO: 33689 - RNA, 18 nt, Homo sapiens
uaucuguucauguuucug

SEQ ID NO: 33690 - RNA, 23 nt, Homo sapiens
uccgcggucaccuucuagccgcc

SEQ ID NO: 33691 - RNA, 18 nt, Homo sapiens
ugagaaguggaacucccc

SEQ ID NO: 33692 - RNA, 22 nt, Homo sapiens
ugugucuggcauucccuguucc

SEQ ID NO: 33693 - RNA, 20 nt, Homo sapiens
agaggucacucccugggguc

SEQ ID NO: 33694 - RNA, 18 nt, Homo sapiens
agguccuggaaacugcca

SEQ ID NO: 33695 - RNA, 23 nt, Homo sapiens
ggaauggagguccuggaaacugc

SEQ ID NO: 33696 - RNA, 20 nt, Homo sapiens
gguggagagggaaccuuuag

SEQ ID NO: 33697 - RNA, 17 nt, Homo sapiens
ucccuggaauggcgggg

SEQ ID NO: 33698 - RNA, 19 nt, Homo sapiens
aagcagcagcccuagcucu

SEQ ID NO: 33699 - RNA, 18 nt, Homo sapiens
acacugaaggccacuggu

SEQ ID NO: 33700 - RNA, 20 nt, Homo sapiens
accucuggggguuugggggu

SEQ ID NO: 33701 - RNA, 18 nt, Homo sapiens
agcggguggaugaugagg

SEQ ID NO: 33702 - RNA, 21 nt, Homo sapiens
aggggaagcaggagcggcacu

SEQ ID NO: 33703 - RNA, 18 nt, Homo sapiens
augagguaucugugcagg

SEQ ID NO: 33704 - RNA, 18 nt, Homo sapiens
cacagugacugcaaccgg

SEQ ID NO: 33705 - RNA, 18 nt, Homo sapiens
ccacuggugugugugugu

SEQ ID NO: 33706 - RNA, 19 nt, Homo sapiens
cccagagccacgggucugg

SEQ ID NO: 33707 - RNA, 16 nt, Homo sapiens
cccugacuccuccccc

SEQ ID NO: 33708 - RNA, 20 nt, Homo sapiens
ccucagcucuguccccuccc

SEQ ID NO: 33709 - RNA, 16 nt, Homo sapiens
ccucgccgcccagccc

SEQ ID NO: 33710 - RNA, 20 nt, Homo sapiens
ccugggagguguccaggacc

SEQ ID NO: 33711 - RNA, 22 nt, Homo sapiens
cgagagcugccgggggcgcgcc

SEQ ID NO: 33712 - RNA, 27 nt, Homo sapiens
cucuguccccuccccgggcccccucgc

SEQ ID NO: 33713 - RNA, 17 nt, Homo sapiens
cuuggagcaugaacagc

SEQ ID NO: 33714 - RNA, 16 nt, Homo sapiens
gcagcagcagcacacg

SEQ ID NO: 33715 - RNA, 21 nt, Homo sapiens
gcccagggcuggggacugggg

SEQ ID NO: 33716 - RNA, 16 nt, Homo sapiens
gccgggggcgcgccgg

SEQ ID NO: 33717 - RNA, 26 nt, Homo sapiens
gcucucucccagagccacgggucugg

SEQ ID NO: 33718 - RNA, 18 nt, Homo sapiens
ggaaggggaaggacagcc

SEQ ID NO: 33719 - RNA, 15 nt, Homo sapiens
gggacccgggauggg

SEQ ID NO: 33720 - RNA, 21 nt, Homo sapiens
gggcaggcugaggggaggggc

SEQ ID NO: 33721 - RNA, 19 nt, Homo sapiens
ggggaggggcagcgggugg

SEQ ID NO: 33722 - RNA, 22 nt, Homo sapiens
gguagggaggggaagcaggagc

SEQ ID NO: 33723 - RNA, 18 nt, Homo sapiens
guccagguggggaggggg

SEQ ID NO: 33724 - RNA, 18 nt, Homo sapiens
gugugcgugcgugugugu

SEQ ID NO: 33725 - RNA, 19 nt, Homo sapiens
uaacacagagccccugacu

SEQ ID NO: 33726 - RNA, 22 nt, Homo sapiens
uggaauguguggagcugguggg

SEQ ID NO: 33727 - RNA, 19 nt, Homo sapiens
uggcaguggcuggguuugg

SEQ ID NO: 33728 - RNA, 16 nt, Homo sapiens
uggcuucuaugcuccu

SEQ ID NO: 33729 - RNA, 24 nt, Homo sapiens
ugggggugggacccgggauggggg

SEQ ID NO: 33730 - RNA, 22 nt, Homo sapiens
ugguguguguguguccaggugg

SEQ ID NO: 33731 - RNA, 21 nt, Homo sapiens
ugugcgugcgugugugugugu

SEQ ID NO: 33732 - RNA, 18 nt, Homo sapiens
ugugugugugugugugug

SEQ ID NO: 33733 - RNA, 19 nt, Homo sapiens
ugugugugugugugugugu

SEQ ID NO: 33734 - RNA, 19 nt, Homo sapiens
uguugaggggaugggagga

SEQ ID NO: 33735 - RNA, 25 nt, Homo sapiens
uuccugaugucucaacgauguggcg

SEQ ID NO: 33736 - RNA, 20 nt, Homo sapiens
aacugauuaaaagauuucca

SEQ ID NO: 33737 - RNA, 23 nt, Homo sapiens
aagaaggaaacaaaaccuucagu

SEQ ID NO: 33738 - RNA, 23 nt, Homo sapiens
aaguggaaagggagaugugggga

SEQ ID NO: 33739 - RNA, 18 nt, Homo sapiens
agacugaacacugggaga

SEQ ID NO: 33740 - RNA, 23 nt, Homo sapiens
caaaggccccuagaaguuagugg

SEQ ID NO: 33741 - RNA, 23 nt, Homo sapiens
caaaggccccuggaaguuagugg

SEQ ID NO: 33742 - RNA, 18 nt, Homo sapiens
caagcauauggaggcucu

SEQ ID NO: 33743 - RNA, 18 nt, Homo sapiens
ccuuggguguuugacaua

SEQ ID NO: 33744 - RNA, 19 nt, Homo sapiens
cgccacaguguggcucucc

SEQ ID NO: 33745 - RNA, 19 nt, Homo sapiens
cgccacagugugguucucc

SEQ ID NO: 33746 - RNA, 20 nt, Homo sapiens
gccaccaaguuggacaggcc

SEQ ID NO: 33747 - RNA, 16 nt, Homo sapiens
ggagauucaguguccc

SEQ ID NO: 33748 - RNA, 18 nt, Homo sapiens
guuuugucuaauuugcug

SEQ ID NO: 33749 - RNA, 23 nt, Homo sapiens
ucuuacagaucucacacuuccag

SEQ ID NO: 33750 - RNA, 19 nt, Homo sapiens
ucuuuagcaaacaugaucu

SEQ ID NO: 33751 - RNA, 18 nt, Homo sapiens
ugucaguccuccuggugu

SEQ ID NO: 33752 - RNA, 16 nt, Homo sapiens
uucaucaagcacugcg

SEQ ID NO: 33753 - RNA, 23 nt, Homo sapiens
ucuuacagaucucacacuuccag

SEQ ID NO: 33754 - RNA, 20 nt, Homo sapiens
aacaaugaaacagcaggguu

SEQ ID NO: 33755 - RNA, 19 nt, Homo sapiens
accaguucgagguguggca

SEQ ID NO: 33756 - RNA, 24 nt, Homo sapiens
accucgguuccuccggccccuccc

SEQ ID NO: 33757 - RNA, 17 nt, Homo sapiens
agcgcuacgauuacagg

SEQ ID NO: 33758 - RNA, 16 nt, Homo sapiens
gaggggcucuggggga

SEQ ID NO: 33759 - RNA, 18 nt, Homo sapiens
gcacugaguucuccacac

SEQ ID NO: 33760 - RNA, 19 nt, Homo sapiens
ggcccaaagccuuuucuuc

SEQ ID NO: 33761 - RNA, 20 nt, Homo sapiens
gggaaagcgcggcucagagc

SEQ ID NO: 33762 - RNA, 18 nt, Homo sapiens
uagcacuggcaacaccuc

SEQ ID NO: 33763 - RNA, 24 nt, Homo sapiens
ugcgggccagggcuccuggccaca

SEQ ID NO: 33764 - RNA, 18 nt, Homo sapiens
uagcacuggcaacaccuc

SEQ ID NO: 33765 - RNA, 18 nt, Homo sapiens
ugccauuaggagguaaau

SEQ ID NO: 33766 - RNA, 18 nt, Homo sapiens
aagcugcauugugauggc

SEQ ID NO: 33767 - RNA, 23 nt, Homo sapiens
acaaaaugcuuuucaaaauacau

SEQ ID NO: 33768 - RNA, 22 nt, Homo sapiens
aggguaguuggaccacagaaaa

SEQ ID NO: 33769 - RNA, 20 nt, Homo sapiens
cagcggcggcagccuaaagg

SEQ ID NO: 33770 - RNA, 23 nt, Homo sapiens
caugugguagcuuccagaggaaa

SEQ ID NO: 33771 - RNA, 18 nt, Homo sapiens
guauuuugcuaaagggua

SEQ ID NO: 33772 - RNA, 18 nt, Homo sapiens
ugcauaacucagcagcag

SEQ ID NO: 33773 - RNA, 22 nt, Homo sapiens
uggaauggauuuuuggagagag

SEQ ID NO: 33774 - RNA, 25 nt, Homo sapiens
uuuaaacauuuauuuaauauagguu

SEQ ID NO: 33775 - RNA, 25 nt, Homo sapiens
augaucaugaauaaugauuuuucaa

SEQ ID NO: 33776 - RNA, 18 nt, Homo sapiens
caugaagcaaaagauccc

SEQ ID NO: 33777 - RNA, 22 nt, Homo sapiens
cuuccugggauaaagggguucc

SEQ ID NO: 33778 - RNA, 19 nt, Homo sapiens
uuccauugauuuuuacuuc

SEQ ID NO: 33779 - RNA, 17 nt, Homo sapiens
agagacuugauuuggga

SEQ ID NO: 33780 - RNA, 17 nt, Homo sapiens
uggagagacuugauuug

SEQ ID NO: 33781 - RNA, 19 nt, Homo sapiens
aacaugaccaucauggagc

SEQ ID NO: 33782 - RNA, 23 nt, Homo sapiens
gggcaucuuccuuucaccaagug

SEQ ID NO: 33783 - RNA, 22 nt, Homo sapiens
uacaaauuuuaaaucucaacuu

SEQ ID NO: 33784 - RNA, 23 nt, Homo sapiens
aacgaucaaaacuuggccugagc

SEQ ID NO: 33785 - RNA, 20 nt, Homo sapiens
caaaguccucacauaaaaac

SEQ ID NO: 33786 - RNA, 19 nt, Homo sapiens
cagcacaaucugaaaacaa

SEQ ID NO: 33787 - RNA, 21 nt, Homo sapiens
ugacaguuuuugauaacauga

SEQ ID NO: 33788 - RNA, 18 nt, Homo sapiens
uuucuuggacugacauac

SEQ ID NO: 33789 - RNA, 18 nt, Homo sapiens
cagauaaaaacgucuggg

SEQ ID NO: 33790 - RNA, 17 nt, Homo sapiens
ugcuggggggccgggcc

SEQ ID NO: 33791 - RNA, 21 nt, Homo sapiens
cgaagggaacugcugggacug

SEQ ID NO: 33792 - RNA, 17 nt, Homo sapiens
gacaggaaaugcagcag

SEQ ID NO: 33793 - RNA, 18 nt, Homo sapiens
ugcaagagcgggggcagg

SEQ ID NO: 33794 - RNA, 22 nt, Homo sapiens
gcugggccuggggagcaggaag

SEQ ID NO: 33795 - RNA, 22 nt, Homo sapiens
aaggaccagcuugugagucuag

SEQ ID NO: 33796 - RNA, 17 nt, Homo sapiens
aauauucggggugugcu

SEQ ID NO: 33797 - RNA, 21 nt, Homo sapiens
acuuuaguuaaccugugucau

SEQ ID NO: 33798 - RNA, 18 nt, Homo sapiens
agcugaggguggaguagg

SEQ ID NO: 33799 - RNA, 18 nt, Homo sapiens
aggugcaggaauagguaa

SEQ ID NO: 33800 - RNA, 20 nt, Homo sapiens
aguuaaccugugucauaugc

SEQ ID NO: 33801 - RNA, 17 nt, Homo sapiens
auacaggcaagcgucac

SEQ ID NO: 33802 - RNA, 19 nt, Homo sapiens
caaaauaccugugugugca

SEQ ID NO: 33803 - RNA, 22 nt, Homo sapiens
caauauucggggugugcugacg

SEQ ID NO: 33804 - RNA, 21 nt, Homo sapiens
ccaaauaagcguuuauuggac

SEQ ID NO: 33805 - RNA, 21 nt, Homo sapiens
ccucagacaguagauaaaaau

SEQ ID NO: 33806 - RNA, 20 nt, Homo sapiens
cggaccugcccccggccugc

SEQ ID NO: 33807 - RNA, 18 nt, Homo sapiens
cuagcacacguuuuccca

SEQ ID NO: 33808 - RNA, 18 nt, Homo sapiens
cugcagccuugaacuccu

SEQ ID NO: 33809 - RNA, 20 nt, Homo sapiens
gagacggagucucgcucugu

SEQ ID NO: 33810 - RNA, 26 nt, Homo sapiens
gcgggcuuugccuugucggccguggc

SEQ ID NO: 33811 - RNA, 18 nt, Homo sapiens
guggccucaaagucuuca

SEQ ID NO: 33812 - RNA, 23 nt, Homo sapiens
uacaguggcaugauuaugacccc

SEQ ID NO: 33813 - RNA, 18 nt, Homo sapiens
uccaaaguuuagagcagg

SEQ ID NO: 33814 - RNA, 18 nt, Homo sapiens
ugacaaccgcagacaucu

SEQ ID NO: 33815 - RNA, 20 nt, Homo sapiens
ugaggaagaaaaaggacagu

SEQ ID NO: 33816 - RNA, 19 nt, Homo sapiens
ugauuaugaccccccacug

SEQ ID NO: 33817 - RNA, 22 nt, Homo sapiens
ugcuacagagcagaccauugac

SEQ ID NO: 33818 - RNA, 16 nt, Homo sapiens
uggcggcagauggccu

SEQ ID NO: 33819 - RNA, 17 nt, Homo sapiens
uggcggcagauggccug

SEQ ID NO: 33820 - RNA, 16 nt, Homo sapiens
uugccucucaacagaa

SEQ ID NO: 33821 - RNA, 15 nt, Homo sapiens
ggaaaggggccuccu

SEQ ID NO: 33822 - RNA, 24 nt, Homo sapiens
gguugggcugcgaucucggcuggc

SEQ ID NO: 33823 - RNA, 19 nt, Homo sapiens
uggaaaggggccuccuucu

SEQ ID NO: 33824 - RNA, 19 nt, Homo sapiens
uguaacugugugacguggg

SEQ ID NO: 33825 - RNA, 18 nt, Homo sapiens
accucagcugcagcagca

SEQ ID NO: 33826 - RNA, 21 nt, Homo sapiens
auuguuuuuaauuuaugaaau

SEQ ID NO: 33827 - RNA, 21 nt, Homo sapiens
guggagugaaacacaagggug

SEQ ID NO: 33828 - RNA, 18 nt, Homo sapiens
acagggauuucaguaguc

SEQ ID NO: 33829 - RNA, 20 nt, Homo sapiens
aguccaggcaccccguggcc

SEQ ID NO: 33830 - RNA, 18 nt, Homo sapiens
cugcucagaaaacacgaa

SEQ ID NO: 33831 - RNA, 16 nt, Homo sapiens
gaaaauagccuuuucc

SEQ ID NO: 33832 - RNA, 20 nt, Homo sapiens
gccaaaaaaugcccagaaaa

SEQ ID NO: 33833 - RNA, 19 nt, Homo sapiens
ucugcaacauuccuccagg

SEQ ID NO: 33834 - RNA, 22 nt, Homo sapiens
uacaaacaaaacacaaauauau

SEQ ID NO: 33835 - RNA, 17 nt, Homo sapiens
uugaauagaauaauggc

SEQ ID NO: 33836 - RNA, 18 nt, Homo sapiens
aggaaaagaaaugcaagc

SEQ ID NO: 33837 - RNA, 20 nt, Homo sapiens
auuugugugugugugcacau

SEQ ID NO: 33838 - RNA, 17 nt, Homo sapiens
cuagugaaaagcuagag

SEQ ID NO: 33839 - RNA, 19 nt, Homo sapiens
cuuaaaucacauugcuguu

SEQ ID NO: 33840 - RNA, 18 nt, Homo sapiens
guacuucuucauaguucu

SEQ ID NO: 33841 - RNA, 20 nt, Homo sapiens
uaaauuuccauuuuuuagaa

SEQ ID NO: 33842 - RNA, 21 nt, Homo sapiens
ugaaaguccuugauaaucaaa

SEQ ID NO: 33843 - RNA, 17 nt, Homo sapiens
ugaagauuuauugcugu

SEQ ID NO: 33844 - RNA, 18 nt, Homo sapiens
uguugauuuuuuuucauu

SEQ ID NO: 33845 - RNA, 16 nt, Homo sapiens
acacucccgcagagcg

SEQ ID NO: 33846 - RNA, 22 nt, Homo sapiens
agaggucaugccgucagcccag

SEQ ID NO: 33847 - RNA, 19 nt, Homo sapiens
agcggcggggcggacgggg

SEQ ID NO: 33848 - RNA, 19 nt, Homo sapiens
agcugcgggguccgcgggg

SEQ ID NO: 33849 - RNA, 21 nt, Homo sapiens
aggcaggauugaagccuggag

SEQ ID NO: 33850 - RNA, 20 nt, Homo sapiens
aggggcccgccgaagggccu

SEQ ID NO: 33851 - RNA, 18 nt, Homo sapiens
cagccaccggccuguccc

SEQ ID NO: 33852 - RNA, 16 nt, Homo sapiens
cagggccccucuccgc

SEQ ID NO: 33853 - RNA, 21 nt, Homo sapiens
ccccggggccugccuggccgg

SEQ ID NO: 33854 - RNA, 20 nt, Homo sapiens
ccccugagucccccagggac

SEQ ID NO: 33855 - RNA, 23 nt, Homo sapiens
ccgcccaagugcccuucugccca

SEQ ID NO: 33856 - RNA, 19 nt, Homo sapiens
ccgccgaagggccuugggg

SEQ ID NO: 33857 - RNA, 16 nt, Homo sapiens
ccucucucuccccgcu

SEQ ID NO: 33858 - RNA, 15 nt, Homo sapiens
cgaggaacugccagc

SEQ ID NO: 33859 - RNA, 23 nt, Homo sapiens
cuccccgcuucuugcugcuuuug

SEQ ID NO: 33860 - RNA, 15 nt, Homo sapiens
gacaccgaauggccc

SEQ ID NO: 33861 - RNA, 20 nt, Homo sapiens
gcagcuccuccgacgcagcc

SEQ ID NO: 33862 - RNA, 21 nt, Homo sapiens
gcauaguauuuauuguuuuuc

SEQ ID NO: 33863 - RNA, 22 nt, Homo sapiens
gccacagcuccuucuccugcag

SEQ ID NO: 33864 - RNA, 21 nt, Homo sapiens
gcccagcuuccuugggccguc

SEQ ID NO: 33865 - RNA, 17 nt, Homo sapiens
gccggagcgugcagcca

SEQ ID NO: 33866 - RNA, 17 nt, Homo sapiens
gccuggaggccgggccg

SEQ ID NO: 33867 - RNA, 18 nt, Homo sapiens
gccuugggggcuugagga

SEQ ID NO: 33868 - RNA, 20 nt, Homo sapiens
gcggccagggggcucugacg

SEQ ID NO: 33869 - RNA, 20 nt, Homo sapiens
ggccccggccucugggcguc

SEQ ID NO: 33870 - RNA, 21 nt, Homo sapiens
gggaggagcgucaccagggag

SEQ ID NO: 33871 - RNA, 19 nt, Homo sapiens
ggggaggauggaggggggc

SEQ ID NO: 33872 - RNA, 20 nt, Homo sapiens
ggguuggggagggugggcag

SEQ ID NO: 33873 - RNA, 18 nt, Homo sapiens
gugugugugugugugugu

SEQ ID NO: 33874 - RNA, 18 nt, Homo sapiens
uagagcaccaaguucacu

SEQ ID NO: 33875 - RNA, 23 nt, Homo sapiens
ucuccuccugugugcauggcaga

SEQ ID NO: 33876 - RNA, 26 nt, Homo sapiens
ucuccuggcccugggggcgcccgccg

SEQ ID NO: 33877 - RNA, 18 nt, Homo sapiens
ugcccuucugcccagcag

SEQ ID NO: 33878 - RNA, 18 nt, Homo sapiens
ugugugugugugugugug

SEQ ID NO: 33879 - RNA, 19 nt, Homo sapiens
ugugugugugugugugugu

SEQ ID NO: 33880 - RNA, 22 nt, Homo sapiens
uuuucuuuccaggaagcccaca

SEQ ID NO: 33881 - RNA, 19 nt, Homo sapiens
augugggagagucaagaaa

SEQ ID NO: 33882 - RNA, 17 nt, Homo sapiens
ccccggcccaccacggg

SEQ ID NO: 33883 - RNA, 23 nt, Homo sapiens
uacacaaggcugauuacuguaca

SEQ ID NO: 33884 - RNA, 19 nt, Homo sapiens
agucaccagcaccaucuga

SEQ ID NO: 33885 - RNA, 19 nt, Homo sapiens
ccugcauuuccuccaaguc

SEQ ID NO: 33886 - RNA, 16 nt, Homo sapiens
ugaguagaauacucaa

SEQ ID NO: 33887 - RNA, 22 nt, Homo sapiens
acacggugggguuccugcuucc

SEQ ID NO: 33888 - RNA, 16 nt, Homo sapiens
acagccggggugggcu

SEQ ID NO: 33889 - RNA, 16 nt, Homo sapiens
aggauccucugguccc

SEQ ID NO: 33890 - RNA, 24 nt, Homo sapiens
agggaccacacacuagagugaggg

SEQ ID NO: 33891 - RNA, 20 nt, Homo sapiens
auaacuccagguccuguggc

SEQ ID NO: 33892 - RNA, 19 nt, Homo sapiens
cauuuuugcauugucagga

SEQ ID NO: 33893 - RNA, 21 nt, Homo sapiens
ccauaugcuacaggaaggggu

SEQ ID NO: 33894 - RNA, 18 nt, Homo sapiens
gaggccggagccccgacu

SEQ ID NO: 33895 - RNA, 16 nt, Homo sapiens
gagggagagggggcuc

SEQ ID NO: 33896 - RNA, 18 nt, Homo sapiens
ggcugggcagcugggcuc

SEQ ID NO: 33897 - RNA, 17 nt, Homo sapiens
gggcuggcagggggcac

SEQ ID NO: 33898 - RNA, 16 nt, Homo sapiens
ggggugggguggggag

SEQ ID NO: 33899 - RNA, 15 nt, Homo sapiens
gggugggguggggag

SEQ ID NO: 33900 - RNA, 17 nt, Homo sapiens
ggugggccuggugcugg

SEQ ID NO: 33901 - RNA, 24 nt, Homo sapiens
uccucuggucccugauccuaggcc

SEQ ID NO: 33902 - RNA, 18 nt, Homo sapiens
ugagaggagggcagaggc

SEQ ID NO: 33903 - RNA, 17 nt, Homo sapiens
ugcugguguccccgcgg

SEQ ID NO: 33904 - RNA, 19 nt, Homo sapiens
uggagggaaggcaucagag

SEQ ID NO: 33905 - RNA, 19 nt, Homo sapiens
uggcuauggggaggggggg

SEQ ID NO: 33906 - RNA, 20 nt, Homo sapiens
uggcugccugggcccugcug

SEQ ID NO: 33907 - RNA, 18 nt, Homo sapiens
ugguugcagugcaaccug

SEQ ID NO: 33908 - RNA, 18 nt, Homo sapiens
ugacagguaguaacuuuu

SEQ ID NO: 33909 - RNA, 17 nt, Homo sapiens
aaacacggaaaggagga

SEQ ID NO: 33910 - RNA, 22 nt, Homo sapiens
caaggcaggggggcagucagcc

SEQ ID NO: 33911 - RNA, 24 nt, Homo sapiens
cagggggagcagccagcagcgagg

SEQ ID NO: 33912 - RNA, 18 nt, Homo sapiens
gcccagcucccaccucuu

SEQ ID NO: 33913 - RNA, 22 nt, Homo sapiens
ggaaaggaggaagucugggggc

SEQ ID NO: 33914 - RNA, 15 nt, Homo sapiens
ggaacuuggggcuga

SEQ ID NO: 33915 - RNA, 25 nt, Homo sapiens
uaacucccuagcuucacaaagagaa

SEQ ID NO: 33916 - RNA, 20 nt, Homo sapiens
ucccgcguggcccgcccggc

SEQ ID NO: 33917 - RNA, 19 nt, Homo sapiens
uggggacccgggagcuguc

SEQ ID NO: 33918 - RNA, 18 nt, Homo sapiens
cgaccucgcucccucgcg

SEQ ID NO: 33919 - RNA, 19 nt, Homo sapiens
gggcgggggucucugcagu

SEQ ID NO: 33920 - RNA, 20 nt, Homo sapiens
aggagugugucuucucucca

SEQ ID NO: 33921 - RNA, 14 nt, Homo sapiens
gaaaaggagacagc

SEQ ID NO: 33922 - RNA, 22 nt, Homo sapiens
ggaaaggugaaacagcaugagg

SEQ ID NO: 33923 - RNA, 18 nt, Homo sapiens
uaaguuucacugcugacu

SEQ ID NO: 33924 - RNA, 17 nt, Homo sapiens
ugagggaagguggaaca

SEQ ID NO: 33925 - RNA, 18 nt, Homo sapiens
uggaggauggcagcagca

SEQ ID NO: 33926 - RNA, 19 nt, Homo sapiens
ugguuauuuucccgaauuc

SEQ ID NO: 33927 - RNA, 18 nt, Homo sapiens
aggggucugggggaaccu

SEQ ID NO: 33928 - RNA, 17 nt, Homo sapiens
caguggcugcucgccag

SEQ ID NO: 33929 - RNA, 20 nt, Homo sapiens
ccacaauuuugcuguuuuug

SEQ ID NO: 33930 - RNA, 21 nt, Homo sapiens
cccaggaggggucugggggaa

SEQ ID NO: 33931 - RNA, 23 nt, Homo sapiens
cccucugggugugugcgcacaca

SEQ ID NO: 33932 - RNA, 17 nt, Homo sapiens
ccugaagguggguaagg

SEQ ID NO: 33933 - RNA, 14 nt, Homo sapiens
cgugagugguacag

SEQ ID NO: 33934 - RNA, 21 nt, Homo sapiens
gauguggugggcccgggggac

SEQ ID NO: 33935 - RNA, 18 nt, Homo sapiens
gccgccccauccccgccc

SEQ ID NO: 33936 - RNA, 18 nt, Homo sapiens
gcgcgcuggggccacggc

SEQ ID NO: 33937 - RNA, 18 nt, Homo sapiens
gcggcggacgcgacggac

SEQ ID NO: 33938 - RNA, 22 nt, Homo sapiens
gcugcgcgcccugcuucggucg

SEQ ID NO: 33939 - RNA, 22 nt, Homo sapiens
gugggggugcguccucccaggg

SEQ ID NO: 33940 - RNA, 19 nt, Homo sapiens
ugaagaaccaaaacuucaa

SEQ ID NO: 33941 - RNA, 21 nt, Homo sapiens
ugauggacacagaccaacacu

SEQ ID NO: 33942 - RNA, 16 nt, Homo sapiens
uguuagugccaucagc

SEQ ID NO: 33943 - RNA, 20 nt, Homo sapiens
uguugugcaucuuucacaaa

SEQ ID NO: 33944 - RNA, 16 nt, Homo sapiens
gccacccgggccaccc

SEQ ID NO: 33945 - RNA, 23 nt, Homo sapiens
aaucucuaaagaauucccuuuuu

SEQ ID NO: 33946 - RNA, 18 nt, Homo sapiens
aaagagagggaggaaaau

SEQ ID NO: 33947 - RNA, 19 nt, Homo sapiens
aaguagcuggugugaggau

SEQ ID NO: 33948 - RNA, 19 nt, Homo sapiens
augugauggcagugagaaa

SEQ ID NO: 33949 - RNA, 17 nt, Homo sapiens
cagcuuaaaaccaucag

SEQ ID NO: 33950 - RNA, 19 nt, Homo sapiens
cuagcagggcagauuuucg

SEQ ID NO: 33951 - RNA, 23 nt, Homo sapiens
cugcuugggaacagaguggggcc

SEQ ID NO: 33952 - RNA, 17 nt, Homo sapiens
cuguggcugcacagagg

SEQ ID NO: 33953 - RNA, 16 nt, Homo sapiens
cuugggaacagagugg

SEQ ID NO: 33954 - RNA, 24 nt, Homo sapiens
gccuuacuggccuuuuccuucucc

SEQ ID NO: 33955 - RNA, 24 nt, Homo sapiens
ggagaguuggaauuuauuuccauu

SEQ ID NO: 33956 - RNA, 24 nt, Homo sapiens
ggaucuuucacugaggagccucca

SEQ ID NO: 33957 - RNA, 22 nt, Homo sapiens
guuacauuuuuauaaauaucua

SEQ ID NO: 33958 - RNA, 21 nt, Homo sapiens
uauacuauuauacauaguuuu

SEQ ID NO: 33959 - RNA, 17 nt, Homo sapiens
uuaaagagagggaggaa

SEQ ID NO: 33960 - RNA, 16 nt, Homo sapiens
uuggcuuugccauaaa

SEQ ID NO: 33961 - RNA, 21 nt, Homo sapiens
uuuucaucaacuugccccauu

SEQ ID NO: 33962 - RNA, 21 nt, Homo sapiens
accaugugggcacgugugugu

SEQ ID NO: 33963 - RNA, 16 nt, Homo sapiens
ccuggggcuucaucac

SEQ ID NO: 33964 - RNA, 17 nt, Homo sapiens
cugcaccucuuccccaa

SEQ ID NO: 33965 - RNA, 17 nt, Homo sapiens
cuuccacgccuggggcu

SEQ ID NO: 33966 - RNA, 17 nt, Homo sapiens
gaggggacacuccgguc

SEQ ID NO: 33967 - RNA, 17 nt, Homo sapiens
gcguguggagauaaaaa

SEQ ID NO: 33968 - RNA, 19 nt, Homo sapiens
gcuggcugcuaccauucgu

SEQ ID NO: 33969 - RNA, 18 nt, Homo sapiens
ggccacaccccaaacugc

SEQ ID NO: 33970 - RNA, 18 nt, Homo sapiens
ucuagccagcgccgcggc

SEQ ID NO: 33971 - RNA, 16 nt, Homo sapiens
ugauucugacccacgg

SEQ ID NO: 33972 - RNA, 18 nt, Homo sapiens
ugccauggaaaaguaucc

SEQ ID NO: 33973 - RNA, 17 nt, Homo sapiens
aaaagcagcucauggcu

SEQ ID NO: 33974 - RNA, 23 nt, Homo sapiens
aacauaugugauuugccaggaaa

SEQ ID NO: 33975 - RNA, 23 nt, Homo sapiens
aauauauauauauauauauauaa

SEQ ID NO: 33976 - RNA, 24 nt, Homo sapiens
aauauauauauauauauauauaua

SEQ ID NO: 33977 - RNA, 20 nt, Homo sapiens
aauggacuguuugucugaaa

SEQ ID NO: 33978 - RNA, 23 nt, Homo sapiens
acauuuucuaaauaaaagcuccc

SEQ ID NO: 33979 - RNA, 22 nt, Homo sapiens
auauauauauauauacacacau

SEQ ID NO: 33980 - RNA, 21 nt, Homo sapiens
auauauauauauauauauaua

SEQ ID NO: 33981 - RNA, 22 nt, Homo sapiens
auauauauauauauauauauau

SEQ ID NO: 33982 - RNA, 24 nt, Homo sapiens
auauauauauauauauauauauau

SEQ ID NO: 33983 - RNA, 23 nt, Homo sapiens
auauauauauauauauauauauu

SEQ ID NO: 33984 - RNA, 19 nt, Homo sapiens
cagcccuaguaaaaguuuu

SEQ ID NO: 33985 - RNA, 17 nt, Homo sapiens
cucacaucaacaacaua

SEQ ID NO: 33986 - RNA, 20 nt, Homo sapiens
ggcaaaaaggaaacuguacc

SEQ ID NO: 33987 - RNA, 20 nt, Homo sapiens
uacauauauauagauauaua

SEQ ID NO: 33988 - RNA, 22 nt, Homo sapiens
uacauauauauagauauauaga

SEQ ID NO: 33989 - RNA, 24 nt, Homo sapiens
uauauagauauauagauauauaua

SEQ ID NO: 33990 - RNA, 18 nt, Homo sapiens
uauauauauauauauaca

SEQ ID NO: 33991 - RNA, 24 nt, Homo sapiens
uauauauauauauauacacacaua

SEQ ID NO: 33992 - RNA, 22 nt, Homo sapiens
uauauauauauauauauauaua

SEQ ID NO: 33993 - RNA, 24 nt, Human papillomavirus type 25
uauauauauauauauauauauaua

SEQ ID NO: 33994 - RNA, 19 nt, Homo sapiens
uauccuaaaaaauuuucau

SEQ ID NO: 33995 - RNA, 18 nt, Homo sapiens
ucucucacagacacagac

SEQ ID NO: 33996 - RNA, 18 nt, Homo sapiens
uguuugaaaaucuuugcu

SEQ ID NO: 33997 - RNA, 17 nt, Homo sapiens
uugguaaaacugcauuc

SEQ ID NO: 33998 - RNA, 18 nt, Homo sapiens
acuauguaagaguucuca

SEQ ID NO: 33999 - RNA, 18 nt, Homo sapiens
agucuguaauauaaauau

SEQ ID NO: 34000 - RNA, 17 nt, Homo sapiens
auaacaguugaucauaa

SEQ ID NO: 34001 - RNA, 27 nt, Homo sapiens
caucagccgucugcugaaaaacacugc

SEQ ID NO: 34002 - RNA, 21 nt, Homo sapiens
cccagcauuuucacccugucc

SEQ ID NO: 34003 - RNA, 18 nt, Homo sapiens
cggccgagcccggggcgc

SEQ ID NO: 34004 - RNA, 24 nt, Homo sapiens
gaaaaccacaucagacuuuauguu

SEQ ID NO: 34005 - RNA, 16 nt, Homo sapiens
gagcuaaaucucaacu

SEQ ID NO: 34006 - RNA, 19 nt, Homo sapiens
gguauuccuaaaaaguugc

SEQ ID NO: 34007 - RNA, 20 nt, Homo sapiens
ggucggccgagcccggggcg

SEQ ID NO: 34008 - RNA, 24 nt, Homo sapiens
uauaaaauacaauaaacauaaacu

SEQ ID NO: 34009 - RNA, 21 nt, Homo sapiens
uauauaauuaaacacaucacu

SEQ ID NO: 34010 - RNA, 17 nt, Homo sapiens
ucugcgcaccugcuucu

SEQ ID NO: 34011 - RNA, 19 nt, Homo sapiens
ugccuaugucagcacuuug

SEQ ID NO: 34012 - RNA, 19 nt, Homo sapiens
uuacugcauuuuuucagaa

SEQ ID NO: 34013 - RNA, 17 nt, Homo sapiens
acauuuuagggggcugg

SEQ ID NO: 34014 - RNA, 19 nt, Homo sapiens
acugaacaaguuacauugu

SEQ ID NO: 34015 - RNA, 16 nt, Homo sapiens
ccggaggagaggagga

SEQ ID NO: 34016 - RNA, 19 nt, Homo sapiens
cgccggcggcccugggucg

SEQ ID NO: 34017 - RNA, 18 nt, Homo sapiens
cgggcgcgggcggccgcg

SEQ ID NO: 34018 - RNA, 15 nt, Homo sapiens
gagaggaggacgcgg

SEQ ID NO: 34019 - RNA, 21 nt, Homo sapiens
gcgcgggcggccgcggcgccg

SEQ ID NO: 34020 - RNA, 19 nt, Homo sapiens
gcgcggucucgggcgcggg

SEQ ID NO: 34021 - RNA, 21 nt, Homo sapiens
ggcgcgggcggccgcggcgcc

SEQ ID NO: 34022 - RNA, 21 nt, Homo sapiens
gggacccacagugagugggca

SEQ ID NO: 34023 - RNA, 19 nt, Homo sapiens
ucccgcaaacggugaaaac

SEQ ID NO: 34024 - RNA, 24 nt, Homo sapiens
ucccugcagcgccuccccgggcac

SEQ ID NO: 34025 - RNA, 23 nt, Homo sapiens
ucccuggggucuggugggggaaa

SEQ ID NO: 34026 - RNA, 15 nt, Homo sapiens
ucgcggccgccggcg

SEQ ID NO: 34027 - RNA, 24 nt, Homo sapiens
ucuggaaggaauaugcauaucugu

SEQ ID NO: 34028 - RNA, 15 nt, Homo sapiens
uggaaggccgggggc

SEQ ID NO: 34029 - RNA, 21 nt, Homo sapiens
uguuaggggaaguugaggcag

SEQ ID NO: 34030 - RNA, 21 nt, Homo sapiens
uucccuggggucugguggggg

SEQ ID NO: 34031 - RNA, 20 nt, Homo sapiens
uucuagacagagaaagcagu

SEQ ID NO: 34032 - RNA, 16 nt, Homo sapiens
gggggagggggcagcg

SEQ ID NO: 34033 - RNA, 19 nt, Homo sapiens
ucccuccaaggaugggacc

SEQ ID NO: 34034 - RNA, 18 nt, Homo sapiens
aacugauugaaagugagc

SEQ ID NO: 34035 - RNA, 23 nt, Homo sapiens
agaagauuugcuacuucagacau

SEQ ID NO: 34036 - RNA, 16 nt, Homo sapiens
aggaucuaccuucugc

SEQ ID NO: 34037 - RNA, 22 nt, Homo sapiens
cauccuaccuaaaagucauaga

SEQ ID NO: 34038 - RNA, 20 nt, Homo sapiens
cauuucuaaaguuauaaauu

SEQ ID NO: 34039 - RNA, 23 nt, Homo sapiens
cccggcccucucucuuucuuuuu

SEQ ID NO: 34040 - RNA, 21 nt, Homo sapiens
cgcagcuuuaucauucuguuu

SEQ ID NO: 34041 - RNA, 21 nt, Homo sapiens
uauaaauuuaugaagcuuuga

SEQ ID NO: 34042 - RNA, 20 nt, Homo sapiens
agaggagacacccugggcac

SEQ ID NO: 34043 - RNA, 19 nt, Homo sapiens
agaggagggggaggaggga

SEQ ID NO: 34044 - RNA, 19 nt, Homo sapiens
agccaccccgguggcuacc

SEQ ID NO: 34045 - RNA, 20 nt, Homo sapiens
caccauccagggcucuggcg

SEQ ID NO: 34046 - RNA, 16 nt, Homo sapiens
cagaggggguggugcc

SEQ ID NO: 34047 - RNA, 19 nt, Homo sapiens
cagccgccggcuuugcugg

SEQ ID NO: 34048 - RNA, 21 nt, Homo sapiens
cagccgccggcuuugcuggug

SEQ ID NO: 34049 - RNA, 22 nt, Homo sapiens
cagccucagcccagagaaguca

SEQ ID NO: 34050 - RNA, 19 nt, Homo sapiens
ccagcacaucaccagccag

SEQ ID NO: 34051 - RNA, 20 nt, Homo sapiens
ccccgugggccugggcgggc

SEQ ID NO: 34052 - RNA, 23 nt, Homo sapiens
ccucgggcugagcgacagcacgu

SEQ ID NO: 34053 - RNA, 21 nt, Homo sapiens
cguguguggggucuggggggc

SEQ ID NO: 34054 - RNA, 18 nt, Homo sapiens
cucuggaguggggagggg

SEQ ID NO: 34055 - RNA, 17 nt, Homo sapiens
cugccccucugggcaga

SEQ ID NO: 34056 - RNA, 17 nt, Homo sapiens
gcgccguccucgccggg

SEQ ID NO: 34057 - RNA, 19 nt, Homo sapiens
gcggccugcuggccaggga

SEQ ID NO: 34058 - RNA, 24 nt, Homo sapiens
gcuccuuccagagcccagacccgg

SEQ ID NO: 34059 - RNA, 19 nt, Homo sapiens
ggccuggaggguggugugg

SEQ ID NO: 34060 - RNA, 21 nt, Homo sapiens
gggcgccuggcuccgugccgc

SEQ ID NO: 34061 - RNA, 18 nt, Homo sapiens
ggggggccuggagggugg

SEQ ID NO: 34062 - RNA, 21 nt, Homo sapiens
ggggucuggggggcagaaccu

SEQ ID NO: 34063 - RNA, 21 nt, Homo sapiens
ggucugcagcucuugcagccc

SEQ ID NO: 34064 - RNA, 16 nt, Homo sapiens
guugggcgugaggacc

SEQ ID NO: 34065 - RNA, 17 nt, Homo sapiens
uccucgccgccaccggg

SEQ ID NO: 34066 - RNA, 17 nt, Homo sapiens
ugagagggaggccacgg

SEQ ID NO: 34067 - RNA, 16 nt, Homo sapiens
uggaguggggaggggg

SEQ ID NO: 34068 - RNA, 24 nt, Homo sapiens
uggggcggccguguguggggucug

SEQ ID NO: 34069 - RNA, 27 nt, Homo sapiens
uugcuggugguucugugcccuccgugg

SEQ ID NO: 34070 - RNA, 18 nt, Homo sapiens
aggcaccagcugcuccca

SEQ ID NO: 34071 - RNA, 16 nt, Homo sapiens
caggcggagccauccc

SEQ ID NO: 34072 - RNA, 19 nt, Homo sapiens
gagccaucccgagggagcc

SEQ ID NO: 34073 - RNA, 17 nt, Homo sapiens
uagcgcggccgcgcggc

SEQ ID NO: 34074 - RNA, 16 nt, Homo sapiens
acauuuuuccuguaua

SEQ ID NO: 34075 - RNA, 20 nt, Homo sapiens
agaacaaaauucuaaaggag

SEQ ID NO: 34076 - RNA, 23 nt, Homo sapiens
agaggcaggacugggacgccaaa

SEQ ID NO: 34077 - RNA, 15 nt, Homo sapiens
ccgaagcuccggagg

SEQ ID NO: 34078 - RNA, 19 nt, Homo sapiens
cgaggaugccccgauagcc

SEQ ID NO: 34079 - RNA, 18 nt, Homo sapiens
cugccuucuuucuagcaa

SEQ ID NO: 34080 - RNA, 20 nt, Homo sapiens
uaacucuaguuauuguaugc

SEQ ID NO: 34081 - RNA, 19 nt, Homo sapiens
uaauguacagaucaaugua

SEQ ID NO: 34082 - RNA, 20 nt, Homo sapiens
uauaauacaaaacaaauuac

SEQ ID NO: 34083 - RNA, 14 nt, Homo sapiens
ucaacaucaguagg

SEQ ID NO: 34084 - RNA, 16 nt, Homo sapiens
ucggguccgcaggacc

SEQ ID NO: 34085 - RNA, 18 nt, Homo sapiens
ucuuucaacaucaguagg

SEQ ID NO: 34086 - RNA, 22 nt, Homo sapiens
uuaauuguaauuaaaauuuaca

SEQ ID NO: 34087 - RNA, 18 nt, Homo sapiens
aaacagcuuagaaaaagu

SEQ ID NO: 34088 - RNA, 24 nt, Homo sapiens
acacagccugcaugcaaaacuucc

SEQ ID NO: 34089 - RNA, 19 nt, Homo sapiens
aggaagggauauccucuuc

SEQ ID NO: 34090 - RNA, 21 nt, Homo sapiens
aguagauaaaugguauuuuug

SEQ ID NO: 34091 - RNA, 20 nt, Homo sapiens
auaacacaaaguccuuucca

SEQ ID NO: 34092 - RNA, 19 nt, Homo sapiens
cuugcaaacggaucggggu

SEQ ID NO: 34093 - RNA, 21 nt, Homo sapiens
gaugaggaagagcaccuaugu

SEQ ID NO: 34094 - RNA, 20 nt, Homo sapiens
gcaaaacacugaaauguuga

SEQ ID NO: 34095 - RNA, 17 nt, Homo sapiens
ggaagggacucaggaag

SEQ ID NO: 34096 - RNA, 20 nt, Homo sapiens
uaaaaguuccuuucuccccu

SEQ ID NO: 34097 - RNA, 20 nt, Homo sapiens
uuaguccugcucgaaaacac

SEQ ID NO: 34098 - RNA, 17 nt, Homo sapiens
uuuugcuuauuucccag

SEQ ID NO: 34099 - RNA, 20 nt, Homo sapiens
acacguggcaagcggacccg

SEQ ID NO: 34100 - RNA, 22 nt, Homo sapiens
aggagcggcggcggccagccgg

SEQ ID NO: 34101 - RNA, 18 nt, Homo sapiens
aggcagaagguacgcucg

SEQ ID NO: 34102 - RNA, 19 nt, Homo sapiens
aggcggagccggggcuccg

SEQ ID NO: 34103 - RNA, 17 nt, Homo sapiens
aggguuggcagguggag

SEQ ID NO: 34104 - RNA, 19 nt, Homo sapiens
aucauccccacuucuugcc

SEQ ID NO: 34105 - RNA, 20 nt, Homo sapiens
caaguaucuuguuccccaaa

SEQ ID NO: 34106 - RNA, 17 nt, Homo sapiens
cagcacccucgcccccc

SEQ ID NO: 34107 - RNA, 17 nt, Homo sapiens
cagggcccuccacccgc

SEQ ID NO: 34108 - RNA, 21 nt, Homo sapiens
ccagcgugaccagcuccaccu

SEQ ID NO: 34109 - RNA, 18 nt, Homo sapiens
cccugagaccucagcacc

SEQ ID NO: 34110 - RNA, 19 nt, Homo sapiens
ccgcaccaggccaaaccgg

SEQ ID NO: 34111 - RNA, 19 nt, Homo sapiens
ccucgccccccacccuagc

SEQ ID NO: 34112 - RNA, 21 nt, Homo sapiens
ccuguguccucuccccuuucu

SEQ ID NO: 34113 - RNA, 20 nt, Homo sapiens
ccuugcccauuuuagcggcu

SEQ ID NO: 34114 - RNA, 24 nt, Homo sapiens
cgccggcgggcaggggcagccggg

SEQ ID NO: 34115 - RNA, 19 nt, Homo sapiens
cggcccccuccuuggcccg

SEQ ID NO: 34116 - RNA, 20 nt, Homo sapiens
cuccuccuccuccuccucgg

SEQ ID NO: 34117 - RNA, 24 nt, Homo sapiens
cucuucggccacuucucguacacg

SEQ ID NO: 34118 - RNA, 22 nt, Homo sapiens
cuguguccucuccccuuucugc

SEQ ID NO: 34119 - RNA, 18 nt, Homo sapiens
gagggcccugggcugggg

SEQ ID NO: 34120 - RNA, 20 nt, Homo sapiens
gcacuugcauuuccggcagc

SEQ ID NO: 34121 - RNA, 23 nt, Homo sapiens
gcagcugcaccucggggagucga

SEQ ID NO: 34122 - RNA, 19 nt, Homo sapiens
gcccccacccgagccuugg

SEQ ID NO: 34123 - RNA, 23 nt, Homo sapiens
gcggcggccagccgggcugccug

SEQ ID NO: 34124 - RNA, 21 nt, Homo sapiens
gcuccucagcacccucgcccc

SEQ ID NO: 34125 - RNA, 19 nt, Homo sapiens
gcuccuguguccucucccc

SEQ ID NO: 34126 - RNA, 17 nt, Homo sapiens
gcuggaggcgccggcgg

SEQ ID NO: 34127 - RNA, 17 nt, Homo sapiens
gcugggaggcaccugcg

SEQ ID NO: 34128 - RNA, 17 nt, Homo sapiens
ggacagaucgagggcag

SEQ ID NO: 34129 - RNA, 20 nt, Homo sapiens
ggauucccacggcuggggcc

SEQ ID NO: 34130 - RNA, 16 nt, Homo sapiens
gggaaaacuaaggcgg

SEQ ID NO: 34131 - RNA, 18 nt, Homo sapiens
ggggaggagcggcggcgg

SEQ ID NO: 34132 - RNA, 22 nt, Homo sapiens
ggggggaggagcggcggcggcc

SEQ ID NO: 34133 - RNA, 21 nt, Homo sapiens
ucaguucugcauggagcagcu

SEQ ID NO: 34134 - RNA, 19 nt, Homo sapiens
uccucggcccccuccuugg

SEQ ID NO: 34135 - RNA, 18 nt, Homo sapiens
ucggcagcugcaccucgg

SEQ ID NO: 34136 - RNA, 20 nt, Homo sapiens
ugaccuuggcuaccuuggcc

SEQ ID NO: 34137 - RNA, 19 nt, Homo sapiens
ugucccggccucugacccc

SEQ ID NO: 34138 - RNA, 19 nt, Homo sapiens
uuccccacugcccucuucc

SEQ ID NO: 34139 - RNA, 18 nt, Homo sapiens
agagguugcagugagcca

SEQ ID NO: 34140 - RNA, 24 nt, Homo sapiens
caacggugucuuaaagagguuuca

SEQ ID NO: 34141 - RNA, 16 nt, Homo sapiens
gaguucaagaucagcc

SEQ ID NO: 34142 - RNA, 23 nt, Homo sapiens
gcaaaaucucaucgcugcaaaag

SEQ ID NO: 34143 - RNA, 20 nt, Homo sapiens
gggaggauggcuugagccca

SEQ ID NO: 34144 - RNA, 18 nt, Homo sapiens
uaugugugugugugugug

SEQ ID NO: 34145 - RNA, 20 nt, Homo sapiens
ugagauuaaugauuaaauaa

SEQ ID NO: 34146 - RNA, 20 nt, Homo sapiens
ugauguuguacagggaggag

SEQ ID NO: 34147 - RNA, 20 nt, Homo sapiens
ugcauccgccaucacaauuu

SEQ ID NO: 34148 - RNA, 18 nt, Homo sapiens
ugugugugugugugugug

SEQ ID NO: 34149 - RNA, 19 nt, Homo sapiens
ugugugugugugugugugu

SEQ ID NO: 34150 - RNA, 20 nt, Homo sapiens
uucaugugacuuucguguau

SEQ ID NO: 34151 - RNA, 18 nt, Homo sapiens
uuggaugggcacauuggc

SEQ ID NO: 34152 - RNA, 20 nt, Homo sapiens
aguggugcugguggcuccuu

SEQ ID NO: 34153 - RNA, 18 nt, Homo sapiens
auuacacuuauuuucaca

SEQ ID NO: 34154 - RNA, 16 nt, Homo sapiens
caacugauuuucuuag

SEQ ID NO: 34155 - RNA, 16 nt, Homo sapiens
ucaccggcuaucagaa

SEQ ID NO: 34156 - RNA, 15 nt, Homo sapiens
uuccaaaucgagggu

SEQ ID NO: 34157 - RNA, 27 nt, Homo sapiens
ugaagaggucugcaggugaaguucuuc

SEQ ID NO: 34158 - RNA, 24 nt, Homo sapiens
caguguccuuuccagaaacuauuu

SEQ ID NO: 34159 - RNA, 21 nt, Homo sapiens
ucaauuucuuccucucaaagu

SEQ ID NO: 34160 - RNA, 19 nt, Homo sapiens
aagacagaggcccacagga

SEQ ID NO: 34161 - RNA, 18 nt, Homo sapiens
accuuggucccuucagcu

SEQ ID NO: 34162 - RNA, 23 nt, Homo sapiens
agagguugcagugagcaaagauc

SEQ ID NO: 34163 - RNA, 20 nt, Homo sapiens
aggaggauggcuuaaggcua

SEQ ID NO: 34164 - RNA, 16 nt, Homo sapiens
caccacuaguagcuca

SEQ ID NO: 34165 - RNA, 20 nt, Homo sapiens
caggggaagggcauggcugg

SEQ ID NO: 34166 - RNA, 18 nt, Homo sapiens
ccccagcccuggccggcc

SEQ ID NO: 34167 - RNA, 16 nt, Homo sapiens
cccccacccccacagu

SEQ ID NO: 34168 - RNA, 17 nt, Homo sapiens
cccccgccccgccgccc

SEQ ID NO: 34169 - RNA, 15 nt, Homo sapiens
ccggcccggcuccgg

SEQ ID NO: 34170 - RNA, 19 nt, Homo sapiens
ccuggccgucccgcccgcc

SEQ ID NO: 34171 - RNA, 17 nt, Homo sapiens
gagaggcaaccuggggu

SEQ ID NO: 34172 - RNA, 17 nt, Homo sapiens
gcgugguggcgggcgcc

SEQ ID NO: 34173 - RNA, 18 nt, Homo sapiens
ggagguugcagggaaagg

SEQ ID NO: 34174 - RNA, 18 nt, Homo sapiens
gguacggggauccagggu

SEQ ID NO: 34175 - RNA, 17 nt, Homo sapiens
gguaggcaacaagggua

SEQ ID NO: 34176 - RNA, 14 nt, Homo sapiens
uagccccuuguuuc

SEQ ID NO: 34177 - RNA, 22 nt, Homo sapiens
ucccaggacacuaucuggggaa

SEQ ID NO: 34178 - RNA, 15 nt, Homo sapiens
uccccaaucaacagg

SEQ ID NO: 34179 - RNA, 21 nt, Homo sapiens
uccucaugccugucuuuguac

SEQ ID NO: 34180 - RNA, 23 nt, Homo sapiens
ucuuuguacaaaauauuguacaa

SEQ ID NO: 34181 - RNA, 18 nt, Homo sapiens
ugcuacugaccccucccc

SEQ ID NO: 34182 - RNA, 17 nt, Homo sapiens
uuagccugggccaggcg

SEQ ID NO: 34183 - RNA, 17 nt, Homo sapiens
uuggggacagaucaugg

SEQ ID NO: 34184 - RNA, 19 nt, Homo sapiens
agagguguggacauuucca

SEQ ID NO: 34185 - RNA, 19 nt, Homo sapiens
gcgcgggggugggggcugc

SEQ ID NO: 34186 - RNA, 23 nt, Homo sapiens
ggcgugucgcagcgcgggggugg

SEQ ID NO: 34187 - RNA, 21 nt, Homo sapiens
guauacuguaguguuugcaaa

SEQ ID NO: 34188 - RNA, 18 nt, Homo sapiens
agcaaguagaaugggcca

SEQ ID NO: 34189 - RNA, 19 nt, Homo sapiens
gcgggggcagguccagagc

SEQ ID NO: 34190 - RNA, 18 nt, Homo sapiens
uccuggaguaggcgcugg

SEQ ID NO: 34191 - RNA, 17 nt, Homo sapiens
gcagggcacccccggca

SEQ ID NO: 34192 - RNA, 21 nt, Homo sapiens
gcgggcgacgacccgcgggga

SEQ ID NO: 34193 - RNA, 21 nt, Homo sapiens
gcuguggcgggcgacgacccg

SEQ ID NO: 34194 - RNA, 21 nt, Homo sapiens
ggacucaauguuuuacaagca

SEQ ID NO: 34195 - RNA, 22 nt, Homo sapiens
ggcgaagggacacaguguugcu

SEQ ID NO: 34196 - RNA, 19 nt, Homo sapiens
ugcugacaaggugacacug

SEQ ID NO: 34197 - RNA, 18 nt, Homo sapiens
ugucagacacguuauauu

SEQ ID NO: 34198 - RNA, 22 nt, Homo sapiens
agaaagcagugauggggguggu

SEQ ID NO: 34199 - RNA, 19 nt, Homo sapiens
agagaaauacuagugacag

SEQ ID NO: 34200 - RNA, 20 nt, Homo sapiens
agggugugcaaaucuuucca

SEQ ID NO: 34201 - RNA, 17 nt, Homo sapiens
caccugcaaaccaggug

SEQ ID NO: 34202 - RNA, 15 nt, Homo sapiens
ccaagggcuuugcac

SEQ ID NO: 34203 - RNA, 17 nt, Homo sapiens
ccaggcagaccacagag

SEQ ID NO: 34204 - RNA, 20 nt, Homo sapiens
ccgccgcccgaaccaaacca

SEQ ID NO: 34205 - RNA, 17 nt, Homo sapiens
ccuccuggggagguggc

SEQ ID NO: 34206 - RNA, 18 nt, Homo sapiens
cgccggagugcggcuccg

SEQ ID NO: 34207 - RNA, 24 nt, Homo sapiens
gaaagaguugggcaucgcgcaucu

SEQ ID NO: 34208 - RNA, 16 nt, Homo sapiens
gagaggaaccgcauca

SEQ ID NO: 34209 - RNA, 21 nt, Homo sapiens
gaugggggugguggugguggg

SEQ ID NO: 34210 - RNA, 18 nt, Homo sapiens
gcccccuggcucgaagcu

SEQ ID NO: 34211 - RNA, 17 nt, Homo sapiens
gcccgcccgccgcucac

SEQ ID NO: 34212 - RNA, 20 nt, Homo sapiens
gcgccgccgccgccgccgga

SEQ ID NO: 34213 - RNA, 19 nt, Homo sapiens
gcgcggcggcgggugcagu

SEQ ID NO: 34214 - RNA, 18 nt, Homo sapiens
gcggcuccgcgccgcggc

SEQ ID NO: 34215 - RNA, 19 nt, Homo sapiens
gcggcuccgcgccgcggcc

SEQ ID NO: 34216 - RNA, 15 nt, Homo sapiens
ggagacggaggcugg

SEQ ID NO: 34217 - RNA, 21 nt, Homo sapiens
gggcgaggggugcaggguggg

SEQ ID NO: 34218 - RNA, 21 nt, Homo sapiens
gucaccacccuagaggaaucg

SEQ ID NO: 34219 - RNA, 24 nt, Homo sapiens
ucacucgcgcacagacacucgcac

SEQ ID NO: 34220 - RNA, 23 nt, Homo sapiens
ucgcuccacccugccugcuccga

SEQ ID NO: 34221 - RNA, 20 nt, Homo sapiens
ugagaagugacgccguucug

SEQ ID NO: 34222 - RNA, 16 nt, Homo sapiens
ugccuggcguggccgu

SEQ ID NO: 34223 - RNA, 21 nt, Homo sapiens
ugccuggugcuuggggcgugc

SEQ ID NO: 34224 - RNA, 21 nt, Homo sapiens
uggcucagagucagaacagcc

SEQ ID NO: 34225 - RNA, 18 nt, Homo sapiens
uguggugggggggagggc

SEQ ID NO: 34226 - RNA, 21 nt, Homo sapiens
uguguuucauucuccuucagc

SEQ ID NO: 34227 - RNA, 17 nt, Homo sapiens
uuuugcuucacagcaga

SEQ ID NO: 34228 - RNA, 23 nt, Homo sapiens
ucaaucgaacagaugaugcuuua

SEQ ID NO: 34229 - RNA, 25 nt, Homo sapiens
aacauccuuuuauauccuuucuuaa

SEQ ID NO: 34230 - RNA, 17 nt, Homo sapiens
agcgagugggagcagaa

SEQ ID NO: 34231 - RNA, 18 nt, Homo sapiens
ccccuggcugcgggcggc

SEQ ID NO: 34232 - RNA, 15 nt, Homo sapiens
ccuuucuuaacagaa

SEQ ID NO: 34233 - RNA, 19 nt, Homo sapiens
cgggcggcggcggggcggc

SEQ ID NO: 34234 - RNA, 19 nt, Homo sapiens
cucgggcuccggcgcgccg

SEQ ID NO: 34235 - RNA, 22 nt, Homo sapiens
gcggcggggcggcggcggcucc

SEQ ID NO: 34236 - RNA, 20 nt, Homo sapiens
ggcggcggcggcuccccggg

SEQ ID NO: 34237 - RNA, 23 nt, Homo sapiens
ggcggcggcggggcggcggcggc

SEQ ID NO: 34238 - RNA, 17 nt, Homo sapiens
ggcugcgggcggcggcg

SEQ ID NO: 34239 - RNA, 20 nt, Homo sapiens
gggagggcgccccggguggc

SEQ ID NO: 34240 - RNA, 16 nt, Homo sapiens
guuucucucggcucag

SEQ ID NO: 34241 - RNA, 24 nt, Homo sapiens
uccccucucuucuuuuagcaaacu

SEQ ID NO: 34242 - RNA, 23 nt, Homo sapiens
ugguuucggggggcuuugcgccg

SEQ ID NO: 34243 - RNA, 19 nt, Homo sapiens
ggcauagaccuccuguggg

SEQ ID NO: 34244 - RNA, 19 nt, Homo sapiens
uagaaucuuuuacacccag

SEQ ID NO: 34245 - RNA, 20 nt, Homo sapiens
uuggagagagaaauuuagaa

SEQ ID NO: 34246 - RNA, 22 nt, Homo sapiens
cagggcacugggcccguucugc

SEQ ID NO: 34247 - RNA, 22 nt, Homo sapiens
gaaggaguuguccagacauugg

SEQ ID NO: 34248 - RNA, 19 nt, Homo sapiens
uagaaacaaacaggcucga

SEQ ID NO: 34249 - RNA, 24 nt, Homo sapiens
acuuggugugugugugugugugua

SEQ ID NO: 34250 - RNA, 21 nt, Homo sapiens
gugugguuugugugugugugu

SEQ ID NO: 34251 - RNA, 18 nt, Homo sapiens
ugugugugugugugugug

SEQ ID NO: 34252 - RNA, 19 nt, Homo sapiens
ugugugugugugugugugu

SEQ ID NO: 34253 - RNA, 24 nt, Homo sapiens
uucugcuucucaucaugggcaugu

SEQ ID NO: 34254 - RNA, 21 nt, Homo sapiens
auuuaguccaauaaaauuggg

SEQ ID NO: 34255 - RNA, 17 nt, Homo sapiens
ugaaguuaucaggaacu

SEQ ID NO: 34256 - RNA, 18 nt, Homo sapiens
uuucaugaaguaucagcc

SEQ ID NO: 34257 - RNA, 25 nt, Homo sapiens
aaaugaaggaacugagggcugaggc

SEQ ID NO: 34258 - RNA, 15 nt, Homo sapiens
aagaaaaagaaagaa

SEQ ID NO: 34259 - RNA, 17 nt, Homo sapiens
aagaacacccacaggaa

SEQ ID NO: 34260 - RNA, 15 nt, Homo sapiens
agcagccccgcuggc

SEQ ID NO: 34261 - RNA, 15 nt, Homo sapiens
cagggccuuccccug

SEQ ID NO: 34262 - RNA, 20 nt, Homo sapiens
cccucugguucacggugguu

SEQ ID NO: 34263 - RNA, 18 nt, Homo sapiens
ccucugucguuugaggau

SEQ ID NO: 34264 - RNA, 18 nt, Homo sapiens
gaggccaaggcaggugga

SEQ ID NO: 34265 - RNA, 18 nt, Homo sapiens
gagggggagaggauaucu

SEQ ID NO: 34266 - RNA, 18 nt, Homo sapiens
gcagggucuuggaaaggc

SEQ ID NO: 34267 - RNA, 20 nt, Homo sapiens
gccaggcuauucacacugcu

SEQ ID NO: 34268 - RNA, 19 nt, Homo sapiens
gccggccugggacagggcc

SEQ ID NO: 34269 - RNA, 19 nt, Homo sapiens
gcugccugucucuccccuc

SEQ ID NO: 34270 - RNA, 14 nt, Homo sapiens
gcuucugcugucca

SEQ ID NO: 34271 - RNA, 18 nt, Homo sapiens
ggaggaaaaagagguugg

SEQ ID NO: 34272 - RNA, 17 nt, Homo sapiens
ggcaggaaagaacaccc

SEQ ID NO: 34273 - RNA, 20 nt, Homo sapiens
gggaggauggcugguggcca

SEQ ID NO: 34274 - RNA, 22 nt, Homo sapiens
uccccucggggguccugggucu

SEQ ID NO: 34275 - RNA, 18 nt, Homo sapiens
ucguccugcuuggggcuc

SEQ ID NO: 34276 - RNA, 19 nt, Homo sapiens
ugaggucauagcaaagccc

SEQ ID NO: 34277 - RNA, 18 nt, Homo sapiens
ugccugucucuccccucc

SEQ ID NO: 34278 - RNA, 19 nt, Homo sapiens
uggcuguccagaggcugcu

SEQ ID NO: 34279 - RNA, 21 nt, Homo sapiens
uggggccaggcucugugcuug

SEQ ID NO: 34280 - RNA, 17 nt, Homo sapiens
gaguauagucccagaau

SEQ ID NO: 34281 - RNA, 19 nt, Homo sapiens
gcgggaguuggcagcugca

SEQ ID NO: 34282 - RNA, 17 nt, Homo sapiens
ggggaaggguggccggg

SEQ ID NO: 34283 - RNA, 18 nt, Homo sapiens
uauaucagaugacaauau

SEQ ID NO: 34284 - RNA, 24 nt, Homo sapiens
ugcguaccuggugaacaaguugcc

SEQ ID NO: 34285 - RNA, 18 nt, Homo sapiens
uggaaucauucuacacca

SEQ ID NO: 34286 - RNA, 20 nt, Homo sapiens
ugacaagugacaaccuuuuc

SEQ ID NO: 34287 - RNA, 25 nt, Homo sapiens
auuaaaacugccauuugcaguaggg

SEQ ID NO: 34288 - RNA, 19 nt, Homo sapiens
caucauucuuuuuccccaa

SEQ ID NO: 34289 - RNA, 15 nt, Homo sapiens
gggaccaccuuugaa

SEQ ID NO: 34290 - RNA, 19 nt, Homo sapiens
uaaacacacaagguggcac

SEQ ID NO: 34291 - RNA, 15 nt, Homo sapiens
ugcaguaggggcagc

SEQ ID NO: 34292 - RNA, 21 nt, Homo sapiens
gcgugagcgcuaucggcgcgg

SEQ ID NO: 34293 - RNA, 20 nt, Homo sapiens
ggcgcggaaagaaagaaacc

SEQ ID NO: 34294 - RNA, 18 nt, Homo sapiens
accugcaggucacggcgc

SEQ ID NO: 34295 - RNA, 21 nt, Homo sapiens
ugaacucuuuuguguauucag

SEQ ID NO: 34296 - RNA, 19 nt, Homo sapiens
acaguagagauauaggaga

SEQ ID NO: 34297 - RNA, 19 nt, Homo sapiens
ccaaaugcuaagagcaagu

SEQ ID NO: 34298 - RNA, 19 nt, Homo sapiens
gaccuugaaauacggcaac

SEQ ID NO: 34299 - RNA, 18 nt, Homo sapiens
ucgcagcauuaucaugag

SEQ ID NO: 34300 - RNA, 18 nt, Homo sapiens
ugaugauaaaugguuccu

SEQ ID NO: 34301 - RNA, 15 nt, Homo sapiens
ugccacaagacaggg

SEQ ID NO: 34302 - RNA, 15 nt, Homo sapiens
uggacuuguaacagg

SEQ ID NO: 34303 - RNA, 17 nt, Homo sapiens
ugguagugacaggugua

SEQ ID NO: 34304 - RNA, 22 nt, Homo sapiens
uuaagugugcuaaucuuugugc

SEQ ID NO: 34305 - RNA, 18 nt, Homo sapiens
acaguacaaucaguaaaa

SEQ ID NO: 34306 - RNA, 18 nt, Homo sapiens
acccucaagaguuugcac

SEQ ID NO: 34307 - RNA, 20 nt, Homo sapiens
acugcaguaauaauaaaaua

SEQ ID NO: 34308 - RNA, 23 nt, Homo sapiens
auauauaucuauuauauauauau

SEQ ID NO: 34309 - RNA, 18 nt, Homo sapiens
cacauuuugcauuuuuga

SEQ ID NO: 34310 - RNA, 19 nt, Homo sapiens
cgcggccccucccccgccc

SEQ ID NO: 34311 - RNA, 18 nt, Homo sapiens
cugcgcggccccuccccc

SEQ ID NO: 34312 - RNA, 19 nt, Homo sapiens
gaaagggaaucuccucaca

SEQ ID NO: 34313 - RNA, 20 nt, Homo sapiens
gaugaaaauguccccucaaa

SEQ ID NO: 34314 - RNA, 15 nt, Homo sapiens
gcccgcgcgggcgcc

SEQ ID NO: 34315 - RNA, 19 nt, Homo sapiens
ggaugucuuguggcugagg

SEQ ID NO: 34316 - RNA, 18 nt, Homo sapiens
ggcggucgcccagcggcg

SEQ ID NO: 34317 - RNA, 19 nt, Homo sapiens
uaacaaggccugauacuca

SEQ ID NO: 34318 - RNA, 19 nt, Homo sapiens
uaaguagaaaugggggugu

SEQ ID NO: 34319 - RNA, 18 nt, Homo sapiens
uacagugugcuguuuggu

SEQ ID NO: 34320 - RNA, 19 nt, Homo sapiens
uagcugcaacauccaaacc

SEQ ID NO: 34321 - RNA, 23 nt, Homo sapiens
uauauauaucuauuauauauaua

SEQ ID NO: 34322 - RNA, 19 nt, Homo sapiens
uccaaaccucaaaaaaagg

SEQ ID NO: 34323 - RNA, 20 nt, Homo sapiens
ucgcugugcagccucuuauc

SEQ ID NO: 34324 - RNA, 17 nt, Homo sapiens
ucugucauuguauuagc

SEQ ID NO: 34325 - RNA, 18 nt, Homo sapiens
ugacacuacauguaauuc

SEQ ID NO: 34326 - RNA, 19 nt, Homo sapiens
ugauuauauauuuauaaga

SEQ ID NO: 34327 - RNA, 21 nt, Homo sapiens
uguaaaguuaaauuggccauu

SEQ ID NO: 34328 - RNA, 23 nt, Homo sapiens
uguauugagagaguuuguguugu

SEQ ID NO: 34329 - RNA, 18 nt, Homo sapiens
uuuuuuuuuccuccuuga

SEQ ID NO: 34330 - RNA, 18 nt, Homo sapiens
acuuguuauagguuuaua

SEQ ID NO: 34331 - RNA, 18 nt, Homo sapiens
auagguuuauagguuuug

SEQ ID NO: 34332 - RNA, 17 nt, Homo sapiens
uguagaaaagagggguu

SEQ ID NO: 34333 - RNA, 21 nt, Homo sapiens
uguagaaaagagggguucccu

SEQ ID NO: 34334 - RNA, 19 nt, Homo sapiens
acaccaagcuucuucacac

SEQ ID NO: 34335 - RNA, 19 nt, Homo sapiens
cauuuccauguugaaccag

SEQ ID NO: 34336 - RNA, 18 nt, Homo sapiens
uacuugagauggauaacc

SEQ ID NO: 34337 - RNA, 25 nt, Homo sapiens
ucguggugguuauagaagugagucu

SEQ ID NO: 34338 - RNA, 18 nt, Homo sapiens
aaacacccucugggagga

SEQ ID NO: 34339 - RNA, 20 nt, Homo sapiens
gaggaaggcaggcagcgccc

SEQ ID NO: 34340 - RNA, 23 nt, Homo sapiens
cuggggcuauuggcuauccccgg

SEQ ID NO: 34341 - RNA, 16 nt, Homo sapiens
gugaagacgguggaag

SEQ ID NO: 34342 - RNA, 21 nt, Homo sapiens
gugaaugaacacccuuguuuc

SEQ ID NO: 34343 - RNA, 18 nt, Homo sapiens
ucuagaggaaaggaugaa

SEQ ID NO: 34344 - RNA, 20 nt, Homo sapiens
cauccagaccuccccugccc

SEQ ID NO: 34345 - RNA, 17 nt, Homo sapiens
cccaugcagucuggggu

SEQ ID NO: 34346 - RNA, 16 nt, Homo sapiens
gaagaaggaggccccg

SEQ ID NO: 34347 - RNA, 22 nt, Homo sapiens
ggggagggcaugggggcagggg

SEQ ID NO: 34348 - RNA, 18 nt, Homo sapiens
ugcccucucuugcuaaca

SEQ ID NO: 34349 - RNA, 18 nt, Homo sapiens
uguuugaagaaggaggcc

SEQ ID NO: 34350 - RNA, 21 nt, Homo sapiens
cgagcucgcaucgaugcuauu

SEQ ID NO: 34351 - RNA, 20 nt, Homo sapiens
ugcuauuucuuaggucuguu

SEQ ID NO: 34352 - RNA, 21 nt, Homo sapiens
aaacucacauccaaauaaugc

SEQ ID NO: 34353 - RNA, 21 nt, Homo sapiens
aacaugguuaccugugaacug

SEQ ID NO: 34354 - RNA, 19 nt, Homo sapiens
aaggguauuauggggaaac

SEQ ID NO: 34355 - RNA, 27 nt, Homo sapiens
aagggugucagaggauacaacuggaga

SEQ ID NO: 34356 - RNA, 17 nt, Homo sapiens
aaugcuguauuugacaa

SEQ ID NO: 34357 - RNA, 17 nt, Homo sapiens
aggugaaaagggagcgc

SEQ ID NO: 34358 - RNA, 20 nt, Homo sapiens
ccagcaaugagaggaagucu

SEQ ID NO: 34359 - RNA, 19 nt, Homo sapiens
ccuggcuucuucccauaca

SEQ ID NO: 34360 - RNA, 21 nt, Homo sapiens
gacggacgcaguggcggcggc

SEQ ID NO: 34361 - RNA, 22 nt, Homo sapiens
gacugguaaguacuggcacaua

SEQ ID NO: 34362 - RNA, 18 nt, Homo sapiens
gauuacaugaagagugca

SEQ ID NO: 34363 - RNA, 22 nt, Homo sapiens
gccuagaagaacacaacauggu

SEQ ID NO: 34364 - RNA, 23 nt, Homo sapiens
ggaguaagaugguaagaauucua

SEQ ID NO: 34365 - RNA, 31 nt, Homo sapiens
ggcggcuguguggcuguggcggcggcggccg

SEQ ID NO: 34366 - RNA, 18 nt, Homo sapiens
guagguuggaaaagggua

SEQ ID NO: 34367 - RNA, 15 nt, Homo sapiens
uaagugauguguugg

SEQ ID NO: 34368 - RNA, 15 nt, Homo sapiens
ucagguuacccaaac

SEQ ID NO: 34369 - RNA, 18 nt, Homo sapiens
ucaguucaccauggcuua

SEQ ID NO: 34370 - RNA, 25 nt, Homo sapiens
ucccuguguagggcucauuauuugu

SEQ ID NO: 34371 - RNA, 23 nt, Homo sapiens
ucuaugcacauaugugauuacau

SEQ ID NO: 34372 - RNA, 18 nt, Homo sapiens
ucuguccuuauaaaugug

SEQ ID NO: 34373 - RNA, 18 nt, Homo sapiens
ugagguagguuggaaaag

SEQ ID NO: 34374 - RNA, 25 nt, Homo sapiens
ugccugugcucugagaccuuggguc

SEQ ID NO: 34375 - RNA, 19 nt, Homo sapiens
uguuugggugcuauuuuug

SEQ ID NO: 34376 - RNA, 26 nt, Homo sapiens
uuaauuaggaagaaacaaaaaaugau

SEQ ID NO: 34377 - RNA, 21 nt, Homo sapiens
caggauccaaaauggcagcgc

SEQ ID NO: 34378 - RNA, 20 nt, Homo sapiens
caggguccuggcgacugcgc

SEQ ID NO: 34379 - RNA, 18 nt, Homo sapiens
gaagguggaccugucuuc

SEQ ID NO: 34380 - RNA, 19 nt, Homo sapiens
gagagcgagccguuguggc

SEQ ID NO: 34381 - RNA, 16 nt, Homo sapiens
gccggcuucccguggc

SEQ ID NO: 34382 - RNA, 16 nt, Homo sapiens
ggugcucaguaagugc

SEQ ID NO: 34383 - RNA, 16 nt, Homo sapiens
gucacccugaaguacu

SEQ ID NO: 34384 - RNA, 17 nt, Homo sapiens
ucagacaagaggugugu

SEQ ID NO: 34385 - RNA, 18 nt, Homo sapiens
ucauaugguuggugacag

SEQ ID NO: 34386 - RNA, 20 nt, Homo sapiens
ucucaggcuuaguuucccag

SEQ ID NO: 34387 - RNA, 21 nt, Homo sapiens
ugcucgggacccgggaagacg

SEQ ID NO: 34388 - RNA, 19 nt, Homo sapiens
aagugcacgggccucucgg

SEQ ID NO: 34389 - RNA, 23 nt, Homo sapiens
acucuguacaggugguuccacgc

SEQ ID NO: 34390 - RNA, 22 nt, Homo sapiens
aggcagcucggcaguuacagug

SEQ ID NO: 34391 - RNA, 15 nt, Homo sapiens
cacugacugacuccu

SEQ ID NO: 34392 - RNA, 18 nt, Homo sapiens
cagcagagucaagcaugg

SEQ ID NO: 34393 - RNA, 19 nt, Homo sapiens
cccugagucuggauuuccc

SEQ ID NO: 34394 - RNA, 19 nt, Homo sapiens
gaagugcuacacagccugg

SEQ ID NO: 34395 - RNA, 21 nt, Homo sapiens
gcgcugggcagcgccugagcc

SEQ ID NO: 34396 - RNA, 15 nt, Homo sapiens
ggaagagauuguuua

SEQ ID NO: 34397 - RNA, 17 nt, Homo sapiens
uacuccuggcucugacc

SEQ ID NO: 34398 - RNA, 18 nt, Homo sapiens
ucagggcaggcuuuggcc

SEQ ID NO: 34399 - RNA, 19 nt, Homo sapiens
uccaacaaggcucucuucu

SEQ ID NO: 34400 - RNA, 18 nt, Homo sapiens
ucccacgggggacaacau

SEQ ID NO: 34401 - RNA, 17 nt, Homo sapiens
uuaaggcuguuuuugga

SEQ ID NO: 34402 - RNA, 20 nt, Homo sapiens
uucaccacguucaaacugug

SEQ ID NO: 34403 - RNA, 20 nt, Homo sapiens
uuuauauauuuaacaauucu

SEQ ID NO: 34404 - RNA, 19 nt, Homo sapiens
uauauauauguauauauau

SEQ ID NO: 34405 - RNA, 20 nt, Homo sapiens
uauauauauguauauauaua

SEQ ID NO: 34406 - RNA, 22 nt, Homo sapiens
uauguauauauauguauauaua

SEQ ID NO: 34407 - RNA, 23 nt, Homo sapiens
uauguauauauauguauauauau

SEQ ID NO: 34408 - RNA, 25 nt, Homo sapiens
uauguauauauauguauauauauau

SEQ ID NO: 34409 - RNA, 18 nt, Homo sapiens
ccgguuccccgcgcuggc

SEQ ID NO: 34410 - RNA, 19 nt, Homo sapiens
gaaauauuaacuuucaaaa

SEQ ID NO: 34411 - RNA, 17 nt, Homo sapiens
uauuugguaguaaaaug

SEQ ID NO: 34412 - RNA, 19 nt, Homo sapiens
ucccgguuccccgcgcugg

SEQ ID NO: 34413 - RNA, 19 nt, Homo sapiens
uuucucaaauugacaauga

SEQ ID NO: 34414 - RNA, 22 nt, Homo sapiens
augaauaccgaugaauauauau

SEQ ID NO: 34415 - RNA, 19 nt, Homo sapiens
gaggagcauucugcacuuu

SEQ ID NO: 34416 - RNA, 18 nt, Homo sapiens
gcaauuauauaaguagca

SEQ ID NO: 34417 - RNA, 18 nt, Homo sapiens
guugcuuacaacauauaa

SEQ ID NO: 34418 - RNA, 18 nt, Homo sapiens
ugugcauacacacaagaa

SEQ ID NO: 34419 - RNA, 19 nt, Homo sapiens
agguaaggacccaaagggc

SEQ ID NO: 34420 - RNA, 18 nt, Homo sapiens
cggggcuccugagggcag

SEQ ID NO: 34421 - RNA, 22 nt, Homo sapiens
cugcuugagcgaaggcaguuuc

SEQ ID NO: 34422 - RNA, 19 nt, Homo sapiens
gaggaggagaggagaucua

SEQ ID NO: 34423 - RNA, 20 nt, Homo sapiens
gcggugacagggcugggaug

SEQ ID NO: 34424 - RNA, 20 nt, Homo sapiens
ggggggcaaggcgugcuugg

SEQ ID NO: 34425 - RNA, 23 nt, Homo sapiens
ucaaggcccccagggccuuugga

SEQ ID NO: 34426 - RNA, 18 nt, Homo sapiens
uccguggaggaggagagg

SEQ ID NO: 34427 - RNA, 18 nt, Homo sapiens
uggaggaggagaggagau

SEQ ID NO: 34428 - RNA, 20 nt, Homo sapiens
ugggguccgggucccccggu

SEQ ID NO: 34429 - RNA, 18 nt, Homo sapiens
agagggacuugauuucuu

SEQ ID NO: 34430 - RNA, 18 nt, Homo sapiens
ccgcggcucggacccccc

SEQ ID NO: 34431 - RNA, 18 nt, Homo sapiens
uccaucaguccuccucuu

SEQ ID NO: 34432 - RNA, 20 nt, Homo sapiens
uuauuuaaaugccaugaucc

SEQ ID NO: 34433 - RNA, 22 nt, Homo sapiens
agugcaagcccuguugugcuug

SEQ ID NO: 34434 - RNA, 19 nt, Homo sapiens
ccuuaucugcaugguucug

SEQ ID NO: 34435 - RNA, 18 nt, Homo sapiens
gcauggcugauccaggua

SEQ ID NO: 34436 - RNA, 14 nt, Homo sapiens
guuauuacaaugac

SEQ ID NO: 34437 - RNA, 18 nt, Homo sapiens
uaaggcagauuuuuaaau

SEQ ID NO: 34438 - RNA, 18 nt, Homo sapiens
uauagaaucuaaggcaga

SEQ ID NO: 34439 - RNA, 20 nt, Homo sapiens
ucuuuugauaugaaaaccac

SEQ ID NO: 34440 - RNA, 17 nt, Homo sapiens
uuaaggcucauuuugga

SEQ ID NO: 34441 - RNA, 18 nt, Homo sapiens
uccccuccucccgccccc

SEQ ID NO: 34442 - RNA, 14 nt, Homo sapiens
aagcuuugaaaagc

SEQ ID NO: 34443 - RNA, 22 nt, Homo sapiens
ugaguauauuggauuagucaca

SEQ ID NO: 34444 - RNA, 20 nt, Homo sapiens
cucugcaauccagcuaggca

SEQ ID NO: 34445 - RNA, 22 nt, Homo sapiens
cggcgccgccggggaacauggc

SEQ ID NO: 34446 - RNA, 16 nt, Homo sapiens
cggcggcuaccagagc

SEQ ID NO: 34447 - RNA, 24 nt, Homo sapiens
cuugcucacugcucuccggaggac

SEQ ID NO: 34448 - RNA, 19 nt, Homo sapiens
gagguguggaugcccucca

SEQ ID NO: 34449 - RNA, 18 nt, Homo sapiens
gaugguuccgcugccugg

SEQ ID NO: 34450 - RNA, 18 nt, Homo sapiens
gggccgggcgggguuggg

SEQ ID NO: 34451 - RNA, 18 nt, Homo sapiens
ugccuggagcucugaguu

SEQ ID NO: 34452 - RNA, 15 nt, Homo sapiens
uggagguguggaugc

SEQ ID NO: 34453 - RNA, 17 nt, Homo sapiens
uucuucagagagacugu

SEQ ID NO: 34454 - RNA, 24 nt, Homo sapiens
ccgggguccgcgaggcggaggagc

SEQ ID NO: 34455 - RNA, 22 nt, Homo sapiens
agcuguguggccacgggagcug

SEQ ID NO: 34456 - RNA, 20 nt, Homo sapiens
cccgcccugugugcacaccc

SEQ ID NO: 34457 - RNA, 17 nt, Homo sapiens
ccggccaccgcggccgg

SEQ ID NO: 34458 - RNA, 17 nt, Homo sapiens
ccugugugcacacccag

SEQ ID NO: 34459 - RNA, 22 nt, Homo sapiens
cgcucccuccgccuccuucucc

SEQ ID NO: 34460 - RNA, 16 nt, Homo sapiens
cugccccucagucugc

SEQ ID NO: 34461 - RNA, 18 nt, Homo sapiens
cugcgcccucgcacugcc

SEQ ID NO: 34462 - RNA, 21 nt, Homo sapiens
gaggaugcuggcaggggacgc

SEQ ID NO: 34463 - RNA, 18 nt, Homo sapiens
gcaucccaggcgcggggc

SEQ ID NO: 34464 - RNA, 22 nt, Homo sapiens
gccgcgccggccaccgcggccg

SEQ ID NO: 34465 - RNA, 18 nt, Homo sapiens
gcgcggggcguggggcgc

SEQ ID NO: 34466 - RNA, 18 nt, Homo sapiens
gcguggggcgcgagcugc

SEQ ID NO: 34467 - RNA, 20 nt, Homo sapiens
ggacgugggugucgggaguc

SEQ ID NO: 34468 - RNA, 21 nt, Homo sapiens
gggcaggccgcgccggccacc

SEQ ID NO: 34469 - RNA, 15 nt, Homo sapiens
uggggcccugcaacc

SEQ ID NO: 34470 - RNA, 19 nt, Homo sapiens
acaugcugguacuuuuuag

SEQ ID NO: 34471 - RNA, 16 nt, Homo sapiens
agugguugacacaagu

SEQ ID NO: 34472 - RNA, 19 nt, Homo sapiens
ccccggcgcggcgacggcg

SEQ ID NO: 34473 - RNA, 22 nt, Homo sapiens
uaccauaagugcggucgacugc

SEQ ID NO: 34474 - RNA, 21 nt, Homo sapiens
cagcaggcugccagguuucuc

SEQ ID NO: 34475 - RNA, 18 nt, Homo sapiens
cagggccucuacagcacc

SEQ ID NO: 34476 - RNA, 21 nt, Homo sapiens
caugucagugaguucaauguu

SEQ ID NO: 34477 - RNA, 17 nt, Homo sapiens
cgcauuccagucucugu

SEQ ID NO: 34478 - RNA, 22 nt, Homo sapiens
gcauggcuggaagccaagggua

SEQ ID NO: 34479 - RNA, 22 nt, Homo sapiens
ggaguagauguguggccaagca

SEQ ID NO: 34480 - RNA, 18 nt, Homo sapiens
ggagugaaggccuucagg

SEQ ID NO: 34481 - RNA, 20 nt, Homo sapiens
gucucaggcugacgcauucc

SEQ ID NO: 34482 - RNA, 30 nt, Homo sapiens
uagugcuguuuauacauucaagccuauagg

SEQ ID NO: 34483 - RNA, 19 nt, Homo sapiens
ucccucagauugauucugc

SEQ ID NO: 34484 - RNA, 18 nt, Homo sapiens
uuauuuuuuaaaaaccaa

SEQ ID NO: 34485 - RNA, 22 nt, Homo sapiens
accaagaagucuguacaccaaa

SEQ ID NO: 34486 - RNA, 20 nt, Homo sapiens
augugguaacuagaaggccu

SEQ ID NO: 34487 - RNA, 17 nt, Homo sapiens
cccuuguaauauauaug

SEQ ID NO: 34488 - RNA, 19 nt, Homo sapiens
ccgcauccaacuuguuuug

SEQ ID NO: 34489 - RNA, 16 nt, Homo sapiens
cuccccuucccacccc

SEQ ID NO: 34490 - RNA, 19 nt, Homo sapiens
cuuguuuuguuagaacucc

SEQ ID NO: 34491 - RNA, 18 nt, Homo sapiens
gcucaacacaaguuguga

SEQ ID NO: 34492 - RNA, 17 nt, Homo sapiens
gugguaacuagaaggcc

SEQ ID NO: 34493 - RNA, 20 nt, Homo sapiens
ugacagcuguuggaggauca

SEQ ID NO: 34494 - RNA, 25 nt, Homo sapiens
ugagggugcugaagacagaggugac

SEQ ID NO: 34495 - RNA, 18 nt, Homo sapiens
ugcuuguugggaggaagc

SEQ ID NO: 34496 - RNA, 15 nt, Homo sapiens
uggcagagauugggc

SEQ ID NO: 34497 - RNA, 21 nt, Homo sapiens
gagcaugauucuacuaauuuc

SEQ ID NO: 34498 - RNA, 18 nt, Homo sapiens
ucacagcucacugcagcc

SEQ ID NO: 34499 - RNA, 16 nt, Homo sapiens
uguaauucauacccuu

SEQ ID NO: 34500 - RNA, 19 nt, Homo sapiens
agaggaaacaggacgucac

SEQ ID NO: 34501 - RNA, 24 nt, Homo sapiens
uagagccagggcacaaaacucuuu

SEQ ID NO: 34502 - RNA, 18 nt, Homo sapiens
uagaugacauugaaaaau

SEQ ID NO: 34503 - RNA, 16 nt, Homo sapiens
uauuuuuacucuuucc

SEQ ID NO: 34504 - RNA, 19 nt, Homo sapiens
uccaacuauuacucuucag

SEQ ID NO: 34505 - RNA, 19 nt, Homo sapiens
ccacucucccccagugucc

SEQ ID NO: 34506 - RNA, 24 nt, Homo sapiens
aagcggaagaagccgcuggaugga

SEQ ID NO: 34507 - RNA, 27 nt, Homo sapiens
agagaaugaagcggaagaagccgcugg

SEQ ID NO: 34508 - RNA, 16 nt, Homo sapiens
uggauggaggacagag

SEQ ID NO: 34509 - RNA, 18 nt, Homo sapiens
uggugcgggcggcgcggc

SEQ ID NO: 34510 - RNA, 23 nt, Homo sapiens
ugaacacagagaaucacaaauaa

SEQ ID NO: 34511 - RNA, 24 nt, Homo sapiens
cccgggcuggcggccacugcgucc

SEQ ID NO: 34512 - RNA, 20 nt, Homo sapiens
ggaagggaggggacgggggc

SEQ ID NO: 34513 - RNA, 20 nt, Homo sapiens
ugucuggcugucccacugcu

SEQ ID NO: 34514 - RNA, 20 nt, Homo sapiens
acaggugcacaccaccacgc

SEQ ID NO: 34515 - RNA, 19 nt, Homo sapiens
aggagauuucucagcagug

SEQ ID NO: 34516 - RNA, 22 nt, Homo sapiens
aggugugagccaccaugccggg

SEQ ID NO: 34517 - RNA, 22 nt, Homo sapiens
auguucaucuuacgugccagac

SEQ ID NO: 34518 - RNA, 20 nt, Homo sapiens
cagugaauucuucugauugu

SEQ ID NO: 34519 - RNA, 21 nt, Homo sapiens
cauucuugcccaacaagcauu

SEQ ID NO: 34520 - RNA, 20 nt, Homo sapiens
gccggagugcaguggugcca

SEQ ID NO: 34521 - RNA, 16 nt, Homo sapiens
gccuuggccucucgag

SEQ ID NO: 34522 - RNA, 24 nt, Homo sapiens
cagggccuugcucccaggauggua

SEQ ID NO: 34523 - RNA, 18 nt, Homo sapiens
cgcguccagcacaugccc

SEQ ID NO: 34524 - RNA, 16 nt, Homo sapiens
gggccugugagugggg

SEQ ID NO: 34525 - RNA, 18 nt, Homo sapiens
ucauguguccgcguccag

SEQ ID NO: 34526 - RNA, 19 nt, Homo sapiens
ugagcugaaugugaacugu

SEQ ID NO: 34527 - RNA, 21 nt, Homo sapiens
caaaagcuuuuuuuuuuuuag

SEQ ID NO: 34528 - RNA, 14 nt, Homo sapiens
ggaucagcucaccu

SEQ ID NO: 34529 - RNA, 22 nt, Homo sapiens
ucuguguaucaccuucugcuca

SEQ ID NO: 34530 - RNA, 24 nt, Homo sapiens
ugaaaauaauacagaaacagccug

SEQ ID NO: 34531 - RNA, 15 nt, Homo sapiens
ugcuguggcugggga

SEQ ID NO: 34532 - RNA, 18 nt, Homo sapiens
agucagcucugaacgaaa

SEQ ID NO: 34533 - RNA, 17 nt, Homo sapiens
gaaaucauccauuuccu

SEQ ID NO: 34534 - RNA, 24 nt, Homo sapiens
gaugaugaggaaaaaugugguugu

SEQ ID NO: 34535 - RNA, 18 nt, Homo sapiens
uacccuaccaaaauucag

SEQ ID NO: 34536 - RNA, 18 nt, Homo sapiens
ugaggaaaaaugugguug

SEQ ID NO: 34537 - RNA, 23 nt, Homo sapiens
uguuaucccuucuacauuucuaa

SEQ ID NO: 34538 - RNA, 18 nt, Homo sapiens
aggagcgcaggaggccgg

SEQ ID NO: 34539 - RNA, 27 nt, Homo sapiens
aggcgcgggcaggcugggggugggggg

SEQ ID NO: 34540 - RNA, 18 nt, Homo sapiens
caaagcagaguuuuauaa

SEQ ID NO: 34541 - RNA, 17 nt, Homo sapiens
cuguucuguuuuggggg

SEQ ID NO: 34542 - RNA, 21 nt, Homo sapiens
gagggucccggcggcaggagc

SEQ ID NO: 34543 - RNA, 16 nt, Homo sapiens
gcgcggggcugccagc

SEQ ID NO: 34544 - RNA, 19 nt, Homo sapiens
ggcgaggagcugggggcgg

SEQ ID NO: 34545 - RNA, 27 nt, Homo sapiens
gggaggcgcgggcaggcuggggguggg

SEQ ID NO: 34546 - RNA, 20 nt, Homo sapiens
gggcgaggagcugggggcgg

SEQ ID NO: 34547 - RNA, 18 nt, Homo sapiens
ggggguggggggauuggg

SEQ ID NO: 34548 - RNA, 21 nt, Homo sapiens
ggggguguggggguaggggcu

SEQ ID NO: 34549 - RNA, 18 nt, Homo sapiens
gggguggggggauugggu

SEQ ID NO: 34550 - RNA, 19 nt, Homo sapiens
ggguggggggauugggugu

SEQ ID NO: 34551 - RNA, 20 nt, Homo sapiens
ugccccaacuccuuucuucc

SEQ ID NO: 34552 - RNA, 21 nt, Homo sapiens
uggggguggggggauugggug

SEQ ID NO: 34553 - RNA, 17 nt, Homo sapiens
cacgagcugggcaggcg

SEQ ID NO: 34554 - RNA, 16 nt, Homo sapiens
cugagcugcugugacc

SEQ ID NO: 34555 - RNA, 15 nt, Homo sapiens
gacuguuacuggugg

SEQ ID NO: 34556 - RNA, 20 nt, Homo sapiens
ucagccggcugcucgggcag

SEQ ID NO: 34557 - RNA, 15 nt, Homo sapiens
ugacuguuacuggug

SEQ ID NO: 34558 - RNA, 20 nt, Homo sapiens
aggaaguguggaaucaucac

SEQ ID NO: 34559 - RNA, 20 nt, Homo sapiens
cccgcucacuaagagcauca

SEQ ID NO: 34560 - RNA, 19 nt, Homo sapiens
ccgcgcccgccccgcgccc

SEQ ID NO: 34561 - RNA, 16 nt, Homo sapiens
gagacacaaagggaga

SEQ ID NO: 34562 - RNA, 19 nt, Homo sapiens
gagcagcagaugaagggcc

SEQ ID NO: 34563 - RNA, 19 nt, Homo sapiens
gaggagcaguucauucuuu

SEQ ID NO: 34564 - RNA, 22 nt, Homo sapiens
ggaaguccgggccgucguccag

SEQ ID NO: 34565 - RNA, 20 nt, Homo sapiens
gggccgucguccaggccuuc

SEQ ID NO: 34566 - RNA, 20 nt, Homo sapiens
uacuugguuuagucuacaag

SEQ ID NO: 34567 - RNA, 17 nt, Homo sapiens
ugcuuuucuucagaaau

SEQ ID NO: 34568 - RNA, 21 nt, Homo sapiens
uucugcuuuucuuuccccaca

SEQ ID NO: 34569 - RNA, 20 nt, Homo sapiens
auuacacaagcuacaguuaa

SEQ ID NO: 34570 - RNA, 21 nt, Homo sapiens
caaauaacuuauuuggggggu

SEQ ID NO: 34571 - RNA, 21 nt, Homo sapiens
ccgcccgggugcgccucuccg

SEQ ID NO: 34572 - RNA, 23 nt, Homo sapiens
ccgcccgggugcgccucuccgga

SEQ ID NO: 34573 - RNA, 18 nt, Homo sapiens
cggggucgaugaguggga

SEQ ID NO: 34574 - RNA, 18 nt, Homo sapiens
gagauggaauuucccaga

SEQ ID NO: 34575 - RNA, 25 nt, Homo sapiens
uaucacaggauuaaaacuccaguua

SEQ ID NO: 34576 - RNA, 27 nt, Homo sapiens
gugcagggguuucuguuuccuccucug

SEQ ID NO: 34577 - RNA, 21 nt, Homo sapiens
uguuucuggaaaagccucucc

SEQ ID NO: 34578 - RNA, 20 nt, Homo sapiens
aggcgcuggaagcucagcca

SEQ ID NO: 34579 - RNA, 16 nt, Homo sapiens
aggcuacuggggauga

SEQ ID NO: 34580 - RNA, 21 nt, Homo sapiens
cagugaagggacugggcaggc

SEQ ID NO: 34581 - RNA, 22 nt, Homo sapiens
cccagcccugccccaucaccuc

SEQ ID NO: 34582 - RNA, 18 nt, Homo sapiens
cccccgcccccuccaggc

SEQ ID NO: 34583 - RNA, 18 nt, Homo sapiens
cccgugccuccgcccggc

SEQ ID NO: 34584 - RNA, 17 nt, Homo sapiens
gaaugagggaaagggaa

SEQ ID NO: 34585 - RNA, 18 nt, Homo sapiens
gccacggcccccgccccc

SEQ ID NO: 34586 - RNA, 27 nt, Homo sapiens
gccgggcggggucgccugggcgcuucc

SEQ ID NO: 34587 - RNA, 23 nt, Homo sapiens
ggagccugggcuacaacagauac

SEQ ID NO: 34588 - RNA, 24 nt, Homo sapiens
ugaaugagggaaagggaaugccgc

SEQ ID NO: 34589 - RNA, 18 nt, Homo sapiens
accgcccgcucgcccgcc

SEQ ID NO: 34590 - RNA, 18 nt, Homo sapiens
aggaggaggaggaggugg

SEQ ID NO: 34591 - RNA, 19 nt, Homo sapiens
aggcggaggcugcgcggcc

SEQ ID NO: 34592 - RNA, 19 nt, Homo sapiens
cacgcagcagggcaggucg

SEQ ID NO: 34593 - RNA, 17 nt, Homo sapiens
cagggguccuggggggc

SEQ ID NO: 34594 - RNA, 18 nt, Homo sapiens
cccggcucgggcgcucag

SEQ ID NO: 34595 - RNA, 17 nt, Homo sapiens
cccuggcccgcuugcgc

SEQ ID NO: 34596 - RNA, 21 nt, Homo sapiens
ccuagaggagcagaguuggag

SEQ ID NO: 34597 - RNA, 22 nt, Homo sapiens
ccuggucuccugggggucccgg

SEQ ID NO: 34598 - RNA, 21 nt, Homo sapiens
cgcgcaggcggcaggggcccg

SEQ ID NO: 34599 - RNA, 20 nt, Homo sapiens
cgcgcgcaggcggcaggggc

SEQ ID NO: 34600 - RNA, 21 nt, Homo sapiens
cggcucccggggcggccgcgu

SEQ ID NO: 34601 - RNA, 17 nt, Homo sapiens
cggggccgguguccccg

SEQ ID NO: 34602 - RNA, 20 nt, Homo sapiens
cgggguccgcgcccgcgccc

SEQ ID NO: 34603 - RNA, 17 nt, Homo sapiens
cgugguugagcgccggc

SEQ ID NO: 34604 - RNA, 21 nt, Homo sapiens
cgugguugagcgccggcggcc

SEQ ID NO: 34605 - RNA, 19 nt, Homo sapiens
cugagggcggggccggugu

SEQ ID NO: 34606 - RNA, 20 nt, Homo sapiens
gcccgcucgcccgccgugcc

SEQ ID NO: 34607 - RNA, 18 nt, Homo sapiens
gcggcgguggcaucuucc

SEQ ID NO: 34608 - RNA, 18 nt, Homo sapiens
gcgucgcgccgcggccgg

SEQ ID NO: 34609 - RNA, 18 nt, Homo sapiens
ggaggggguggaggggcg

SEQ ID NO: 34610 - RNA, 21 nt, Homo sapiens
ggaggugguggccgcagggac

SEQ ID NO: 34611 - RNA, 18 nt, Homo sapiens
gggcacgggggcgcgggu

SEQ ID NO: 34612 - RNA, 24 nt, Homo sapiens
ggggcggggucccaggggaggugg

SEQ ID NO: 34613 - RNA, 17 nt, Homo sapiens
gggggcacgggggcgcg

SEQ ID NO: 34614 - RNA, 22 nt, Homo sapiens
ggguggggccggguccacgggg

SEQ ID NO: 34615 - RNA, 17 nt, Homo sapiens
guccucauacugccgca

SEQ ID NO: 34616 - RNA, 20 nt, Homo sapiens
guggcaucuuccucccaggc

SEQ ID NO: 34617 - RNA, 21 nt, Homo sapiens
ucagggcaaugccccgcggcc

SEQ ID NO: 34618 - RNA, 18 nt, Homo sapiens
uccacguggcacgguugc

SEQ ID NO: 34619 - RNA, 19 nt, Homo sapiens
ugcgcaggguccgcggcgg

SEQ ID NO: 34620 - RNA, 20 nt, Homo sapiens
uggccgcagggaccuugcug

SEQ ID NO: 34621 - RNA, 17 nt, Homo sapiens
uuggaggggguggaggg

SEQ ID NO: 34622 - RNA, 18 nt, Homo sapiens
aguacuagugccugcaca

SEQ ID NO: 34623 - RNA, 25 nt, Homo sapiens
ucguggugguuauagaagugagucu

SEQ ID NO: 34624 - RNA, 18 nt, Homo sapiens
agacggggugggggugcg

SEQ ID NO: 34625 - RNA, 18 nt, Homo sapiens
cccccggccgcugcaucc

SEQ ID NO: 34626 - RNA, 22 nt, Homo sapiens
gcaggggccgggcgggcggccg

SEQ ID NO: 34627 - RNA, 18 nt, Homo sapiens
ucccagguuagagcccag

SEQ ID NO: 34628 - RNA, 21 nt, Homo sapiens
uccgcggcccacucgugcgcc

SEQ ID NO: 34629 - RNA, 18 nt, Homo sapiens
ugggaccugggucuggcu

SEQ ID NO: 34630 - RNA, 19 nt, Homo sapiens
aggcggagcggggcgcucg

SEQ ID NO: 34631 - RNA, 21 nt, Homo sapiens
ccagaccugggcagaucugcc

SEQ ID NO: 34632 - RNA, 22 nt, Homo sapiens
ccccaccagccccgccgccgcc

SEQ ID NO: 34633 - RNA, 17 nt, Homo sapiens
cgcaggaagggagggcc

SEQ ID NO: 34634 - RNA, 18 nt, Homo sapiens
gcccgucucagcggcggc

SEQ ID NO: 34635 - RNA, 18 nt, Homo sapiens
gcgaggcgcgggcgcugc

SEQ ID NO: 34636 - RNA, 19 nt, Homo sapiens
gcgaggcgcgggcgcugcu

SEQ ID NO: 34637 - RNA, 16 nt, Homo sapiens
gcgcggggcggggcgc

SEQ ID NO: 34638 - RNA, 21 nt, Homo sapiens
gcggggcccgucucagcggcg

SEQ ID NO: 34639 - RNA, 19 nt, Homo sapiens
gcuuggggcgcccucgggu

SEQ ID NO: 34640 - RNA, 18 nt, Homo sapiens
gggagggccggggggagg

SEQ ID NO: 34641 - RNA, 17 nt, Homo sapiens
gggcgcgggcugcgcgc

SEQ ID NO: 34642 - RNA, 24 nt, Homo sapiens
ucuggccacggcccgcgcgcuccu

SEQ ID NO: 34643 - RNA, 19 nt, Homo sapiens
ugaggccagccuggggcuc

SEQ ID NO: 34644 - RNA, 18 nt, Homo sapiens
ccccggucccgcggcgac

SEQ ID NO: 34645 - RNA, 15 nt, Homo sapiens
gugaagucuccuccc

SEQ ID NO: 34646 - RNA, 19 nt, Homo sapiens
cgaggcugcuacaaucagc

SEQ ID NO: 34647 - RNA, 21 nt, Homo sapiens
ggagguggggcaguuuagagg

SEQ ID NO: 34648 - RNA, 22 nt, Homo sapiens
uggagcugggugcacagcaggc

SEQ ID NO: 34649 - RNA, 26 nt, Homo sapiens
uggcccugacagaucagggaggaggg

SEQ ID NO: 34650 - RNA, 24 nt, Homo sapiens
aggcguuggcgaugccaccugggg

SEQ ID NO: 34651 - RNA, 26 nt, Homo sapiens
gggaagaaggggaggcgccagaggca

SEQ ID NO: 34652 - RNA, 15 nt, Homo sapiens
acggugggugccagg

SEQ ID NO: 34653 - RNA, 15 nt, Homo sapiens
ccagagagauaagac

SEQ ID NO: 34654 - RNA, 21 nt, Homo sapiens
cuccgucucccccgugggugg

SEQ ID NO: 34655 - RNA, 14 nt, Homo sapiens
gccggggcaggugc

SEQ ID NO: 34656 - RNA, 18 nt, Homo sapiens
ggccgagacggugggugc

SEQ ID NO: 34657 - RNA, 24 nt, Homo sapiens
gggugccaggcuuggagggaggag

SEQ ID NO: 34658 - RNA, 21 nt, Homo sapiens
ggguggggacgugggcagggg

SEQ ID NO: 34659 - RNA, 18 nt, Homo sapiens
ggguguggucauccuugg

SEQ ID NO: 34660 - RNA, 26 nt, Homo sapiens
uccacauagcucaggucagagccguc

SEQ ID NO: 34661 - RNA, 15 nt, Homo sapiens
ucucagcugccuggu

SEQ ID NO: 34662 - RNA, 22 nt, Homo sapiens
ugcaaggaggggccauccaggc

SEQ ID NO: 34663 - RNA, 21 nt, Homo sapiens
ugcccuggccccagcaccccc

SEQ ID NO: 34664 - RNA, 18 nt, Homo sapiens
agaguuuucacucauuuu

SEQ ID NO: 34665 - RNA, 19 nt, Homo sapiens
cccccgccgccggggcacc

SEQ ID NO: 34666 - RNA, 22 nt, Homo sapiens
cgacagcggcgaggaggugcgg

SEQ ID NO: 34667 - RNA, 19 nt, Homo sapiens
gcgcagcuguugcaccgga

SEQ ID NO: 34668 - RNA, 16 nt, Homo sapiens
gcucucgcggcgcgcc

SEQ ID NO: 34669 - RNA, 18 nt, Homo sapiens
ggagcagcagggacaggu

SEQ ID NO: 34670 - RNA, 19 nt, Homo sapiens
ggguccggaaggcgccgcc

SEQ ID NO: 34671 - RNA, 21 nt, Homo sapiens
uggugcugguggugcgccggg

SEQ ID NO: 34672 - RNA, 18 nt, Homo sapiens
aaaacuguuguccuugcg

SEQ ID NO: 34673 - RNA, 22 nt, Homo sapiens
accugccuuccaggcacugauc

SEQ ID NO: 34674 - RNA, 17 nt, Homo sapiens
agggcugcugggagagc

SEQ ID NO: 34675 - RNA, 22 nt, Homo sapiens
cagcaccccaaagcuuggcggc

SEQ ID NO: 34676 - RNA, 15 nt, Homo sapiens
ccgggcagaggcgga

SEQ ID NO: 34677 - RNA, 19 nt, Homo sapiens
ccuccccagccuucucucc

SEQ ID NO: 34678 - RNA, 18 nt, Homo sapiens
cugccuguguuaacaaac

SEQ ID NO: 34679 - RNA, 17 nt, Homo sapiens
gcccuugaguaggagcc

SEQ ID NO: 34680 - RNA, 15 nt, Homo sapiens
ggcggcucugcccga

SEQ ID NO: 34681 - RNA, 15 nt, Homo sapiens
ggggagggggagggg

SEQ ID NO: 34682 - RNA, 19 nt, Homo sapiens
uaacucaacuucccugucc

SEQ ID NO: 34683 - RNA, 17 nt, Homo sapiens
ucuguggccacacccag

SEQ ID NO: 34684 - RNA, 15 nt, Homo sapiens
ugagcccugggacuc

SEQ ID NO: 34685 - RNA, 18 nt, Homo sapiens
ugcagggaggaugugacu

SEQ ID NO: 34686 - RNA, 19 nt, Homo sapiens
cccuucagaagauuuguag

SEQ ID NO: 34687 - RNA, 19 nt, Homo sapiens
cuaugugucaggcacugug

SEQ ID NO: 34688 - RNA, 19 nt, Homo sapiens
gagucuuacacuugggaag

SEQ ID NO: 34689 - RNA, 18 nt, Homo sapiens
gagugaugagaaucuuuu

SEQ ID NO: 34690 - RNA, 15 nt, Homo sapiens
gauaugacugccuuc

SEQ ID NO: 34691 - RNA, 19 nt, Homo sapiens
gauuacaggcaugugccac

SEQ ID NO: 34692 - RNA, 19 nt, Homo sapiens
guaguuuuuaauggcccac

SEQ ID NO: 34693 - RNA, 21 nt, Homo sapiens
uaaauugaauuguagcucugu

SEQ ID NO: 34694 - RNA, 18 nt, Homo sapiens
ucuauuaauaucuuuuua

SEQ ID NO: 34695 - RNA, 15 nt, Homo sapiens
uggcuuacuaauugc

SEQ ID NO: 34696 - RNA, 19 nt, Homo sapiens
uuagaguucugguauuacc

SEQ ID NO: 34697 - RNA, 19 nt, Homo sapiens
caagguaagugcuuugugu

SEQ ID NO: 34698 - RNA, 16 nt, Homo sapiens
ucuagaugaagaggaa

SEQ ID NO: 34699 - RNA, 21 nt, Homo sapiens
acaauuguccuuguaugcuaa

SEQ ID NO: 34700 - RNA, 23 nt, Homo sapiens
ugccuuagcccugcaugcucauu

SEQ ID NO: 34701 - RNA, 17 nt, Homo sapiens
aaggucuugggguggcc

SEQ ID NO: 34702 - RNA, 17 nt, Homo sapiens
ggccagaggcucaucuu

SEQ ID NO: 34703 - RNA, 21 nt, Homo sapiens
gggccaggggaggguuguggg

SEQ ID NO: 34704 - RNA, 18 nt, Homo sapiens
ggggaggguuguggggga

SEQ ID NO: 34705 - RNA, 20 nt, Homo sapiens
ugauggggagaaacggggca

SEQ ID NO: 34706 - RNA, 19 nt, Homo sapiens
ugguuugcuuuuccuuuuc

SEQ ID NO: 34707 - RNA, 16 nt, Homo sapiens
uucccugggacagagg

SEQ ID NO: 34708 - RNA, 20 nt, Homo sapiens
uucccugggacagagggcuc

SEQ ID NO: 34709 - RNA, 21 nt, Homo sapiens
accccgcuuggggcagcuggc

SEQ ID NO: 34710 - RNA, 17 nt, Homo sapiens
uggugucccagcugggu

SEQ ID NO: 34711 - RNA, 23 nt, Homo sapiens
aagcugcgacugcggcaauggcc

SEQ ID NO: 34712 - RNA, 19 nt, Homo sapiens
agggccgggggcccauugg

SEQ ID NO: 34713 - RNA, 23 nt, Homo sapiens
aggggcggggagaggggacaaag

SEQ ID NO: 34714 - RNA, 16 nt, Homo sapiens
cucccggcuuucugag

SEQ ID NO: 34715 - RNA, 18 nt, Homo sapiens
cugauaccauguagaagg

SEQ ID NO: 34716 - RNA, 14 nt, Homo sapiens
gagaagaaugacgu

SEQ ID NO: 34717 - RNA, 21 nt, Homo sapiens
ggcagccucagggcaggcggc

SEQ ID NO: 34718 - RNA, 15 nt, Homo sapiens
ggcgggccagccugg

SEQ ID NO: 34719 - RNA, 17 nt, Homo sapiens
ggggcggggagagggga

SEQ ID NO: 34720 - RNA, 18 nt, Homo sapiens
gugaugccaagauccucu

SEQ ID NO: 34721 - RNA, 16 nt, Homo sapiens
uaagcuugggacagcu

SEQ ID NO: 34722 - RNA, 17 nt, Homo sapiens
ugccuuugcauggggcc

SEQ ID NO: 34723 - RNA, 21 nt, Homo sapiens
aaaaaaaaaaaaaaaggcauu

SEQ ID NO: 34724 - RNA, 23 nt, Homo sapiens
augguguuuauauaaauauauau

SEQ ID NO: 34725 - RNA, 17 nt, Homo sapiens
ccucguuccucuaaguu

SEQ ID NO: 34726 - RNA, 20 nt, Homo sapiens
ccuucugaaagcuugaaacu

SEQ ID NO: 34727 - RNA, 14 nt, Homo sapiens
cgugguuagcgagc

SEQ ID NO: 34728 - RNA, 19 nt, Homo sapiens
cuugaacauuuacaaaaua

SEQ ID NO: 34729 - RNA, 17 nt, Homo sapiens
gaggacgcagucagagc

SEQ ID NO: 34730 - RNA, 22 nt, Homo sapiens
gguggaaagaaguuuccaaaca

SEQ ID NO: 34731 - RNA, 15 nt, Homo sapiens
guuguguuuauucug

SEQ ID NO: 34732 - RNA, 18 nt, Homo sapiens
uauauaaauauauauaua

SEQ ID NO: 34733 - RNA, 19 nt, Homo sapiens
uauauaaauauauauauau

SEQ ID NO: 34734 - RNA, 25 nt, Homo sapiens
uauauaaauauauauauauuuuaga

SEQ ID NO: 34735 - RNA, 18 nt, Homo sapiens
ucgaauccagcuuuugau

SEQ ID NO: 34736 - RNA, 20 nt, Homo sapiens
ucucuuuccaaugaauacua

SEQ ID NO: 34737 - RNA, 20 nt, Homo sapiens
ucuuccgcuagucaaaacuc

SEQ ID NO: 34738 - RNA, 19 nt, Homo sapiens
ugacauguguacuguuugu

SEQ ID NO: 34739 - RNA, 18 nt, Homo sapiens
ugagaguaaaauuguaga

SEQ ID NO: 34740 - RNA, 23 nt, Homo sapiens
agaugaaaagaaaaagacaccca

SEQ ID NO: 34741 - RNA, 14 nt, Homo sapiens
uacagauuuuaacu

SEQ ID NO: 34742 - RNA, 20 nt, Homo sapiens
cucacaaaaguuuuuuuuuu

SEQ ID NO: 34743 - RNA, 17 nt, Homo sapiens
gguguuggggugggggu

SEQ ID NO: 34744 - RNA, 19 nt, Homo sapiens
uggggguguuggggugggg

SEQ ID NO: 34745 - RNA, 20 nt, Homo sapiens
ccuaauucucagcuuauaug

SEQ ID NO: 34746 - RNA, 18 nt, Homo sapiens
guuuuaaaugccuuuuua

SEQ ID NO: 34747 - RNA, 20 nt, Homo sapiens
aaaggagaaaagaaaaggaa

SEQ ID NO: 34748 - RNA, 19 nt, Homo sapiens
uaacuuuguucuuaauugc

SEQ ID NO: 34749 - RNA, 16 nt, Homo sapiens
aacugaagaggggugc

SEQ ID NO: 34750 - RNA, 18 nt, Homo sapiens
auuugcccccaggauugg

SEQ ID NO: 34751 - RNA, 17 nt, Homo sapiens
ucagacauuuguacacu

SEQ ID NO: 34752 - RNA, 19 nt, Homo sapiens
acguuuauugagggucugc

SEQ ID NO: 34753 - RNA, 22 nt, Homo sapiens
cccgcccgccucggcucuggcc

SEQ ID NO: 34754 - RNA, 20 nt, Homo sapiens
gaggcagacgcuggagggcu

SEQ ID NO: 34755 - RNA, 18 nt, Homo sapiens
gaggggaggcgacuuggc

SEQ ID NO: 34756 - RNA, 23 nt, Homo sapiens
guguuuaauaaauaucucuuggg

SEQ ID NO: 34757 - RNA, 23 nt, Homo sapiens
uccaugagugccacggggggugg

SEQ ID NO: 34758 - RNA, 19 nt, Homo sapiens
agucaaggguaagaaaaca

SEQ ID NO: 34759 - RNA, 18 nt, Homo sapiens
cagcauaggggacagucu

SEQ ID NO: 34760 - RNA, 17 nt, Homo sapiens
cggaaacaagaggcaca

SEQ ID NO: 34761 - RNA, 18 nt, Homo sapiens
uauaauacaaucuacucu

SEQ ID NO: 34762 - RNA, 19 nt, Homo sapiens
ugagugucugcuuugugcu

SEQ ID NO: 34763 - RNA, 20 nt, Homo sapiens
ugcucagcacugcucaaaca

SEQ ID NO: 34764 - RNA, 18 nt, Homo sapiens
uuuacauacaacaaaauc

SEQ ID NO: 34765 - RNA, 22 nt, Homo sapiens
aaaaacaaaaacccagaggcag

SEQ ID NO: 34766 - RNA, 14 nt, Homo sapiens
aaaauuaucaucag

SEQ ID NO: 34767 - RNA, 19 nt, Homo sapiens
aagaagaggagaggucacu

SEQ ID NO: 34768 - RNA, 19 nt, Homo sapiens
agaaagcaugcuuucuucu

SEQ ID NO: 34769 - RNA, 19 nt, Homo sapiens
agaggaauguuggaaccug

SEQ ID NO: 34770 - RNA, 18 nt, Homo sapiens
agaggcagguuuuaaaag

SEQ ID NO: 34771 - RNA, 21 nt, Homo sapiens
agaggugcacuugcaucagac

SEQ ID NO: 34772 - RNA, 23 nt, Homo sapiens
aggggcgaggggaggccgggggg

SEQ ID NO: 34773 - RNA, 20 nt, Homo sapiens
aggggugggugggaggaagg

SEQ ID NO: 34774 - RNA, 17 nt, Homo sapiens
aguaggccaagaaauuc

SEQ ID NO: 34775 - RNA, 17 nt, Homo sapiens
auauauaauauguacag

SEQ ID NO: 34776 - RNA, 19 nt, Homo sapiens
auauauauauauauauaua

SEQ ID NO: 34777 - RNA, 20 nt, Homo sapiens
auauauauauauauauauau

SEQ ID NO: 34778 - RNA, 27 nt, Homo sapiens
auauauauauauuuuuuauauauauau

SEQ ID NO: 34779 - RNA, 24 nt, Homo sapiens
auauggauauauauauauauauau

SEQ ID NO: 34780 - RNA, 16 nt, Homo sapiens
cagcccccucccggca

SEQ ID NO: 34781 - RNA, 18 nt, Homo sapiens
cagcccccucccggcagc

SEQ ID NO: 34782 - RNA, 19 nt, Homo sapiens
caguggcugguuggccccg

SEQ ID NO: 34783 - RNA, 24 nt, Homo sapiens
cauauggauauauauauauauaua

SEQ ID NO: 34784 - RNA, 26 nt, Homo sapiens
cauauggauauauauauauauauaua

SEQ ID NO: 34785 - RNA, 17 nt, Homo sapiens
ccccacugcccaccacc

SEQ ID NO: 34786 - RNA, 20 nt, Homo sapiens
cguggcuggggccaacacgg

SEQ ID NO: 34787 - RNA, 21 nt, Homo sapiens
gaaggggcgaggggaggccgg

SEQ ID NO: 34788 - RNA, 20 nt, Homo sapiens
gaggcaugcaggacuuuugc

SEQ ID NO: 34789 - RNA, 22 nt, Homo sapiens
gcagaaguuagguugggggaag

SEQ ID NO: 34790 - RNA, 19 nt, Homo sapiens
gcccccucccggcagccgg

SEQ ID NO: 34791 - RNA, 17 nt, Homo sapiens
gccugggcaggaaagcc

SEQ ID NO: 34792 - RNA, 19 nt, Homo sapiens
gcgaggggaggccgggggg

SEQ ID NO: 34793 - RNA, 19 nt, Homo sapiens
gcggcgggagugggcaggc

SEQ ID NO: 34794 - RNA, 18 nt, Homo sapiens
ggcuggaguggcccucgg

SEQ ID NO: 34795 - RNA, 21 nt, Homo sapiens
gggaaggggacagggaggguu

SEQ ID NO: 34796 - RNA, 18 nt, Homo sapiens
gguggcgagggcggcggc

SEQ ID NO: 34797 - RNA, 20 nt, Homo sapiens
guucuuuuuuuaaaagaaga

SEQ ID NO: 34798 - RNA, 20 nt, Homo sapiens
uauacaguauacuugaguua

SEQ ID NO: 34799 - RNA, 30 nt, Homo sapiens
uauauauauauauauauuuuuuauauauau

SEQ ID NO: 34800 - RNA, 30 nt, Homo sapiens
uauauauauauauauuuuuuauauauauau

SEQ ID NO: 34801 - RNA, 19 nt, Homo sapiens
uauauauauauuauauaua

SEQ ID NO: 34802 - RNA, 23 nt, Homo sapiens
uauccuacugcaugaacugacaa

SEQ ID NO: 34803 - RNA, 22 nt, Homo sapiens
uauggauauauauauauauaua

SEQ ID NO: 34804 - RNA, 18 nt, Homo sapiens
uauuuuuguaagaaaaga

SEQ ID NO: 34805 - RNA, 16 nt, Homo sapiens
ucacgugauucacauu

SEQ ID NO: 34806 - RNA, 19 nt, Homo sapiens
ucacuagaggugccauguc

SEQ ID NO: 34807 - RNA, 18 nt, Homo sapiens
ucagaagauaaauagcag

SEQ ID NO: 34808 - RNA, 20 nt, Homo sapiens
uccagaaucaguauguaaua

SEQ ID NO: 34809 - RNA, 16 nt, Homo sapiens
uccccgcgucuucccg

SEQ ID NO: 34810 - RNA, 21 nt, Homo sapiens
ucugccacaaugagacuuuuc

SEQ ID NO: 34811 - RNA, 18 nt, Homo sapiens
ugagucauugcugggaac

SEQ ID NO: 34812 - RNA, 15 nt, Homo sapiens
uguacaaaugcuauu

SEQ ID NO: 34813 - RNA, 16 nt, Homo sapiens
uuucuaacuguuuugu

SEQ ID NO: 34814 - RNA, 20 nt, Homo sapiens
accagaguacuuguuugcaa

SEQ ID NO: 34815 - RNA, 19 nt, Homo sapiens
cagcgacgccgggccaggg

SEQ ID NO: 34816 - RNA, 22 nt, Homo sapiens
ccggcgccgccgccuccuuccc

SEQ ID NO: 34817 - RNA, 19 nt, Homo sapiens
ccuccuucccucccgagcc

SEQ ID NO: 34818 - RNA, 23 nt, Homo sapiens
ccucggccucccaaaaugcuggg

SEQ ID NO: 34819 - RNA, 20 nt, Homo sapiens
ccugaaagauuaaaaggccc

SEQ ID NO: 34820 - RNA, 26 nt, Homo sapiens
ccuuauuuuguuuuuauaucucucga

SEQ ID NO: 34821 - RNA, 22 nt, Homo sapiens
gccgccuguccggagcccgggg

SEQ ID NO: 34822 - RNA, 18 nt, Homo sapiens
gcgccggccgucuccgcc

SEQ ID NO: 34823 - RNA, 17 nt, Homo sapiens
gcuccgcgccgggcgcc

SEQ ID NO: 34824 - RNA, 19 nt, Homo sapiens
gcuucaccauguugcccag

SEQ ID NO: 34825 - RNA, 16 nt, Homo sapiens
ugggaguaguuuguau

SEQ ID NO: 34826 - RNA, 14 nt, Homo sapiens
cacguggcucucuc

SEQ ID NO: 34827 - RNA, 26 nt, Homo sapiens
uggaaaaggcucuauaaaauguccug

SEQ ID NO: 34828 - RNA, 22 nt, Homo sapiens
aggcggccuggagucuggggcg

SEQ ID NO: 34829 - RNA, 22 nt, Homo sapiens
agggaucacaggggcaggcugc

SEQ ID NO: 34830 - RNA, 19 nt, Homo sapiens
caaaccacacaagaacugu

SEQ ID NO: 34831 - RNA, 23 nt, Homo sapiens
gcuguuaucaauauaaaagauua

SEQ ID NO: 34832 - RNA, 16 nt, Homo sapiens
guccauucucuggugg

SEQ ID NO: 34833 - RNA, 24 nt, Homo sapiens
uggagucuggggcgcaggaaaggg

SEQ ID NO: 34834 - RNA, 19 nt, Homo sapiens
agaggaaaaggcuccagcc

SEQ ID NO: 34835 - RNA, 15 nt, Homo sapiens
ccgggcagcaaaccc

SEQ ID NO: 34836 - RNA, 18 nt, Homo sapiens
aaaaaaguaaaucucuuu

SEQ ID NO: 34837 - RNA, 21 nt, Homo sapiens
aagaaggaaaugcaaggggcc

SEQ ID NO: 34838 - RNA, 19 nt, Homo sapiens
ccuugguauaucuuuacaa

SEQ ID NO: 34839 - RNA, 18 nt, Homo sapiens
uauuuauugagucauggc

SEQ ID NO: 34840 - RNA, 20 nt, Homo sapiens
ucaaagacuaauaugucuca

SEQ ID NO: 34841 - RNA, 20 nt, Homo sapiens
uguauuuucucuccacuucu

SEQ ID NO: 34842 - RNA, 24 nt, Homo sapiens
gcagcgggcgaggggugggggggg

SEQ ID NO: 34843 - RNA, 18 nt, Homo sapiens
ggcgaggggugggggggg

SEQ ID NO: 34844 - RNA, 18 nt, Homo sapiens
acaaaggagcguuucagg

SEQ ID NO: 34845 - RNA, 24 nt, Homo sapiens
aggcagcgggcgaggggugggggg

SEQ ID NO: 34846 - RNA, 20 nt, Homo sapiens
cagcaggcccucagcccggc

SEQ ID NO: 34847 - RNA, 17 nt, Homo sapiens
gacccauccucagggac

SEQ ID NO: 34848 - RNA, 19 nt, Homo sapiens
gagggaggagagggaugcg

SEQ ID NO: 34849 - RNA, 18 nt, Homo sapiens
gagggguggggggggggg

SEQ ID NO: 34850 - RNA, 24 nt, Homo sapiens
gcagcgggcgaggggugggggggg

SEQ ID NO: 34851 - RNA, 20 nt, Homo sapiens
gcggggagggcggggggcga

SEQ ID NO: 34852 - RNA, 21 nt, Homo sapiens
ggaugcggggagggcgggggg

SEQ ID NO: 34853 - RNA, 19 nt, Homo sapiens
ggcaccagccagggaagcc

SEQ ID NO: 34854 - RNA, 18 nt, Homo sapiens
ggcagaaggcuggcugga

SEQ ID NO: 34855 - RNA, 24 nt, Homo sapiens
gggaggcagcgggcgagggguggg

SEQ ID NO: 34856 - RNA, 19 nt, Homo sapiens
gggcgaggggugggggggg

SEQ ID NO: 34857 - RNA, 19 nt, Homo sapiens
ggggggggggggaaggagg

SEQ ID NO: 34858 - RNA, 21 nt, Homo sapiens
uaccacgguuccuacagagau

SEQ ID NO: 34859 - RNA, 18 nt, Homo sapiens
ucugacccauccucaggg

SEQ ID NO: 34860 - RNA, 15 nt, Homo sapiens
aaagaaggcccccaa

SEQ ID NO: 34861 - RNA, 20 nt, Homo sapiens
gccggggugaggcccagcug

SEQ ID NO: 34862 - RNA, 20 nt, Homo sapiens
gcuggggaaggggcggcgga

SEQ ID NO: 34863 - RNA, 20 nt, Homo sapiens
ggcggcggagggggcggugg

SEQ ID NO: 34864 - RNA, 22 nt, Homo sapiens
gggaaggggcggcggagggggc

SEQ ID NO: 34865 - RNA, 24 nt, Homo sapiens
gggaaggggcggcggagggggcgg

SEQ ID NO: 34866 - RNA, 25 nt, Homo sapiens
ucacgcaaaagcugccggggugagg

SEQ ID NO: 34867 - RNA, 19 nt, Homo sapiens
ugccaggggaguccuggcc

SEQ ID NO: 34868 - RNA, 21 nt, Homo sapiens
uacaugcagggcugugcaggc

SEQ ID NO: 34869 - RNA, 16 nt, Homo sapiens
gcgcauggccacggcg

SEQ ID NO: 34870 - RNA, 17 nt, Homo sapiens
gcggcugccggggaccg

SEQ ID NO: 34871 - RNA, 19 nt, Homo sapiens
uuuguccuggauugaugug

SEQ ID NO: 34872 - RNA, 20 nt, Homo sapiens
auauaugcugagaaguucac

SEQ ID NO: 34873 - RNA, 19 nt, Homo sapiens
auauaugugugugucugcu

SEQ ID NO: 34874 - RNA, 18 nt, Homo sapiens
gcggagggggaggggagg

SEQ ID NO: 34875 - RNA, 17 nt, Homo sapiens
gugugucugugugugua

SEQ ID NO: 34876 - RNA, 22 nt, Homo sapiens
ucacauauauauacaauugcgu

SEQ ID NO: 34877 - RNA, 23 nt, Homo sapiens
accacauaaugucagagcuuuag

SEQ ID NO: 34878 - RNA, 18 nt, Homo sapiens
acuugagaagauaacauu

SEQ ID NO: 34879 - RNA, 15 nt, Homo sapiens
agcgggggaggggga

SEQ ID NO: 34880 - RNA, 22 nt, Homo sapiens
aggcguggggugggaaaguggg

SEQ ID NO: 34881 - RNA, 20 nt, Homo sapiens
cacacccccacaguugggga

SEQ ID NO: 34882 - RNA, 15 nt, Homo sapiens
cagauucuagagcuu

SEQ ID NO: 34883 - RNA, 21 nt, Homo sapiens
cagcgggggagggggcagggc

SEQ ID NO: 34884 - RNA, 22 nt, Homo sapiens
gaauugcagauucuagagcuuu

SEQ ID NO: 34885 - RNA, 21 nt, Homo sapiens
gagaaggggagggaccugucu

SEQ ID NO: 34886 - RNA, 17 nt, Homo sapiens
gauauacaaaguuuuau

SEQ ID NO: 34887 - RNA, 18 nt, Homo sapiens
ggugggauagguaggaag

SEQ ID NO: 34888 - RNA, 14 nt, Homo sapiens
ucguugauauacaa

SEQ ID NO: 34889 - RNA, 19 nt, Homo sapiens
ugaaucuagacucuuuaaa

SEQ ID NO: 34890 - RNA, 18 nt, Homo sapiens
ugaggagggggaagggga

SEQ ID NO: 34891 - RNA, 23 nt, Homo sapiens
ugccuguaaucucagcacuuugg

SEQ ID NO: 34892 - RNA, 19 nt, Homo sapiens
ugggaagguggaguuuucc

SEQ ID NO: 34893 - RNA, 17 nt, Homo sapiens
uugggaggcugaggugg

SEQ ID NO: 34894 - RNA, 18 nt, Homo sapiens
agccuuuggaaauauagc

SEQ ID NO: 34895 - RNA, 21 nt, Homo sapiens
cacgggugccgcgccgccccc

SEQ ID NO: 34896 - RNA, 21 nt, Homo sapiens
cauguagucccagcuacuugg

SEQ ID NO: 34897 - RNA, 20 nt, Homo sapiens
cggcgguggcgggccagcuc

SEQ ID NO: 34898 - RNA, 17 nt, Homo sapiens
gccggggcacgggugcc

SEQ ID NO: 34899 - RNA, 20 nt, Homo sapiens
uugaugaggagugugccugg

SEQ ID NO: 34900 - RNA, 21 nt, Homo sapiens
agggggagaaugcagugggga

SEQ ID NO: 34901 - RNA, 21 nt, Homo sapiens
cacgcgugugugugugugugu

SEQ ID NO: 34902 - RNA, 22 nt, Homo sapiens
cauguccagacagcauaucugu

SEQ ID NO: 34903 - RNA, 22 nt, Homo sapiens
ccgugcaugugugugucaaggc

SEQ ID NO: 34904 - RNA, 18 nt, Homo sapiens
ccgugugugugugugugu

SEQ ID NO: 34905 - RNA, 24 nt, Homo sapiens
ccguguguguguguguguccaggc

SEQ ID NO: 34906 - RNA, 19 nt, Homo sapiens
cgugcaugugugugucaag

SEQ ID NO: 34907 - RNA, 21 nt, Homo sapiens
cugcacgugugugcaugucca

SEQ ID NO: 34908 - RNA, 19 nt, Homo sapiens
cugcacgugugugcgucca

SEQ ID NO: 34909 - RNA, 18 nt, Homo sapiens
cuguguguguguguccag

SEQ ID NO: 34910 - RNA, 20 nt, Homo sapiens
gccuucgucugcagcuccgu

SEQ ID NO: 34911 - RNA, 17 nt, Homo sapiens
gcguguguauguucagg

SEQ ID NO: 34912 - RNA, 17 nt, Homo sapiens
gcgugugugugugacua

SEQ ID NO: 34913 - RNA, 19 nt, Homo sapiens
gucuggaagugugugucca

SEQ ID NO: 34914 - RNA, 18 nt, Homo sapiens
gugcauacaugcauccag

SEQ ID NO: 34915 - RNA, 18 nt, Homo sapiens
gugugucugugugugugu

SEQ ID NO: 34916 - RNA, 18 nt, Homo sapiens
guguguguguccaggggc

SEQ ID NO: 34917 - RNA, 18 nt, Homo sapiens
uccaggcagcauaucugu

SEQ ID NO: 34918 - RNA, 19 nt, Homo sapiens
ucuggaaguguguguccag

SEQ ID NO: 34919 - RNA, 23 nt, Homo sapiens
ucugugcacgcgugugugugugu

SEQ ID NO: 34920 - RNA, 19 nt, Homo sapiens
ucugugcacgugugugucc

SEQ ID NO: 34921 - RNA, 17 nt, Homo sapiens
ucuguguguguguccag

SEQ ID NO: 34922 - RNA, 23 nt, Homo sapiens
ucuuaaauauaaauaccaaggcc

SEQ ID NO: 34923 - RNA, 15 nt, Homo sapiens
ugggguggggggugg

SEQ ID NO: 34924 - RNA, 19 nt, Homo sapiens
ugugucugugugugugugu

SEQ ID NO: 34925 - RNA, 18 nt, Homo sapiens
acagccuuguacccgccc

SEQ ID NO: 34926 - RNA, 20 nt, Homo sapiens
accucagcgaccuucgcccc

SEQ ID NO: 34927 - RNA, 18 nt, Homo sapiens
acgguggaguucacuuuc

SEQ ID NO: 34928 - RNA, 18 nt, Homo sapiens
aguggcugguugguggga

SEQ ID NO: 34929 - RNA, 19 nt, Homo sapiens
ccaccugaagauggggugc

SEQ ID NO: 34930 - RNA, 23 nt, Homo sapiens
ccagaggguggaugagggccugu

SEQ ID NO: 34931 - RNA, 20 nt, Homo sapiens
cccggggaccccccgggugu

SEQ ID NO: 34932 - RNA, 18 nt, Homo sapiens
cccucuggccgccgcucc

SEQ ID NO: 34933 - RNA, 15 nt, Homo sapiens
cccuucaccagcaga

SEQ ID NO: 34934 - RNA, 20 nt, Homo sapiens
ccgcgcccucgcccucaucg

SEQ ID NO: 34935 - RNA, 23 nt, Homo sapiens
ccuuguggucagggaggaacgcc

SEQ ID NO: 34936 - RNA, 22 nt, Homo sapiens
gccagcucgggccgcugcgggg

SEQ ID NO: 34937 - RNA, 19 nt, Homo sapiens
gccggagucacuggcgcca

SEQ ID NO: 34938 - RNA, 16 nt, Homo sapiens
gcggccauagugcuug

SEQ ID NO: 34939 - RNA, 16 nt, Homo sapiens
gcuggggacgggcgcc

SEQ ID NO: 34940 - RNA, 17 nt, Homo sapiens
gggagcgagaccuccag

SEQ ID NO: 34941 - RNA, 20 nt, Homo sapiens
gggggagaggguggaggggc

SEQ ID NO: 34942 - RNA, 17 nt, Homo sapiens
gggucugugcugugccc

SEQ ID NO: 34943 - RNA, 17 nt, Homo sapiens
ggucagggaggaacgcc

SEQ ID NO: 34944 - RNA, 24 nt, Homo sapiens
gucaccaaugugccuccgcucuga

SEQ ID NO: 34945 - RNA, 14 nt, Homo sapiens
ucagggcgggacgg

SEQ ID NO: 34946 - RNA, 21 nt, Homo sapiens
uggacaaggacgcgaggccaa

SEQ ID NO: 34947 - RNA, 22 nt, Homo sapiens
uggacaaggacggcgaggccaa

SEQ ID NO: 34948 - RNA, 27 nt, Homo sapiens
uggaggggggcuccuguucggaaacuu

SEQ ID NO: 34949 - RNA, 22 nt, Homo sapiens
uggcaguguggcuggguuccac

SEQ ID NO: 34950 - RNA, 18 nt, Homo sapiens
ugugcugugcccccacug

SEQ ID NO: 34951 - RNA, 17 nt, Homo sapiens
ccaccgcgcgccuuggc

SEQ ID NO: 34952 - RNA, 18 nt, Homo sapiens
gggccuggaaaacauggg

SEQ ID NO: 34953 - RNA, 15 nt, Homo sapiens
ugggaggcugggggc

SEQ ID NO: 34954 - RNA, 17 nt, Homo sapiens
uggggaggcgaggaggc

SEQ ID NO: 34955 - RNA, 22 nt, Homo sapiens
aggagccagucaggauugggga

SEQ ID NO: 34956 - RNA, 17 nt, Homo sapiens
aggggcugggagugggg

SEQ ID NO: 34957 - RNA, 21 nt, Homo sapiens
caccagagaugucuccucugc

SEQ ID NO: 34958 - RNA, 19 nt, Homo sapiens
cucgcagugggccucugug

SEQ ID NO: 34959 - RNA, 18 nt, Homo sapiens
ggggaggaaggcagaggg

SEQ ID NO: 34960 - RNA, 17 nt, Homo sapiens
uagaggucugugcugug

SEQ ID NO: 34961 - RNA, 24 nt, Homo sapiens
uguggaggggagguaugguggggg

SEQ ID NO: 34962 - RNA, 18 nt, Homo sapiens
acccauggccacaugaaa

SEQ ID NO: 34963 - RNA, 23 nt, Homo sapiens
aggaugugcugugguuuaaacca

SEQ ID NO: 34964 - RNA, 20 nt, Homo sapiens
ccagucaguacuccagggau

SEQ ID NO: 34965 - RNA, 22 nt, Homo sapiens
ccuccgcgcgccuccccggccg

SEQ ID NO: 34966 - RNA, 25 nt, Homo sapiens
ggccuguaaauuccgggcugcacgc

SEQ ID NO: 34967 - RNA, 15 nt, Homo sapiens
gucuuuaauguguuu

SEQ ID NO: 34968 - RNA, 18 nt, Homo sapiens
uacaaguuuucaagaacc

SEQ ID NO: 34969 - RNA, 18 nt, Homo sapiens
ugugcugugguuuaaacc

SEQ ID NO: 34970 - RNA, 18 nt, Homo sapiens
uuaagaaucugauaacua

SEQ ID NO: 34971 - RNA, 15 nt, Homo sapiens
aauggauuugggucc

SEQ ID NO: 34972 - RNA, 19 nt, Homo sapiens
cgugcaugugugcguguga

SEQ ID NO: 34973 - RNA, 21 nt, Homo sapiens
gcgugugacuucgugugaguc

SEQ ID NO: 34974 - RNA, 19 nt, Homo sapiens
ggggcccggaggcgcuccu

SEQ ID NO: 34975 - RNA, 18 nt, Homo sapiens
gggggacgggggcggggg

SEQ ID NO: 34976 - RNA, 16 nt, Homo sapiens
guagcugacuugguga

SEQ ID NO: 34977 - RNA, 18 nt, Homo sapiens
uggguccuugcaaaugcc

SEQ ID NO: 34978 - RNA, 21 nt, Homo sapiens
aacagguuaguaggaaaucac

SEQ ID NO: 34979 - RNA, 19 nt, Homo sapiens
acuuuaaauugcacuguua

SEQ ID NO: 34980 - RNA, 16 nt, Homo sapiens
caaauguguuacagcc

SEQ ID NO: 34981 - RNA, 16 nt, Homo sapiens
cuggcccccucucucg

SEQ ID NO: 34982 - RNA, 20 nt, Homo sapiens
gagggaugaacccgacggac

SEQ ID NO: 34983 - RNA, 19 nt, Homo sapiens
ucguguaugugugugugug

SEQ ID NO: 34984 - RNA, 17 nt, Homo sapiens
uuuuugggggggugggc

SEQ ID NO: 34985 - RNA, 15 nt, Homo sapiens
agcgugaaugucggg

SEQ ID NO: 34986 - RNA, 17 nt, Homo sapiens
gcaaggcccggaucccc

SEQ ID NO: 34987 - RNA, 25 nt, Homo sapiens
gcgcggcugccgcaguccagccgga

SEQ ID NO: 34988 - RNA, 16 nt, Homo sapiens
gcgcggggaggggcgc

SEQ ID NO: 34989 - RNA, 18 nt, Homo sapiens
gcgggcgggggagccagg

SEQ ID NO: 34990 - RNA, 15 nt, Homo sapiens
gggcgcgcggggagg

SEQ ID NO: 34991 - RNA, 16 nt, Homo sapiens
gggugggugggcgcgc

SEQ ID NO: 34992 - RNA, 22 nt, Homo sapiens
gaggaagggggaugagacaccc

SEQ ID NO: 34993 - RNA, 17 nt, Homo sapiens
aaggaauacuuaccaaa

SEQ ID NO: 34994 - RNA, 20 nt, Homo sapiens
aggaaggacaggaaauaaaa

SEQ ID NO: 34995 - RNA, 19 nt, Homo sapiens
auagaaacaaaacaguaag

SEQ ID NO: 34996 - RNA, 18 nt, Homo sapiens
caaacaagggaucaaaug

SEQ ID NO: 34997 - RNA, 18 nt, Homo sapiens
caauauagacacuuucuu

SEQ ID NO: 34998 - RNA, 15 nt, Homo sapiens
gcaccaugguuagac

SEQ ID NO: 34999 - RNA, 19 nt, Homo sapiens
guaguugguccuaacccuu

SEQ ID NO: 35000 - RNA, 18 nt, Homo sapiens
uaaauucgauacuuccuu

SEQ ID NO: 35001 - RNA, 15 nt, Homo sapiens
ucagcaauuucaagg

SEQ ID NO: 35002 - RNA, 21 nt, Homo sapiens
ucuggcuagguugcuagggug

SEQ ID NO: 35003 - RNA, 17 nt, Homo sapiens
uggggccccuaaaaacc

SEQ ID NO: 35004 - RNA, 24 nt, Homo sapiens
ugguuuugguggugguggugguug

SEQ ID NO: 35005 - RNA, 19 nt, Homo sapiens
aggaagacugaggggaggc

SEQ ID NO: 35006 - RNA, 18 nt, Homo sapiens
caguagaaggaacaguca

SEQ ID NO: 35007 - RNA, 20 nt, Homo sapiens
ccccagcccugagggcccgg

SEQ ID NO: 35008 - RNA, 19 nt, Homo sapiens
cuggcuccugacuccugcc

SEQ ID NO: 35009 - RNA, 18 nt, Homo sapiens
cugguuccaccacccgcc

SEQ ID NO: 35010 - RNA, 17 nt, Homo sapiens
gccuuugcuucccaggu

SEQ ID NO: 35011 - RNA, 21 nt, Homo sapiens
gcgggcgggagccgggggagg

SEQ ID NO: 35012 - RNA, 18 nt, Homo sapiens
ggaggaaaugaaagaaca

SEQ ID NO: 35013 - RNA, 21 nt, Homo sapiens
ggcagccggcuuuguacaagg

SEQ ID NO: 35014 - RNA, 17 nt, Homo sapiens
ggcugggcagccggcuu

SEQ ID NO: 35015 - RNA, 22 nt, Homo sapiens
gggcgggcgggagccgggggag

SEQ ID NO: 35016 - RNA, 17 nt, Homo sapiens
uaagucgagccccugga

SEQ ID NO: 35017 - RNA, 14 nt, Homo sapiens
ugagcuccccagcc

SEQ ID NO: 35018 - RNA, 18 nt, Homo sapiens
ugccagggagcuccuggc

SEQ ID NO: 35019 - RNA, 18 nt, Homo sapiens
uggaggaagacugagggg

SEQ ID NO: 35020 - RNA, 21 nt, Homo sapiens
uggaggaagacugaggggagg

SEQ ID NO: 35021 - RNA, 26 nt, Homo sapiens
uggcugcagccuaccugccuggacac

SEQ ID NO: 35022 - RNA, 19 nt, Homo sapiens
aggggaaggggggaggggg

SEQ ID NO: 35023 - RNA, 15 nt, Homo sapiens
ccuugagaggagggg

SEQ ID NO: 35024 - RNA, 23 nt, Homo sapiens
cgggcgcggccgaagucgucagc

SEQ ID NO: 35025 - RNA, 21 nt, Homo sapiens
gccgaagucgucagcggucac

SEQ ID NO: 35026 - RNA, 16 nt, Homo sapiens
aacacaacauccccau

SEQ ID NO: 35027 - RNA, 19 nt, Homo sapiens
ggccaggcucaggcccugg

SEQ ID NO: 35028 - RNA, 15 nt, Homo sapiens
gggaaacccaaccuc

SEQ ID NO: 35029 - RNA, 22 nt, Homo sapiens
uagaagcugauugcgcacgaag

SEQ ID NO: 35030 - RNA, 22 nt, Homo sapiens
ucauccucugucuguccauucc

SEQ ID NO: 35031 - RNA, 17 nt, Homo sapiens
ugaguccugagcacaga

SEQ ID NO: 35032 - RNA, 20 nt, Homo sapiens
gccagccucugcccaccuga

SEQ ID NO: 35033 - RNA, 18 nt, Homo sapiens
ugccccuccaggagcauu

SEQ ID NO: 35034 - RNA, 22 nt, Homo sapiens
ugagaaugaaaauugggcaugg

SEQ ID NO: 35035 - RNA, 20 nt, Homo sapiens
aagcuggaggauggggaugg

SEQ ID NO: 35036 - RNA, 20 nt, Homo sapiens
uccacaaaguugggggcagu

SEQ ID NO: 35037 - RNA, 18 nt, Homo sapiens
uggagagagccagugcug

SEQ ID NO: 35038 - RNA, 20 nt, Homo sapiens
aaaaauagcagaucgguucc

SEQ ID NO: 35039 - RNA, 18 nt, Homo sapiens
cacucgugaaaccauccc

SEQ ID NO: 35040 - RNA, 19 nt, Homo sapiens
ccccuucaccaccaccacc

SEQ ID NO: 35041 - RNA, 27 nt, Homo sapiens
cucuggacagugacagggucuuguaaa

SEQ ID NO: 35042 - RNA, 17 nt, Homo sapiens
gggggggcggcgggaag

SEQ ID NO: 35043 - RNA, 22 nt, Homo sapiens
gggggggcggcgggaagcuggg

SEQ ID NO: 35044 - RNA, 18 nt, Homo sapiens
ggggggggcggcgggaag

SEQ ID NO: 35045 - RNA, 20 nt, Homo sapiens
gugagaagcaccacgucugg

SEQ ID NO: 35046 - RNA, 17 nt, Homo sapiens
cccgccgcccgccgccc

SEQ ID NO: 35047 - RNA, 16 nt, Homo sapiens
cccuuauuagucucug

SEQ ID NO: 35048 - RNA, 15 nt, Homo sapiens
ccgccgcccgccgcc

SEQ ID NO: 35049 - RNA, 18 nt, Homo sapiens
cuguacaacuuucucaaa

SEQ ID NO: 35050 - RNA, 17 nt, Homo sapiens
gcccgccgcccgccgcc

SEQ ID NO: 35051 - RNA, 18 nt, Homo sapiens
gcucauuuuacgauuacg

SEQ ID NO: 35052 - RNA, 19 nt, Homo sapiens
ggagguggacgggagggac

SEQ ID NO: 35053 - RNA, 18 nt, Homo sapiens
gugcaccugacagcuucu

SEQ ID NO: 35054 - RNA, 19 nt, Homo sapiens
ugucaugagaaucagguug

SEQ ID NO: 35055 - RNA, 18 nt, Homo sapiens
uuauacaguauuacaaca

SEQ ID NO: 35056 - RNA, 16 nt, Homo sapiens
agcgguccagucucca

SEQ ID NO: 35057 - RNA, 17 nt, Homo sapiens
aggcggcgggauuccgg

SEQ ID NO: 35058 - RNA, 18 nt, Homo sapiens
caaaccuuugcccccagu

SEQ ID NO: 35059 - RNA, 21 nt, Homo sapiens
caccaguguccuccccuucua

SEQ ID NO: 35060 - RNA, 22 nt, Homo sapiens
ccgaccggcggcggugcccucg

SEQ ID NO: 35061 - RNA, 18 nt, Homo sapiens
ccuggagauugaguucac

SEQ ID NO: 35062 - RNA, 22 nt, Homo sapiens
gaggcuccgaagcuccguuccc

SEQ ID NO: 35063 - RNA, 20 nt, Homo sapiens
gcgcggggcgcaggcggcgg

SEQ ID NO: 35064 - RNA, 16 nt, Homo sapiens
gcgcggggcgcggggc

SEQ ID NO: 35065 - RNA, 18 nt, Homo sapiens
gcgcggggcgcggggcgc

SEQ ID NO: 35066 - RNA, 18 nt, Homo sapiens
cggcggcgguggcggagg

SEQ ID NO: 35067 - RNA, 18 nt, Homo sapiens
cgggcggcggcgguggcg

SEQ ID NO: 35068 - RNA, 19 nt, Homo sapiens
gagagaacucccgaccggg

SEQ ID NO: 35069 - RNA, 22 nt, Homo sapiens
ggcggcggcgguggcggagggg

SEQ ID NO: 35070 - RNA, 16 nt, Homo sapiens
uggcuucgcucagggu

SEQ ID NO: 35071 - RNA, 20 nt, Homo sapiens
aaaauggggauaagaauccu

SEQ ID NO: 35072 - RNA, 20 nt, Homo sapiens
aagaagagggagguggccca

SEQ ID NO: 35073 - RNA, 22 nt, Homo sapiens
agcaagugauagaacuccgaca

SEQ ID NO: 35074 - RNA, 22 nt, Homo sapiens
aggggaaggggaugaagggaag

SEQ ID NO: 35075 - RNA, 16 nt, Homo sapiens
gaacacugagcaucac

SEQ ID NO: 35076 - RNA, 21 nt, Homo sapiens
gccgcguuugccuaguguugg

SEQ ID NO: 35077 - RNA, 18 nt, Homo sapiens
guggcugugguuuugaac

SEQ ID NO: 35078 - RNA, 18 nt, Homo sapiens
uagugggcuucuggaaaa

SEQ ID NO: 35079 - RNA, 18 nt, Homo sapiens
uggggacuuucuaugcug

SEQ ID NO: 35080 - RNA, 16 nt, Homo sapiens
uguucaggaugcgaga

SEQ ID NO: 35081 - RNA, 19 nt, Homo sapiens
uguuuggggaauggggcag

SEQ ID NO: 35082 - RNA, 21 nt, Homo sapiens
uuuacauauuuccccauuuca

SEQ ID NO: 35083 - RNA, 16 nt, Homo sapiens
gcauguccaaauucau

SEQ ID NO: 35084 - RNA, 15 nt, Homo sapiens
ggcagaaaagaaaag

SEQ ID NO: 35085 - RNA, 21 nt, Homo sapiens
gggguggcaccaguagaaacg

SEQ ID NO: 35086 - RNA, 17 nt, Homo sapiens
ggaaagacaaaaaaaag

SEQ ID NO: 35087 - RNA, 15 nt, Homo sapiens
ggcaggcagcggggc

SEQ ID NO: 35088 - RNA, 18 nt, Homo sapiens
gggcugcaccugagccug

SEQ ID NO: 35089 - RNA, 18 nt, Homo sapiens
acugcuuccuuuauauga

SEQ ID NO: 35090 - RNA, 21 nt, Homo sapiens
caauuucuuuuuauuuuuccu

SEQ ID NO: 35091 - RNA, 22 nt, Homo sapiens
uagcauaucauaucuccuaaau

SEQ ID NO: 35092 - RNA, 15 nt, Homo sapiens
cagccucuacggccg

SEQ ID NO: 35093 - RNA, 20 nt, Homo sapiens
gcagaggcggcuacugcggu

SEQ ID NO: 35094 - RNA, 19 nt, Homo sapiens
gcuccgcggcggcagaggc

SEQ ID NO: 35095 - RNA, 21 nt, Homo sapiens
uaaauaguuaaauauauuuga

SEQ ID NO: 35096 - RNA, 24 nt, Homo sapiens
aagaggaggggaacgagugggaag

SEQ ID NO: 35097 - RNA, 20 nt, Homo sapiens
aagcagcucggaagaggagg

SEQ ID NO: 35098 - RNA, 19 nt, Homo sapiens
aauguaaggugcuuacaca

SEQ ID NO: 35099 - RNA, 21 nt, Homo sapiens
aggaaugcuagccagcuguca

SEQ ID NO: 35100 - RNA, 21 nt, Homo sapiens
ccagaggggagcugaagaguc

SEQ ID NO: 35101 - RNA, 16 nt, Homo sapiens
cuuuauggcaggugag

SEQ ID NO: 35102 - RNA, 19 nt, Homo sapiens
gaacagugugcucuggggu

SEQ ID NO: 35103 - RNA, 23 nt, Homo sapiens
gaccuacaggucagugcacucuc

SEQ ID NO: 35104 - RNA, 20 nt, Homo sapiens
gagagggagagggagaccac

SEQ ID NO: 35105 - RNA, 19 nt, Homo sapiens
gcaggccuccuggcuucuc

SEQ ID NO: 35106 - RNA, 21 nt, Homo sapiens
gcugggauuuccuagggguug

SEQ ID NO: 35107 - RNA, 19 nt, Homo sapiens
guguucaaauggaugcaga

SEQ ID NO: 35108 - RNA, 17 nt, Homo sapiens
uccuugugcugcuuuug

SEQ ID NO: 35109 - RNA, 16 nt, Homo sapiens
ucuuggcccgggagug

SEQ ID NO: 35110 - RNA, 20 nt, Homo sapiens
ugauugucagcguagccuug

SEQ ID NO: 35111 - RNA, 19 nt, Homo sapiens
aagaccacugcccgugcuc

SEQ ID NO: 35112 - RNA, 17 nt, Homo sapiens
aagcagccgccucaggu

SEQ ID NO: 35113 - RNA, 18 nt, Homo sapiens
aguagaagcccugggccu

SEQ ID NO: 35114 - RNA, 17 nt, Homo sapiens
cagccgccucagguucc

SEQ ID NO: 35115 - RNA, 22 nt, Homo sapiens
gagcagauggccauguggcuca

SEQ ID NO: 35116 - RNA, 20 nt, Homo sapiens
gagugaaaggaguccaugaa

SEQ ID NO: 35117 - RNA, 17 nt, Homo sapiens
gauugaagucucagaag

SEQ ID NO: 35118 - RNA, 17 nt, Homo sapiens
gccugccagagacccaa

SEQ ID NO: 35119 - RNA, 19 nt, Homo sapiens
ggagccugcugagucucca

SEQ ID NO: 35120 - RNA, 16 nt, Homo sapiens
gggugggggacacaca

SEQ ID NO: 35121 - RNA, 21 nt, Homo sapiens
gugggcaggaccgcaggcugc

SEQ ID NO: 35122 - RNA, 18 nt, Homo sapiens
uagggucccagagcccau

SEQ ID NO: 35123 - RNA, 18 nt, Homo sapiens
ucacagcgcacgguuugg

SEQ ID NO: 35124 - RNA, 23 nt, Homo sapiens
ugaguucccacucucguuaugac

SEQ ID NO: 35125 - RNA, 14 nt, Homo sapiens
uucaaccucucacu

SEQ ID NO: 35126 - RNA, 21 nt, Homo sapiens
aggggccagggggacggaucu

SEQ ID NO: 35127 - RNA, 15 nt, Homo sapiens
agggggcugcuggau

SEQ ID NO: 35128 - RNA, 21 nt, Homo sapiens
gacauggacacugaggggcca

SEQ ID NO: 35129 - RNA, 19 nt, Homo sapiens
ggaugcuuuggcggcgaag

SEQ ID NO: 35130 - RNA, 23 nt, Homo sapiens
ggcugcuggaugcuuuggcggcg

SEQ ID NO: 35131 - RNA, 20 nt, Homo sapiens
ugcugggccgggauggacuc

SEQ ID NO: 35132 - RNA, 16 nt, Homo sapiens
gcuggccugccagggg

SEQ ID NO: 35133 - RNA, 16 nt, Homo sapiens
uuccagaucuggggca

SEQ ID NO: 35134 - RNA, 16 nt, Homo sapiens
cacaagcugaagauga

SEQ ID NO: 35135 - RNA, 17 nt, Homo sapiens
aaugaacugucuccuug

SEQ ID NO: 35136 - RNA, 18 nt, Homo sapiens
acauauuaaacaugauug

SEQ ID NO: 35137 - RNA, 18 nt, Homo sapiens
acugaaauaacuguaauu

SEQ ID NO: 35138 - RNA, 20 nt, Homo sapiens
agaguuaccauaccaaagcc

SEQ ID NO: 35139 - RNA, 17 nt, Homo sapiens
caacagcugacugguac

SEQ ID NO: 35140 - RNA, 19 nt, Homo sapiens
ccgcccggcccggcucucc

SEQ ID NO: 35141 - RNA, 21 nt, Homo sapiens
ccggcccggcucuccgcgcuc

SEQ ID NO: 35142 - RNA, 23 nt, Homo sapiens
ccggcucccgacaccguccggcc

SEQ ID NO: 35143 - RNA, 24 nt, Homo sapiens
cucccagguaguuuuucaacaguu

SEQ ID NO: 35144 - RNA, 18 nt, Homo sapiens
gaaaugagucaacauuua

SEQ ID NO: 35145 - RNA, 16 nt, Homo sapiens
gagcagaagcuggagc

SEQ ID NO: 35146 - RNA, 18 nt, Homo sapiens
gagcccccgggacgugcc

SEQ ID NO: 35147 - RNA, 22 nt, Homo sapiens
gccuccaacaucuacagccaca

SEQ ID NO: 35148 - RNA, 17 nt, Homo sapiens
gcgcccgcuccucugcc

SEQ ID NO: 35149 - RNA, 17 nt, Homo sapiens
uacaugauagcaauucc

SEQ ID NO: 35150 - RNA, 23 nt, Homo sapiens
ugaaaaaguuucugaucccuaug

SEQ ID NO: 35151 - RNA, 20 nt, Homo sapiens
ugagaagugggguaaagugg

SEQ ID NO: 35152 - RNA, 21 nt, Homo sapiens
ugagaagugggguaaaguggg

SEQ ID NO: 35153 - RNA, 18 nt, Homo sapiens
ugcgcgcgcgcccgcccg

SEQ ID NO: 35154 - RNA, 22 nt, Homo sapiens
ugcucauugagaaggcagaaug

SEQ ID NO: 35155 - RNA, 18 nt, Homo sapiens
ugcugcuucuuacagcca

SEQ ID NO: 35156 - RNA, 17 nt, Homo sapiens
uguacugacuuccagca

SEQ ID NO: 35157 - RNA, 19 nt, Homo sapiens
aauagaacacuugcaacac

SEQ ID NO: 35158 - RNA, 21 nt, Homo sapiens
acagcagucaaaaucuucugu

SEQ ID NO: 35159 - RNA, 24 nt, Homo sapiens
agggccggggggagggccgagggg

SEQ ID NO: 35160 - RNA, 18 nt, Homo sapiens
auacagccucuauuucaa

SEQ ID NO: 35161 - RNA, 19 nt, Homo sapiens
cagccgcaagcggguagcg

SEQ ID NO: 35162 - RNA, 19 nt, Homo sapiens
ccccucggccgccgccgcc

SEQ ID NO: 35163 - RNA, 20 nt, Homo sapiens
ccucggcuucugccucggag

SEQ ID NO: 35164 - RNA, 21 nt, Homo sapiens
cuccgcacucggcggggccgg

SEQ ID NO: 35165 - RNA, 20 nt, Homo sapiens
cuuccuccaggccggcgcgg

SEQ ID NO: 35166 - RNA, 20 nt, Homo sapiens
gcgcagggcauacgggcgcc

SEQ ID NO: 35167 - RNA, 14 nt, Homo sapiens
gcgccggcagccgc

SEQ ID NO: 35168 - RNA, 18 nt, Homo sapiens
gcgcggggugugcgaggc

SEQ ID NO: 35169 - RNA, 20 nt, Homo sapiens
gcggagggagggccgggagg

SEQ ID NO: 35170 - RNA, 19 nt, Homo sapiens
ggaggagcgcagggcauac

SEQ ID NO: 35171 - RNA, 19 nt, Homo sapiens
gggagggccgaggggcggg

SEQ ID NO: 35172 - RNA, 18 nt, Homo sapiens
gggagggccggggggagg

SEQ ID NO: 35173 - RNA, 17 nt, Homo sapiens
gggccgggagggccggg

SEQ ID NO: 35174 - RNA, 19 nt, Homo sapiens
ggggagggccgaggggcgg

SEQ ID NO: 35175 - RNA, 20 nt, Homo sapiens
ggggcggagggagggccggg

SEQ ID NO: 35176 - RNA, 21 nt, Homo sapiens
ucacuugaguauacuguaacu

SEQ ID NO: 35177 - RNA, 16 nt, Homo sapiens
uccauuacaccauaca

SEQ ID NO: 35178 - RNA, 18 nt, Homo sapiens
ucccaauccuuaauauug

SEQ ID NO: 35179 - RNA, 16 nt, Homo sapiens
uccggcgcagcgccgg

SEQ ID NO: 35180 - RNA, 18 nt, Homo sapiens
ucgaacacuauguggaaa

SEQ ID NO: 35181 - RNA, 18 nt, Homo sapiens
ugauguuauuuugaggaa

SEQ ID NO: 35182 - RNA, 25 nt, Homo sapiens
uguaaaacauuaacuaaaaguuauu

SEQ ID NO: 35183 - RNA, 20 nt, Homo sapiens
uuuaaaacauuuuucauaca

SEQ ID NO: 35184 - RNA, 20 nt, Homo sapiens
ggggguaacagggguggaca

SEQ ID NO: 35185 - RNA, 20 nt, Homo sapiens
accaaccugggagcuacacu

SEQ ID NO: 35186 - RNA, 17 nt, Homo sapiens
agggcuguggaagacca

SEQ ID NO: 35187 - RNA, 21 nt, Homo sapiens
ggccuugguggugcauuucag

SEQ ID NO: 35188 - RNA, 21 nt, Homo sapiens
ugauggacuuccugagacacc

SEQ ID NO: 35189 - RNA, 15 nt, Homo sapiens
uuaaggccuugaugg

SEQ ID NO: 35190 - RNA, 19 nt, Homo sapiens
acuuaucucuuuaaggaag

SEQ ID NO: 35191 - RNA, 19 nt, Homo sapiens
cauagucuuauucauuuuu

SEQ ID NO: 35192 - RNA, 23 nt, Homo sapiens
ccauggagcaaaacuuacaguag

SEQ ID NO: 35193 - RNA, 16 nt, Homo sapiens
aggagacggcggccgg

SEQ ID NO: 35194 - RNA, 19 nt, Homo sapiens
cacugggguaggcaaggga

SEQ ID NO: 35195 - RNA, 19 nt, Homo sapiens
ccgcccgccuggcccgucc

SEQ ID NO: 35196 - RNA, 18 nt, Homo sapiens
cgcaagggcugaggccag

SEQ ID NO: 35197 - RNA, 23 nt, Homo sapiens
gaccgugcgcucaguacucggcc

SEQ ID NO: 35198 - RNA, 19 nt, Homo sapiens
gaggacgacggcccgagga

SEQ ID NO: 35199 - RNA, 20 nt, Homo sapiens
gcccgccuggcccguccgcc

SEQ ID NO: 35200 - RNA, 20 nt, Homo sapiens
gccuggcccguccgccgacc

SEQ ID NO: 35201 - RNA, 22 nt, Homo sapiens
gccuucguugcggguacaggag

SEQ ID NO: 35202 - RNA, 23 nt, Homo sapiens
gggguugcagugagccgagauca

SEQ ID NO: 35203 - RNA, 18 nt, Homo sapiens
uugggaggccuggguggg

SEQ ID NO: 35204 - RNA, 23 nt, Homo sapiens
aggcgcggggagcguggcccggg

SEQ ID NO: 35205 - RNA, 21 nt, Homo sapiens
cauaacaaaggaaaauauuuc

SEQ ID NO: 35206 - RNA, 18 nt, Homo sapiens
ccgcugcagcgucgggga

SEQ ID NO: 35207 - RNA, 21 nt, Homo sapiens
gaagccgaggcgcggggagcg

SEQ ID NO: 35208 - RNA, 18 nt, Homo sapiens
gcggagcuccacgacccg

SEQ ID NO: 35209 - RNA, 23 nt, Homo sapiens
uauuuuaggugcugagaguaugu

SEQ ID NO: 35210 - RNA, 18 nt, Homo sapiens
ucggagggcgccuuuugg

SEQ ID NO: 35211 - RNA, 18 nt, Homo sapiens
ucgggagaagggaucugc

SEQ ID NO: 35212 - RNA, 21 nt, Homo sapiens
ugaaggaugcaagaaguagca

SEQ ID NO: 35213 - RNA, 18 nt, Homo sapiens
uucaggaaccguuacuaa

SEQ ID NO: 35214 - RNA, 14 nt, Homo sapiens
aggucacgcgccgc

SEQ ID NO: 35215 - RNA, 19 nt, Homo sapiens
cgugggaguggagucggcc

SEQ ID NO: 35216 - RNA, 19 nt, Homo sapiens
cuguggcugucugcagaac

SEQ ID NO: 35217 - RNA, 19 nt, Homo sapiens
uaccugcggcgugggagug

SEQ ID NO: 35218 - RNA, 23 nt, Homo sapiens
ugacuauaacguaauagaacugc

SEQ ID NO: 35219 - RNA, 18 nt, Homo sapiens
aaaaggugaguggcuguu

SEQ ID NO: 35220 - RNA, 17 nt, Homo sapiens
accagagauguuagagc

SEQ ID NO: 35221 - RNA, 18 nt, Homo sapiens
ccucagcuggguuuuccc

SEQ ID NO: 35222 - RNA, 21 nt, Homo sapiens
uaugggccagagagaucuggu

SEQ ID NO: 35223 - RNA, 16 nt, Homo sapiens
uuuacaagugcugcag

SEQ ID NO: 35224 - RNA, 15 nt, Homo sapiens
uccaugaguuguuga

SEQ ID NO: 35225 - RNA, 17 nt, Homo sapiens
ucucugauucccucagc

SEQ ID NO: 35226 - RNA, 15 nt, Homo sapiens
uuuggcaccuuugau

SEQ ID NO: 35227 - RNA, 19 nt, Homo sapiens
aaaaggcuccucaagguca

SEQ ID NO: 35228 - RNA, 21 nt, Homo sapiens
acacugagacucaggcaggcc

SEQ ID NO: 35229 - RNA, 17 nt, Homo sapiens
accccagccuucccucc

SEQ ID NO: 35230 - RNA, 16 nt, Homo sapiens
cagggagguguaggcg

SEQ ID NO: 35231 - RNA, 18 nt, Homo sapiens
cugugcugcugugacugg

SEQ ID NO: 35232 - RNA, 17 nt, Homo sapiens
gcaggucugagcagagg

SEQ ID NO: 35233 - RNA, 21 nt, Homo sapiens
ggcccacacccaugaauucac

SEQ ID NO: 35234 - RNA, 19 nt, Homo sapiens
uaggacauacuacguacag

SEQ ID NO: 35235 - RNA, 19 nt, Homo sapiens
uaugcuaaugauaacagua

SEQ ID NO: 35236 - RNA, 17 nt, Homo sapiens
ucaccacagcucggggc

SEQ ID NO: 35237 - RNA, 16 nt, Homo sapiens
ucagaaaaccuuucug

SEQ ID NO: 35238 - RNA, 19 nt, Homo sapiens
ucagcaaagugaugacgcu

SEQ ID NO: 35239 - RNA, 19 nt, Homo sapiens
uccagggagguguaggcgc

SEQ ID NO: 35240 - RNA, 24 nt, Homo sapiens
uccucccucccaucaccacagcuc

SEQ ID NO: 35241 - RNA, 19 nt, Homo sapiens
ugcaguggcgugaucucgg

SEQ ID NO: 35242 - RNA, 22 nt, Homo sapiens
ccccgcccgccuccguccuucg

SEQ ID NO: 35243 - RNA, 16 nt, Homo sapiens
cccggcugcccagccc

SEQ ID NO: 35244 - RNA, 21 nt, Homo sapiens
ccggggccccgcccgccuccg

SEQ ID NO: 35245 - RNA, 18 nt, Homo sapiens
ggggaggaugcugaggag

SEQ ID NO: 35246 - RNA, 21 nt, Homo sapiens
ggggaggaugcugaggagugg

SEQ ID NO: 35247 - RNA, 20 nt, Homo sapiens
uagggacuuuugggaucuga

SEQ ID NO: 35248 - RNA, 22 nt, Homo sapiens
ucccuuccgcgaccccacgcgg

SEQ ID NO: 35249 - RNA, 21 nt, Homo sapiens
ucuccggggccccgcccgccu

SEQ ID NO: 35250 - RNA, 19 nt, Homo sapiens
gaauggugguaauggcugc

SEQ ID NO: 35251 - RNA, 20 nt, Homo sapiens
gcacagcagugugagggcac

SEQ ID NO: 35252 - RNA, 17 nt, Homo sapiens
ucccuggcuggggcgga

SEQ ID NO: 35253 - RNA, 17 nt, Homo sapiens
uggccuggagccggugc

SEQ ID NO: 35254 - RNA, 21 nt, Homo sapiens
uggcuggggcggaagcugagc

SEQ ID NO: 35255 - RNA, 22 nt, Homo sapiens
acccugugagguggguuucaua

SEQ ID NO: 35256 - RNA, 17 nt, Homo sapiens
cuguguccucucucacc

SEQ ID NO: 35257 - RNA, 17 nt, Homo sapiens
aaacaccggaaaggagg

SEQ ID NO: 35258 - RNA, 19 nt, Homo sapiens
acaggacuggugagccugg

SEQ ID NO: 35259 - RNA, 18 nt, Homo sapiens
ccggaaaggagggcaggc

SEQ ID NO: 35260 - RNA, 19 nt, Homo sapiens
cggggaauggccuggaugg

SEQ ID NO: 35261 - RNA, 17 nt, Homo sapiens
ugcucccuccucugcca

SEQ ID NO: 35262 - RNA, 14 nt, Homo sapiens
uuguacauccuggg

SEQ ID NO: 35263 - RNA, 15 nt, Homo sapiens
uuuuuuaaagcugca

SEQ ID NO: 35264 - RNA, 19 nt, Homo sapiens
aaacccgcuggccauucac

SEQ ID NO: 35265 - RNA, 22 nt, Homo sapiens
auguguuuuguucuuuaucuua

SEQ ID NO: 35266 - RNA, 18 nt, Homo sapiens
cagcaccagcaccacccc

SEQ ID NO: 35267 - RNA, 17 nt, Homo sapiens
ccaggcugugguccugc

SEQ ID NO: 35268 - RNA, 18 nt, Homo sapiens
ccugcugccggccgcccc

SEQ ID NO: 35269 - RNA, 18 nt, Homo sapiens
gcugcccggggacucacc

SEQ ID NO: 35270 - RNA, 22 nt, Homo sapiens
gggaaaacaaggagcaggagaa

SEQ ID NO: 35271 - RNA, 19 nt, Homo sapiens
gggacucaccaggcugugc

SEQ ID NO: 35272 - RNA, 18 nt, Homo sapiens
uacugaaggauuuuucau

SEQ ID NO: 35273 - RNA, 18 nt, Homo sapiens
uggcucugaacugaaggg

SEQ ID NO: 35274 - RNA, 19 nt, Homo sapiens
uucuuuaucuuauccacau

SEQ ID NO: 35275 - RNA, 17 nt, Homo sapiens
aagacaaaagaacugau

SEQ ID NO: 35276 - RNA, 17 nt, Homo sapiens
acaucuuuggaaacucc

SEQ ID NO: 35277 - RNA, 21 nt, Homo sapiens
aguggggaggagcugagccug

SEQ ID NO: 35278 - RNA, 18 nt, Homo sapiens
ccagcccuguaggcacug

SEQ ID NO: 35279 - RNA, 18 nt, Homo sapiens
ccaggggcugugaauaac

SEQ ID NO: 35280 - RNA, 23 nt, Homo sapiens
cggcaguugucccugaggucugg

SEQ ID NO: 35281 - RNA, 21 nt, Homo sapiens
gaggaauaugaguaggacagu

SEQ ID NO: 35282 - RNA, 18 nt, Homo sapiens
ggaguagcagaacccagu

SEQ ID NO: 35283 - RNA, 21 nt, Homo sapiens
ucgaacuccugaccucgugau

SEQ ID NO: 35284 - RNA, 16 nt, Homo sapiens
ugggugggccaggggc

SEQ ID NO: 35285 - RNA, 18 nt, Homo sapiens
acuccgccuccuccuccg

SEQ ID NO: 35286 - RNA, 25 nt, Homo sapiens
caugaugccuugaagcuaaaaagua

SEQ ID NO: 35287 - RNA, 22 nt, Homo sapiens
ugcugucgcggcggcgccucca

SEQ ID NO: 35288 - RNA, 24 nt, Homo sapiens
uuguguuugaaacaaggaucugag

SEQ ID NO: 35289 - RNA, 17 nt, Homo sapiens
cccccauccugugcacc

SEQ ID NO: 35290 - RNA, 22 nt, Homo sapiens
gcuguaucccucuccauagcug

SEQ ID NO: 35291 - RNA, 19 nt, Homo sapiens
ucuaagguguugggaauga

SEQ ID NO: 35292 - RNA, 18 nt, Homo sapiens
ugaagaagagagaaaagc

SEQ ID NO: 35293 - RNA, 21 nt, Homo sapiens
ucaucuuugucagcaccuuca

SEQ ID NO: 35294 - RNA, 18 nt, Homo sapiens
agcacccuuaugugaaua

SEQ ID NO: 35295 - RNA, 17 nt, Homo sapiens
cauauacuguccauacu

SEQ ID NO: 35296 - RNA, 21 nt, Homo sapiens
gccacccauuugccauauacu

SEQ ID NO: 35297 - RNA, 22 nt, Homo sapiens
uacuuucaugucuucagagugu

SEQ ID NO: 35298 - RNA, 21 nt, Homo sapiens
aaagauaugacugauuuuccc

SEQ ID NO: 35299 - RNA, 23 nt, Homo sapiens
acccugggguguuuucuaaaugu

SEQ ID NO: 35300 - RNA, 17 nt, Homo sapiens
agccccgcuuccuuucc

SEQ ID NO: 35301 - RNA, 20 nt, Homo sapiens
cagugaacucuaaccccugg

SEQ ID NO: 35302 - RNA, 16 nt, Homo sapiens
ccccgcuuccuuuccg

SEQ ID NO: 35303 - RNA, 18 nt, Homo sapiens
ccugccaucagggaguuc

SEQ ID NO: 35304 - RNA, 20 nt, Homo sapiens
ccuucugucuucuacuggag

SEQ ID NO: 35305 - RNA, 19 nt, Homo sapiens
cuccacuuucuuuuugcuc

SEQ ID NO: 35306 - RNA, 22 nt, Homo sapiens
cugccuaagacugaaguggaag

SEQ ID NO: 35307 - RNA, 16 nt, Homo sapiens
gcccucucagaagcag

SEQ ID NO: 35308 - RNA, 19 nt, Homo sapiens
gcuuguccugggaggacag

SEQ ID NO: 35309 - RNA, 20 nt, Homo sapiens
uacguuccuucugucuucua

SEQ ID NO: 35310 - RNA, 18 nt, Homo sapiens
ucuguuuuuauucccauu

SEQ ID NO: 35311 - RNA, 19 nt, Homo sapiens
ugaaauaauaccuggagca

SEQ ID NO: 35312 - RNA, 19 nt, Homo sapiens
ugacacuggcuggccuuac

SEQ ID NO: 35313 - RNA, 20 nt, Homo sapiens
ugggguguuuucuaaauguu

SEQ ID NO: 35314 - RNA, 28 nt, Homo sapiens
ucugcuuuucuucucuguacagaccucu

SEQ ID NO: 35315 - RNA, 22 nt, Homo sapiens
ccgcgccccggcggcuucggcc

SEQ ID NO: 35316 - RNA, 19 nt, Homo sapiens
cggcgcccagccgaggagc

SEQ ID NO: 35317 - RNA, 17 nt, Homo sapiens
cggcgccuguuccgggc

SEQ ID NO: 35318 - RNA, 16 nt, Homo sapiens
gcggcuucggccgccu

SEQ ID NO: 35319 - RNA, 17 nt, Homo sapiens
ggccgagcgcgggggcg

SEQ ID NO: 35320 - RNA, 16 nt, Homo sapiens
gggcgcaccguggcca

SEQ ID NO: 35321 - RNA, 24 nt, Homo sapiens
gggggcccagcggccaaugggcgc

SEQ ID NO: 35322 - RNA, 20 nt, Homo sapiens
ggggugguggggggcgggug

SEQ ID NO: 35323 - RNA, 20 nt, Homo sapiens
gggugguggggggcgggugg

SEQ ID NO: 35324 - RNA, 16 nt, Homo sapiens
uaauucgcgcauccuu

SEQ ID NO: 35325 - RNA, 21 nt, Homo sapiens
ucgaaaucucuugacccuccg

SEQ ID NO: 35326 - RNA, 21 nt, Homo sapiens
uuccgggcuuccccagguauc

SEQ ID NO: 35327 - RNA, 21 nt, Homo sapiens
accccggagucccuugggaca

SEQ ID NO: 35328 - RNA, 16 nt, Homo sapiens
ccccagaguggcuuca

SEQ ID NO: 35329 - RNA, 22 nt, Homo sapiens
gcccugccugcuccaccugacc

SEQ ID NO: 35330 - RNA, 20 nt, Homo sapiens
gugcucuguagcaguggugc

SEQ ID NO: 35331 - RNA, 18 nt, Homo sapiens
uaaacauauuuuuaagcu

SEQ ID NO: 35332 - RNA, 15 nt, Homo sapiens
uuucagacguucaga

SEQ ID NO: 35333 - RNA, 22 nt, Homo sapiens
ccauggaccucuggaaagaucu

SEQ ID NO: 35334 - RNA, 18 nt, Homo sapiens
ggcagugggggggugguu

SEQ ID NO: 35335 - RNA, 20 nt, Homo sapiens
gggacgagcgccgcucagac

SEQ ID NO: 35336 - RNA, 23 nt, Homo sapiens
ucagcagaggaucuuucuuuccu

SEQ ID NO: 35337 - RNA, 15 nt, Homo sapiens
uggcacaagaugggg

SEQ ID NO: 35338 - RNA, 19 nt, Homo sapiens
aaagacgcagcaauuugcc

SEQ ID NO: 35339 - RNA, 18 nt, Homo sapiens
aaaggaacuugaggagga

SEQ ID NO: 35340 - RNA, 19 nt, Homo sapiens
aaggggaagggccuguggu

SEQ ID NO: 35341 - RNA, 16 nt, Homo sapiens
agagggcuguuguugc

SEQ ID NO: 35342 - RNA, 18 nt, Homo sapiens
agugguccugaacagcaa

SEQ ID NO: 35343 - RNA, 18 nt, Homo sapiens
cagcauuuagugguccug

SEQ ID NO: 35344 - RNA, 21 nt, Homo sapiens
ccagaaguucaacuacgugga

SEQ ID NO: 35345 - RNA, 19 nt, Homo sapiens
gagaccccaggccguguaa

SEQ ID NO: 35346 - RNA, 20 nt, Homo sapiens
gcgggaguggaggagcgugg

SEQ ID NO: 35347 - RNA, 22 nt, Homo sapiens
ggaggcgggaggguaaagggag

SEQ ID NO: 35348 - RNA, 20 nt, Homo sapiens
ggaggcgggaggguaagggg

SEQ ID NO: 35349 - RNA, 16 nt, Homo sapiens
gggagggugggaggcg

SEQ ID NO: 35350 - RNA, 17 nt, Homo sapiens
ggggaaggggaagggcc

SEQ ID NO: 35351 - RNA, 21 nt, Homo sapiens
gggggagagaagauaugggga

SEQ ID NO: 35352 - RNA, 21 nt, Homo sapiens
uccuaaaagagggacaauaua

SEQ ID NO: 35353 - RNA, 18 nt, Homo sapiens
agcccuuguuguuagaca

SEQ ID NO: 35354 - RNA, 16 nt, Homo sapiens
gaugaugaugcagacu

SEQ ID NO: 35355 - RNA, 16 nt, Homo sapiens
gcuuucuuagcaugua

SEQ ID NO: 35356 - RNA, 22 nt, Homo sapiens
uccccuagagagguuuagauuc

SEQ ID NO: 35357 - RNA, 18 nt, Homo sapiens
ucuuugguagcaaaauuu

SEQ ID NO: 35358 - RNA, 21 nt, Homo sapiens
ugcauucuuacuuuugaauuu

SEQ ID NO: 35359 - RNA, 18 nt, Homo sapiens
agggggaaagaaagaaaa

SEQ ID NO: 35360 - RNA, 22 nt, Homo sapiens
ccuugguuggggcccacuggau

SEQ ID NO: 35361 - RNA, 24 nt, Homo sapiens
cuccuugguuggggcccacuggau

SEQ ID NO: 35362 - RNA, 18 nt, Homo sapiens
uggaaaaguugggggaaa

SEQ ID NO: 35363 - RNA, 22 nt, Homo sapiens
uuuuuuuuuuuuuuuuugacuc

SEQ ID NO: 35364 - RNA, 18 nt, Homo sapiens
aaaaauccaaguuacaag

SEQ ID NO: 35365 - RNA, 19 nt, Homo sapiens
aaagccugaggacuaugaa

SEQ ID NO: 35366 - RNA, 19 nt, Homo sapiens
cagccgcgccggggaccgg

SEQ ID NO: 35367 - RNA, 18 nt, Homo sapiens
cccgccgccgcgccgccc

SEQ ID NO: 35368 - RNA, 16 nt, Homo sapiens
cgccgccgcgccgccc

SEQ ID NO: 35369 - RNA, 20 nt, Homo sapiens
cguccgcccgccgcaggggc

SEQ ID NO: 35370 - RNA, 21 nt, Homo sapiens
gaggggccacgguugaaugga

SEQ ID NO: 35371 - RNA, 21 nt, Homo sapiens
gcuuuuaaggaaauaagaaac

SEQ ID NO: 35372 - RNA, 20 nt, Homo sapiens
ugaauaagcuucacuuagua

SEQ ID NO: 35373 - RNA, 22 nt, Homo sapiens
aagcacuagggggucacugagg

SEQ ID NO: 35374 - RNA, 18 nt, Homo sapiens
aggcggggcggggcugcg

SEQ ID NO: 35375 - RNA, 18 nt, Homo sapiens
auagucuagaagaauagu

SEQ ID NO: 35376 - RNA, 17 nt, Homo sapiens
cagcgcgcgaccggggc

SEQ ID NO: 35377 - RNA, 14 nt, Homo sapiens
cagggucgcgccgc

SEQ ID NO: 35378 - RNA, 21 nt, Homo sapiens
cagggucgcgccgcugggucg

SEQ ID NO: 35379 - RNA, 20 nt, Homo sapiens
ccagcggcgggggacucggc

SEQ ID NO: 35380 - RNA, 19 nt, Homo sapiens
cccaagcuggguggccugg

SEQ ID NO: 35381 - RNA, 16 nt, Homo sapiens
cccgccgccgccgccc

SEQ ID NO: 35382 - RNA, 21 nt, Homo sapiens
ccgcgggcccgccccuugucc

SEQ ID NO: 35383 - RNA, 17 nt, Homo sapiens
ccuccccgccccucccc

SEQ ID NO: 35384 - RNA, 20 nt, Homo sapiens
ccuuguccuccccgccccuc

SEQ ID NO: 35385 - RNA, 18 nt, Homo sapiens
gccccuccccgggcucgg

SEQ ID NO: 35386 - RNA, 21 nt, Homo sapiens
ggaccugggggaggagauccg

SEQ ID NO: 35387 - RNA, 17 nt, Homo sapiens
ggccagggucgcgccgc

SEQ ID NO: 35388 - RNA, 21 nt, Homo sapiens
ggccgccggcgggguucgaag

SEQ ID NO: 35389 - RNA, 19 nt, Homo sapiens
ggggucccgggaagugcgc

SEQ ID NO: 35390 - RNA, 18 nt, Homo sapiens
gggguucgaagggggccu

SEQ ID NO: 35391 - RNA, 18 nt, Homo sapiens
gucccagguccccaccag

SEQ ID NO: 35392 - RNA, 18 nt, Homo sapiens
gucgucccuccagccacu

SEQ ID NO: 35393 - RNA, 16 nt, Homo sapiens
ucgcagucaggccugu

SEQ ID NO: 35394 - RNA, 17 nt, Homo sapiens
uggagagggcggggggc

SEQ ID NO: 35395 - RNA, 21 nt, Homo sapiens
uucguuuuuauuguccugagu

SEQ ID NO: 35396 - RNA, 18 nt, Homo sapiens
uucucuccagggugcaag

SEQ ID NO: 35397 - RNA, 21 nt, Homo sapiens
gaaugcucuguugaaagcuuc

SEQ ID NO: 35398 - RNA, 21 nt, Homo sapiens
ggcaguuuuugccagaucaag

SEQ ID NO: 35399 - RNA, 24 nt, Homo sapiens
ugcccagugcauagaagcacaguc

SEQ ID NO: 35400 - RNA, 20 nt, Homo sapiens
aagugggaggaggagaagga

SEQ ID NO: 35401 - RNA, 25 nt, Homo sapiens
acacagccucucauguuucguuccc

SEQ ID NO: 35402 - RNA, 18 nt, Homo sapiens
agggaaggggagggggcg

SEQ ID NO: 35403 - RNA, 20 nt, Homo sapiens
agggccagcgcugggcucua

SEQ ID NO: 35404 - RNA, 22 nt, Homo sapiens
caccgcuucucgcgcgcccccg

SEQ ID NO: 35405 - RNA, 24 nt, Homo sapiens
ccgcuucucgcgcgcccccgccca

SEQ ID NO: 35406 - RNA, 16 nt, Homo sapiens
ccucuuuucuucuucu

SEQ ID NO: 35407 - RNA, 15 nt, Homo sapiens
cgacggcggcggcgg

SEQ ID NO: 35408 - RNA, 21 nt, Homo sapiens
cgcgccccuugacgucaccgc

SEQ ID NO: 35409 - RNA, 20 nt, Homo sapiens
gaggaggagaaggaguugga

SEQ ID NO: 35410 - RNA, 15 nt, Homo sapiens
gcgcggggaggugcg

SEQ ID NO: 35411 - RNA, 17 nt, Homo sapiens
gcggggcaggcggaggc

SEQ ID NO: 35412 - RNA, 14 nt, Homo sapiens
ggagguggcgggga

SEQ ID NO: 35413 - RNA, 20 nt, Homo sapiens
ggcgcgggaggauggggggg

SEQ ID NO: 35414 - RNA, 18 nt, Homo sapiens
uagaauauucaaacaguc

SEQ ID NO: 35415 - RNA, 19 nt, Homo sapiens
uuuuuuaaugacaggauaa

SEQ ID NO: 35416 - RNA, 15 nt, Homo sapiens
agcgccgccgauccc

SEQ ID NO: 35417 - RNA, 17 nt, Homo sapiens
gucauggcucacugcag

SEQ ID NO: 35418 - RNA, 19 nt, Homo sapiens
ugggacaggaaguaggcgc

SEQ ID NO: 35419 - RNA, 20 nt, Homo sapiens
aagacccuagaaaguagcga

SEQ ID NO: 35420 - RNA, 17 nt, Homo sapiens
caacggcaaaggacccc

SEQ ID NO: 35421 - RNA, 17 nt, Homo sapiens
gagguugcagugagcca

SEQ ID NO: 35422 - RNA, 18 nt, Homo sapiens
gucccuccugaaagagua

SEQ ID NO: 35423 - RNA, 19 nt, Homo sapiens
ucucuuucuagucccuccu

SEQ ID NO: 35424 - RNA, 19 nt, Homo sapiens
ugaaagaguacuuuucuca

SEQ ID NO: 35425 - RNA, 22 nt, Homo sapiens
agaguaucagcuacuuccgccg

SEQ ID NO: 35426 - RNA, 20 nt, Homo sapiens
uccgccggccugcgggacgu

SEQ ID NO: 35427 - RNA, 21 nt, Homo sapiens
uguaucaaaaauuuuauuauc

SEQ ID NO: 35428 - RNA, 24 nt, Homo sapiens
uucaauguaucaaaaauuuuauua

SEQ ID NO: 35429 - RNA, 20 nt, Homo sapiens
gcgcggggcuggggggcugc

SEQ ID NO: 35430 - RNA, 19 nt, Homo sapiens
gcugcgcgcccuggugccg

SEQ ID NO: 35431 - RNA, 21 nt, Homo sapiens
ggcuggggggcugcugggcuu

SEQ ID NO: 35432 - RNA, 19 nt, Homo sapiens
gggcuggggggcugcuggg

SEQ ID NO: 35433 - RNA, 18 nt, Homo sapiens
ggagaggcacuggggagg

SEQ ID NO: 35434 - RNA, 17 nt, Homo sapiens
gugggcacuggaguagc

SEQ ID NO: 35435 - RNA, 18 nt, Homo sapiens
gaagccacagcugcccuc

SEQ ID NO: 35436 - RNA, 25 nt, Homo sapiens
auuugguguuuucgaaugcaauugu

SEQ ID NO: 35437 - RNA, 19 nt, Homo sapiens
ccucucucccucucccucc

SEQ ID NO: 35438 - RNA, 15 nt, Homo sapiens
gagacuauccaaagc

SEQ ID NO: 35439 - RNA, 19 nt, Homo sapiens
uacugugcaucauggaagc

SEQ ID NO: 35440 - RNA, 18 nt, Homo sapiens
uaguaguguuuuguuguu

SEQ ID NO: 35441 - RNA, 18 nt, Homo sapiens
aaacgccuccuaacacau

SEQ ID NO: 35442 - RNA, 24 nt, Homo sapiens
aggggaaggggaggggaggggaag

SEQ ID NO: 35443 - RNA, 21 nt, Homo sapiens
caaauggacaguuuggaucua

SEQ ID NO: 35444 - RNA, 17 nt, Homo sapiens
ggaccccuaccugaggg

SEQ ID NO: 35445 - RNA, 18 nt, Homo sapiens
ggaguaaaugaacuggau

SEQ ID NO: 35446 - RNA, 17 nt, Homo sapiens
guuuuaaacgccuccua

SEQ ID NO: 35447 - RNA, 17 nt, Homo sapiens
ucuucccacccgagggc

SEQ ID NO: 35448 - RNA, 21 nt, Homo sapiens
ugaauguuagcauaugaaaga

SEQ ID NO: 35449 - RNA, 20 nt, Homo sapiens
ugccuggaagaugaggggaa

SEQ ID NO: 35450 - RNA, 19 nt, Homo sapiens
uguggcuagggccagcccu

SEQ ID NO: 35451 - RNA, 22 nt, Homo sapiens
cagccucccaaguagcuggggc

SEQ ID NO: 35452 - RNA, 20 nt, Homo sapiens
cuauguacucuucuuguucc

SEQ ID NO: 35453 - RNA, 23 nt, Homo sapiens
ugaugaaagaaacacuaugaaaa

SEQ ID NO: 35454 - RNA, 21 nt, Homo sapiens
agguggcugccgucuuccagc

SEQ ID NO: 35455 - RNA, 18 nt, Homo sapiens
gaagccacagcugcccuc

SEQ ID NO: 35456 - RNA, 18 nt, Homo sapiens
ggagaggcacuggggagg

SEQ ID NO: 35457 - RNA, 17 nt, Homo sapiens
ugucauacaccagguug

SEQ ID NO: 35458 - RNA, 20 nt, Homo sapiens
uguggagcagcucuaaguug

SEQ ID NO: 35459 - RNA, 18 nt, Homo sapiens
ggagaggcacuggggagg

SEQ ID NO: 35460 - RNA, 23 nt, Homo sapiens
uacccuggccaguucucucuccc

SEQ ID NO: 35461 - RNA, 19 nt, Homo sapiens
acagguggccagaaaaaga

SEQ ID NO: 35462 - RNA, 21 nt, Homo sapiens
acuccugcuggggucuuugua

SEQ ID NO: 35463 - RNA, 19 nt, Homo sapiens
agaggugggagcuaaggca

SEQ ID NO: 35464 - RNA, 22 nt, Homo sapiens
agccgagcuguuuauaauucga

SEQ ID NO: 35465 - RNA, 15 nt, Homo sapiens
cacaugccuugggga

SEQ ID NO: 35466 - RNA, 19 nt, Homo sapiens
cacuggcccugggcaaggg

SEQ ID NO: 35467 - RNA, 18 nt, Homo sapiens
cagcaggcccaggagcuc

SEQ ID NO: 35468 - RNA, 17 nt, Homo sapiens
ccaguggcggaggcagc

SEQ ID NO: 35469 - RNA, 20 nt, Homo sapiens
cccagggucacuagagugca

SEQ ID NO: 35470 - RNA, 19 nt, Homo sapiens
ccccacaagccccuucccc

SEQ ID NO: 35471 - RNA, 21 nt, Homo sapiens
ccccacaagccccuuccccau

SEQ ID NO: 35472 - RNA, 22 nt, Homo sapiens
ccccugcugcacugccaccacc

SEQ ID NO: 35473 - RNA, 22 nt, Homo sapiens
cgagcucaacagcugccuguuc

SEQ ID NO: 35474 - RNA, 21 nt, Homo sapiens
cuccugcuggggucuuuguag

SEQ ID NO: 35475 - RNA, 20 nt, Homo sapiens
gagccguuguccucgaggcu

SEQ ID NO: 35476 - RNA, 19 nt, Homo sapiens
gcacuuucuucucuccucc

SEQ ID NO: 35477 - RNA, 20 nt, Homo sapiens
ggcucuguuugguuugacaa

SEQ ID NO: 35478 - RNA, 24 nt, Homo sapiens
ucauguauauauuauauaauauuu

SEQ ID NO: 35479 - RNA, 20 nt, Homo sapiens
ucccacuccugcuggggucu

SEQ ID NO: 35480 - RNA, 17 nt, Homo sapiens
uccuuaaauggugguca

SEQ ID NO: 35481 - RNA, 20 nt, Homo sapiens
ugaggugccuugggucugag

SEQ ID NO: 35482 - RNA, 16 nt, Homo sapiens
ugcugagccacaugcc

SEQ ID NO: 35483 - RNA, 17 nt, Homo sapiens
uguuuccaccccgggag

SEQ ID NO: 35484 - RNA, 17 nt, Homo sapiens
uuuucccaacuguccag

SEQ ID NO: 35485 - RNA, 17 nt, Homo sapiens
acugguuaguuggagga

SEQ ID NO: 35486 - RNA, 20 nt, Homo sapiens
augacaaacucuggaaacug

SEQ ID NO: 35487 - RNA, 23 nt, Homo sapiens
ucagaaguucaaagauggauaag

SEQ ID NO: 35488 - RNA, 19 nt, Homo sapiens
uccacuucuuuucuggagc

SEQ ID NO: 35489 - RNA, 22 nt, Homo sapiens
uggaaaagugugcuauuuuuug

SEQ ID NO: 35490 - RNA, 20 nt, Homo sapiens
cggcaggcuuuuguagguuu

SEQ ID NO: 35491 - RNA, 18 nt, Homo sapiens
aagaaaaagaaauggaag

SEQ ID NO: 35492 - RNA, 18 nt, Homo sapiens
aagcagcaagaucccuaa

SEQ ID NO: 35493 - RNA, 20 nt, Homo sapiens
aauauauacaguauauauau

SEQ ID NO: 35494 - RNA, 19 nt, Homo sapiens
aauauauauauaaauauau

SEQ ID NO: 35495 - RNA, 22 nt, Homo sapiens
agaaggggugggagagaagaau

SEQ ID NO: 35496 - RNA, 19 nt, Homo sapiens
auauauauauauauauaua

SEQ ID NO: 35497 - RNA, 21 nt, Homo sapiens
auauauauauauauauauaua

SEQ ID NO: 35498 - RNA, 22 nt, Homo sapiens
auauauauauauauauauauaa

SEQ ID NO: 35499 - RNA, 22 nt, Homo sapiens
auauauauauauauauauauau

SEQ ID NO: 35500 - RNA, 23 nt, Homo sapiens
auauauauauauauauauauaua

SEQ ID NO: 35501 - RNA, 24 nt, Homo sapiens
auauauauauauauauauauauau

SEQ ID NO: 35502 - RNA, 25 nt, Homo sapiens
auauauauauaugaaauauauauau

SEQ ID NO: 35503 - RNA, 18 nt, Homo sapiens
cagaagaagagagaagaa

SEQ ID NO: 35504 - RNA, 20 nt, Homo sapiens
cagagcguugugcaccagcc

SEQ ID NO: 35505 - RNA, 16 nt, Homo sapiens
cauuucaccagagcuc

SEQ ID NO: 35506 - RNA, 17 nt, Homo sapiens
cccagagggaggaggaa

SEQ ID NO: 35507 - RNA, 21 nt, Homo sapiens
ccugugcagggcuauuguugg

SEQ ID NO: 35508 - RNA, 17 nt, Homo sapiens
cucucugcacuccugug

SEQ ID NO: 35509 - RNA, 18 nt, Homo sapiens
gacaaugagaaagggaau

SEQ ID NO: 35510 - RNA, 14 nt, Homo sapiens
gacuaaaugguauu

SEQ ID NO: 35511 - RNA, 21 nt, Homo sapiens
gaggccaaguccggcgcgguc

SEQ ID NO: 35512 - RNA, 18 nt, Homo sapiens
gcagauguauuagagagc

SEQ ID NO: 35513 - RNA, 18 nt, Homo sapiens
ggcaaacagaagaagaga

SEQ ID NO: 35514 - RNA, 21 nt, Homo sapiens
uaaguagccauggcgcuuuuc

SEQ ID NO: 35515 - RNA, 18 nt, Homo sapiens
uaagugaagaacggauag

SEQ ID NO: 35516 - RNA, 23 nt, Homo sapiens
uaauaggagccuguaauuacgug

SEQ ID NO: 35517 - RNA, 22 nt, Homo sapiens
uagccauggcgcuuuucagugu

SEQ ID NO: 35518 - RNA, 25 nt, Homo sapiens
uauaaauauauacaguauauauaua

SEQ ID NO: 35519 - RNA, 24 nt, Homo sapiens
uauauauaaauauauaaauauaua

SEQ ID NO: 35520 - RNA, 18 nt, Homo sapiens
uauauauauauauauaua

SEQ ID NO: 35521 - RNA, 22 nt, Homo sapiens
uauauauauauauauauauaua

SEQ ID NO: 35522 - RNA, 24 nt, Human papillomavirus type 25
uauauauauauauauauauauaua

SEQ ID NO: 35523 - RNA, 22 nt, Homo sapiens
uauauauauauaugaaauauau

SEQ ID NO: 35524 - RNA, 23 nt, Homo sapiens
uauauauauauaugaaauauaua

SEQ ID NO: 35525 - RNA, 25 nt, Homo sapiens
uauauauauauaugaaauauauaua

SEQ ID NO: 35526 - RNA, 27 nt, Homo sapiens
uauauauauauaugaaauauauauaua

SEQ ID NO: 35527 - RNA, 18 nt, Homo sapiens
ugacuguuggcaccuggu

SEQ ID NO: 35528 - RNA, 20 nt, Homo sapiens
ugguggugguaucccagagg

SEQ ID NO: 35529 - RNA, 27 nt, Homo sapiens
ugugccugacguuucacagacccccuu

SEQ ID NO: 35530 - RNA, 16 nt, Homo sapiens
caacagcuucuggccc

SEQ ID NO: 35531 - RNA, 20 nt, Homo sapiens
gaaggcuggaguccucugcu

SEQ ID NO: 35532 - RNA, 17 nt, Homo sapiens
ggcccugggguguggug

SEQ ID NO: 35533 - RNA, 21 nt, Homo sapiens
caagauggccuucauggauua

SEQ ID NO: 35534 - RNA, 17 nt, Homo sapiens
gacaaaaauaucuugau

SEQ ID NO: 35535 - RNA, 16 nt, Homo sapiens
uaggccuugcuauggu

SEQ ID NO: 35536 - RNA, 18 nt, Homo sapiens
ucaaugcuuuaaagggac

SEQ ID NO: 35537 - RNA, 15 nt, Homo sapiens
aguucugacuacucu

SEQ ID NO: 35538 - RNA, 23 nt, Homo sapiens
caaguuuaaguguauacacauuu

SEQ ID NO: 35539 - RNA, 14 nt, Homo sapiens
cgccgcggcggcgg

SEQ ID NO: 35540 - RNA, 25 nt, Homo sapiens
cgggcgcuggcggcaggagaaagcg

SEQ ID NO: 35541 - RNA, 19 nt, Homo sapiens
gguauauuuccacauauga

SEQ ID NO: 35542 - RNA, 17 nt, Homo sapiens
uaccuaguuaauaaaua

SEQ ID NO: 35543 - RNA, 19 nt, Homo sapiens
uauguuauagcuuacaaaa

SEQ ID NO: 35544 - RNA, 19 nt, Homo sapiens
aaaacccuccuacaagaag

SEQ ID NO: 35545 - RNA, 18 nt, Homo sapiens
aacacaaauuaaagcuau

SEQ ID NO: 35546 - RNA, 21 nt, Homo sapiens
aggcagcaaggggcuaaccau

SEQ ID NO: 35547 - RNA, 20 nt, Homo sapiens
caguauuuuucucauaaaaa

SEQ ID NO: 35548 - RNA, 14 nt, Homo sapiens
gggguuugugacua

SEQ ID NO: 35549 - RNA, 23 nt, Homo sapiens
uggaauaaugugggguuugugac

SEQ ID NO: 35550 - RNA, 18 nt, Homo sapiens
ucccacccucuuuaaucc

SEQ ID NO: 35551 - RNA, 23 nt, Homo sapiens
ugcauuguuugugugcggcaucu

SEQ ID NO: 35552 - RNA, 19 nt, Homo sapiens
aguggccaggggccugcgg

SEQ ID NO: 35553 - RNA, 19 nt, Homo sapiens
ccgcaaguuagagaaggag

SEQ ID NO: 35554 - RNA, 19 nt, Homo sapiens
ccucucgguccucacaggc

SEQ ID NO: 35555 - RNA, 17 nt, Homo sapiens
gagccgguguccacggu

SEQ ID NO: 35556 - RNA, 19 nt, Homo sapiens
gggcugucgggcuagucgg

SEQ ID NO: 35557 - RNA, 17 nt, Homo sapiens
ggguccagggagggagg

SEQ ID NO: 35558 - RNA, 17 nt, Homo sapiens
uaacacuggaggaauac

SEQ ID NO: 35559 - RNA, 21 nt, Homo sapiens
uacuggauauauucuuuacag

SEQ ID NO: 35560 - RNA, 20 nt, Homo sapiens
uccagggcuucgagaggcau

SEQ ID NO: 35561 - RNA, 18 nt, Homo sapiens
uccugcuggggcugucgg

SEQ ID NO: 35562 - RNA, 24 nt, Homo sapiens
ugaggaucugcugaaaaugccagc

SEQ ID NO: 35563 - RNA, 18 nt, Homo sapiens
ugauguuguuuguucuug

SEQ ID NO: 35564 - RNA, 15 nt, Homo sapiens
uggcaaggagcagca

SEQ ID NO: 35565 - RNA, 20 nt, Homo sapiens
uggccaggggccugcggugc

SEQ ID NO: 35566 - RNA, 23 nt, Homo sapiens
uucauaauuuuauuauacucuga

SEQ ID NO: 35567 - RNA, 22 nt, Homo sapiens
gcagaggugcgcaaaacaugga

SEQ ID NO: 35568 - RNA, 18 nt, Homo sapiens
ucaaagauuugcagaggu

SEQ ID NO: 35569 - RNA, 18 nt, Homo sapiens
ucaguuaauauuuuuacu

SEQ ID NO: 35570 - RNA, 19 nt, Homo sapiens
ucugacccuggacaugaga

SEQ ID NO: 35571 - RNA, 22 nt, Homo sapiens
acaugcugggcacugcacacuc

SEQ ID NO: 35572 - RNA, 18 nt, Homo sapiens
cacugacugacaggccuc

SEQ ID NO: 35573 - RNA, 18 nt, Homo sapiens
aaagaacaagucaccucu

SEQ ID NO: 35574 - RNA, 23 nt, Homo sapiens
aacaggaaggaggucagagcccg

SEQ ID NO: 35575 - RNA, 18 nt, Homo sapiens
aacgugguuucuguggcu

SEQ ID NO: 35576 - RNA, 20 nt, Homo sapiens
acccggccugagacugucau

SEQ ID NO: 35577 - RNA, 16 nt, Homo sapiens
accugagggaguggua

SEQ ID NO: 35578 - RNA, 19 nt, Homo sapiens
agggagggagaacauggga

SEQ ID NO: 35579 - RNA, 24 nt, Homo sapiens
aguggggccgguagcccucguaga

SEQ ID NO: 35580 - RNA, 14 nt, Homo sapiens
cagagcguuucagc

SEQ ID NO: 35581 - RNA, 17 nt, Homo sapiens
cagggcagugccugccu

SEQ ID NO: 35582 - RNA, 22 nt, Homo sapiens
ccucugacucuccugcgcaggg

SEQ ID NO: 35583 - RNA, 16 nt, Homo sapiens
cggaaguguuagaggc

SEQ ID NO: 35584 - RNA, 20 nt, Homo sapiens
cuuuaaaauucccccagcua

SEQ ID NO: 35585 - RNA, 18 nt, Homo sapiens
gaacauggaguuagcuuu

SEQ ID NO: 35586 - RNA, 18 nt, Homo sapiens
gccccucccaaagggcag

SEQ ID NO: 35587 - RNA, 16 nt, Homo sapiens
gcccguaccugaggga

SEQ ID NO: 35588 - RNA, 19 nt, Homo sapiens
gcccuuagagcguggcagc

SEQ ID NO: 35589 - RNA, 15 nt, Homo sapiens
gcugcaaugaugcgc

SEQ ID NO: 35590 - RNA, 16 nt, Homo sapiens
gguuucuguuuggccu

SEQ ID NO: 35591 - RNA, 24 nt, Homo sapiens
ugggagcaugugaauaaaauggca

SEQ ID NO: 35592 - RNA, 20 nt, Homo sapiens
ugggugguggagccucaggg

SEQ ID NO: 35593 - RNA, 18 nt, Homo sapiens
ggaaauauuucugggaua

SEQ ID NO: 35594 - RNA, 19 nt, Homo sapiens
ggaacuuaagggagaaaaa

SEQ ID NO: 35595 - RNA, 17 nt, Homo sapiens
ugcauuuccagaugugu

SEQ ID NO: 35596 - RNA, 22 nt, Homo sapiens
ugggagccuugggggagcagug

SEQ ID NO: 35597 - RNA, 21 nt, Homo sapiens
aagggacugauaaaggaaaaa

SEQ ID NO: 35598 - RNA, 16 nt, Homo sapiens
aggcagaggagaagcu

SEQ ID NO: 35599 - RNA, 17 nt, Homo sapiens
caacucucagaucaaaa

SEQ ID NO: 35600 - RNA, 22 nt, Homo sapiens
gaugaaacccucgucccggacg

SEQ ID NO: 35601 - RNA, 21 nt, Homo sapiens
ggcgguggcgguggcggcggc

SEQ ID NO: 35602 - RNA, 21 nt, Homo sapiens
gguggcggcggcugugcggcc

SEQ ID NO: 35603 - RNA, 17 nt, Homo sapiens
guggcgguggcggcggc

SEQ ID NO: 35604 - RNA, 26 nt, Homo sapiens
ucuaccacaggcaaacaguuuucucc

SEQ ID NO: 35605 - RNA, 26 nt, Homo sapiens
ucuaccacaggcaaacaguuuuuucc

SEQ ID NO: 35606 - RNA, 20 nt, Homo sapiens
uguaguuucaacacugcaac

SEQ ID NO: 35607 - RNA, 19 nt, Homo sapiens
agggggcggcuggccuugc

SEQ ID NO: 35608 - RNA, 18 nt, Homo sapiens
gggaagacagggggcggc

SEQ ID NO: 35609 - RNA, 21 nt, Homo sapiens
uacaguggcugcggccagccc

SEQ ID NO: 35610 - RNA, 23 nt, Homo sapiens
uggugucucagcuaagaaugccu

SEQ ID NO: 35611 - RNA, 15 nt, Homo sapiens
gccuugccacugcag

SEQ ID NO: 35612 - RNA, 21 nt, Homo sapiens
ucagugaggcaguccuucugc

SEQ ID NO: 35613 - RNA, 15 nt, Homo sapiens
aaagaguuggcuggc

SEQ ID NO: 35614 - RNA, 24 nt, Homo sapiens
cucauucuguaguguuuauuuuuc

SEQ ID NO: 35615 - RNA, 14 nt, Homo sapiens
uugccaguuccuca

SEQ ID NO: 35616 - RNA, 15 nt, Homo sapiens
caguggaaacagcca

SEQ ID NO: 35617 - RNA, 20 nt, Homo sapiens
gaugugggcuuggcugggug

SEQ ID NO: 35618 - RNA, 16 nt, Homo sapiens
ggcugcucucggccag

SEQ ID NO: 35619 - RNA, 17 nt, Homo sapiens
uccacaguuuuaagucg

SEQ ID NO: 35620 - RNA, 21 nt, Homo sapiens
ucuaaaacaaaaaaagcaaca

SEQ ID NO: 35621 - RNA, 16 nt, Homo sapiens
ugacacuaagaggcgc

SEQ ID NO: 35622 - RNA, 20 nt, Homo sapiens
ugcuuggcacgcgcugaagc

SEQ ID NO: 35623 - RNA, 21 nt, Homo sapiens
aaagaggucucguuuccucgc

SEQ ID NO: 35624 - RNA, 18 nt, Homo sapiens
agacaaugcuaaguacag

SEQ ID NO: 35625 - RNA, 21 nt, Homo sapiens
cacagguguguaccaccacgc

SEQ ID NO: 35626 - RNA, 21 nt, Homo sapiens
ccugggcuggagcguucuucc

SEQ ID NO: 35627 - RNA, 17 nt, Homo sapiens
ggggaaagaauucucaa

SEQ ID NO: 35628 - RNA, 16 nt, Homo sapiens
uagggguggugguggu

SEQ ID NO: 35629 - RNA, 21 nt, Homo sapiens
uggugguggugguggugguug

SEQ ID NO: 35630 - RNA, 19 nt, Homo sapiens
aaggaggugccaaaugacu

SEQ ID NO: 35631 - RNA, 16 nt, Homo sapiens
cagguauuauaaucau

SEQ ID NO: 35632 - RNA, 19 nt, Homo sapiens
gaggucaucaccaccaccu

SEQ ID NO: 35633 - RNA, 26 nt, Homo sapiens
guggaccgaaagcccuuagcuagaca

SEQ ID NO: 35634 - RNA, 18 nt, Homo sapiens
uaaggcaggaggaucgcu

SEQ ID NO: 35635 - RNA, 17 nt, Homo sapiens
uagaaaaaaugauuaga

SEQ ID NO: 35636 - RNA, 18 nt, Homo sapiens
ugugaugucuauuacugc

SEQ ID NO: 35637 - RNA, 17 nt, Homo sapiens
uuugucagaaggcugug

SEQ ID NO: 35638 - RNA, 17 nt, Homo sapiens
augcaauuauagcucau

SEQ ID NO: 35639 - RNA, 18 nt, Homo sapiens
gacaggaggaucacuuga

SEQ ID NO: 35640 - RNA, 18 nt, Homo sapiens
gcgccgcgcgcgggcucc

SEQ ID NO: 35641 - RNA, 17 nt, Homo sapiens
uggcgccgcgcgcgggc

SEQ ID NO: 35642 - RNA, 15 nt, Homo sapiens
uguuggggagaguga

SEQ ID NO: 35643 - RNA, 19 nt, Homo sapiens
uaagacacucuaacacuuc

SEQ ID NO: 35644 - RNA, 18 nt, Homo sapiens
ucauuccuaaaugcuuaa

SEQ ID NO: 35645 - RNA, 16 nt, Homo sapiens
ugcgcagcguggggcc

SEQ ID NO: 35646 - RNA, 19 nt, Homo sapiens
aauguccaauuuauuuuua

SEQ ID NO: 35647 - RNA, 20 nt, Homo sapiens
cacaccaacaggauaguauc

SEQ ID NO: 35648 - RNA, 19 nt, Homo sapiens
gagccgccgccgcgccgcu

SEQ ID NO: 35649 - RNA, 19 nt, Homo sapiens
guuuuuuaaacacaaaaca

SEQ ID NO: 35650 - RNA, 19 nt, Homo sapiens
uaauauauauaauauauac

SEQ ID NO: 35651 - RNA, 16 nt, Homo sapiens
acgcggcaggguccgc

SEQ ID NO: 35652 - RNA, 20 nt, Homo sapiens
ccuaugugccugcacagccu

SEQ ID NO: 35653 - RNA, 17 nt, Homo sapiens
ccuguuuucggcaggcu

SEQ ID NO: 35654 - RNA, 15 nt, Homo sapiens
gcccuuggacacggc

SEQ ID NO: 35655 - RNA, 19 nt, Homo sapiens
ggagguguggggaaagggg

SEQ ID NO: 35656 - RNA, 19 nt, Homo sapiens
ggggagguguggggaaagg

SEQ ID NO: 35657 - RNA, 20 nt, Homo sapiens
aggcagacacagucauucau

SEQ ID NO: 35658 - RNA, 22 nt, Homo sapiens
caacaagcucugggaggcaugg

SEQ ID NO: 35659 - RNA, 18 nt, Homo sapiens
caggcuugcguugccucc

SEQ ID NO: 35660 - RNA, 23 nt, Homo sapiens
cggcaggugagagggguuacaug

SEQ ID NO: 35661 - RNA, 20 nt, Homo sapiens
cuccuggggaagauuacaag

SEQ ID NO: 35662 - RNA, 18 nt, Homo sapiens
cugcggccucggggcccc

SEQ ID NO: 35663 - RNA, 20 nt, Homo sapiens
gcauucaucuugcacggcua

SEQ ID NO: 35664 - RNA, 17 nt, Homo sapiens
gcgcgggcaugacgccc

SEQ ID NO: 35665 - RNA, 20 nt, Homo sapiens
ggaaauagaugccaggaaca

SEQ ID NO: 35666 - RNA, 18 nt, Homo sapiens
guggauacugaggaaggc

SEQ ID NO: 35667 - RNA, 17 nt, Homo sapiens
uaacuaggugaauacug

SEQ ID NO: 35668 - RNA, 18 nt, Homo sapiens
uccccaacaaccauccag

SEQ ID NO: 35669 - RNA, 22 nt, Homo sapiens
ucuggaacuccugaccucauga

SEQ ID NO: 35670 - RNA, 14 nt, Homo sapiens
ugagagggguuaca

SEQ ID NO: 35671 - RNA, 22 nt, Homo sapiens
ugcucuguaagugugugcugac

SEQ ID NO: 35672 - RNA, 20 nt, Homo sapiens
uuuauaagcucauauacaug

SEQ ID NO: 35673 - RNA, 20 nt, Homo sapiens
uuugugcucuguaagugugu

SEQ ID NO: 35674 - RNA, 17 nt, Homo sapiens
aaggcaaguugggaaga

SEQ ID NO: 35675 - RNA, 20 nt, Homo sapiens
aggggcgggcggagcggggg

SEQ ID NO: 35676 - RNA, 22 nt, Homo sapiens
cauauauauaugcauauauaua

SEQ ID NO: 35677 - RNA, 21 nt, Homo sapiens
cgggcggagcgggggcgcgcg

SEQ ID NO: 35678 - RNA, 18 nt, Homo sapiens
cuuguuauucuuuggcuu

SEQ ID NO: 35679 - RNA, 18 nt, Homo sapiens
gaaaggcaauuuucagca

SEQ ID NO: 35680 - RNA, 19 nt, Homo sapiens
gcggagcgggggcgcgcgg

SEQ ID NO: 35681 - RNA, 20 nt, Homo sapiens
ggaggggcgggcggagcggg

SEQ ID NO: 35682 - RNA, 18 nt, Homo sapiens
ggcggagcgggggcgcgc

SEQ ID NO: 35683 - RNA, 18 nt, Homo sapiens
ggugguguggcagagcca

SEQ ID NO: 35684 - RNA, 23 nt, Homo sapiens
uaacuaugguucaagugugaaua

SEQ ID NO: 35685 - RNA, 16 nt, Homo sapiens
uacaacuuuaguugau

SEQ ID NO: 35686 - RNA, 19 nt, Homo sapiens
uauauauaugcauauauau

SEQ ID NO: 35687 - RNA, 18 nt, Homo sapiens
uauauaugcauauauaua

SEQ ID NO: 35688 - RNA, 18 nt, Homo sapiens
ugggacgaggaggagcgc

SEQ ID NO: 35689 - RNA, 18 nt, Homo sapiens
ugggaguugggggcagau

SEQ ID NO: 35690 - RNA, 19 nt, Homo sapiens
uaugagaagagagugaaau

SEQ ID NO: 35691 - RNA, 19 nt, Homo sapiens
agauggggguggcgggcgg

SEQ ID NO: 35692 - RNA, 16 nt, Homo sapiens
cucuauucuuugcccu

SEQ ID NO: 35693 - RNA, 18 nt, Homo sapiens
cugcguguuucuacguca

SEQ ID NO: 35694 - RNA, 19 nt, Homo sapiens
aagcugaacggggcaggaa

SEQ ID NO: 35695 - RNA, 19 nt, Homo sapiens
acccagagacacagaaucc

SEQ ID NO: 35696 - RNA, 21 nt, Homo sapiens
aggggugggggcagugauggg

SEQ ID NO: 35697 - RNA, 20 nt, Homo sapiens
agugaagcugaacggggcag

SEQ ID NO: 35698 - RNA, 22 nt, Homo sapiens
agugggggaacccgggucaagg

SEQ ID NO: 35699 - RNA, 17 nt, Homo sapiens
cagagagaaaagguaga

SEQ ID NO: 35700 - RNA, 18 nt, Homo sapiens
cucucaucuaccuuucug

SEQ ID NO: 35701 - RNA, 22 nt, Homo sapiens
ggggugggggcagugauggggg

SEQ ID NO: 35702 - RNA, 20 nt, Homo sapiens
gugaaguccucaaucaaggg

SEQ ID NO: 35703 - RNA, 17 nt, Homo sapiens
uccccucugcugccuga

SEQ ID NO: 35704 - RNA, 15 nt, Homo sapiens
ugaaguccucaauca

SEQ ID NO: 35705 - RNA, 16 nt, Homo sapiens
ugcuuuaaucaagggg

SEQ ID NO: 35706 - RNA, 20 nt, Homo sapiens
acaguugcccuguuggggaa

SEQ ID NO: 35707 - RNA, 19 nt, Homo sapiens
ucuaccaaauccacgugga

SEQ ID NO: 35708 - RNA, 21 nt, Homo sapiens
ugcaggagcugcgcguagggc

SEQ ID NO: 35709 - RNA, 19 nt, Homo sapiens
uucgccacuugugcuuugu

SEQ ID NO: 35710 - RNA, 20 nt, Homo sapiens
aggugggccucguuagacug

SEQ ID NO: 35711 - RNA, 15 nt, Homo sapiens
gagaggagccugcgg

SEQ ID NO: 35712 - RNA, 17 nt, Homo sapiens
gaggagggccacggccg

SEQ ID NO: 35713 - RNA, 18 nt, Homo sapiens
ggcuggcagcccggccug

SEQ ID NO: 35714 - RNA, 20 nt, Homo sapiens
uaauguauacaguuugggcu

SEQ ID NO: 35715 - RNA, 22 nt, Homo sapiens
ucugggaugaaauuguacagga

SEQ ID NO: 35716 - RNA, 23 nt, Homo sapiens
ugccaauaaugaugauuggcgaa

SEQ ID NO: 35717 - RNA, 21 nt, Homo sapiens
ugcggcuggcagcccggccug

SEQ ID NO: 35718 - RNA, 17 nt, Homo sapiens
ugcuguacugagaggcu

SEQ ID NO: 35719 - RNA, 16 nt, Homo sapiens
uguucagagucuugaa

SEQ ID NO: 35720 - RNA, 19 nt, Homo sapiens
uuagaaggcacauugcuga

SEQ ID NO: 35721 - RNA, 16 nt, Homo sapiens
uugaagggaaagagaa

SEQ ID NO: 35722 - RNA, 20 nt, Homo sapiens
uuggugaaguggcauuuauu

SEQ ID NO: 35723 - RNA, 18 nt, Homo sapiens
uuucucucaucgggccuu

SEQ ID NO: 35724 - RNA, 21 nt, Homo sapiens
agcccaucgggcggcggcggc

SEQ ID NO: 35725 - RNA, 20 nt, Homo sapiens
aggguucgugcaggcccuuc

SEQ ID NO: 35726 - RNA, 19 nt, Homo sapiens
cccggcccgcggggccugg

SEQ ID NO: 35727 - RNA, 25 nt, Homo sapiens
ccgcugcccgggccaucggccucgu

SEQ ID NO: 35728 - RNA, 17 nt, Homo sapiens
cgccgcccccgcugccc

SEQ ID NO: 35729 - RNA, 18 nt, Homo sapiens
cgcugcuguggccccccg

SEQ ID NO: 35730 - RNA, 19 nt, Homo sapiens
cgggcggcggcggcucggc

SEQ ID NO: 35731 - RNA, 23 nt, Homo sapiens
cucgucguagucggagcuccgag

SEQ ID NO: 35732 - RNA, 19 nt, Homo sapiens
cugaggcugccggggcugg

SEQ ID NO: 35733 - RNA, 17 nt, Homo sapiens
gcccuuccuggagcccg

SEQ ID NO: 35734 - RNA, 21 nt, Homo sapiens
gccgcugguggccgcccggcc

SEQ ID NO: 35735 - RNA, 17 nt, Homo sapiens
gccuggccaccgccugc

SEQ ID NO: 35736 - RNA, 25 nt, Homo sapiens
gcgcccgaggacgcgugucguacgg

SEQ ID NO: 35737 - RNA, 19 nt, Homo sapiens
gcuccgggccgggccuggg

SEQ ID NO: 35738 - RNA, 17 nt, Homo sapiens
ggagccccgguaguagc

SEQ ID NO: 35739 - RNA, 24 nt, Homo sapiens
ggcggcggcggcucggcgccucgg

SEQ ID NO: 35740 - RNA, 17 nt, Homo sapiens
gggacccgggggccccu

SEQ ID NO: 35741 - RNA, 20 nt, Homo sapiens
ggggcugggagcgcggcggc

SEQ ID NO: 35742 - RNA, 21 nt, Homo sapiens
guggccgcccggcccggccug

SEQ ID NO: 35743 - RNA, 24 nt, Homo sapiens
ucgggucgggggcucagaaggcgg

SEQ ID NO: 35744 - RNA, 24 nt, Homo sapiens
ugccggggcugggagcgcggcggc

SEQ ID NO: 35745 - RNA, 19 nt, Homo sapiens
accccaccggccccuuccc

SEQ ID NO: 35746 - RNA, 22 nt, Homo sapiens
cccuaucuccacagguccugcc

SEQ ID NO: 35747 - RNA, 20 nt, Homo sapiens
uaauuuuacaagaauuagga

SEQ ID NO: 35748 - RNA, 18 nt, Homo sapiens
ugcuggggggcagaggga

SEQ ID NO: 35749 - RNA, 14 nt, Homo sapiens
uuccugauuuguag

SEQ ID NO: 35750 - RNA, 17 nt, Homo sapiens
caaagcaccacacggcc

SEQ ID NO: 35751 - RNA, 18 nt, Homo sapiens
gaggggacguggcuuguc

SEQ ID NO: 35752 - RNA, 21 nt, Homo sapiens
agacagcgagucgggccuucc

SEQ ID NO: 35753 - RNA, 19 nt, Homo sapiens
agggucauuucaguugacg

SEQ ID NO: 35754 - RNA, 18 nt, Homo sapiens
uaagagcaguauccagug

SEQ ID NO: 35755 - RNA, 20 nt, Homo sapiens
uauacaguaaaacauaguua

SEQ ID NO: 35756 - RNA, 21 nt, Homo sapiens
ucgccaccggccagcugugcc

SEQ ID NO: 35757 - RNA, 21 nt, Homo sapiens
ucucuccuuuuuuuuaauauu

SEQ ID NO: 35758 - RNA, 18 nt, Homo sapiens
ugucccucucuccuuuuu

SEQ ID NO: 35759 - RNA, 18 nt, Homo sapiens
acccucugggugugaggc

SEQ ID NO: 35760 - RNA, 22 nt, Homo sapiens
aggaucugggagggauccuggg

SEQ ID NO: 35761 - RNA, 18 nt, Homo sapiens
aguccgccgcgugcagcc

SEQ ID NO: 35762 - RNA, 18 nt, Homo sapiens
cacaaccuuguaggugcc

SEQ ID NO: 35763 - RNA, 20 nt, Homo sapiens
caccagcuggcccccagggc

SEQ ID NO: 35764 - RNA, 17 nt, Homo sapiens
cagccgccgccgccucc

SEQ ID NO: 35765 - RNA, 17 nt, Homo sapiens
cagcggcuccugcagca

SEQ ID NO: 35766 - RNA, 19 nt, Homo sapiens
cagggcugcgucucuccug

SEQ ID NO: 35767 - RNA, 17 nt, Homo sapiens
cccgccgcuucucuacc

SEQ ID NO: 35768 - RNA, 22 nt, Homo sapiens
ccgccuccggcccgccccgccc

SEQ ID NO: 35769 - RNA, 19 nt, Homo sapiens
cgugaccggguagccaacg

SEQ ID NO: 35770 - RNA, 18 nt, Homo sapiens
cuguugguagaguuucag

SEQ ID NO: 35771 - RNA, 16 nt, Homo sapiens
gcagggguuggugggg

SEQ ID NO: 35772 - RNA, 24 nt, Homo sapiens
gccccgggggugguguucuuggcc

SEQ ID NO: 35773 - RNA, 19 nt, Homo sapiens
gcccguuccccgcccggcc

SEQ ID NO: 35774 - RNA, 16 nt, Homo sapiens
gcccuugacccaggcc

SEQ ID NO: 35775 - RNA, 25 nt, Homo sapiens
gccuccggcccgccccgcccguucc

SEQ ID NO: 35776 - RNA, 17 nt, Homo sapiens
gggcuccagucaccuga

SEQ ID NO: 35777 - RNA, 18 nt, Homo sapiens
gggcugcuggacaguggg

SEQ ID NO: 35778 - RNA, 18 nt, Homo sapiens
ucaagcauuugcccugcc

SEQ ID NO: 35779 - RNA, 20 nt, Homo sapiens
uggaagccgaugggguggaa

SEQ ID NO: 35780 - RNA, 16 nt, Homo sapiens
uggcacgcagcucagc

SEQ ID NO: 35781 - RNA, 19 nt, Homo sapiens
agcuggcacagggggccac

SEQ ID NO: 35782 - RNA, 17 nt, Homo sapiens
cccguuccccgcccggc

SEQ ID NO: 35783 - RNA, 22 nt, Homo sapiens
ccgccccgcccguuccccgccc

SEQ ID NO: 35784 - RNA, 21 nt, Homo sapiens
ccgccgcgugcagccuggauc

SEQ ID NO: 35785 - RNA, 16 nt, Homo sapiens
gcagaggaucugggag

SEQ ID NO: 35786 - RNA, 20 nt, Homo sapiens
gcccgccccgcccguucccc

SEQ ID NO: 35787 - RNA, 23 nt, Homo sapiens
gcccgccccgcccguuccccgcc

SEQ ID NO: 35788 - RNA, 22 nt, Homo sapiens
gcugccccccgccgucuggccg

SEQ ID NO: 35789 - RNA, 19 nt, Homo sapiens
ccgcguccccggcuccggc

SEQ ID NO: 35790 - RNA, 22 nt, Homo sapiens
gucgcaagagcuccgcggccgg

SEQ ID NO: 35791 - RNA, 19 nt, Homo sapiens
uccgccguggcuugugcga

SEQ ID NO: 35792 - RNA, 17 nt, Homo sapiens
uuccuccgcgcgcugcg

SEQ ID NO: 35793 - RNA, 14 nt, Homo sapiens
cuagggccuuugag

SEQ ID NO: 35794 - RNA, 20 nt, Homo sapiens
gagguaaggccagaaaggua

SEQ ID NO: 35795 - RNA, 23 nt, Homo sapiens
ggguggggcagggggauaggggu

SEQ ID NO: 35796 - RNA, 22 nt, Homo sapiens
uauuaugggagauaccaagaaa

SEQ ID NO: 35797 - RNA, 20 nt, Homo sapiens
ugaggaggguggggcagggg

SEQ ID NO: 35798 - RNA, 18 nt, Homo sapiens
uugcauucucuuaguaau

SEQ ID NO: 35799 - RNA, 22 nt, Homo sapiens
uucagcauagguuauuccuggu

SEQ ID NO: 35800 - RNA, 17 nt, Homo sapiens
cuguucccagucccagc

SEQ ID NO: 35801 - RNA, 21 nt, Homo sapiens
gagugcgaugcugggaguggg

SEQ ID NO: 35802 - RNA, 21 nt, Homo sapiens
ggagcuccugaaagccggcca

SEQ ID NO: 35803 - RNA, 18 nt, Homo sapiens
ggcuggggaguggcuggg

SEQ ID NO: 35804 - RNA, 17 nt, Homo sapiens
gggccugcuggagaggg

SEQ ID NO: 35805 - RNA, 20 nt, Homo sapiens
guugugugguggguaccgaa

SEQ ID NO: 35806 - RNA, 20 nt, Homo sapiens
ucugggcucuccagauggcc

SEQ ID NO: 35807 - RNA, 18 nt, Homo sapiens
uggggaguggcuggggga

SEQ ID NO: 35808 - RNA, 19 nt, Homo sapiens
aaaacugcacuguagagca

SEQ ID NO: 35809 - RNA, 22 nt, Homo sapiens
aauguacugcgaguucuugaaa

SEQ ID NO: 35810 - RNA, 20 nt, Homo sapiens
agggaaggggaggagaggga

SEQ ID NO: 35811 - RNA, 19 nt, Homo sapiens
aggggaggggaagaggagg

SEQ ID NO: 35812 - RNA, 18 nt, Homo sapiens
augcaguuugggaugggg

SEQ ID NO: 35813 - RNA, 19 nt, Homo sapiens
cagggcugcugauuguucc

SEQ ID NO: 35814 - RNA, 18 nt, Homo sapiens
cccuagucucagccucgg

SEQ ID NO: 35815 - RNA, 23 nt, Homo sapiens
cgugaccguaggugucgcgugcg

SEQ ID NO: 35816 - RNA, 18 nt, Homo sapiens
gaagaguaccgagaacuc

SEQ ID NO: 35817 - RNA, 18 nt, Homo sapiens
gaccguaggugucgcgug

SEQ ID NO: 35818 - RNA, 18 nt, Homo sapiens
gagccaacaggacaucaa

SEQ ID NO: 35819 - RNA, 15 nt, Homo sapiens
gagcuacacuucccg

SEQ ID NO: 35820 - RNA, 23 nt, Homo sapiens
gcccucgcucuuccgcggguagc

SEQ ID NO: 35821 - RNA, 22 nt, Homo sapiens
gcucuggagcgcaccgcgcggc

SEQ ID NO: 35822 - RNA, 15 nt, Homo sapiens
ggaggagagggaggg

SEQ ID NO: 35823 - RNA, 15 nt, Homo sapiens
ggccagaagaaaaca

SEQ ID NO: 35824 - RNA, 17 nt, Homo sapiens
ucuuuuggucaaguuuc

SEQ ID NO: 35825 - RNA, 18 nt, Homo sapiens
ugaaagaggaauugcugu

SEQ ID NO: 35826 - RNA, 18 nt, Homo sapiens
ugauaucuugagcauuac

SEQ ID NO: 35827 - RNA, 18 nt, Homo sapiens
uuaggaaauuuuugccgu

SEQ ID NO: 35828 - RNA, 24 nt, Homo sapiens
uugagguucaaucuuuacauucag

SEQ ID NO: 35829 - RNA, 19 nt, Homo sapiens
uugcacuuuaggaaauuuu

SEQ ID NO: 35830 - RNA, 20 nt, Homo sapiens
uugggauggggguaggcggg

SEQ ID NO: 35831 - RNA, 19 nt, Homo sapiens
uuucguuuuucguuuuuuu

SEQ ID NO: 35832 - RNA, 21 nt, Homo sapiens
uuuuucguuuuuuuuguuuuu

SEQ ID NO: 35833 - RNA, 18 nt, Homo sapiens
acccgccugccuguccac

SEQ ID NO: 35834 - RNA, 20 nt, Homo sapiens
aggacacuagauccagggaa

SEQ ID NO: 35835 - RNA, 17 nt, Homo sapiens
cacuaguugccagggcc

SEQ ID NO: 35836 - RNA, 19 nt, Homo sapiens
cagaggguguggacgggug

SEQ ID NO: 35837 - RNA, 23 nt, Homo sapiens
gugccuuguuucugugcugcugu

SEQ ID NO: 35838 - RNA, 18 nt, Homo sapiens
ucaaggccaggcuguugg

SEQ ID NO: 35839 - RNA, 19 nt, Homo sapiens
ugccuuguuucugugcugc

SEQ ID NO: 35840 - RNA, 24 nt, Homo sapiens
ucauauuucccagcaucauaaaaa

SEQ ID NO: 35841 - RNA, 19 nt, Homo sapiens
gaggacuggggguaaucuu

SEQ ID NO: 35842 - RNA, 19 nt, Homo sapiens
gcagggggaagggaagcgc

SEQ ID NO: 35843 - RNA, 21 nt, Homo sapiens
gcagggggaagggaagcgcuc

SEQ ID NO: 35844 - RNA, 19 nt, Homo sapiens
ggagcagggggaggaacgg

SEQ ID NO: 35845 - RNA, 15 nt, Homo sapiens
ggugggaggugggga

SEQ ID NO: 35846 - RNA, 18 nt, Homo sapiens
guuggaaggagagggaaa

SEQ ID NO: 35847 - RNA, 21 nt, Homo sapiens
ucggacucuccuggccuggcu

SEQ ID NO: 35848 - RNA, 18 nt, Homo sapiens
uggcuuuccugucuacag

SEQ ID NO: 35849 - RNA, 21 nt, Homo sapiens
aagguacuuucuauggggaaa

SEQ ID NO: 35850 - RNA, 20 nt, Homo sapiens
agaaggaaaaagggaggggg

SEQ ID NO: 35851 - RNA, 22 nt, Homo sapiens
uaaagcuccaaguauauuugac

SEQ ID NO: 35852 - RNA, 19 nt, Homo sapiens
ucgaaucucucuccuuuua

SEQ ID NO: 35853 - RNA, 21 nt, Homo sapiens
uuucaagugcuguugccucau

SEQ ID NO: 35854 - RNA, 16 nt, Homo sapiens
aggggucugaaaaucu

SEQ ID NO: 35855 - RNA, 22 nt, Homo sapiens
caguauugggcaaguuuucugu

SEQ ID NO: 35856 - RNA, 16 nt, Homo sapiens
ccugaagagagcgggg

SEQ ID NO: 35857 - RNA, 21 nt, Homo sapiens
ccuugucaccuccucugacag

SEQ ID NO: 35858 - RNA, 21 nt, Homo sapiens
gagaaucaauuggaaaugaac

SEQ ID NO: 35859 - RNA, 18 nt, Homo sapiens
gcauuucaauugccuugu

SEQ ID NO: 35860 - RNA, 19 nt, Homo sapiens
guauguucaauacauuauu

SEQ ID NO: 35861 - RNA, 23 nt, Homo sapiens
uccuucaauaggagccuggugag

SEQ ID NO: 35862 - RNA, 23 nt, Homo sapiens
ucgaacuccugaccucaagugau

SEQ ID NO: 35863 - RNA, 22 nt, Homo sapiens
ugguaaucgcuagagguugccu

SEQ ID NO: 35864 - RNA, 17 nt, Homo sapiens
uguaaaauuuugaaaga

SEQ ID NO: 35865 - RNA, 24 nt, Homo sapiens
uucugaguagcugggauuacagga

SEQ ID NO: 35866 - RNA, 17 nt, Homo sapiens
aaggucuucgguguguc

SEQ ID NO: 35867 - RNA, 18 nt, Homo sapiens
gcgcggggcgcagagcgg

SEQ ID NO: 35868 - RNA, 19 nt, Homo sapiens
ugagcagugcaggacugaa

SEQ ID NO: 35869 - RNA, 22 nt, Homo sapiens
ugcuccuucuuguuucucauug

SEQ ID NO: 35870 - RNA, 20 nt, Homo sapiens
uuuccauuccauucaugaaa

SEQ ID NO: 35871 - RNA, 17 nt, Homo sapiens
gggaaggaugggagggg

SEQ ID NO: 35872 - RNA, 21 nt, Homo sapiens
agaggaaagcggggcaggaag

SEQ ID NO: 35873 - RNA, 22 nt, Homo sapiens
aacaagggucaacccucgugcc

SEQ ID NO: 35874 - RNA, 24 nt, Homo sapiens
aaggggcagcuaggcggccugagc

SEQ ID NO: 35875 - RNA, 16 nt, Homo sapiens
aaggugggugggcugg

SEQ ID NO: 35876 - RNA, 20 nt, Homo sapiens
acgcaggaugcagacgcggc

SEQ ID NO: 35877 - RNA, 18 nt, Homo sapiens
acgccggcggcaugaagc

SEQ ID NO: 35878 - RNA, 21 nt, Homo sapiens
cacgguuauuagggcaguggu

SEQ ID NO: 35879 - RNA, 21 nt, Homo sapiens
cagcggcccagcaggcggcag

SEQ ID NO: 35880 - RNA, 18 nt, Homo sapiens
ccgcacagcagcgcaccc

SEQ ID NO: 35881 - RNA, 18 nt, Homo sapiens
ccguccgugcucccagcc

SEQ ID NO: 35882 - RNA, 17 nt, Homo sapiens
cgaaggccaaggcaaac

SEQ ID NO: 35883 - RNA, 20 nt, Homo sapiens
cgcagcagggccgacagugc

SEQ ID NO: 35884 - RNA, 18 nt, Homo sapiens
cucugaugacaggagggg

SEQ ID NO: 35885 - RNA, 22 nt, Homo sapiens
gaaggugggugggcuggguggu

SEQ ID NO: 35886 - RNA, 17 nt, Homo sapiens
gcagcugcgcgggcgcc

SEQ ID NO: 35887 - RNA, 19 nt, Homo sapiens
ggacucuuucuggggagga

SEQ ID NO: 35888 - RNA, 16 nt, Homo sapiens
ggaggguggcccagag

SEQ ID NO: 35889 - RNA, 18 nt, Homo sapiens
guauuuagcuggggaaga

SEQ ID NO: 35890 - RNA, 21 nt, Homo sapiens
ucugcaauauuggugcgauga

SEQ ID NO: 35891 - RNA, 17 nt, Homo sapiens
ugaguccuuuagcaacc

SEQ ID NO: 35892 - RNA, 15 nt, Homo sapiens
ugcagggcccagcag

SEQ ID NO: 35893 - RNA, 20 nt, Homo sapiens
ugcuggggucccgagguggc

SEQ ID NO: 35894 - RNA, 18 nt, Homo sapiens
ugggacggccguccccag

SEQ ID NO: 35895 - RNA, 19 nt, Homo sapiens
ugggggaaggcugacugca

SEQ ID NO: 35896 - RNA, 17 nt, Homo sapiens
ccuggugcucuccuccu

SEQ ID NO: 35897 - RNA, 19 nt, Homo sapiens
gcccccccaggcccaccug

SEQ ID NO: 35898 - RNA, 18 nt, Homo sapiens
ucccccuuccccucuccg

SEQ ID NO: 35899 - RNA, 23 nt, Homo sapiens
ucuaguggcggaagcaaccccug

SEQ ID NO: 35900 - RNA, 18 nt, Homo sapiens
ugcccuagagcgcagggc

SEQ ID NO: 35901 - RNA, 16 nt, Homo sapiens
ugggcagaacacuuuu

SEQ ID NO: 35902 - RNA, 16 nt, Homo sapiens
cgacaggcuccggcgg

SEQ ID NO: 35903 - RNA, 24 nt, Homo sapiens
aauauuuuaauucucagacucucu

SEQ ID NO: 35904 - RNA, 17 nt, Homo sapiens
acagcuuucacauuccc

SEQ ID NO: 35905 - RNA, 18 nt, Homo sapiens
caacagacacgcaggguu

SEQ ID NO: 35906 - RNA, 15 nt, Homo sapiens
cagacaaaucaggua

SEQ ID NO: 35907 - RNA, 15 nt, Homo sapiens
ccaggccauggaugc

SEQ ID NO: 35908 - RNA, 16 nt, Homo sapiens
gcaggaaguaggggga

SEQ ID NO: 35909 - RNA, 20 nt, Homo sapiens
gcuaguguagaaucuucuca

SEQ ID NO: 35910 - RNA, 20 nt, Homo sapiens
ggagucaaagaaagaaagca

SEQ ID NO: 35911 - RNA, 23 nt, Homo sapiens
guauuggaaaauaaaaaauacaa

SEQ ID NO: 35912 - RNA, 15 nt, Homo sapiens
uaacaugcugguagg

SEQ ID NO: 35913 - RNA, 21 nt, Homo sapiens
uagaaggaaugagaacuguca

SEQ ID NO: 35914 - RNA, 23 nt, Homo sapiens
ugaaagaaagauuggugagcagg

SEQ ID NO: 35915 - RNA, 22 nt, Homo sapiens
ugacagaugcuuuuuccccagg

SEQ ID NO: 35916 - RNA, 15 nt, Homo sapiens
uucaaauaucucacu

SEQ ID NO: 35917 - RNA, 24 nt, Homo sapiens
uucccuuuuauuagauaccacaca

SEQ ID NO: 35918 - RNA, 19 nt, Homo sapiens
uuuguugguucaauaaauu

SEQ ID NO: 35919 - RNA, 18 nt, Homo sapiens
aagagggcuuuuucucuu

SEQ ID NO: 35920 - RNA, 18 nt, Homo sapiens
auuuauuguacuggagga

SEQ ID NO: 35921 - RNA, 18 nt, Homo sapiens
cugcugcugcugcugccg

SEQ ID NO: 35922 - RNA, 18 nt, Homo sapiens
ggcagccaauucagcugc

SEQ ID NO: 35923 - RNA, 17 nt, Homo sapiens
ugccugggaaugagaga

SEQ ID NO: 35924 - RNA, 19 nt, Homo sapiens
uggaguagaagcaugauac

SEQ ID NO: 35925 - RNA, 21 nt, Homo sapiens
ugggaggaggugccaaagagg

SEQ ID NO: 35926 - RNA, 18 nt, Homo sapiens
uuuaugauguguauacua

SEQ ID NO: 35927 - RNA, 14 nt, Homo sapiens
aacaccauuuguau

SEQ ID NO: 35928 - RNA, 17 nt, Homo sapiens
cccagcccuuccccucc

SEQ ID NO: 35929 - RNA, 20 nt, Homo sapiens
gggccggggcuggggcuggg

SEQ ID NO: 35930 - RNA, 18 nt, Homo sapiens
ggggccggggcuggggcu

SEQ ID NO: 35931 - RNA, 23 nt, Homo sapiens
aguaggaggagcaacgggagaau

SEQ ID NO: 35932 - RNA, 19 nt, Homo sapiens
cccuggccagucuccuucc

SEQ ID NO: 35933 - RNA, 18 nt, Homo sapiens
uagcagaugcugcuaaca

SEQ ID NO: 35934 - RNA, 21 nt, Homo sapiens
ucuuucauggaaaucuucuca

SEQ ID NO: 35935 - RNA, 20 nt, Homo sapiens
aaugugcauuugaccaaaga

SEQ ID NO: 35936 - RNA, 19 nt, Homo sapiens
caggucgcgggccgagcgu

SEQ ID NO: 35937 - RNA, 17 nt, Homo sapiens
cgcggggcgagggccgc

SEQ ID NO: 35938 - RNA, 17 nt, Homo sapiens
gcaagaaugcagucuac

SEQ ID NO: 35939 - RNA, 21 nt, Homo sapiens
gugcuuuucuuagcuucucug

SEQ ID NO: 35940 - RNA, 19 nt, Homo sapiens
aaacuaucacuuaaaguga

SEQ ID NO: 35941 - RNA, 20 nt, Homo sapiens
aguggguguuucaguagccg

SEQ ID NO: 35942 - RNA, 21 nt, Homo sapiens
augaauuugguagugcaguag

SEQ ID NO: 35943 - RNA, 18 nt, Homo sapiens
cgugguggugggcgccug

SEQ ID NO: 35944 - RNA, 16 nt, Homo sapiens
gcgccgggagggugcc

SEQ ID NO: 35945 - RNA, 22 nt, Homo sapiens
guuuauuuuuuaaacuaucacu

SEQ ID NO: 35946 - RNA, 24 nt, Homo sapiens
uaagucuaaaacacauagauuuua

SEQ ID NO: 35947 - RNA, 20 nt, Homo sapiens
ugcccugaguucuuucuccc

SEQ ID NO: 35948 - RNA, 16 nt, Homo sapiens
ugcuaccaaaaagcag

SEQ ID NO: 35949 - RNA, 15 nt, Homo sapiens
uggcaugcggucuuc

SEQ ID NO: 35950 - RNA, 19 nt, Homo sapiens
uggguguuucaguagccgu

SEQ ID NO: 35951 - RNA, 18 nt, Homo sapiens
ugguagugcaguaggggu

SEQ ID NO: 35952 - RNA, 20 nt, Homo sapiens
uuuaaaaagucaaggccauc

SEQ ID NO: 35953 - RNA, 16 nt, Homo sapiens
uuuaccaguugucugu

SEQ ID NO: 35954 - RNA, 18 nt, Homo sapiens
uuuauuacuaaaauaucc

SEQ ID NO: 35955 - RNA, 23 nt, Homo sapiens
uuucuucuauuauuuuaaaauuu

SEQ ID NO: 35956 - RNA, 15 nt, Homo sapiens
uuugugcaugcuucu

SEQ ID NO: 35957 - RNA, 24 nt, Homo sapiens
uuuucuuuuauacauucaaaauuu

SEQ ID NO: 35958 - RNA, 17 nt, Homo sapiens
aaaaaaagaagggaagg

SEQ ID NO: 35959 - RNA, 19 nt, Homo sapiens
cuggcugaccucgggaaug

SEQ ID NO: 35960 - RNA, 21 nt, Homo sapiens
gccccgcggcuccuccggccc

SEQ ID NO: 35961 - RNA, 22 nt, Homo sapiens
gccgcccgggucccggacuccc

SEQ ID NO: 35962 - RNA, 20 nt, Homo sapiens
gcggagcgugugcugagacg

SEQ ID NO: 35963 - RNA, 16 nt, Homo sapiens
gcuccgggacacacgu

SEQ ID NO: 35964 - RNA, 16 nt, Homo sapiens
ggcccagaugccgccc

SEQ ID NO: 35965 - RNA, 17 nt, Homo sapiens
gggagggcgggaagugg

SEQ ID NO: 35966 - RNA, 20 nt, Homo sapiens
gggggagcggacaggcgguc

SEQ ID NO: 35967 - RNA, 19 nt, Homo sapiens
gugugccaguguucacauu

SEQ ID NO: 35968 - RNA, 19 nt, Homo sapiens
ucgcggcgaggagacggcg

SEQ ID NO: 35969 - RNA, 21 nt, Homo sapiens
ugcaucuaguacuuauacagu

SEQ ID NO: 35970 - RNA, 17 nt, Homo sapiens
ugggggagcggacaggc

SEQ ID NO: 35971 - RNA, 18 nt, Homo sapiens
gggcgggaagugggggag

SEQ ID NO: 35972 - RNA, 18 nt, Homo sapiens
ucccggcucugggugggu

SEQ ID NO: 35973 - RNA, 21 nt, Homo sapiens
uuuacauuagcagacacauac

SEQ ID NO: 35974 - RNA, 23 nt, Homo sapiens
aacuggacacacugucuuugcaa

SEQ ID NO: 35975 - RNA, 17 nt, Homo sapiens
agaggcagacucaggac

SEQ ID NO: 35976 - RNA, 18 nt, Homo sapiens
aguccuuguacuuggugc

SEQ ID NO: 35977 - RNA, 17 nt, Homo sapiens
ccauguucacaccugcc

SEQ ID NO: 35978 - RNA, 19 nt, Homo sapiens
cucgcggcccgggcgcggc

SEQ ID NO: 35979 - RNA, 22 nt, Homo sapiens
cuuugguaugugccaugcagcu

SEQ ID NO: 35980 - RNA, 25 nt, Homo sapiens
gaggaaaccaggacucuguuuggaa

SEQ ID NO: 35981 - RNA, 17 nt, Homo sapiens
gcccgcccgcgccggcc

SEQ ID NO: 35982 - RNA, 18 nt, Homo sapiens
uagguuaucaucacucgc

SEQ ID NO: 35983 - RNA, 14 nt, Homo sapiens
ucagguauuaauca

SEQ ID NO: 35984 - RNA, 23 nt, Homo sapiens
ugaaguggagcccagcccuccug

SEQ ID NO: 35985 - RNA, 19 nt, Homo sapiens
ugugcucugcccucugcca

SEQ ID NO: 35986 - RNA, 19 nt, Homo sapiens
cugccgccgucugcgccgc

SEQ ID NO: 35987 - RNA, 17 nt, Homo sapiens
uccaacccauggcgagu

SEQ ID NO: 35988 - RNA, 19 nt, Homo sapiens
aacagauggggccgugaga

SEQ ID NO: 35989 - RNA, 19 nt, Homo sapiens
cagggcccacgcuauucua

SEQ ID NO: 35990 - RNA, 18 nt, Homo sapiens
cugcuggguuugugccuc

SEQ ID NO: 35991 - RNA, 19 nt, Homo sapiens
ucaguauugccauuguauu

SEQ ID NO: 35992 - RNA, 20 nt, Homo sapiens
ugaagguuggagacaucugu

SEQ ID NO: 35993 - RNA, 15 nt, Homo sapiens
ccuggggccaccagg

SEQ ID NO: 35994 - RNA, 23 nt, Homo sapiens
agccccucuucagauauauuuuc

SEQ ID NO: 35995 - RNA, 15 nt, Homo sapiens
augguagccacaugu

SEQ ID NO: 35996 - RNA, 16 nt, Homo sapiens
caaggacgcugcagcc

SEQ ID NO: 35997 - RNA, 14 nt, Homo sapiens
gaaacacugaaaga

SEQ ID NO: 35998 - RNA, 24 nt, Homo sapiens
uauauagcuccagagaauagugag

SEQ ID NO: 35999 - RNA, 24 nt, Homo sapiens
uccugggcucaaacaaccugcuug

SEQ ID NO: 36000 - RNA, 21 nt, Homo sapiens
ucgaacuccugaccucaugau

SEQ ID NO: 36001 - RNA, 21 nt, Homo sapiens
ucuuagucacaaaagcugcuu

SEQ ID NO: 36002 - RNA, 18 nt, Homo sapiens
uguccuuaagcacaagcc

SEQ ID NO: 36003 - RNA, 22 nt, Homo sapiens
ugugguacccacaaggaagccu

SEQ ID NO: 36004 - RNA, 21 nt, Homo sapiens
uguuaaaaagaaaaaaaugua

SEQ ID NO: 36005 - RNA, 22 nt, Homo sapiens
uucgucaugauguccaagcugu

SEQ ID NO: 36006 - RNA, 19 nt, Homo sapiens
aauggcuagccauuuugga

SEQ ID NO: 36007 - RNA, 19 nt, Homo sapiens
acagcugcucuccaggcag

SEQ ID NO: 36008 - RNA, 20 nt, Homo sapiens
acaguauuguuagguacagc

SEQ ID NO: 36009 - RNA, 15 nt, Homo sapiens
aggcgagggggccgc

SEQ ID NO: 36010 - RNA, 22 nt, Homo sapiens
cacgucgccaucuggcuggccc

SEQ ID NO: 36011 - RNA, 22 nt, Homo sapiens
ccgccgcccgggccuugggagc

SEQ ID NO: 36012 - RNA, 21 nt, Homo sapiens
cgccucggccccgccucgugc

SEQ ID NO: 36013 - RNA, 18 nt, Homo sapiens
gaacagggaaggcgaggg

SEQ ID NO: 36014 - RNA, 19 nt, Homo sapiens
gacuacaggcgugugccac

SEQ ID NO: 36015 - RNA, 20 nt, Homo sapiens
gaggcgggucagcggccugg

SEQ ID NO: 36016 - RNA, 18 nt, Homo sapiens
gggcagggaggcggguca

SEQ ID NO: 36017 - RNA, 18 nt, Homo sapiens
uaauguacauuacaguau

SEQ ID NO: 36018 - RNA, 23 nt, Homo sapiens
ucagaggcaucgguaauacauuu

SEQ ID NO: 36019 - RNA, 24 nt, Homo sapiens
ucaguagagacaggguuagcuugg

SEQ ID NO: 36020 - RNA, 18 nt, Homo sapiens
ucauagcaauauaaugaa

SEQ ID NO: 36021 - RNA, 17 nt, Homo sapiens
ugccugggaacagggaa

SEQ ID NO: 36022 - RNA, 19 nt, Homo sapiens
gccgcagcuguggcccaug

SEQ ID NO: 36023 - RNA, 19 nt, Homo sapiens
uaacgcucagagugcguca

SEQ ID NO: 36024 - RNA, 18 nt, Homo sapiens
ugggguguuuuucggguu

SEQ ID NO: 36025 - RNA, 22 nt, Homo sapiens
ugggguguuuuucggguuuggu

SEQ ID NO: 36026 - RNA, 20 nt, Homo sapiens
aguuaacaagaugguugucc

SEQ ID NO: 36027 - RNA, 17 nt, Homo sapiens
uggaaucaauaguuaac

SEQ ID NO: 36028 - RNA, 18 nt, Homo sapiens
agucaccgcgcccggccc

SEQ ID NO: 36029 - RNA, 17 nt, Homo sapiens
ccccaccuuggaacggu

SEQ ID NO: 36030 - RNA, 21 nt, Homo sapiens
gccugcccgccgcggcuguuu

SEQ ID NO: 36031 - RNA, 25 nt, Homo sapiens
uucuccuuuggaaucuuucugcaca

SEQ ID NO: 36032 - RNA, 18 nt, Homo sapiens
aagccaugccugcugcca

SEQ ID NO: 36033 - RNA, 18 nt, Homo sapiens
aggaggcggcggcggcga

SEQ ID NO: 36034 - RNA, 18 nt, Homo sapiens
aguaaggauuaguuucug

SEQ ID NO: 36035 - RNA, 19 nt, Homo sapiens
caaaacauccuuuuucugu

SEQ ID NO: 36036 - RNA, 17 nt, Homo sapiens
ccaugggcaguggguug

SEQ ID NO: 36037 - RNA, 17 nt, Homo sapiens
cccgccgccccuagucc

SEQ ID NO: 36038 - RNA, 26 nt, Homo sapiens
cucccgcccgcgcugcagccgcgcgg

SEQ ID NO: 36039 - RNA, 17 nt, Homo sapiens
gcggcggcgacaucgcg

SEQ ID NO: 36040 - RNA, 22 nt, Homo sapiens
ggcggcggcggcgacaucgcgu

SEQ ID NO: 36041 - RNA, 16 nt, Homo sapiens
ggcucuggcggcggcu

SEQ ID NO: 36042 - RNA, 20 nt, Homo sapiens
gggagggccagaucaugugc

SEQ ID NO: 36043 - RNA, 26 nt, Homo sapiens
ucaggcagcaguuugcugcgcaucug

SEQ ID NO: 36044 - RNA, 16 nt, Homo sapiens
ugacuuuugaccugca

SEQ ID NO: 36045 - RNA, 17 nt, Homo sapiens
ugccaguggggacauau

SEQ ID NO: 36046 - RNA, 21 nt, Homo sapiens
uguuucuauauaaaacagaga

SEQ ID NO: 36047 - RNA, 15 nt, Homo sapiens
uucccaaucccaggc

SEQ ID NO: 36048 - RNA, 20 nt, Homo sapiens
ccccugccccugcccccgcc

SEQ ID NO: 36049 - RNA, 21 nt, Homo sapiens
ccuguaaguuuccauuucaua

SEQ ID NO: 36050 - RNA, 19 nt, Homo sapiens
gcagccuccgcuuggcuuc

SEQ ID NO: 36051 - RNA, 22 nt, Homo sapiens
gggaaggggcgggaccacgggc

SEQ ID NO: 36052 - RNA, 24 nt, Homo sapiens
gggaaggggcgggaccacgggcgg

SEQ ID NO: 36053 - RNA, 18 nt, Homo sapiens
uauauuacaaaauauauu

SEQ ID NO: 36054 - RNA, 18 nt, Homo sapiens
uccgcuuggcuucuuuca

SEQ ID NO: 36055 - RNA, 22 nt, Homo sapiens
uucacugauauuuaaguccugu

SEQ ID NO: 36056 - RNA, 21 nt, Homo sapiens
agacaauaccuuauuugacau

SEQ ID NO: 36057 - RNA, 23 nt, Homo sapiens
cuuaaacucacuauggcaggucc

SEQ ID NO: 36058 - RNA, 16 nt, Homo sapiens
gagucugaauucagcc

SEQ ID NO: 36059 - RNA, 19 nt, Homo sapiens
agacgggggcugggggcug

SEQ ID NO: 36060 - RNA, 19 nt, Homo sapiens
ccgcugcgcagcggcagug

SEQ ID NO: 36061 - RNA, 19 nt, Homo sapiens
ccggcccaggcggaccggg

SEQ ID NO: 36062 - RNA, 15 nt, Homo sapiens
cggcgcuccacgccc

SEQ ID NO: 36063 - RNA, 20 nt, Homo sapiens
gagagccugcggccgcccuc

SEQ ID NO: 36064 - RNA, 18 nt, Homo sapiens
gagaggagagccugcggc

SEQ ID NO: 36065 - RNA, 23 nt, Homo sapiens
ggggccgccaugagcccgagggc

SEQ ID NO: 36066 - RNA, 17 nt, Homo sapiens
gggggacagacgggggc

SEQ ID NO: 36067 - RNA, 18 nt, Homo sapiens
uaacgagaggagagccug

SEQ ID NO: 36068 - RNA, 17 nt, Homo sapiens
aggugaaggaugaugga

SEQ ID NO: 36069 - RNA, 18 nt, Homo sapiens
ccaccacgcccgguuaac

SEQ ID NO: 36070 - RNA, 17 nt, Homo sapiens
gcccgccucggccuccc

SEQ ID NO: 36071 - RNA, 19 nt, Homo sapiens
gggagaaaaggccacugca

SEQ ID NO: 36072 - RNA, 18 nt, Homo sapiens
ucuugcucuguugcccag

SEQ ID NO: 36073 - RNA, 20 nt, Homo sapiens
uuugccagagugcccacggu

SEQ ID NO: 36074 - RNA, 20 nt, Homo sapiens
agaaggaagggagacagaaa

SEQ ID NO: 36075 - RNA, 17 nt, Homo sapiens
ccgggauaauuccaggu

SEQ ID NO: 36076 - RNA, 18 nt, Homo sapiens
ccucucggcuugaagaac

SEQ ID NO: 36077 - RNA, 22 nt, Homo sapiens
cucaguuuccagccagccaggg

SEQ ID NO: 36078 - RNA, 19 nt, Homo sapiens
ucuguuuuuuucccuuuuu

SEQ ID NO: 36079 - RNA, 18 nt, Homo sapiens
uucuucuccucuuucucu

SEQ ID NO: 36080 - RNA, 21 nt, Homo sapiens
uuggcuggcguagggagagga

SEQ ID NO: 36081 - RNA, 22 nt, Homo sapiens
uuugcaauuugugcaaaguucu

SEQ ID NO: 36082 - RNA, 19 nt, Homo sapiens
agagaucaaggcagcauug

SEQ ID NO: 36083 - RNA, 17 nt, Homo sapiens
caccgccccacaccccc

SEQ ID NO: 36084 - RNA, 16 nt, Homo sapiens
cacuucuuggggugca

SEQ ID NO: 36085 - RNA, 17 nt, Homo sapiens
cagguccuggggguggg

SEQ ID NO: 36086 - RNA, 15 nt, Homo sapiens
cccucgccccucccc

SEQ ID NO: 36087 - RNA, 18 nt, Homo sapiens
gcggcggagugcaggggg

SEQ ID NO: 36088 - RNA, 16 nt, Homo sapiens
ggagaucgacguuuug

SEQ ID NO: 36089 - RNA, 19 nt, Homo sapiens
ggaggagagaggaaaacag

SEQ ID NO: 36090 - RNA, 19 nt, Homo sapiens
ggguggggguggugagugg

SEQ ID NO: 36091 - RNA, 21 nt, Homo sapiens
ugcagaucggggcugggggcu

SEQ ID NO: 36092 - RNA, 17 nt, Homo sapiens
uggggugggggugguga

SEQ ID NO: 36093 - RNA, 19 nt, Homo sapiens
ugggguggggguggugagu

SEQ ID NO: 36094 - RNA, 22 nt, Homo sapiens
ugggguggggguggugaguggg

SEQ ID NO: 36095 - RNA, 22 nt, Homo sapiens
aagaugaaucaccucaagguuu

SEQ ID NO: 36096 - RNA, 23 nt, Homo sapiens
cauuaauauaaauuuuuucuuau

SEQ ID NO: 36097 - RNA, 22 nt, Homo sapiens
cugaagucuaacgugauuauuu

SEQ ID NO: 36098 - RNA, 15 nt, Homo sapiens
aaaaccccagggcgg

SEQ ID NO: 36099 - RNA, 24 nt, Homo sapiens
cagcacuuguaguuuuucccccaa

SEQ ID NO: 36100 - RNA, 18 nt, Homo sapiens
caguccugcaggcuuuca

SEQ ID NO: 36101 - RNA, 19 nt, Homo sapiens
ccagaggagggcacgccac

SEQ ID NO: 36102 - RNA, 19 nt, Homo sapiens
ccgugaguggugggcagaa

SEQ ID NO: 36103 - RNA, 21 nt, Homo sapiens
gagggcacgccaccuuccagu

SEQ ID NO: 36104 - RNA, 18 nt, Homo sapiens
gaggggggccuugccggc

SEQ ID NO: 36105 - RNA, 17 nt, Homo sapiens
gcuggcgggcugagggg

SEQ ID NO: 36106 - RNA, 17 nt, Homo sapiens
ggaccagcaaagguagg

SEQ ID NO: 36107 - RNA, 17 nt, Homo sapiens
ggcacgccaccuuccag

SEQ ID NO: 36108 - RNA, 20 nt, Homo sapiens
ggccugcaaggccagugucc

SEQ ID NO: 36109 - RNA, 16 nt, Homo sapiens
ggccuggaaggucuca

SEQ ID NO: 36110 - RNA, 25 nt, Homo sapiens
ugucuggaaaugauuuucaaaaaga

SEQ ID NO: 36111 - RNA, 18 nt, Homo sapiens
agauuuaagccuuuuuau

SEQ ID NO: 36112 - RNA, 17 nt, Homo sapiens
ugagaucaaucuuggcu

SEQ ID NO: 36113 - RNA, 18 nt, Homo sapiens
uugucugcuuccaaaguc

SEQ ID NO: 36114 - RNA, 18 nt, Homo sapiens
agcggccauugcgcaaca

SEQ ID NO: 36115 - RNA, 21 nt, Homo sapiens
cacgggguugauggggugggg

SEQ ID NO: 36116 - RNA, 16 nt, Homo sapiens
ccgcucaucguccugg

SEQ ID NO: 36117 - RNA, 19 nt, Homo sapiens
cggugccuugaacguuuua

SEQ ID NO: 36118 - RNA, 20 nt, Homo sapiens
ggggaaggugaaggcugggc

SEQ ID NO: 36119 - RNA, 18 nt, Homo sapiens
gugcacucagcaccaggc

SEQ ID NO: 36120 - RNA, 24 nt, Homo sapiens
caacagggccugguuuucaguggc

SEQ ID NO: 36121 - RNA, 26 nt, Homo sapiens
cagcggagggaguggaggugcugcag

SEQ ID NO: 36122 - RNA, 17 nt, Homo sapiens
caucagcuuguuccaaa

SEQ ID NO: 36123 - RNA, 17 nt, Homo sapiens
ccagcgccggguccauu

SEQ ID NO: 36124 - RNA, 20 nt, Homo sapiens
cccacaccuccucuaguguc

SEQ ID NO: 36125 - RNA, 24 nt, Homo sapiens
cugccgccucugguaccacaggcg

SEQ ID NO: 36126 - RNA, 14 nt, Homo sapiens
cugcggggucgcgg

SEQ ID NO: 36127 - RNA, 20 nt, Homo sapiens
gccacagccucgcucaucug

SEQ ID NO: 36128 - RNA, 19 nt, Homo sapiens
gccagagugcaucgcaugg

SEQ ID NO: 36129 - RNA, 19 nt, Homo sapiens
ggugccuggaggcuggagc

SEQ ID NO: 36130 - RNA, 21 nt, Homo sapiens
agccagccuguccaugggcag

SEQ ID NO: 36131 - RNA, 20 nt, Homo sapiens
gccagguccuggggccaggg

SEQ ID NO: 36132 - RNA, 18 nt, Homo sapiens
gcuuccuccgagccgccg

SEQ ID NO: 36133 - RNA, 16 nt, Homo sapiens
agccaaacuuguccau

SEQ ID NO: 36134 - RNA, 21 nt, Homo sapiens
aggcagugcaggggcuggccc

SEQ ID NO: 36135 - RNA, 17 nt, Homo sapiens
aucauccucgccacccc

SEQ ID NO: 36136 - RNA, 20 nt, Homo sapiens
caaucuucggcaccgagagc

SEQ ID NO: 36137 - RNA, 20 nt, Homo sapiens
cauccggcugcuggcccggc

SEQ ID NO: 36138 - RNA, 22 nt, Homo sapiens
ccagcauagggaagccggaagc

SEQ ID NO: 36139 - RNA, 15 nt, Homo sapiens
cccacacaaguuucu

SEQ ID NO: 36140 - RNA, 17 nt, Homo sapiens
gcaauguacaaacacaa

SEQ ID NO: 36141 - RNA, 17 nt, Homo sapiens
ggcaaaguggcggggug

SEQ ID NO: 36142 - RNA, 16 nt, Homo sapiens
ggccacgacggaggcc

SEQ ID NO: 36143 - RNA, 22 nt, Homo sapiens
gggcuagggggagggggucggg

SEQ ID NO: 36144 - RNA, 23 nt, Homo sapiens
cccgguuggggcucagcuguccc

SEQ ID NO: 36145 - RNA, 19 nt, Homo sapiens
cugcuucuccaccagcggc

SEQ ID NO: 36146 - RNA, 18 nt, Homo sapiens
cugguuaagagggggcca

SEQ ID NO: 36147 - RNA, 21 nt, Homo sapiens
uagagauuugcugggguuggg

SEQ ID NO: 36148 - RNA, 22 nt, Homo sapiens
ugcugggguugggggccagggu

SEQ ID NO: 36149 - RNA, 18 nt, Homo sapiens
gaaggccaguauaucuuu

SEQ ID NO: 36150 - RNA, 23 nt, Homo sapiens
aacacaauuugcacuggccauag

SEQ ID NO: 36151 - RNA, 16 nt, Homo sapiens
aggaggaggaggaaga

SEQ ID NO: 36152 - RNA, 18 nt, Homo sapiens
augugguacagauuuaga

SEQ ID NO: 36153 - RNA, 17 nt, Homo sapiens
cagcugcugcggcagca

SEQ ID NO: 36154 - RNA, 15 nt, Homo sapiens
cccgucccucugggu

SEQ ID NO: 36155 - RNA, 22 nt, Homo sapiens
ccuucgcccacuugccccucgc

SEQ ID NO: 36156 - RNA, 22 nt, Homo sapiens
gaggaggaggaagaggaggagc

SEQ ID NO: 36157 - RNA, 20 nt, Homo sapiens
gaggaggaggaggaagagga

SEQ ID NO: 36158 - RNA, 18 nt, Homo sapiens
uaguaauugucaacccuu

SEQ ID NO: 36159 - RNA, 22 nt, Homo sapiens
ucccuucgcccacuugccccuc

SEQ ID NO: 36160 - RNA, 18 nt, Homo sapiens
ucgcccacuugccccucg

SEQ ID NO: 36161 - RNA, 20 nt, Homo sapiens
ucgcccacuugccccucgcc

SEQ ID NO: 36162 - RNA, 19 nt, Homo sapiens
aagagaaagucguugaugg

SEQ ID NO: 36163 - RNA, 19 nt, Homo sapiens
aaugugaucucgggguggg

SEQ ID NO: 36164 - RNA, 21 nt, Homo sapiens
acagagaaugcgacccaccuc

SEQ ID NO: 36165 - RNA, 18 nt, Homo sapiens
agggaggggccgaaaaca

SEQ ID NO: 36166 - RNA, 23 nt, Homo sapiens
aucaugcucuucucacaguaucg

SEQ ID NO: 36167 - RNA, 18 nt, Homo sapiens
cacacuuuuauuuaagga

SEQ ID NO: 36168 - RNA, 19 nt, Homo sapiens
cagaccugauguuggggaa

SEQ ID NO: 36169 - RNA, 20 nt, Homo sapiens
cagcacucuggacuccacac

SEQ ID NO: 36170 - RNA, 20 nt, Homo sapiens
cagcgcucuggacuccacac

SEQ ID NO: 36171 - RNA, 19 nt, Homo sapiens
caggagcccuguggccaug

SEQ ID NO: 36172 - RNA, 18 nt, Homo sapiens
caggagccuguggccaug

SEQ ID NO: 36173 - RNA, 20 nt, Homo sapiens
ccacaggccuggaugcaccu

SEQ ID NO: 36174 - RNA, 17 nt, Homo sapiens
cuuucuucuucucugcu

SEQ ID NO: 36175 - RNA, 17 nt, Homo sapiens
gcagcagcugggaaugg

SEQ ID NO: 36176 - RNA, 20 nt, Homo sapiens
gcaggggcugcaagagcuuc

SEQ ID NO: 36177 - RNA, 21 nt, Homo sapiens
gccuucccugggggugccugg

SEQ ID NO: 36178 - RNA, 18 nt, Homo sapiens
ggcaggauguugucugga

SEQ ID NO: 36179 - RNA, 18 nt, Homo sapiens
gggugccuggccgggggc

SEQ ID NO: 36180 - RNA, 22 nt, Homo sapiens
ugggacaggauagggagcaggg

SEQ ID NO: 36181 - RNA, 24 nt, Homo sapiens
uggguuucaccuuuguaacaggau

SEQ ID NO: 36182 - RNA, 17 nt, Homo sapiens
cagcucccucccauggg

SEQ ID NO: 36183 - RNA, 18 nt, Homo sapiens
cagcucccucccaugggc

SEQ ID NO: 36184 - RNA, 14 nt, Homo sapiens
caggauuucaggcc

SEQ ID NO: 36185 - RNA, 17 nt, Homo sapiens
agcacacgguauacagu

SEQ ID NO: 36186 - RNA, 18 nt, Homo sapiens
caucuuucaaaagaauug

SEQ ID NO: 36187 - RNA, 25 nt, Homo sapiens
ugaaagguuaauuugguuaauaaga

SEQ ID NO: 36188 - RNA, 18 nt, Homo sapiens
aaagugcucggcauccuc

SEQ ID NO: 36189 - RNA, 16 nt, Homo sapiens
aagcauccccagagga

SEQ ID NO: 36190 - RNA, 15 nt, Homo sapiens
agggcgcacauuggc

SEQ ID NO: 36191 - RNA, 24 nt, Homo sapiens
aguggccuaucgaggagcaggaag

SEQ ID NO: 36192 - RNA, 20 nt, Homo sapiens
ccaggccccaugcuggagcc

SEQ ID NO: 36193 - RNA, 20 nt, Homo sapiens
cgcagcagcugggaaccggg

SEQ ID NO: 36194 - RNA, 16 nt, Homo sapiens
ggcagcccagcuggcc

SEQ ID NO: 36195 - RNA, 19 nt, Homo sapiens
ggccgccccgcgcagaccg

SEQ ID NO: 36196 - RNA, 16 nt, Homo sapiens
ggcugcugcguccggc

SEQ ID NO: 36197 - RNA, 15 nt, Homo sapiens
gggggaaggagagga

SEQ ID NO: 36198 - RNA, 24 nt, Homo sapiens
ucgcguuuacagauuuuuuuuuuc

SEQ ID NO: 36199 - RNA, 22 nt, Homo sapiens
ucuuccgugcacagcacucggc

SEQ ID NO: 36200 - RNA, 17 nt, Homo sapiens
ucuucggccaaagaacc

SEQ ID NO: 36201 - RNA, 16 nt, Homo sapiens
uggcccgccgcacggc

SEQ ID NO: 36202 - RNA, 18 nt, Homo sapiens
uuccggcaguccagggaa

SEQ ID NO: 36203 - RNA, 25 nt, Homo sapiens
agcccggggcugcggccgcggccca

SEQ ID NO: 36204 - RNA, 21 nt, Homo sapiens
aggccggcgucggggcggccg

SEQ ID NO: 36205 - RNA, 21 nt, Homo sapiens
cccggggcugcggccgcggcc

SEQ ID NO: 36206 - RNA, 21 nt, Homo sapiens
ccgaggggcgcuggggcugag

SEQ ID NO: 36207 - RNA, 21 nt, Homo sapiens
ccgcaggggugaggcaggagg

SEQ ID NO: 36208 - RNA, 18 nt, Homo sapiens
gccggcggcggcggcgcc

SEQ ID NO: 36209 - RNA, 18 nt, Homo sapiens
ggccggcggcggcggcgc

SEQ ID NO: 36210 - RNA, 19 nt, Homo sapiens
ggaaaugguagucacugug

SEQ ID NO: 36211 - RNA, 18 nt, Homo sapiens
ugugcugucuaaauguca

SEQ ID NO: 36212 - RNA, 19 nt, Homo sapiens
aauuaaauuguggccuuug

SEQ ID NO: 36213 - RNA, 22 nt, Homo sapiens
cauaagcauuauuuucucuguu

SEQ ID NO: 36214 - RNA, 19 nt, Homo sapiens
ccaauuaauuaaauugugg

SEQ ID NO: 36215 - RNA, 21 nt, Homo sapiens
cccuggccuuuuuagucuccc

SEQ ID NO: 36216 - RNA, 17 nt, Homo sapiens
gcacaguuguaauagcu

SEQ ID NO: 36217 - RNA, 22 nt, Homo sapiens
gcauggugugccuaucugaagg

SEQ ID NO: 36218 - RNA, 20 nt, Homo sapiens
uguggccuuuguuauuauaa

SEQ ID NO: 36219 - RNA, 18 nt, Homo sapiens
uucauuaaacuauauuau

SEQ ID NO: 36220 - RNA, 24 nt, Homo sapiens
agcaaagacaaaguuuuaaaaaaa

SEQ ID NO: 36221 - RNA, 16 nt, Homo sapiens
agggacacuggggcug

SEQ ID NO: 36222 - RNA, 24 nt, Homo sapiens
cggggacucgggggcacggcugcg

SEQ ID NO: 36223 - RNA, 18 nt, Homo sapiens
cuacugcugucuuuuguc

SEQ ID NO: 36224 - RNA, 17 nt, Homo sapiens
cucacaacccaugcaga

SEQ ID NO: 36225 - RNA, 17 nt, Homo sapiens
uccuggcgagcgcaugc

SEQ ID NO: 36226 - RNA, 18 nt, Homo sapiens
ucuggaagcaagggagga

SEQ ID NO: 36227 - RNA, 19 nt, Homo sapiens
ggcgguggcugccucgugc

SEQ ID NO: 36228 - RNA, 22 nt, Homo sapiens
aaacgggaggugcagcaggaag

SEQ ID NO: 36229 - RNA, 21 nt, Homo sapiens
aagggguuuuguguuggaauc

SEQ ID NO: 36230 - RNA, 18 nt, Homo sapiens
augaucuuugccugggau

SEQ ID NO: 36231 - RNA, 16 nt, Homo sapiens
cacaccugugcugaca

SEQ ID NO: 36232 - RNA, 18 nt, Homo sapiens
cagcaggccagggaugca

SEQ ID NO: 36233 - RNA, 23 nt, Homo sapiens
cagcaggccagggaugcagccuc

SEQ ID NO: 36234 - RNA, 20 nt, Homo sapiens
ccaccccagugcugagggag

SEQ ID NO: 36235 - RNA, 20 nt, Homo sapiens
ccagguaagggccgccccuu

SEQ ID NO: 36236 - RNA, 16 nt, Homo sapiens
cccagcugcccagccc

SEQ ID NO: 36237 - RNA, 20 nt, Homo sapiens
ccgccccuuccugccgccuc

SEQ ID NO: 36238 - RNA, 16 nt, Homo sapiens
gggguggggagggggg

SEQ ID NO: 36239 - RNA, 18 nt, Homo sapiens
uccaaaagagguuccaca

SEQ ID NO: 36240 - RNA, 21 nt, Homo sapiens
uccgcagaguccuggaaaacu

SEQ ID NO: 36241 - RNA, 19 nt, Homo sapiens
ucguugccuuccagaggcu

SEQ ID NO: 36242 - RNA, 20 nt, Homo sapiens
ugccgucuguauuacagcac

SEQ ID NO: 36243 - RNA, 17 nt, Homo sapiens
ugggucaaucuuuggcu

SEQ ID NO: 36244 - RNA, 25 nt, Homo sapiens
ggcagaagucgugguguugcgagac

SEQ ID NO: 36245 - RNA, 22 nt, Homo sapiens
ugggcagaagucgugguguugc

SEQ ID NO: 36246 - RNA, 21 nt, Homo sapiens
uugugacccuguuacacacac

SEQ ID NO: 36247 - RNA, 17 nt, Homo sapiens
aacaaagcagcgggguu

SEQ ID NO: 36248 - RNA, 21 nt, Homo sapiens
agaucuucugcacgcgugagu

SEQ ID NO: 36249 - RNA, 18 nt, Homo sapiens
caaaaccuuucaaggugg

SEQ ID NO: 36250 - RNA, 21 nt, Homo sapiens
gaggaggggaggggaaggggg

SEQ ID NO: 36251 - RNA, 23 nt, Homo sapiens
gaggggaaggggggggagaucuu

SEQ ID NO: 36252 - RNA, 23 nt, Homo sapiens
ucacccccucaaaguuuugcccc

SEQ ID NO: 36253 - RNA, 24 nt, Homo sapiens
uucugcacgcgugaguuuggguuu

SEQ ID NO: 36254 - RNA, 18 nt, Homo sapiens
gcccggggcagcggcugc

SEQ ID NO: 36255 - RNA, 15 nt, Homo sapiens
gccgccgcgggcgcc

SEQ ID NO: 36256 - RNA, 23 nt, Homo sapiens
gcgcccggcccggggcagcggcu

SEQ ID NO: 36257 - RNA, 23 nt, Homo sapiens
aggauauaucaguuuggacuugu

SEQ ID NO: 36258 - RNA, 20 nt, Homo sapiens
auggcccagcuccguguuuc

SEQ ID NO: 36259 - RNA, 24 nt, Homo sapiens
uaguguguggagggugggguggug

SEQ ID NO: 36260 - RNA, 20 nt, Homo sapiens
ucuguacagauagauaucua

SEQ ID NO: 36261 - RNA, 15 nt, Homo sapiens
ucugugcgucuccag

SEQ ID NO: 36262 - RNA, 25 nt, Homo sapiens
ugcgggaugagcaaaacaggaacuc

SEQ ID NO: 36263 - RNA, 19 nt, Homo sapiens
ugggaauagaugcacuuga

SEQ ID NO: 36264 - RNA, 23 nt, Homo sapiens
aucacuuuccuauuauuuauucu

SEQ ID NO: 36265 - RNA, 14 nt, Homo sapiens
ccacaagaguccuu

SEQ ID NO: 36266 - RNA, 20 nt, Homo sapiens
gggcagcgcgcgggcgcccg

SEQ ID NO: 36267 - RNA, 19 nt, Homo sapiens
uuauucuugguaacagaac

SEQ ID NO: 36268 - RNA, 18 nt, Homo sapiens
aggagguaggagacgucg

SEQ ID NO: 36269 - RNA, 17 nt, Homo sapiens
cagggcccuaagcugcc

SEQ ID NO: 36270 - RNA, 15 nt, Homo sapiens
caugggaggagggaa

SEQ ID NO: 36271 - RNA, 20 nt, Homo sapiens
ccuguaggucucaaucugca

SEQ ID NO: 36272 - RNA, 19 nt, Homo sapiens
cuccagguagauccaggga

SEQ ID NO: 36273 - RNA, 22 nt, Homo sapiens
gccaguuuuuagguuauuagaa

SEQ ID NO: 36274 - RNA, 19 nt, Homo sapiens
ggggcgcagggaggcgguc

SEQ ID NO: 36275 - RNA, 18 nt, Homo sapiens
ugagaggagguguggggc

SEQ ID NO: 36276 - RNA, 21 nt, Homo sapiens
ugccugaccggcucaccagcc

SEQ ID NO: 36277 - RNA, 21 nt, Homo sapiens
uggggcaagaccaaagcaggg

SEQ ID NO: 36278 - RNA, 23 nt, Homo sapiens
uguggggggcgggagacaauguc

SEQ ID NO: 36279 - RNA, 18 nt, Homo sapiens
aagcugcuugagaagugc

SEQ ID NO: 36280 - RNA, 15 nt, Homo sapiens
cagcgccccgccgcc

SEQ ID NO: 36281 - RNA, 21 nt, Homo sapiens
ccccaagcuuucagggaagcc

SEQ ID NO: 36282 - RNA, 18 nt, Homo sapiens
gaggggaggcgaggaagg

SEQ ID NO: 36283 - RNA, 22 nt, Homo sapiens
uggugaggagaaggaagcagga

SEQ ID NO: 36284 - RNA, 21 nt, Homo sapiens
aggucgacggucaggcggccg

SEQ ID NO: 36285 - RNA, 21 nt, Homo sapiens
cagccucuggccgcccaggug

SEQ ID NO: 36286 - RNA, 19 nt, Homo sapiens
ugcccaccccuuuuccguc

SEQ ID NO: 36287 - RNA, 16 nt, Homo sapiens
ccgcggccucgcagcc

SEQ ID NO: 36288 - RNA, 25 nt, Homo sapiens
ggagugauucagcugacaguguccg

SEQ ID NO: 36289 - RNA, 21 nt, Homo sapiens
gugaaaaaaguuuuagcccuc

SEQ ID NO: 36290 - RNA, 20 nt, Homo sapiens
cccccacaaugugcucuuuc

SEQ ID NO: 36291 - RNA, 20 nt, Homo sapiens
acgggcagaaaggagcaagc

SEQ ID NO: 36292 - RNA, 17 nt, Homo sapiens
ucuaaaacaugucuucu

SEQ ID NO: 36293 - RNA, 21 nt, Homo sapiens
agcagcagccagugcuucugu

SEQ ID NO: 36294 - RNA, 18 nt, Homo sapiens
agggcuuguggagggcga

SEQ ID NO: 36295 - RNA, 18 nt, Homo sapiens
cacuggcaagaccugcag

SEQ ID NO: 36296 - RNA, 18 nt, Homo sapiens
cagugcuucugugucccc

SEQ ID NO: 36297 - RNA, 18 nt, Homo sapiens
gcucacuguauuccucag

SEQ ID NO: 36298 - RNA, 19 nt, Homo sapiens
ggcaagaccugcagaucgu

SEQ ID NO: 36299 - RNA, 16 nt, Homo sapiens
ucugcuuuugcggucu

SEQ ID NO: 36300 - RNA, 17 nt, Homo sapiens
uggcaaagccagggugc

SEQ ID NO: 36301 - RNA, 22 nt, Homo sapiens
uguccagggguucacuggcaag

SEQ ID NO: 36302 - RNA, 15 nt, Homo sapiens
ccagccccucccucc

SEQ ID NO: 36303 - RNA, 24 nt, Homo sapiens
ccagccccucccucccuuccuucc

SEQ ID NO: 36304 - RNA, 21 nt, Homo sapiens
gagcagaugaccaauagcacc

SEQ ID NO: 36305 - RNA, 16 nt, Homo sapiens
gccccagacauaaaaa

SEQ ID NO: 36306 - RNA, 22 nt, Homo sapiens
uacuaaauuaguuuguauuacu

SEQ ID NO: 36307 - RNA, 27 nt, Homo sapiens
ucugcuuuuucucuuguacagaccucu

SEQ ID NO: 36308 - RNA, 20 nt, Homo sapiens
ugagaggaguaccccuuaga

SEQ ID NO: 36309 - RNA, 16 nt, Homo sapiens
cgggacccggcgcugc

SEQ ID NO: 36310 - RNA, 19 nt, Homo sapiens
gaagcccauggcaaauagg

SEQ ID NO: 36311 - RNA, 20 nt, Homo sapiens
auuuaguccaauaacauuga

SEQ ID NO: 36312 - RNA, 22 nt, Homo sapiens
ucucugcugccuguguguucuc

SEQ ID NO: 36313 - RNA, 22 nt, Homo sapiens
cccuggcccaccccccaaaugu

SEQ ID NO: 36314 - RNA, 22 nt, Homo sapiens
cccugucccaccccccaaaugu

SEQ ID NO: 36315 - RNA, 21 nt, Homo sapiens
ccuucccccccccaacccugu

SEQ ID NO: 36316 - RNA, 17 nt, Homo sapiens
cucaacuuguaguacug

SEQ ID NO: 36317 - RNA, 19 nt, Homo sapiens
ucugcaaugcugucgccug

SEQ ID NO: 36318 - RNA, 18 nt, Homo sapiens
aggucggcgggcaccacg

SEQ ID NO: 36319 - RNA, 23 nt, Homo sapiens
ccgagaagcgcuuguccuccgag

SEQ ID NO: 36320 - RNA, 16 nt, Homo sapiens
ggggucgugcgugggg

SEQ ID NO: 36321 - RNA, 21 nt, Homo sapiens
ucuugcugaggggcaucggcu

SEQ ID NO: 36322 - RNA, 17 nt, Homo sapiens
ugcguagaaggcucccg

SEQ ID NO: 36323 - RNA, 20 nt, Homo sapiens
aaagaggcuuauccugggga

SEQ ID NO: 36324 - RNA, 18 nt, Homo sapiens
ccuaccacauuuacaaac

SEQ ID NO: 36325 - RNA, 18 nt, Homo sapiens
gcuugaccuucccuuuuu

SEQ ID NO: 36326 - RNA, 23 nt, Homo sapiens
uauuaacuauaaaugcuguaaca

SEQ ID NO: 36327 - RNA, 23 nt, Homo sapiens
ucaaaucucuuacuucuuucggu

SEQ ID NO: 36328 - RNA, 20 nt, Homo sapiens
ugaaacauaucagaagcaag

SEQ ID NO: 36329 - RNA, 21 nt, Homo sapiens
ucuaggcacaaccaaaaauuu

SEQ ID NO: 36330 - RNA, 14 nt, Homo sapiens
uaacacgcccgaag

SEQ ID NO: 36331 - RNA, 16 nt, Homo sapiens
gcuccaauucccuucu

SEQ ID NO: 36332 - RNA, 15 nt, Homo sapiens
gguuucacuccauua

SEQ ID NO: 36333 - RNA, 18 nt, Homo sapiens
uacuuggcaauacaaacu

SEQ ID NO: 36334 - RNA, 20 nt, Homo sapiens
aagcaggaguucccccuuac

SEQ ID NO: 36335 - RNA, 17 nt, Homo sapiens
aagcggccucgguggga

SEQ ID NO: 36336 - RNA, 17 nt, Homo sapiens
agaaguuaccuuggugu

SEQ ID NO: 36337 - RNA, 20 nt, Homo sapiens
caacagcagcugguggugcu

SEQ ID NO: 36338 - RNA, 16 nt, Homo sapiens
cuccuggccuugacuu

SEQ ID NO: 36339 - RNA, 19 nt, Homo sapiens
gaagcaugaaaagccaugg

SEQ ID NO: 36340 - RNA, 20 nt, Homo sapiens
gccuaugcuugcugcugucc

SEQ ID NO: 36341 - RNA, 18 nt, Homo sapiens
gcuccuucucuuccguug

SEQ ID NO: 36342 - RNA, 18 nt, Homo sapiens
gcuugcugcuguccuucu

SEQ ID NO: 36343 - RNA, 18 nt, Homo sapiens
ggauuuuaugccaguuug

SEQ ID NO: 36344 - RNA, 21 nt, Homo sapiens
gggcugcauacaggcuccugu

SEQ ID NO: 36345 - RNA, 21 nt, Homo sapiens
ggugcuguggccaaaggcugg

SEQ ID NO: 36346 - RNA, 21 nt, Homo sapiens
gugauggauaucauaaaagcg

SEQ ID NO: 36347 - RNA, 18 nt, Homo sapiens
uaauccugagccuaugcu

SEQ ID NO: 36348 - RNA, 22 nt, Homo sapiens
ucucuugcuccacgucuauuuu

SEQ ID NO: 36349 - RNA, 19 nt, Homo sapiens
ugagcagauuuuuuucuuu

SEQ ID NO: 36350 - RNA, 23 nt, Homo sapiens
uggaguuuguucugccacugugc

SEQ ID NO: 36351 - RNA, 20 nt, Homo sapiens
uucucuugcuccacgucuau

SEQ ID NO: 36352 - RNA, 18 nt, Homo sapiens
caucucugcaaaucccaa

SEQ ID NO: 36353 - RNA, 21 nt, Homo sapiens
gaaagugaauauccuuuugcu

SEQ ID NO: 36354 - RNA, 23 nt, Homo sapiens
uaauauuuggcugcugguuuuug

SEQ ID NO: 36355 - RNA, 23 nt, Homo sapiens
uccaucaggagaccucuaauauu

SEQ ID NO: 36356 - RNA, 19 nt, Homo sapiens
ucucaguuuauguuuugcu

SEQ ID NO: 36357 - RNA, 20 nt, Homo sapiens
ucuuuucuucucucucccuu

SEQ ID NO: 36358 - RNA, 17 nt, Homo sapiens
uggcuuccuauuucuuu

SEQ ID NO: 36359 - RNA, 26 nt, Homo sapiens
ugggauaucugucaccuuaaauauuc

SEQ ID NO: 36360 - RNA, 21 nt, Homo sapiens
uguaucaugaaauauccauac

SEQ ID NO: 36361 - RNA, 18 nt, Homo sapiens
accugagucccugcgacg

SEQ ID NO: 36362 - RNA, 17 nt, Homo sapiens
cggauuuggcagaggau

SEQ ID NO: 36363 - RNA, 20 nt, Homo sapiens
cggggcuugggggggcugcg

SEQ ID NO: 36364 - RNA, 21 nt, Homo sapiens
cgguucuaggucucgcggggc

SEQ ID NO: 36365 - RNA, 18 nt, Homo sapiens
gaguuccgcgaaggcugc

SEQ ID NO: 36366 - RNA, 20 nt, Homo sapiens
gcuccugcuccgccccggcc

SEQ ID NO: 36367 - RNA, 20 nt, Homo sapiens
gggaggggagggggcucggg

SEQ ID NO: 36368 - RNA, 18 nt, Homo sapiens
gggccugcggagccgggg

SEQ ID NO: 36369 - RNA, 19 nt, Homo sapiens
gggcuugggggggcugcgg

SEQ ID NO: 36370 - RNA, 20 nt, Homo sapiens
ggggaggggagggggcucgg

SEQ ID NO: 36371 - RNA, 21 nt, Homo sapiens
ggggaggggccggcucccugg

SEQ ID NO: 36372 - RNA, 16 nt, Homo sapiens
ugaaggggccggcaag

SEQ ID NO: 36373 - RNA, 16 nt, Homo sapiens
aaagcaucuucaaagc

SEQ ID NO: 36374 - RNA, 18 nt, Homo sapiens
aacacuaguuuaauguuu

SEQ ID NO: 36375 - RNA, 22 nt, Homo sapiens
aauuguauaagcuacucauaag

SEQ ID NO: 36376 - RNA, 16 nt, Homo sapiens
acauuugauacauaga

SEQ ID NO: 36377 - RNA, 19 nt, Homo sapiens
ccugcggagugugcuugga

SEQ ID NO: 36378 - RNA, 16 nt, Homo sapiens
cucgccucgccacucg

SEQ ID NO: 36379 - RNA, 18 nt, Homo sapiens
cugucucugggucauguu

SEQ ID NO: 36380 - RNA, 22 nt, Homo sapiens
gcgaguccggggacccucaggc

SEQ ID NO: 36381 - RNA, 19 nt, Homo sapiens
ggaaacaaauugaaacuuu

SEQ ID NO: 36382 - RNA, 19 nt, Homo sapiens
ggugauauuuugugaauag

SEQ ID NO: 36383 - RNA, 18 nt, Homo sapiens
guguuaucaucaagguau

SEQ ID NO: 36384 - RNA, 20 nt, Homo sapiens
uaacaauaucauuuuaaaac

SEQ ID NO: 36385 - RNA, 20 nt, Homo sapiens
ucuagaaaugggcuggcucg

SEQ ID NO: 36386 - RNA, 17 nt, Homo sapiens
ugaguggaggccagugg

SEQ ID NO: 36387 - RNA, 20 nt, Homo sapiens
ugccuggacaugcuuggugc

SEQ ID NO: 36388 - RNA, 19 nt, Homo sapiens
uuaaucuguaauauuaauc

SEQ ID NO: 36389 - RNA, 21 nt, Homo sapiens
cccuggccugcccccuucgcc

SEQ ID NO: 36390 - RNA, 20 nt, Homo sapiens
ccuucgccucccacucucgc

SEQ ID NO: 36391 - RNA, 18 nt, Homo sapiens
cuccugcgccucucccug

SEQ ID NO: 36392 - RNA, 18 nt, Homo sapiens
gccgagacuacacccgcc

SEQ ID NO: 36393 - RNA, 19 nt, Homo sapiens
uuuugcacauuuauccaga

SEQ ID NO: 36394 - RNA, 16 nt, Homo sapiens
agaaaagagagagaga

SEQ ID NO: 36395 - RNA, 18 nt, Homo sapiens
aguugguuagagaagguu

SEQ ID NO: 36396 - RNA, 20 nt, Homo sapiens
gaaaagaugauuagacaagu

SEQ ID NO: 36397 - RNA, 21 nt, Homo sapiens
gagagagagagagagaaagag

SEQ ID NO: 36398 - RNA, 20 nt, Homo sapiens
gggaacuuucugcagauuuc

SEQ ID NO: 36399 - RNA, 15 nt, Homo sapiens
guaggcuagcacacc

SEQ ID NO: 36400 - RNA, 14 nt, Homo sapiens
uccaaccucucacu

SEQ ID NO: 36401 - RNA, 18 nt, Homo sapiens
uugguuagagaagguugu

SEQ ID NO: 36402 - RNA, 20 nt, Homo sapiens
uuguauucauauuucucuuu

SEQ ID NO: 36403 - RNA, 18 nt, Homo sapiens
agaauuucaaagcauucu

SEQ ID NO: 36404 - RNA, 17 nt, Homo sapiens
uuguauucauauuucuc

SEQ ID NO: 36405 - RNA, 21 nt, Homo sapiens
aaaauucuagaggagaaaaag

SEQ ID NO: 36406 - RNA, 17 nt, Homo sapiens
agggguuggauauucca

SEQ ID NO: 36407 - RNA, 18 nt, Homo sapiens
gcaaaucugaagaagaga

SEQ ID NO: 36408 - RNA, 21 nt, Homo sapiens
uccaugggaaggugaagggag

SEQ ID NO: 36409 - RNA, 18 nt, Homo sapiens
ucucccacagucucacag

SEQ ID NO: 36410 - RNA, 21 nt, Homo sapiens
ugcugaguuuagaaccagugu

SEQ ID NO: 36411 - RNA, 17 nt, Homo sapiens
uggcagagagaagaaaa

SEQ ID NO: 36412 - RNA, 18 nt, Homo sapiens
acguaucuaugaugagaa

SEQ ID NO: 36413 - RNA, 18 nt, Homo sapiens
agaggaaaggaugacacc

SEQ ID NO: 36414 - RNA, 16 nt, Homo sapiens
ccuuaacaucagcggc

SEQ ID NO: 36415 - RNA, 18 nt, Homo sapiens
gauuucuguaaaguucuu

SEQ ID NO: 36416 - RNA, 21 nt, Homo sapiens
ucacguacuuacuguacaaua

SEQ ID NO: 36417 - RNA, 17 nt, Homo sapiens
ucagaagcaaccaaucu

SEQ ID NO: 36418 - RNA, 19 nt, Homo sapiens
ucugcagucagcacugagc

SEQ ID NO: 36419 - RNA, 21 nt, Homo sapiens
ugcagucagcacugagcagca

SEQ ID NO: 36420 - RNA, 19 nt, Homo sapiens
uucacguuuuagcaaaccu

SEQ ID NO: 36421 - RNA, 18 nt, Homo sapiens
uucuguaaaguucuuugc

SEQ ID NO: 36422 - RNA, 19 nt, Homo sapiens
aaggggaagaggccuggau

SEQ ID NO: 36423 - RNA, 19 nt, Homo sapiens
aguacauuuuuguugaauc

SEQ ID NO: 36424 - RNA, 14 nt, Homo sapiens
cgcccggcggccgg

SEQ ID NO: 36425 - RNA, 17 nt, Homo sapiens
aaggaaaaugacucucc

SEQ ID NO: 36426 - RNA, 18 nt, Homo sapiens
acuuuuuuuuuccuucuc

SEQ ID NO: 36427 - RNA, 14 nt, Homo sapiens
agcaggagacuuuu

SEQ ID NO: 36428 - RNA, 21 nt, Homo sapiens
ccuggccuugucucccacacc

SEQ ID NO: 36429 - RNA, 21 nt, Homo sapiens
gcggcagcuuuggcagcggcg

SEQ ID NO: 36430 - RNA, 23 nt, Homo sapiens
ggcaggcugcagcuucucuggag

SEQ ID NO: 36431 - RNA, 18 nt, Homo sapiens
guggggcacagccugggg

SEQ ID NO: 36432 - RNA, 20 nt, Homo sapiens
uggugugagguuccaguuug

SEQ ID NO: 36433 - RNA, 17 nt, Homo sapiens
uuggcagaaucuguggu

SEQ ID NO: 36434 - RNA, 23 nt, Homo sapiens
agcacacgaaugugugugugcca

SEQ ID NO: 36435 - RNA, 19 nt, Homo sapiens
cagcaugguuuccuagacu

SEQ ID NO: 36436 - RNA, 18 nt, Homo sapiens
aagggucccggcagcgag

SEQ ID NO: 36437 - RNA, 17 nt, Homo sapiens
accguggcggcgugugc

SEQ ID NO: 36438 - RNA, 17 nt, Homo sapiens
agggcuggggauacggg

SEQ ID NO: 36439 - RNA, 24 nt, Homo sapiens
agggggcugagccccgcaggaaaa

SEQ ID NO: 36440 - RNA, 18 nt, Homo sapiens
cacggggcuggggagagc

SEQ ID NO: 36441 - RNA, 16 nt, Homo sapiens
cacguguucuugcggg

SEQ ID NO: 36442 - RNA, 19 nt, Homo sapiens
cacuuuuucugggcaaccg

SEQ ID NO: 36443 - RNA, 22 nt, Homo sapiens
cccgagcucggggccugccucc

SEQ ID NO: 36444 - RNA, 22 nt, Homo sapiens
gcagugaaagggucccggcagc

SEQ ID NO: 36445 - RNA, 16 nt, Homo sapiens
ggacgccaugcacgug

SEQ ID NO: 36446 - RNA, 19 nt, Homo sapiens
ggagguggggccagaggug

SEQ ID NO: 36447 - RNA, 23 nt, Homo sapiens
gggccuggcuggcuggggcuggg

SEQ ID NO: 36448 - RNA, 18 nt, Homo sapiens
ucauccucuauucacucc

SEQ ID NO: 36449 - RNA, 20 nt, Homo sapiens
ugcgggccgggaggcggagc

SEQ ID NO: 36450 - RNA, 15 nt, Homo sapiens
uggggucccgggggc

SEQ ID NO: 36451 - RNA, 22 nt, Homo sapiens
aaaugccucuuaccaagaggcu

SEQ ID NO: 36452 - RNA, 24 nt, Homo sapiens
acucggggcggcggcgacuccuca

SEQ ID NO: 36453 - RNA, 23 nt, Homo sapiens
cagggucucccuauguugcccag

SEQ ID NO: 36454 - RNA, 17 nt, Homo sapiens
cucccagagugcuagga

SEQ ID NO: 36455 - RNA, 20 nt, Homo sapiens
gcaugguaccgggacucggg

SEQ ID NO: 36456 - RNA, 18 nt, Homo sapiens
uaggaaaaucuuguauau

SEQ ID NO: 36457 - RNA, 19 nt, Homo sapiens
ugcaaauaaguucuugccc

SEQ ID NO: 36458 - RNA, 21 nt, Homo sapiens
uuacacucagauaacucucua

SEQ ID NO: 36459 - RNA, 19 nt, Homo sapiens
agaaggaaaagaagagguc

SEQ ID NO: 36460 - RNA, 26 nt, Homo sapiens
caggagacagggugaggccucgcuga

SEQ ID NO: 36461 - RNA, 21 nt, Homo sapiens
gcacaaucugggcuugaaggg

SEQ ID NO: 36462 - RNA, 20 nt, Homo sapiens
ggacaggagagagcggagau

SEQ ID NO: 36463 - RNA, 21 nt, Homo sapiens
ugagagauuccagccagcucc

SEQ ID NO: 36464 - RNA, 16 nt, Homo sapiens
agaaaagagagagaga

SEQ ID NO: 36465 - RNA, 18 nt, Homo sapiens
agaauuucaaagcauucu

SEQ ID NO: 36466 - RNA, 18 nt, Homo sapiens
aguugguuagagaagguu

SEQ ID NO: 36467 - RNA, 21 nt, Homo sapiens
cccaaacuauauuuuuacaaa

SEQ ID NO: 36468 - RNA, 21 nt, Homo sapiens
gagagagagagagagaaagag

SEQ ID NO: 36469 - RNA, 14 nt, Homo sapiens
uccaaccucucacu

SEQ ID NO: 36470 - RNA, 18 nt, Homo sapiens
uugguuagagaagguugu

SEQ ID NO: 36471 - RNA, 17 nt, Homo sapiens
uuguauucauauuucuc

SEQ ID NO: 36472 - RNA, 20 nt, Homo sapiens
uuguauucauauuucucuuu

SEQ ID NO: 36473 - RNA, 16 nt, Homo sapiens
agaaaagagagagaga

SEQ ID NO: 36474 - RNA, 18 nt, Homo sapiens
aguugguuagagaagguu

SEQ ID NO: 36475 - RNA, 21 nt, Homo sapiens
gagagagagagagagaaagag

SEQ ID NO: 36476 - RNA, 20 nt, Homo sapiens
gggaacuuucugcagauuuc

SEQ ID NO: 36477 - RNA, 15 nt, Homo sapiens
guaggcuagcacacc

SEQ ID NO: 36478 - RNA, 14 nt, Homo sapiens
uccaaccucucacu

SEQ ID NO: 36479 - RNA, 20 nt, Homo sapiens
uuguauucauauuucucuuu

SEQ ID NO: 36480 - RNA, 19 nt, Homo sapiens
auggagggacaggacccac

SEQ ID NO: 36481 - RNA, 18 nt, Homo sapiens
cccacccaacccuggccc

SEQ ID NO: 36482 - RNA, 24 nt, Homo sapiens
ccccacaguuucaccuuacgaagu

SEQ ID NO: 36483 - RNA, 20 nt, Homo sapiens
cccucuggggucuuggggua

SEQ ID NO: 36484 - RNA, 22 nt, Homo sapiens
gccuccuaguucuucaucagcu

SEQ ID NO: 36485 - RNA, 21 nt, Homo sapiens
gccugcuuucuccuccuuccc

SEQ ID NO: 36486 - RNA, 16 nt, Homo sapiens
agaaaagagagagaga

SEQ ID NO: 36487 - RNA, 18 nt, Homo sapiens
agaauuucaaagcauucu

SEQ ID NO: 36488 - RNA, 18 nt, Homo sapiens
aguugguuagagaagguu

SEQ ID NO: 36489 - RNA, 20 nt, Homo sapiens
gggaacuuucugcagauuuc

SEQ ID NO: 36490 - RNA, 15 nt, Homo sapiens
guaggcuagcacacc

SEQ ID NO: 36491 - RNA, 14 nt, Homo sapiens
uccaaccucucacu

SEQ ID NO: 36492 - RNA, 18 nt, Homo sapiens
uugguuagagaagguugu

SEQ ID NO: 36493 - RNA, 17 nt, Homo sapiens
uuguauucauauuucuc

SEQ ID NO: 36494 - RNA, 20 nt, Homo sapiens
uuguauucauauuucucuuu

SEQ ID NO: 36495 - RNA, 16 nt, Homo sapiens
agaaaagagagagaga

SEQ ID NO: 36496 - RNA, 18 nt, Homo sapiens
agaauuucaaagcauucu

SEQ ID NO: 36497 - RNA, 21 nt, Homo sapiens
gagagagagagagagaaagag

SEQ ID NO: 36498 - RNA, 20 nt, Homo sapiens
gggaacuuucugcagauuuc

SEQ ID NO: 36499 - RNA, 15 nt, Homo sapiens
guaggcuagcacacc

SEQ ID NO: 36500 - RNA, 14 nt, Homo sapiens
uccaaccucucacu

SEQ ID NO: 36501 - RNA, 18 nt, Homo sapiens
uugguuagagaagguugu

SEQ ID NO: 36502 - RNA, 17 nt, Homo sapiens
uuguauucauauuucuc

SEQ ID NO: 36503 - RNA, 20 nt, Homo sapiens
uuguauucauauuucucuuu

SEQ ID NO: 36504 - RNA, 17 nt, Homo sapiens
guggacacaaaucuagc

SEQ ID NO: 36505 - RNA, 20 nt, Homo sapiens
uacaugcucuucccuuccug

SEQ ID NO: 36506 - RNA, 22 nt, Homo sapiens
uauauauauauuuauaucuaua

SEQ ID NO: 36507 - RNA, 19 nt, Homo sapiens
uugaaucuuucuucccauu

SEQ ID NO: 36508 - RNA, 16 nt, Homo sapiens
agaaaagagagagaga

SEQ ID NO: 36509 - RNA, 18 nt, Homo sapiens
agaauuucaaagcauucu

SEQ ID NO: 36510 - RNA, 18 nt, Homo sapiens
aguugguuagagaagguu

SEQ ID NO: 36511 - RNA, 21 nt, Homo sapiens
gagagagagagagagaaagag

SEQ ID NO: 36512 - RNA, 20 nt, Homo sapiens
gggaacuuucugcagauuuc

SEQ ID NO: 36513 - RNA, 15 nt, Homo sapiens
guaggcuagcacacc

SEQ ID NO: 36514 - RNA, 17 nt, Homo sapiens
uuguauucauauuucuc

SEQ ID NO: 36515 - RNA, 20 nt, Homo sapiens
uuguauucauauuucucuuu

SEQ ID NO: 36516 - RNA, 16 nt, Homo sapiens
agaaaagagagagaga

SEQ ID NO: 36517 - RNA, 18 nt, Homo sapiens
agaauuucaaagcauucu

SEQ ID NO: 36518 - RNA, 18 nt, Homo sapiens
aguugguuagagaagguu

SEQ ID NO: 36519 - RNA, 21 nt, Homo sapiens
gagagagagagagagaaagag

SEQ ID NO: 36520 - RNA, 20 nt, Homo sapiens
gggaacuuucugcagauuuc

SEQ ID NO: 36521 - RNA, 15 nt, Homo sapiens
guaggcuagcacacc

SEQ ID NO: 36522 - RNA, 14 nt, Homo sapiens
uccaaccucucacu

SEQ ID NO: 36523 - RNA, 18 nt, Homo sapiens
uugguuagagaagguugu

SEQ ID NO: 36524 - RNA, 17 nt, Homo sapiens
uuguauucauauuucuc

SEQ ID NO: 36525 - RNA, 20 nt, Homo sapiens
uuguauucauauuucucuuu

SEQ ID NO: 36526 - RNA, 16 nt, Homo sapiens
agaaaagagagagaga

SEQ ID NO: 36527 - RNA, 18 nt, Homo sapiens
agaauuucaaagcauucu

SEQ ID NO: 36528 - RNA, 18 nt, Homo sapiens
aguugguuagagaagguu

SEQ ID NO: 36529 - RNA, 20 nt, Homo sapiens
gggaacuuucugcagauuuc

SEQ ID NO: 36530 - RNA, 15 nt, Homo sapiens
guaggcuagcacacc

SEQ ID NO: 36531 - RNA, 18 nt, Homo sapiens
uugguuagagaagguugu

SEQ ID NO: 36532 - RNA, 17 nt, Homo sapiens
uuguauucauauuucuc

SEQ ID NO: 36533 - RNA, 20 nt, Homo sapiens
uuguauucauauuucucuuu

SEQ ID NO: 36534 - RNA, 20 nt, Homo sapiens
aauuuauuacuaagguguuc

SEQ ID NO: 36535 - RNA, 20 nt, Homo sapiens
acuggcauuuucauaguuau

SEQ ID NO: 36536 - RNA, 16 nt, Homo sapiens
agaaaagagagagaga

SEQ ID NO: 36537 - RNA, 18 nt, Homo sapiens
agaauuucaaagcauucu

(The sequence listing continues in the following parts.)

The invention claimed is:

1. An isolated nucleic acid selected from the group consisting of:
   (a) SEQ ID NO: 2194;
   (b) a DNA encoding the sequence of (a), wherein the DNA is identical in length to the sequence of (a); and
   (c) the complement of (a) or (b), wherein the complement is identical in length to (a) or (b).

2. An isolated nucleic acid selected from the group consisting of:
   (a) SEQ ID NO: 5264;
   (b) a DNA encoding the sequence of (a), wherein the DNA is identical in length to the sequence of (a); and
   (c) the complement of (a) or (b), wherein the complement is identical in length to (a) or (b).

3. A vector comprising a heterologous sequence, wherein the heterologous sequence consists of the sequence of the nucleic acid of claim 1.

4. A vector comprising a heterologous sequence, wherein the heterologous sequence consists of the sequence of the nucleic acid of claims 2.

5. A probe comprising a heterologous sequence, wherein the heterologous sequence consists of the sequence of the nucleic acid of claim 1.

6. A probe comprising a heterologous sequence, wherein the heterologous sequence consists of the sequence of the nucleic acid of claim 2.

* * * * *